United States Patent 11,098,302 (IDENTIFICATION OF POLYNUCLEOTIDES ASSOCIATED WITH A SAMPLE) - sequence listing, part 80

SEQ ID NO: 275340 - DNA, 527 bp, Homo sapiens
  misc_feature: GYAE6OF02HS9CM.9.50.E06.1.454.CMB.1.raw
  modified_base (205)..(205): a, c, t, g, unknown or other
  misc_feature (205)..(205): n is a, c, g, or t
  modified_base (312)..(312): a, c, t, g, unknown or other
  misc_feature (312)..(312): n is a, c, g, or t
tcagtgatacgtctcacgaccggtgctcgatttagatctactgacaacacacaagggggaggaactgctcagttagggacccagagggaaccatggaagccccagctcagcttctcttcctcctgctactctggctcccagattccaccggagaagttgtgttgacacagtctccagccaccctgtctttgtctccaggggaaangccacctctcctgcagggccagtcagagtcttaggagctccttagcctggtatcaaacagaaacctggccaggctcccaggctcctcatctatgatgcatccaaacncgggccactggcatcccagccaggttcagtgcaggtgggtctgggacagtacttcactctcaccatcagacagactaagacgcctagaagtattttgacttaagttttattacttgtacagcagtcgtagacaacgtcggcctcggacgttcgaccgaagggaccaagtcggaacatacgaagacgtaacgtgtcggactcgacacctatctacg

SEQ ID NO: 275341 - DNA, 768 bp, Homo sapiens
  misc_feature: GYAE6OF02JGROT.9.50.E06.1.454.CMB.1.raw
  modified_base (204)..(204): a, c, t, g, unknown or other
  misc_feature (204)..(204): n is a, c, g, or t
  modified_base (243)..(243): a, c, t, g, unknown or other
  misc_feature (243)..(243): n is a, c, g, or t
tcagtgatacgtctcacgaccggtgctcgatttagatctactgacaacacacaagggggaggaacgtgctcagttaggacccagagggaaccatggaagcccagctcagcttctcttcctcctgctactctggctcccagattccaccggagaagttgtgttgacacagtctccagccaccctgtctttgtctccaggggaaanagccaccctctcctgcagggccagtccagagtcttaggngctcttagcctggtactcgaacagaaacctggaccaggcctcccgaggtcctctcatctatgatgcatccaagcggccaacgtggacactcctagctacggttcagtcggaccaggttcggggtactaggggacaaggtacctttccgacgtcccttccaacctagttaccgacgtaccgaacggtaaccgttaaggaacgtacccggtaaggtaaaacggtttacgtttttaaccggacgtttaaacggtttttaacgttttaaacccgttgggttaacccgtaacgtaccggtacggtaccggttaacggtaaccctaacgggttaccgggcccggttaacgggtaccgggttttaaccggacccgggtttaaaccgggggaacccggtaaaacgggttccgggtaaccgggttaaaccgtttacggaaaaacccggttccgggtaaaacccggtttacgggtaaccgggttaccgttaccgggttacccgaaaacccggtttcgttacccggttttaaccgg

SEQ ID NO: 275342 - DNA, 582 bp, Homo sapiens
  misc_feature: GYAE6OF02HV0ST.9.50.E06.1.454.CMB.1.raw
  modified_base (218)..(218): a, c, t, g, unknown or other
  misc_feature (218)..(218): n is a, c, g, or t
  modified_base (230)..(230): a, c, t, g, unknown or other
  misc_feature (230)..(230): n is a, c, g, or t
  modified_base (240)..(240): a, c, t, g, unknown or other
  misc_feature (240)..(240): n is a, c, g, or t
  modified_base (379)..(379): a, c, t, g, unknown or other
  misc_feature (379)..(379): n is a, c, g, or t
  modified_base (403)..(403): a, c, t, g, unknown or other
  misc_feature (403)..(403): n is a, c, g, or t
  modified_base (413)..(413): a, c, t, g, unknown or other
  misc_feature (413)..(413): n is a, c, g, or t
  modified_base (459)..(459): a, c, t, g, unknown or other
  misc_feature (459)..(459): n is a, c, g, or t
  modified_base (484)..(484): a, c, t, g, unknown or other
  misc_feature (484)..(484): n is a, c, g, or t
  modified_base (489)..(489): a, c, t, g, unknown or other
  misc_feature (489)..(489): n is a, c, g, or t
  modified_base (517)..(517): a, c, t, g, unknown or other
  misc_feature (517)..(517): n is a, c, g, or t
  modified_base (574)..(574): a, c, t, g, unknown or other
  misc_feature (574)..(574): n is a, c, g, or t
tcagtgatacgtctcacgaccggtgctcgatttagatctactgacaacacacaaggggaggaactgctcagttaggacccagagggaaccatggaagcccagctcagcttctcttcctcctgctactctggctcccagacttccaccggagaagttgtgttgaccacagttctccagccaccctgtcctttagctccaggggaaacgccacctctccngcaggccagtcngatcttaagngctccttagccctggtatcaaacagtaaaacccgtggaccaaggcctacccaggcctcctcactctaactgatgcatccgaaacagggaccacgcggaccatccccagcctaaggttccaggtggcctagtcgggtacngggaactaggtaacttcgaacttnaccaaccctntacagcaacgactagcgtcagtaagtattttcgacttaagttttanaactgtactagccagtccgtaacgnaacgngtccccgtggaccgttgaaccagggaanaaaccggtgaacgaagtacaacggaacaacgaggttaccgagtccgtggaaccctancgttaccg

SEQ ID NO: 275343 - DNA, 533 bp, Homo sapiens
  misc_feature: GYAE6OF02GFQ88.9.50.E06.1.454.CMB.1.raw
  modified_base (204)..(204): a, c, t, g, unknown or other
  misc_feature (204)..(204): n is a, c, g, or t
  modified_base (368)..(368): a, c, t, g, unknown or other
  misc_feature (368)..(368): n is a, c, g, or t
tcagtgatacgtctcacgaccggtgctcgatttagatctactgacaacacacaagggggaggaactgctcagttaggacccagagggaaccatggaagccccagctcagcttctcttcctcctgctactctggctcccagattccaccggagaagttgtgttgacacagtctccagccaccctgtctttgtctccaggggaaanagccaccctctcctgcagggccagtcagagtcttaggagctccttagcctggtatcaacagaaacctggccaggctcccaggctcctcatctatgatgcatccaacagggcccacgtggcactcccagccaggttcagtggcagtgggtctggggacagacttnactctcaccatcagcagactagacgcctagaagtattttgcttagtttattactgtcagcagtcgtagctaacgtcggcctcggtacgttccggaccgaacgggaccaaggtggaacgacgtacgaagaccgaacgtggtacggtctcggaccaccgtatcgtcg

SEQ ID NO: 275344 - DNA, 608 bp, Homo sapiens
  misc_feature: GYAE6OF02HYGV0.9.50.E06.1.454.CMB.1.raw
  modified_base (206)..(206): a, c, t, g, unknown or other
  misc_feature (206)..(206): n is a, c, g, or t
  modified_base (237)..(237): a, c, t, g, unknown or other
  misc_feature (237)..(237): n is a, c, g, or t
tcagtgatacgtctcacgaccggtgctcgatttagatctactgacaacacacaagggggaggaactgctcagttaggacccagagggaaccatggaagccccagctcagcttctcttcctcctgctactctggctcccagattccaccggagaagttgtgttgacacagtctccagcccaccctgtctttgtctccgaggggaaanacgccaccctctcctgcagggccaggtcagngtcttaggagctccttagcctggtatcaacagaaacctggccaggcctcccgaggcctcctctatctatgatgctataccaacgacgggccacgtcggctaactccccgagcccgtaggttccaagggtggaccgtaggtcgggtacgtggggaacagtacttcactcgtacaccatcagcagactagagcctagaagtatttgacttagtttacttacgtgtacgagacgtaggtacgtacgaccgtaacgtcgtaccggttcggtaaccggttaccggaacccggaaagggaaccgtaagggtcggaacgacttaaccgaacgtacgtaacgtgggtacggaccgtacgtaccgaactcgtacgttacg

SEQ ID NO: 275345 - DNA, 549 bp, Homo sapiens
  misc_feature: GYAE6OF02H2K0T.9.50.E06.1.454.CMB.1.raw
  modified_base (207)..(207): a, c, t, g, unknown or other
  misc_feature (207)..(207): n is a, c, g, or t
  modified_base (235)..(235): a, c, t, g, unknown or other
  misc_feature (235)..(235): n is a, c, g, or t
  modified_base (316)..(316): a, c, t, g, unknown or other
  misc_feature (316)..(316): n is a, c, g, or t
  modified_base (502)..(502): a, c, t, g, unknown or other
  misc_feature (502)..(502): n is a, c, g, or t
tcagtgatacgtctcacgaccggtgctcgatttagatctactgacaacacacaaggggggaggaactgctcagttaggacccagagggaaccatggaagccccagctcagcttctcttcctcctgctactctggctcccagattcccaccggagaagttgtgttgacacagtctccagcccaccctgtctttgtctccaggggaaangccaccctctcctgcagggccagtcagngtcttaggagctccttagccttggtatcaacagaaacctggaccaggctcccaggctcctcatctatgatgcatccaacgngggccatcggacactaccccagcctaggttcagtggacaggtcgggtactcgggactagactttcacgtctcaccatcagcagactagacgctagaatgtttgactagtttattactgtacagtacagtcgtagactacgtcggccgtaccggacgttcggaccgaagggaaccaaggtcggaacngtacgaacgacgtaacgtggtacggctagaccgacgtactcgttacg

SEQ ID NO: 275346 - DNA, 681 bp, Homo sapiens
  misc_feature: GYAE6OF02J252Q.9.50.E06.1.454.CMB.1.raw
  modified_base (141)..(141): a, c, t, g, unknown or other
  misc_feature (141)..(141): n is a, c, g, or t
  modified_base (205)..(205): a, c, t, g, unknown or other
  misc_feature (205)..(205): n is a, c, g, or t
  modified_base (218)..(218): a, c, t, g, unknown or other
  misc_feature (218)..(218): n is a, c, g, or t
tcagtgatacgtctcacgaccggtgctcgatttagatctactgacaacacacaagggggaggaactgctcagttaggacccagagggaaccatggaagccccagctcagcttctcttcctcctgctactctggctcccagnttccaccggagaagttgtgttgacacagtctccagcccacctgtctttgtctccgaggggaaancgccacctctccngcagggccagtcagtagtcttaggagtcctctagcctggtactacaacagaaccgtggaccaggcctccccgaggtcctccctctactctatgactcgacctacgtacccgaacgcgggtacccacgtcggaccctactccccgagcccgtaggtccaggtcggacgtgggtcgggtacgtcggggaacctacgtaccgttaccaccgttcgtaaccaccgtatacgacgactaaggtaaccgtacgtacgacctaaggtaacgttagtttcgtacttagttttacttcgttacggtactagaccgtagtacgtacgtaccgtaacggtccggtaccgttacgggtaccggttaccggaaccggtaacggtaaccgaggtacggaacctacggtaccgaacggtacccgttaaggtccgtaggtacccgtacggtaccctaaccgttacgtcccgtttaccgg

SEQ ID NO: 275347 - DNA, 671 bp, Homo sapiens
  misc_feature: GYAE6OF02JM5BU.9.50.E06.1.454.CMB.1.raw
  modified_base (205)..(205): a, c, t, g, unknown or other
  misc_feature (205)..(205): n is a, c, g, or t
tcagtgatacgtctcacgaccggtgctcgatttagatctactgacaacacacaagggggaggaactgctcagttaggacccagagggaaccatggaagccccagctcagcttctcttcctcctgctactctggctcccagattccaccggagaagttgtgttgacacagtctccagccaccctgtctttgtctccgaggggaaancgccaccctctcctgcagggccagtcagtagtcttaggacgtctccttagcctggtatcaacagaacctggaccaggcctaccgaggcctcctcactctatgatcgactactacccaacgacgggcccacgtggaccacgtccccgagtccgtaggttcaggtcggctagggttcggtacgtacgggaactaggtacctttaccaccttccgtaccaaccctataccgacgtacgaacgtaacgtacggtacgtaccgttaaggtaacgttagttttcggaacgtttaacgtttttaacttaccgttacgtacgtaacgcgtaacggtcgttaacgaccgtaacgtccggtaccgttacgggtaccggttaccggaaccgtaacgggtaaccgtacgtacggaacgtacggtaacgaacgtaccggtacgtaggtacggtcgtaccgactactacgtccgttacgg

SEQ ID NO: 275348 - DNA, 630 bp, Homo sapiens
  misc_feature: GYAE6OF02IVRZ1.9.50.E06.1.454.CMB.1.raw
tcagtgatacgtctcacgaccggtgctcgatttagatctactgacaacacacaagggggaggaactgctcagttaggacccagagggaaccatggaagccccagctcagcttctcttcctcctgctactctggctcccagattccaccggagaagttgtgttgacacagtctccagccaccctgtctttgtctccgaggggaagacgcccaccctctcctgcagggccagtcagagtcttaggagcctccttagcctggtatacaacagaaacctggaccacggcctaccccgaggcctcctacatctatgatgcactccaacgacgggcctacgtcggccactcccgagccgtaggttcagtcgcgtaggtcgggtacgagggacagtaccttcgactcgtaccacctatacgagacagacgtagacgaccgtagtaacgtattttgacttaagttttacttacgtgttacagtcgtacgtacgtacgtacctaacgtcggtacccgttacgggtaccggttaccggaaccgtaacgggaaccgtaacggtacggaacgtaacggtaccgaacggtaccgtaacgttcggtacggtcgtaccgtaccgaaccgttacgtaccgttaccg

SEQ ID NO: 275349 - DNA, 770 bp, Homo sapiens
  misc_feature: GYAE6OF02H4XSY.9.50.E06.1.454.CMB.1.raw
  modified_base (205)..(205): a, c, t, g, unknown or other
  misc_feature (205)..(205): n is a, c, g, or t
tcagtgatacgtctcacgaccggtgctcgatttagatctactgacaacacacaagggggaggaactgctcagttaggacccagagggaaccatggaagccccagctcagcttctcttcctcctgctactctggctcccagattccaccggagaagttgtgttgacacagtctccagccaccctgtctttgtctccgaggggaaancgccacctctcctgcagggccagtcagagtcttaggagctccttagcctggtatcaacagaaacctggccaggcctccgaggtcctcctcatctatgatcgacactaccaaacgacgggaccctacgtcggactaaccgtccccaacggtacccgtaggtttccgaacggttcggacgtagggttcggggttcgtacggggactaacggtacctttaccacgttacctaccgaacctacgtaccaacgaccaacgtaacgtacggacgtacccgtaggtaaacgtttgttttacggtaccgttaagttttttaacgttaccgttacggttaccgtaacggtaccgtaacggtaccggttaacggtaacccgtaaccgtttccgggacccgttttaccgggggttaaccggtttacccggggaaacccgggtaaaccgggggttaaacccggtaaacggggtttaccgggaaacgtaaaccggtaccgaaaacggggtcccgttaaacggttcggggttaacgtacggttacgggtacccaacccggtttacctccgtttaaccgg

SEQ ID NO: 275350 - DNA, 583 bp, Homo sapiens
  misc_feature: GYAE6OF02ISQ9W.9.50.E06.1.454.CMB.1.raw
  modified_base (206)..(206): a, c, t, g, unknown or other
  misc_feature (206)..(206): n is a, c, g, or t
  modified_base (247)..(247): a, c, t, g, unknown or other
  misc_feature (247)..(247): n is a, c, g, or t
  modified_base (316)..(316): a, c, t, g, unknown or other
  misc_feature (316)..(316): n is a, c, g, or t
  modified_base (465)..(465): a, c, t, g, unknown or other
  misc_feature (465)..(465): n is a, c, g, or t
tcagtgatacgtctcacgaccggtgctcgatttagatctactgacaacacacaagggggaggaactgctcagttaggacccagagggaaccatggaagccccagctcagcttctcttcctcctgctactctggcctcccagattcccaccggagaagttgtgtgacacagtctccagccaccctgtctttgtctccgaggggaaanacgcccaccctctcctgcacgggccagtcagagtcttaggngcctcctagcctgtatcaacagaacctggccaggctcccgaggcctcctcatctatgatgcatccaacncgggccacgtcggcactcccagccgagttcaggtgcgtaggtggtcgtggacagtactcacgtctacaccatacgacgacaacgactagacgccgtagtaagtagtttgacgttagttttacttacgttgtacagtacgtagacggtanacgtacgtcggtccgtccgggtaaccgttcggaaccgtaacgggaaccgaacggtggaacctacgtaacgaacggtacgaacgttggtacggtctacggaccaacctacgtcgttacg

SEQ ID NO: 275351 - DNA, 553 bp, Homo sapiens
  misc_feature: GYAE6OF02F6H02.9.50.E06.1.454.CMB.1.raw
  modified_base (205)..(205): a, c, t, g, unknown or other
  misc_feature (205)..(205): n is a, c, g, or t
tcagtgatacgtctcacgaccggtgctcgatttagatctactgacaacacacaagggggaggaactgctcagttaggacccagagggaaccatggaagccccagctcagcttctcttcctcctgctactctggctcccagattccaccggagaagttgtgttgacacagtctccagcccaccctgtctttgtctccaggggaaanagccaccctctcctgcagggccagtcagagtcttaggagctccttagcctggtatcaacagaaacctggccaggctccgaggctcctcatctatgatgcatccaacgacgggccacgtggcactcccgagccgaggttcagtggcaggtgggtctggggacagacttcactctaccacatcagcagactagacgctagtaagtatttgcttagtttattactgtcagctagcgtagactacgtcggcctacgggtaccgtcggaccgaacgggtaccaaggtcggaacgtacgtaacgaacggtaccggaacgtacggtcggtactacggacctacctagtcttacgg

SEQ ID NO: 275352 - DNA, 718 bp, Homo sapiens
  misc_feature: GYAE6OF02GF39D.9.50.E06.1.454.CMB.1.raw
  modified_base (205)..(205): a, c, t, g, unknown or other
  misc_feature (205)..(205): n is a, c, g, or t
tcagtgatacgtctcacgaccggtgctcgatttagatctactgacaacacacaagggggaggaactgctcagttaggacccaagagggaaccatggaagccccagctcagcttctcttcctcctgctactctggctcccagattccaccggagaagttgtgttgacacagtctccagccaccctgtctttgtctccaggggaaangccaccctctcctgcagggccagtcagagtcttaggacgcctccttagcctggtatcgaacagaactggccaggctcccaggctcctcgatctatgatgcataccaaacgagggccacgtggacacgtaccccagccctaggttccaaggtcgctaggtcgggtcgtgggacacgactttcgaccttctacaaccgtctacaacgccgaagtaacgtaaggacgtaccgtagtaaaggtactttttacgaccgttaaggttttaacttaacgttacggttacgaaacgtccgtaaggtaccggttaagaccgtaaccgtttacgggaccccggtttaccggggtaacccgggtttccgggtaaacccggtaaaccgggggttaaccccgtaaaaggggttaaccgggaaacccgttaaacgtacccggttaaaaacgggccggtaaaaccggttacgggtacgggttacccgtaccggtaaccctaacccgttaacggttacctttaacccgg

SEQ ID NO: 275353 - DNA, 645 bp, Homo sapiens
  misc_feature: GYAE6OF02HYCE9.9.50.E06.1.454.CMB.1.raw
  modified_base (201)..(201): a, c, t, g, unknown or other
  misc_feature (201)..(201): n is a, c, g, or t
tcagtgatacgtctcacgaccggtgctcgatttagatctactgacaacacacaagggggaggaactgctcagttaggacccagagggaaccatggaagccccagctcagcttctcttcctcctgctactctggctcccagattccaccggagaagttgtgttgacacagtctccagccacctgtctttgctccaggggaangccacctctcctgcagggccagtcagagtcttaggagctccttagcctggtatcaacagaaacctggccaggctcccaggctcctacatctatgatgcactaccaacgcggccacgtcggacacgtcccagtccgtacggttcaggtggaccgtagggttcgggtcgtacggggaacctacggtacctttacaccgttccgtaccaacccgtataccgacgtaccaacggtaacgtaacggacgtaccgtaaggaaacgttacgttttacgactttaagttttacttacgttgtacacgtactaggtacgtaggacctaacgtcgggacccttacgggtaccgttccggaaccgtaagggaaccgtaacggtacggaaccgtaactacggaacggaccgttaacgtggtacggtaccgtacgaccgtacctagttaccgttacg

SEQ ID NO: 275354 - DNA, 579 bp, Homo sapiens
  misc_feature: GYAE6OF02GC51E.9.50.E06.1.454.CMB.1.raw
  modified_base (204)..(204): a, c, t, g, unknown or other
  misc_feature (204)..(204): n is a, c, g, or t
  modified_base (242)..(242): a, c, t, g, unknown or other
  misc_feature (242)..(242): n is a, c, g, or t
  modified_base (352)..(352): a, c, t, g, unknown or other
  misc_feature (352)..(352): n is a, c, g, or t
  modified_base (370)..(370): a, c, t, g, unknown or other
  misc_feature (370)..(370): n is a, c, g, or t
  modified_base (374)..(374): a, c, t, g, unknown or other
  misc_feature (374)..(374): n is a, c, g, or t
tcagtgatacgtctcacgaccggtgctcgatttagatctactgacaacacacaagggggaggaactgctcagttaggacccagagggaaccatggaagccccagctcagcttctcttcctcctgctactctggctcccagattccaccggagaagttgtgttgacacagtctccagccaccctgtctttgtctccaggggaaangccaccctctcctgcagggccagtcagagtcttagganctccttagcctggtatcaacagaaacctggaccaggctcccaggctcctcatctatgatgcatccaacagggccacgtgcactcccagccagtcagtggcaggtgggtcngggacagtactcacgtcncacntcagcagactagacgctagaagtagttttcgacttagtttacttacgtgtacgagtctacgtcggtagtacgtaacgttcgggtacccgttacggggtaccgttaccgggaccgaacggggaacccgtaaggtacggaacgtaacgtacgaaacggtaccgtaacgtaggtacggtacgtacggaccacccgttactccgttacg

SEQ ID NO: 275355 - DNA, 611 bp, Homo sapiens
  misc_feature: GYAE6OF02JB047.9.50.E06.1.454.CMB.1.raw
  modified_base (202)..(202): a, c, t, g, unknown or other
  misc_feature (202)..(202): n is a, c, g, or t
  modified_base (397)..(397): a, c, t, g, unknown or other
  misc_feature (397)..(397): n is a, c, g, or t
tcagtgatacgtctcacgaccggtgctcgatttagatctactgacaacacacaagggggaggaactgctcagttaggacccagagggaaccatggaagccccagctcagcttctcttcctcctgctactctggctcccagattccaccggagaagttgtgttgacacagtctccagccaccctgtctttgtctcgagggaangccacctctcctgcagggccagtcagagtcttaggacgcttcgttagccttggtatcaacgacgaaaccgtggaccaggcctccgagtcctcctcatctatgatgcatccaagcggtccaacgtggcctaacgtcccgagtccgaggttcaggtcgcgtaggttcgggtcgtacggacaggtacgttcacgttcncgaccagtaccagtccagtcacgtcgaacgtaggtaagttcgtttgtacttagttttactacgtttggactagtcttaacgttaggtaacgtaaccgggccttaccgttaccgttaaccgtttcgggacggaacggtacgtagggtgaacgtaacgtaccgaaaggtcgttaggacgtcgtacggtcctaacgtctacgttcgtcctttaccgg

SEQ ID NO: 275356 - DNA, 671 bp, Homo sapiens
  misc_feature: GYAE6OF02H12TB.9.50.E06.1.454.CMB.1.raw
  modified_base (166)..(166): a, c, t, g, unknown or other
  misc_feature (166)..(166): n is a, c, g, or t
  modified_base (254)..(254): a, c, t, g, unknown or other
  misc_feature (254)..(254): n is a, c, g, or t
  modified_base (314)..(314): a, c, t, g, unknown or other
  misc_feature (314)..(314): n is a, c, g, or t
  modified_base (431)..(431): a, c, t, g, unknown or other
  misc_feature (431)..(431): n is a, c, g, or t
tcagtgatacgtctcacgaccggtgctcgatttagatctactgacaacacacaagggggaggaactgctcagttaggacccagagggaaccatggaagccccagctcagcttctcttcctcctgctactctggctcccagattccaccggagaagttgtgttgacncagtctccacgccaccctgttctttgtctccgaaggggaaagcgcccaccctctccgtgacgagggcctagtcaggagttcgtaaggntcctaccgttagcctggtatcaacaagaacctggactacggcctacccaggtcctcctanactctaagtgactgacactaccaaacgcggaccacgtcggacactacccgacgcgtaacggttcaggtgaccgaggtcgggtacgtagggacagtaccttcaactctacgaccctanacgacgacgaaacgtacgtaacgagtaccctaaggtaacctttagtttaccgaagtttaaccggtttttagtacgttacgtaacgacggtaccgtacggtaccggtacaacccgttcgaccgtaccggtaacggttcgggtacgaaccggaaccggttaacgtacggaacggttcaaacgttaccgaacgtaacgtacggttactagggtccctagaacccggaacttcgtaacgttccg

SEQ ID NO: 275357 - DNA, 798 bp, Homo sapiens
  misc_feature: GYAE6OF02G6JB3.9.50.E06.1.454.CMB.1.raw
  modified_base (204)..(204): a, c, t, g, unknown or other
  misc_feature (204)..(204): n is a, c, g, or t
tcagtgatacgtctcacgaccggtgctcgatttagatctactgacaacacacaagggggaggaactgctcagttaggacccagagggaaccatggaagccccagctcagcttctcttcctcctgctactctggctcccagattccaccggagaagttgtgttgacacagtctccagcccacctgtctttgtctccgaggggaangcccaccctctcctgcagggccagtcagacgtcgttaggacgtccttccttagcctaggtactacaacagaaacctggaccaggcctaccgaggctcctacatctatgatgacactaccgaacgacggaccacgtcggacctacgtccccgacgtaccgtaggttaccgagggtcgggtcgtaggggttcgggtacccggtaggggaccctaaggttacctttacccgaaccgttcccgttaaccgaacccgtacgtaccgaacggtacctaaacgggaaccgttaaacggtaccggttaccgttaaacgggtaaacgtttacgttttttacggaaaccgttttaagtttttaaccgtttacgttacggttaccgtaaacggtccgttaaacgggttaccggtaacgtacccggttaaacggtttccgggtaacccgtttacccgggggtaacccgtttacccgggggtaaacccggaaaccgggggtttaaacccggaaggtttaaccgggaaccttaaccggtaaccgaaaggtacccggtaacgtttcgggtacggaccgttacggaaccctacgttacgttacgttacgg

SEQ ID NO: 275358 - DNA, 633 bp, Homo sapiens
  misc_feature: GYAE6OF02G26F5.9.50.E06.1.454.CMB.1.raw
  modified_base (204)..(204): a, c, t, g, unknown or other
  misc_feature (204)..(204): n is a, c, g, or t
tcagtgatacgtctcacgaccggtgctcgatttagatctactgacaacacacaagggggaggaactgctcagttaggacccagagggaaccatggaagccccagctcagcttctcttcctctgctactctggctcccagattcccaccggagaagttgtgttgacacagtctccagccaccctgtctttgtctccgaggggaangccaccctctcctgcagggccagtcagagtcttaggagcctcttagcctggtactcaacagaaacctggccaggcctctcgaggtcctcctcatctatgatcgcactccgaacgcggccacgtggctactccacgccgtaggttcaggtcgcgtaggtgggtcgtagggactacggtacttacacttcctaccaccactcgacgacagactacgacgtccgtagtaagttacgtttagtaccttagtttaacttacgtacgttacaggtacgtaggtacgttaacgaccttaaaccggttccggtacccgttaccgggttaccgtacccggggtaccggtaaaccgggaccgtaaacgggtacggaacgtacgtaacgaacggtaaccggtaacgtaggtccggtacgtacggacctaccgtacgttcg

SEQ ID NO: 275359 - DNA, 745 bp, Homo sapiens
  misc_feature: GYAE6OF02I5LX7.9.50.E06.1.454.CMB.1.raw
  modified_base (204)..(204): a, c, t, g, unknown or other
  misc_feature (204)..(204): n is a, c, g, or t
tcagtgatacgtctcacgaccggtgctcgatttagatctactgacaacacacaagggggaggaactgctcagttaggacccagagggaaccatggaagccccagctcagcttctcttcctcctgctactctggctcccagattccaccggagaagttgtgttgacacagtctccagccaccctgtctttgtctccaggggaaanacgccaccctctcctgcagggccagtcagagtcttaggagctcttagcctggtatcaacagaaacctggccaggctccaggctccgtcatctatgatgacactaccaagacgggcccacgtggaccactaccccgacgcctacgggttcaaggtcgggaccgtagggtcggggttcgtaggggaactaggtacccgtttcaccgttcctacccaaccgtactacctaacggaccaacggtaaccgtacggtacgtacccgttagggtaaacgttacgttttacggaccgtttaaggtttttaacttacgtttcgtacgtaacggaccgtaacggtacggttaacggaccttaaaccggtcgggttaccccggttccggggttaaacccgggttcccgggtaaacccggtaaacggggtaaccgtaaaccgggtggtaaacccgtaacggttaaacccggtaacgggaacccggttaacggttaccgggttacgggtacccgtttacgggaacccgtaacccgtgttaacccgttttaccgg

SEQ ID NO: 275360 - DNA, 768 bp, Homo sapiens
  misc_feature: GYAE6OF02ILJ87.9.50.E06.1.454.CMB.1.raw
  modified_base (204)..(204): a, c, t, g, unknown or other
  misc_feature (204)..(204): n is a, c, g, or t
  modified_base (308)..(308): a, c, t, g, unknown or other
  misc_feature (308)..(308): n is a, c, g, or t
tcagtgatacgtctcacgaccggtgctcgatttagatctactgacaacacacaagggggaggaactgctcagttaggacccagagggaaccatggaagccccagctcagcttctcttcctcctgctattctggctcccagattccaccggagaagttgtgttgacacagtctccagccaccctgtctttgtctccaggggaaanagcccaccctctcctgcagggcccagtccagagtcttaggacgcttcctagcctggtatcaacacaacctggacccaggcctaccgaggcctcctcatctatgntgccatccaacgacggggcctaagtcggactacgtccccagtccccaggtttacccagggtcggaccgtagggttacggggttccgttagggggacctaagtacctttccgaaaccgttcccttacccgaacctacgttaccacgaccgaacgtaacggttaacggaccggtacctagggttaaacggttactttttcgggaaccgtttaaggtttttaaccgttttacgttaccggttaactaccggcgttaacgggaccggttaaaccggtacccgttaaaccggggttccgggttaacccgttacccgggtaaccgggtttcccgggtaaccggtaaacccggggtaaacccggtaaggttacccgggaagtaaccggtacgaaaacgggtccggttaaccggtacggttacgggacccgtttaccggacctaacccggttcttacggtttaaccgg

SEQ ID NO: 275361 - DNA, 772 bp, Homo sapiens
  misc_feature: GYAE6OF02IGNGI.9.50.E06.1.454.CMB.1.raw
  modified_base (153)..(153): a, c, t, g, unknown or other
  misc_feature (153)..(153): n is a, c, g, or t
  modified_base (206)..(206): a, c, t, g, unknown or other
  misc_feature (206)..(206): n is a, c, g, or t
  modified_base (249)..(249): a, c, t, g, unknown or other
  misc_feature (249)..(249): n is a, c, g, or t
  modified_base (423)..(423): a, c, t, g, unknown or other
  misc_feature (423)..(423): n is a, c, g, or t
tcagtgatacgtctcacgaccggtgctcgatttagatctactgacaacacacaagggggaggaactgctcagttaggacccagagggaaccatggaagccccagctcagcttctcttcctcctgctactctggctccagacttccaccggganaagttgtgttgacacagtctccagcccacctgtctttgtctaccgaggggaanacgccaccctctcctgacacgggccagtcagagtcttagggcnccttccgttagccttggtatacgaacacgtaaacctggccagggtcctaccccggaggtcctacccgtactactaccttagtaggtaacttcggacctaccgttaacccgaacgacgggggtaccccaaggtcggacctacctaccccgaaacggtcccgttagggttaaccgngggtacggtaccggtagggttacgggttcggtaacgggtaaccgtacgtttacctttcccgaaccgtttcccaaccgtaaccgtacgtacggtaacgaacgtaaacggtaaccgtacggaaccgttacgtaacggttaacgttacggttttaacggtacgtttaaacgttttaactttaccgtttacgtaccgtacgtaccggtaacgttaccgggtaacctacggtaaccgtccggtaccggttacgggtaccgtacggaaccgaacggaacgtaacgtaggaagtacgtaccgaacggtacgtaacggtacgtacggtacgtacggtaacctacgtcgttacgtacg

SEQ ID NO: 275362 - DNA, 631 bp, Homo sapiens
  misc_feature: GYAE6OF02I6CES.9.50.E06.1.454.CMB.1.raw
  modified_base (204)..(204): a, c, t, g, unknown or other
  misc_feature (204)..(204): n is a, c, g, or t
  modified_base (297)..(297): a, c, t, g, unknown or other
  misc_feature (297)..(297): n is a, c, g, or t
tcagtgatacgtctcacgaccggtgctcgatttagatctactgacaacacacaagggggaggaactgctcagttaggacccagagggaaccatggaagccccagctcagcttctcttcctcctgctactctggctcccagattccaccggagaagttgtgttgacacagtctccagccaccctgtctttgtctccaggggaaanagcccacctctcctgcagggccagtcagagtcttaggagctccttagcctggtatcaacagaacctggccagctcccgaggctcctcatctangatgcactccaacgagggccactcggcacgtcccagaccgaggtttcaggtcggctggtgggtcgtaggggacagtacctcacgttcctccaacctagtcacgacaggactaggactccgtagaagttattttcggactttagttttaattaccgttgtacgagtaccgaagtccggttaagaccgtaacgttcgggtacccgttcgggtaacccggtttcccgggaaaccggtaacgggtaacccggtaacggtacggtaacccgtaaggtaaccgtaacggacggttaaccgtggtacggacgttacgcccgtaacctacgttacgtttccg

SEQ ID NO: 275363 - DNA, 678 bp, Homo sapiens
  misc_feature: GYAE6OF02GW32M.9.50.E06.1.454.CMB.1.raw
  modified_base (204)..(204): a, c, t, g, unknown or other
  misc_feature (204)..(204): n is a, c, g, or t
  modified_base (239)..(239): a, c, t, g, unknown or other
  misc_feature (239)..(239): n is a, c, g, or t
  modified_base (283)..(283): a, c, t, g, unknown or other
  misc_feature (283)..(283): n is a, c, g, or t
  modified_base (335)..(335): a, c, t, g, unknown or other
  misc_feature (335)..(335): n is a, c, g, or t
tcagtgatacgtctcacgaccggtgctcgatttagatctactgacaacacacaagggggaggaactgctcagttaggacccagagggaaccatggaagccccagctcagcttctcttcctcctgctactctggctcccagattccaccggagaagttgtgttgacacagtctccagccaccctgtctttgtctccgaggggaangccacctctcctgcagggccagtcagatcttaggngcctccgttagccttggtactcaacagaacctggaccaggtccncccgaggctcctcatctatgatgccatcccaacgcgggacccacgtggaccnctaccccaggcctaaggttcacgggtgacgtaggttcgggtacgtgggaactagtaccttcgaccttctaccgacctagtacacgaccaacggtaactacggtacgtaccgtaggtaacgttacgttttacgtacgttaagtttttacgttacttacggttacacggttaccgaagttaccggtacgtaccgtaacggttccggtacccgttaccgggtaaccgggttcccggaacccggtaaacggggtaacccgtaagggttccggaaccgtaacggtaccgaacggtaccggtaaccgttggtaccggtacgtacgaccgtaccgtacgttccggttccg

SEQ ID NO: 275364 - DNA, 721 bp, Homo sapiens
  misc_feature: GYAE6OF02GA75C.9.50.E06.1.454.CMB.1.raw
  modified_base (203)..(203): a, c, t, g, unknown or other
  misc_feature (203)..(203): n is a, c, g, or t
tcagtgatacgtctcacgaccggtgctcgatttagatctactgacaacacacaagggggaggaactgctcagttaggacccagagggaaccatggaagccccagctcagcttctcttcctcctgctactctggctcccagattcccaccggagaagttgtgttgacacagtctccagccacctgtctttgctccgaggggaangccaccctctcctgcagggccagtcagacgtcttaggagtcttcctagcctggtatccaacagaacctggaccaggcctcccgaggcctcctcatctagtgatcgactactacccaagacgggaccctagtcggacacgtccccgaagtcccgtagggttacagggttcggacgtagggttcggggtcgtaggggaacctacggtacctttccgaccgttacctcccaacctacgtaccgtaacggacccaaggtaacccttagggaccgtacccgttaaaggtaacggtttactttttacggaacgtttaacgtttttaactttaaccgttagttaccgaacggtaccgtaggtaaccgtaacgtaccgtaaccgtcgggtacccgttcggggtaaccgttaccggaaaccggtaacggggaaccctaaggggtcgtaaaccggtacgttaaccaaacggggtacctaaccggttcggttacggaccggttcgaacctaccggtactttacggttcg

SEQ ID NO: 275365 - DNA, 711 bp, Homo sapiens
  misc_feature: GYAE6OF02IFSJ2.9.50.E06.1.454.CMB.1.raw
  modified_base (205)..(205): a, c, t, g, unknown or other
  misc_feature (205)..(205): n is a, c, g, or t
tcagtgatacgtctcacgaccggtgctcgatttagatctactgacaacacacaagggggaggaactgctcagttaggacccagagggaaccatggaagccccagctcagcttctcttcctcctgctactctggctcccagattccaccggagaagttgtgttgacacagtctccagccaccctgtctttgtctccgaggggaaanagccaccctctcctgcagggccagtcagagtcttaggagcttccttagcctggtatcaacagaaacctggccaggcctccgaggcctcctcatctatgatgacactccaacgagggcccacgtcggaccactccccgacggccgtaaggttcctaggttcgggaccgtagggttcggggttcgttacggggaactacggtacctttaccgtaaccgttccgttacccaacccgttaacttaccgacggtaccgaacggttaaaccgtaacggacggttaccccgtaagggtaaaacggttttacggttttttacgtaccgtttaaggtttttaacctttaacgtttcgtttacacggtacgtaggtaccggttacgaccgtaacggtcggtacccggtacggtaccgggttaccggaccggtaacgggtaaccaacgggtcggaacgtacgtaacgacggtaaccgtacggtacggtcggaccgttacgacaaccgtctcgttacg

SEQ ID NO: 275366 - DNA, 699 bp, Homo sapiens
  misc_feature: GYAE6OF02HAQ8C.9.50.E06.1.454.CMB.1.raw
  modified_base (288)..(288): a, c, t, g, unknown or other
  misc_feature (288)..(288): n is a, c, g, or t
  modified_base (294)..(294): a, c, t, g, unknown or other
  misc_feature (294)..(294): n is a, c, g, or t
  modified_base (301)..(301): a, c, t, g, unknown or other
  misc_feature (301)..(301): n is a, c, g, or t
tcagtgatacgtctcacgaccggtgctcgatttagatctactgacaacacacaagggggaggaactgctcagttaggacccagagggaaccatggaagccccagctcagcttctcttcctcctgctactctggctcccagattccaccggagaagttgtgttgacacagtctccagccaccctgtctttgtctccaggggaaacagccaccctctcctgcagggccagtcagagtcttagagctcttagcctgtatcaacagaacctggccaggctccgaggctcctnatctangatgcanccaacgaggccacgtggcactcccagccaggttcaggtcggctagggtcgggttcgtaggggaacctaggtaccttacgaccttcctaccgaaccctaatacccgaacgacgtaaacggtacctaacggtacgtaccgtaaggttaaagtttacggtttttacggacttttaaggtttttaactttaacgtcggttaactaggaccgtaaggtacggtaacgttaccgtaaccgggttccggtacccgttaccggggtaaccgtttacccgggaacccggtaaaccgggggtaacctaaacggggtgaaacccgtaaggttaacccgaaagggtacccggtaacgttcgggtacgggtaccgttaccgacccgttaaccgtcgtttaccgtttaccgg

SEQ ID NO: 275367 - DNA, 767 bp, Homo sapiens
  misc_feature: GYAE6OF02HG89H.9.50.E06.1.454.CMB.1.raw
  modified_base (205)..(205): a, c, t, g, unknown or other
  misc_feature (205)..(205): n is a, c, g, or t
tcagtgatacgtctcacgaccggtgctcgatttagatctactgacaacacacaagggggaggaactgctcagttaggacccagagggaaccatggaagccccagctcagcttctcttcctcctgctactctggatcccagattccaccggagaagttgtgttgacacagtctccagccaccctgtctttgtctccgaggggaaanacgccaccctctcctgcagggccagtcagagtcttaggatctcttagcctgtatcaacagaacctggaccaggcctcccaggcctcctcacttctatgatgcatcccaacgacgggaccacgtcggaccactccccagtcccgtaggttccaggttcggcgtacgggttcggggtacgttacggggaactacggtacctttcgaacccttccgtaccaaccctaattaccgacgtaccaacggtaacctaacggacgtccgttaaggtaaacggtttagtttttacggaccgtttaaggtttttaacttaccgttaggttaccgtacggtaccgtacggtaccgggttaacgtaccgtaaacccggtttccggggtaaccccgtttacccgggggttaacccgggtttacccggggaacccgggtaaaccgggggtaaacccgtaaaccggggttacgggtaaacccgtaacggtaacccgtaaacgggtaacccggttaacggttacgggtacggggtaccgttacggacccgtaacccgttacgtttacccgtttaccgg

SEQ ID NO: 275368 - DNA, 660 bp, Homo sapiens
  misc_feature: GYAE6OF02FGUST.9.50.E06.1.454.CMB.1.raw
  modified_base (204)..(204): a, c, t, g, unknown or other
  misc_feature (204)..(204): n is a, c, g, or t
  modified_base (315)..(315): a, c, t, g, unknown or other
  misc_feature (315)..(315): n is a, c, g, or t
  modified_base (401)..(401): a, c, t, g, unknown or other
  misc_feature (401)..(401): n is a, c, g, or t
tcagtgatacgtctcacgaccggtgctcgatttagatctactgacaacacacaagggggaggaactgctcagttaggacccagagggaaccatggaagccccagctcagcttctcttcctcctgctactctggctcccagattccaccggagaagttgtgttgacacagtctccagccaccctgtctttgtctccaggggaaanagccacctctcctgcagggccagtcagagtcttaggagctccttagcctggtatcaacagaaacctggccaggtcctccccgaggcctcctcatctatgatgcatcccaangggccatggcactcccagcctaggttccaggtcggctaggtgggtcgtggggaactaggtacgtttccacttcctaccgaaccctntcaacgactaacggaacttaaggacgtcccgtaggtaaagttacgtttttcggaccttaaaggttttatttaacgttgtacaggtcaacggtaccgttaaggcctaaacggttcggtacccgttccgggtacccggtttacggacccggaaacggggttaacccgtaagggtaccgggaacgtaacgttaacgaacgggaacccgtaacgttacgggtcgggtacctaacggacccgtaacctagttaccgtttaccgg

SEQ ID NO: 275369 - DNA, 131 bp, Homo sapiens
  misc_feature: GYAE6OF02HXY0N.9.50.E06.1.454.CMB.1.raw
  modified_base (127)..(131): a, c, t, g, unknown or other
  misc_feature (127)..(131): n is a, c, g, or t
tcagtgatacgtctcacgaccggtgctcgatttagatctactgacaacacacaagggggaggaactgctcagttaggacccagagggaaccatggaagccccagctcagcttctctcctcctgctannnnn

SEQ ID NO: 275370 - DNA, 799 bp, Homo sapiens
  misc_feature: GYAE6OF02JPFVR.9.50.E06.1.454.CMB.1.raw
  modified_base (204)..(204): a, c, t, g, unknown or other
  misc_feature (204)..(204): n is a, c, g, or t
tcagtgatacgtctcacgaccggtgctcgatttagatctactgacaacacacaagggggaggaactgctcagttaggacccagagggaaccatggaagccccagctcagcttctcttcctcctgctactctggctcccagattccaccggagaagttgtgttgacacagtctccagccaccctgtctttgtctccgaggggaanagcccacctctcctgcagggccagtcagtagtcttaggacgtctacctagcctggtactacaacgagaaacctggaccagggcctacccgaggtccttccgtactacgtactagtacgatcggacctacgtcccgaaacgacggggtccctaacgttggacctaacctccccgaaggccccgttaggttacgaacggttacggactagggttcgggtaccgtacggggaacctacgggtaccttaccgtaccttaccgttacccgaaccgtactttaccggaacgttaccggtaaacggtaaccgttaacggtaaccggtacccttaaagggttaaacgttttaccgttttacgtaaccgggtttaatttttaacgtttacccgttaggttaccgtaaacggtttaccaacggttacgggtaaccgtaacggtaaccgttccgggtaacccgtttacccggtacggggttaaacccggacgggtaaaccgggtaacctaagggtacggtaacccgtagttacccggaaaggtacccgttaacggtacggttaccgggtaactccggtaaccgtaaccgttacgttccgttaacgg

SEQ ID NO: 275371 - DNA, 706 bp, Homo sapiens
  misc_feature: GYAE6OF02H34LG.9.50.E06.1.454.CMB.1.raw
  modified_base (205)..(205): a, c, t, g, unknown or other
  misc_feature (205)..(205): n is a, c, g, or t
  modified_base (331)..(331): a, c, t, g, unknown or other
  misc_feature (331)..(331): n is a, c, g, or t
  modified_base (338)..(338): a, c, t, g, unknown or other
  misc_feature (338)..(338): n is a, c, g, or t
tcagtgatacgtctcacgaccggtgctcgatttagatctactgacaacacacaaggggggaggaactgctcagttaggacccagagggaaccatggaagccccagctcagcttctcttcctcctgctactctggctcccagattccaccggagaagttgtgttgacacagtctcagccaccctgtctttgtctccgaggggaaanagccacctctcctgcagggccagtcagagtcttaaggagcttccttagcctaggtatcaacagaaaacctggccaaggcctccgaggtcctcctacatctatgatgcatcccaagacggcctacgnggctacncccgagccgtaaggttcaggtcggactagggtcgggtcgtagggaactacggtactttcgaacttcctaaccaaccctaatcgaacgtaccgaaaggttaacgtaaggacctacccgttaaggaaacgtttacgtttttagaacgtttaaacgttttttaacttaaccgttgttaacgacggtaccgtaacggtaccggttaagacccgtaaaccgggtttcgggaaccccggtttacggggttaaacccggttaccggaaaccgggtaaaccggggaaaccgttaagggacgttaaccgaagtaaccgtaagaaccggttaaccggtggttaacggccgtaccgtaccgaccgtacgtagttacccg

SEQ ID NO: 275372 - DNA, 669 bp, Homo sapiens
  misc_feature: GYAE6OF02HYNK7.9.50.E06.1.454.CMB.1.raw
  modified_base (203)..(203): a, c, t, g, unknown or other
  misc_feature (203)..(203): n is a, c, g, or t
tcagtgatacgtctcacgaccggtgctcgatttagatctactgacaacacacaagggggaggaactgctcagttaggacccagagggaaccatggaagccccagctcagcttctcttcctcctgctactctggctcccagacttccaccggagaagttgtgttgacacagtctccagccacctgtctttgtctcgaggggaanacgccacctctcctagccgagggccagtcagagtcgttaaggcgctccttagccttggtactcaacgagaaaccgtggaccaggcctccgaggcctcctcaatctatgatcgcaacttccaacgtcgggccctagtcggacaccgtcccaacggccgtaaggttcacgggttaggccgtaggttcgggtcttaggggaacctgtaacctttcgacttacctacgaccagtccaacgtcaacggtaaccgtgaacgtcctaaggaattacgtttttcgaacgttaacgtttttacttaacgtggttacacggtaactagccggtttaaagccgtaaaccgttcgggaccttacgggttaccggttacggaaccggtaacggaccgtaaacggttcgtacgacgttaaccaagggacccgtaacggttacgttcgggaccttaggtacccaacgtccttacggttacc

SEQ ID NO: 275373 - DNA, 566 bp, Homo sapiens
  misc_feature: GYAE6OF02GL7L3.9.50.E06.1.454.CMB.1.raw
  modified_base (204)..(204): a, c, t, g, unknown or other
  misc_feature (204)..(204): n is a, c, g, or t
  modified_base (443)..(443): a, c, t, g, unknown or other
  misc_feature (443)..(443): n is a, c, g, or t
tcagtgatacgtctcacgaccggtgctcgatttagatctactgacaacacacaagggggaggaactgctcagttaggacccagagggaaccatggaagccccagctcagcttctcttcctcctgctactctggctcccagattccaccggagaagttgtgttgacacagtctccagccaccctgtctttgtctccaggggaaanagccaccctctcctgcagggccagtcagagtcttaggagctccttagcctggtactcaacagaaacctggccaggctcccaggctcctcatctatgatgcatccaacagggccacgtggcactccccagccaggttcagtggcaggtgggtctgggacagtacttcactctacaccatcagcagactagagccgtagtaagtatttgacttagttttattactgtcagtacagcgtacncgtaacgtcggaccgttcgggtaccgttcggaccgtaacggggaacccgaaggtcggaaccgaacgtaacgaaacggccgtaaacgtggtacggtacgtaggaccacccgtagttccgttacg

SEQ ID NO: 275374 - DNA, 730 bp, Homo sapiens
  misc_feature: GYAE6OF02GR3E1.9.50.E06.1.454.CMB.1.raw
  modified_base (204)..(204): a, c, t, g, unknown or other
  misc_feature (204)..(204): n is a, c, g, or t
tcagtgatacgtctcacgaccggtgctcgatttagatctactgacaacacacaagggggaggaactgctcagttaggacccagagggaaccatggaagccccagctcagcttctcttcctcctgctactctggctcccagattccaccggagaagttgtgttgacacagtctccagccacctgtctttgtctccgaggggaaancgccaccctctcctgcagggccagtcagagtcgtaggagtcctcgtagcctggtactcaacacgaaaccgtggaccacggcctcccgaggcctcctcatctagtgtagtcgcactaccaacgacgggaccctacgtcggactaccgtcccgagtcccgtaggttacgacggtcggaccgtagggtcgggtacgtacggggactacggtacctccgaccttccgtaccaccctacgtccaacgaccgtacgttaactaacggacgtaccgtaaggtaaacgtttcgttttagtaacgttttaggttttaacgtttacgttacgttacgtaacgtcgtaacgtaccggtaacgtaccgtaacggttccggtacccggttcggggttaacccggttccgggaaacccggtaaagggggtaacccctaaaggggttccgtaaaccgtaacggtaaccggtaaaccggtaccggtaacgtcggggtacggtaccttaccggaccgtaaccgttacggacccgttttaccgg

SEQ ID NO: 275375 - DNA, 803 bp, Homo sapiens
  misc_feature: GYAE6OF02HYH4I.9.50.E06.1.454.CMB.1.raw
  modified_base (172)..(172): a, c, t, g, unknown or other
  misc_feature (172)..(172): n is a, c, g, or t
tcagtgatacgtctcacgaccggtgctcgatttagatctactgacaacacacaaggggggaggaactgctcagttaggacccagagggaaccatggaacgccccagctcagctttctcttcctcctgctactctggctcccagattccgaccggagtaagttgtgttgacanagtctccagcccacctgtctttgctccgaaggggaaagcgtccacctctcctgacagggccagtcagtagttcgttaggagcttccttaggccttagggtataccaaacgaacgtaaaacccgtgggacccgacggtccctacccgaagggtcccttaccctactaacgttacgtaacttaggtacttacggaacctaaccgtaacccaaaaccggacggggtaacccctacgttacgggacctaaccgtaccccgaacggtacccgttagggtttaccgaggttacggggaaccgtaggggtttcgggtacggttaacgggaaaccggtaacggttaaccctttacgtaaccctttcccgaaccgtaaaccgtacgttaccgaacggtaaactaacgggtaaactaacgggaaccgttaccgttaagggtaaaactttaggtttttacggacttttaaggttttaaccgttaacgttacgtacgtacgaacgtaggtaccgttagaaccgtaacgtcggtaccgtacgggtaccgttacgggacgtaaaccgggaacgtaacgtacgtacgaagtacgaacggacgtaaccgtggtacggttacgtacgaacctaccgtagttcctacgg

SEQ ID NO: 275376 - DNA, 729 bp, Homo sapiens
  misc_feature: GYAE6OF02ISTV4.9.50.E06.1.454.CMB.1.raw
  modified_base (205)..(205): a, c, t, g, unknown or other
  misc_feature (205)..(205): n is a, c, g, or t
  modified_base (216)..(216): a, c, t, g, unknown or other
  misc_feature (216)..(216): n is a, c, g, or t
tcagtgatacgtctcacgaccggtgctcgatttagatctactgacaacacacaagggggaggaactgctcagttaggacccagagggaaccatggaagccccagctcagcttctcttcctctgctactctggctccagattccaccggagaagttgtgttgacacgagtctccagcccacctgttctttgtctccgaggggaaancgcccaccctntaccgtgccgacgggccagtcaggtagttcttaaggagtccttaccgttagccgttaggtactacctaacgaacgtaaaccgtcggaccacggtcctaccccgaggccttccgtacatactagtcgagtcgctacaccgaacgcgggccaacgtcggcctacgtcccgaggacccgtaggttacgacgtcggtactacggttacgggtacgtcgggtactaacggtaacgtttcaacttccgtacctacctagtccacgtacgtaacgaaccgtacgaccgttaccggtaagtaaacgttacgttttacggaccgtttaaaggttttcgtttacgttaccggttactacgaccgtaggtaccgtaacgtaccggtaacgtccggtacggttacccggtaaccggttccggaacggtaaacgggtaccgaacgtacggaaccgtaagtacccgtaaggtaccgttaacggtacggttacggtccgtacggtaccctacgtaccgttccgtacgg

SEQ ID NO: 275377 - DNA, 600 bp, Homo sapiens
  misc_feature: GYAE6OF02F4UBJ.9.50.E06.1.454.CMB.1.raw
  modified_base (204)..(204): a, c, t, g, unknown or other
  misc_feature (204)..(204): n is a, c, g, or t
  modified_base (314)..(314): a, c, t, g, unknown or other
  misc_feature (314)..(314): n is a, c, g, or t
tcagtgatacgtctcacgaccggtgctcgatttagatctactgacaacacacaagggggaggaactgctcagttaggacccagagggaaccatggaagccccagctcagcttctcttcctcctgctactctggcctcccagattccaccggagaagttgtgttgacacagtctccagccaccctgtctttgtctccaggggaanagccaccctctcctgcagggccagtcagagtcttaggagctccttagcctggtatcaacagaacctggccaggctcccgaggcctcctcatctatgatgctatccaacgngggccacgtggcactcccagcctaggttcagtcgctaggtgggtcgtagggacagtacttcactctacacatcacgcaagactagacgtcctaggtaagtctttagacttaagttttacttacgtcgtcagtcgtaacgtcgttaagaccgtaacgttcggtcccgttacgggtaccgttccgggaaccgtaacgggtaacctaacgggtacggaacctaacgtaaccggaaacgtaccggtaacgttggtaccggtctacggacctaacccgtattccgttccgg

SEQ ID NO: 275378 - DNA, 601 bp, Homo sapiens
  misc_feature: GYAE6OF02FY1M1.9.50.E06.1.454.CMB.1.raw
  modified_base (200)..(200): a, c, t, g, unknown or other
  misc_feature (200)..(200): n is a, c, g, or t
  modified_base (227)..(227): a, c, t, g, unknown or other
  misc_feature (227)..(227): n is a, c, g, or t
  modified_base (319)..(319): a, c, t, g, unknown or other
  misc_feature (319)..(319): n is a, c, g, or t
tcagtgatacgtctcacgaccggtgctcgatttagatctactgacaacacacaagggggaggaactgctcagttaggacccagagggaaccatggaagccccagctcagcttctcttcctcctgctactctggctcccagattccaccggagaagttgtgttgacacagtctccagccacctgtcttgtctcaggggaangccacctctcctgcagggccagtcagngtcttaggagctcttagcctggtatcaacagaaacctggccaggctccgaggcctctcatctatgatgcatccaacgaggccactggctacncccagccaggttacagtggactaggtcgggtgacggggacacgtacttcaccgttcaccacctagactacgacgaacgaacgtacgtaacgcctacgtaacgtacgtttacgtacgttagtttaagtttacttcgtactagtactacggtcgtacgtacgtaaccgtaggtccccccgtaggtaccggttacggaccggtaacgggaaccggtaacgtacggtaacgaacgtacgaacggtacgaacgtggtacggtacgtccgacgacctacgtcttacgg

SEQ ID NO: 275379 - DNA, 625 bp, Homo sapiens
  misc_feature: GYAE6OF02FN7EA.9.50.E06.1.454.CMB.1.raw
  modified_base (150)..(150): a, c, t, g, unknown or other
  misc_feature (150)..(150): n is a, c, g, or t
  modified_base (596)..(596): a, c, t, g, unknown or other
  misc_feature (596)..(596): n is a, c, g, or t
tcagtgatacgtctcacgaccggtgctcgatttagatctactgacaacacacaagggggaggaactgctcagttaggacccagagggaaccatggaagccccagctcagcttctcttcctcctgctactctgctcccagattccaccggngaaaaaaaaaagttgtgttgacacagtctccagccaccctgtctttgtctccaggggaaagagccaccctctcctgcagggccagtcagagtcttaggagctccttacgcctggtatcaacaagaaacctggccacggcctcccgacggcctcctactactctatcgatgcactaccaacgacgggacccacgtcggcactccccgacgaccgacggttacgaggtcggcgaggtcgggtcgtgggacgacgtacttcgacctcctaccaacctactacgagaccagaacctagacgtccgtagtaaacgttattttgacttaagttttattacgttgtacgacgtccaaggtcctaacgctaacgtcggtccgttaccgggtacgttacccggaaccgaaacgggtacccaaaggtcggaactaagtaaccgaaggcgtaaacgnggttcggacgtgcccacctacgtcttacg

SEQ ID NO: 275380 - DNA, 715 bp, Homo sapiens
  misc_feature: GYAE6OF02JUC5D.9.50.E06.1.454.CMB.1.raw
  modified_base (209)..(209): a, c, t, g, unknown or other
  misc_feature (209)..(209): n is a, c, g, or t
  modified_base (574)..(574): a, c, t, g, unknown or other
  misc_feature (574)..(574): n is a, c, g, or t
tcagtgatacgtctcacgaccggtgctcgatttagatctactgacaacacacaagggggaggaactgctcagttaggacccagagggaaccatggaagccccagctcagcttctcttcctcctgctactctggcctcccagattccgaccggagaagttgtgttgacacagtctccagcccaccctgttctttgtctccgaggggaaangccaccctctcctgcagggccagtcagagtcctaggcgtcctaccgtagcctggtactcaacaacgaaacccgtggaccacgggtcctaccccgagggtcctccctccaagtttctaagtcggtaatcgacctacgttaccaaacgcgggaccctagtcggacactccccgaagtcccgtaaggtccgaggtcggccgtagggtcgggtacgtagggactacggtaccctttcgaaccttcgaacctccgtaatccgaaggtccaaacgtacgacgtacgccgtaagtacgtattttacgacgttaaggttttaccttacggttacgtcctaaaggtcctacggtacctaggaccgttaaaccgngggtacccgttaccgggtaccgtaccgggttaacgaaccggggaacctaaacgggtcggaaaccgtacgtaacctaaacgggtaccgtaaccggtgggttacgggtaccctcgggtaaccctacgtacgtttacgttccgg

SEQ ID NO: 275381 - DNA, 846 bp, Homo sapiens
  misc_feature: GYAE6OF02IQKCF.9.50.E06.1.454.CMB.1.raw
  modified_base (204)..(204): a, c, t, g, unknown or other
  misc_feature (204)..(204): n is a, c, g, or t
tcagtgatacgtctcacgaccggtgctcgatttagatctactgacaacacacaagggggaggaactgctcagttaggacccagagggaaccatggaagccccagctcagcttctcttcctcctgctactctggctcccagattccaccggagaagttgtgttgacacagtctccagccaccctgtctttgtctccgaggggaanacgccaccctctcctgcagggccagtcagagtcttaggagccttaccgttagcctaggtactaccaacaacgaaacctgggacccaagggtcctccccgaagggtccttacccctacaacgttccttaagtacggtaactcggtacctaacttacccgaaaccggacggggacccctaacggtcgggacctacgtccccgaacgtacccggtaggtttaccgagggtcgggacgtagggttaccggggtacggtaggggaacctacggtacctttaccgtaaccgttaccgtacccgaacctaacgttccgaacggtaccgaacgtaacgttacggacgtaacccgttaggtaaacgtttacgtttttaccgaacgtttaaaggttttttaacttaaccccgttgggttaccgtaaggtacccggtaacggggttaaccgttaaccggtaacccgtaacccggttaccggggttaccccggttaacggggttacccgggtttacccgggaacccgggtaaaacggggtaaccccgtaagggtaccggtaacccgtaacgtaccggtaaaaccggtaccggtaaacgtttcgggtaaccgggttcgaccgggtacccaaccgttacggttccgttttaaccgg

SEQ ID NO: 275382 - DNA, 622 bp, Homo sapiens
  misc_feature: GYAE6OF02FYQVB.9.50.E06.1.454.CMB.1.raw
  modified_base (203)..(203): a, c, t, g, unknown or other
  misc_feature (203)..(203): n is a, c, g, or t
tcagtgatacgtctcacgaccggtgctcgatttagatctactgacaacacacaagggggaggaactgctcagttaggacccagagggaaccatggaagccccagctcagcttctcttcctcctgctactctggctcccagattccaccggagaagttgtgttgacacagtctccagccacctgtctttgtctccaggggaaanacgccaccctctcctgcagggccagtcagagtcttaggagcttccttagcctggtactcaacagaaacctggccaggcctcccaggctactcatctatgatgacactaccaaacgcgggccacgtggaccactacccagccgtaggttcagtgcgtaggttcgggtctacggggacagtacttcaccttcaccacctatcaggcaagactagacgtccgtagtaagttattttcgattaagttttacttacgttgtacagtacgtagtacgtacgaccgtaacgtccggtaccgttaccgggtacgttaccgggaaccgtaaacgggaaccgtaaggaccgggtaactaacggaaccgtaaaggaaccggtaaccgttggttacggccgttaacgccgtaaccttacgtcgtttacccg

SEQ ID NO: 275383 - DNA, 626 bp, Homo sapiens
  misc_feature: GYAE6OF02FZ6PC.9.50.E06.1.454.CMB.1.raw
  modified_base (206)..(206): a, c, t, g, unknown or other
  misc_feature (206)..(206): n is a, c, g, or t
  modified_base (246)..(246): a, c, t, g, unknown or other
  misc_feature (246)..(246): n is a, c, g, or t
  modified_base (300)..(300): a, c, t, g, unknown or other
  misc_feature (300)..(300): n is a, c, g, or t
  modified_base (391)..(391): a, c, t, g, unknown or other
  misc_feature (391)..(391): n is a, c, g, or t
  modified_base (445)..(445): a, c, t, g, unknown or other
  misc_feature (445)..(445): n is a, c, g, or t
tcagtgatacgtctcacgaccggtgctcgatttagatctactgacaacacacaagggggaggaactgctcagttaggacccagagggaaccatggaagccccagctcagcttctcttcctcctgctactctggctcccagattccaccggagaagttgtgttgacacagtctccagccaccctgtctttgtctccgaggggaaagngccaccctctcctgcgacgggccagtcagagtcttagganctccttagcctggtactcaacagaaacctggaccaggcctccccgaggctcctnatctatgatgcatccaacgacgggccacgtgcactcccgagcctaggtcaggtcgacgtaggtcgggtgtcgggacacgtacttcaccgtntaccacctatccaaggactagacgtagacgtcccgtaaggtaacgttagttttnaacgtttaagtttatttacgtagttcagtacacgggccttaaggcctaaccgtcggccttaccgggtaccgttcgggaccgtaaagggaccgaaggttaccggaagtacgttaaaccggaacggtaccggaaagttcgggtacggtaccttagggaccctaaccgttacgttacccgttag

SEQ ID NO: 275384 - DNA, 595 bp, Homo sapiens
  misc_feature: GYAE6OF02G4UO0.9.50.E06.1.454.CMB.1.raw
  modified_base (204)..(204): a, c, t, g, unknown or other
  misc_feature (204)..(204): n is a, c, g, or t
  modified_base (241)..(241): a, c, t, g, unknown or other
  misc_feature (241)..(241): n is a, c, g, or t
tcagtgatacgtctcacgaccggtgctcgatttagatctactgacaacacacaagggggaggaactgctcagttaggacccagagggaaccatggaagccccagctcagcttctcttcctcctgctactctggctcccagattccaccggagaagttgtgttgacacagtctccagccaccctgtctttgtctccaggggaaangccaccctctcctgcagggccagtcagagtcttaggngcttcctagcctggtactcaacagaaacctggaccaggcctacccaggcctcctcatctatgacttgacatcccgaacgacgggccacgtcggactacgtccccagccgtaggttcgaggtgaccgtaggttcgggtctagggacacgtacttcacgttctccacgactcacgcacgacgtagacgaccgtagtaacttgttgtacttagtttacttactagtctagcgtagcgtagcgtaacgtcggaccgttacgcggttaccggaccgtaaagggacccgtaaggtaccggacgtaacgtaccgaacgacgtaacgtggtacggtcgtaccggaccacgtacgttacgtcg

SEQ ID NO: 275385 - DNA, 648 bp, Homo sapiens
  misc_feature: GYAE6OF02GLTS6.9.50.E06.1.454.CMB.1.raw
  modified_base (201)..(201): a, c, t, g, unknown or other
  misc_feature (201)..(201): n is a, c, g, or t
  modified_base (314)..(314): a, c, t, g, unknown or other
  misc_feature (314)..(314): n is a, c, g, or t
tcagtgatacgtctcacgaccggtgctcgatttagatctactgacaacacacaagggggaggaactgctcagttaggacccagagggaaccatggaagccccagctcagcttctcttcctcctgctactctggctcccagattccaccggagaagttgtgttgacacagtctccagccacctgtctttgtctcaggggaangccaccctctcctgcagggccagtcagagtcttaggagcttccttagcctggtatcaacagtaaacctggaccaggcctcccgaggctcctcactctagtgatgcatccaacngggccacgtggacactcccagccaggttcaggttcgcaggtgggtctgggacaggtacttcactctccaaccgtatacgacgaccaacggtaacttaagggaccgtccgttaaggtaaaacgttacgttttacggacttaaggtttttaacgttaacttcggttactaaggtaccacggtacgttaacgaccgtaacgttcggggacccttacggggtaaccgtttccgggaaccgtaaacggggacccgtaaaggttcgggaaccaagtaaccggaaacggaccggtaacgttcgggtacggtccgttacgaccgaccctacgttcttaaccg

SEQ ID NO: 275386 - DNA, 844 bp, Homo sapiens
  misc_feature: GYAE6OF02HIU1A.9.50.E06.1.454.CMB.1.raw
  modified_base (200)..(200): a, c, t, g, unknown or other
  misc_feature (200)..(200): n is a, c, g, or t
  modified_base (213)..(213): a, c, t, g, unknown or other
  misc_feature (213)..(213): n is a, c, g, or t
tcagtgatacgtctcacgaccggtgctcgatttagatctactgacaacacacaagggggaggaactgctcagttaggacccagagggaaccatggaagccccagctcagcttctcttcctcctgctactctggctcccagattcccaccggagaagttgtgttgacacagtctccagccacctgtcttgctcgagggaancgccacctctccngcaggccagtcagacgtcgttaggagtccttccgtacgccgttggtataccaaacacgaaaccgtcggaccaaggcctaccccgaggtcctcccgtactaacgttccttaagtgtaacttcgactaccgtaccgaaacgaccgggtacccaacgtcggacctaaccgtaccccgaggtacccgtaagggttaccgtagggtaccggaccggtaagggttcggggttccggttacgggggaaacccttacggtaacccgtttaccaacccgtttcccgtaacccgtaacccgttaacgtcccaacggtaccgtaaaccggtaaacgttaccggacggttaacccgttaaggttaaacggttttaaccgttttcggttaccgtttaaacggttttttaacgttaaccgttcgggtttaacgaacgttacggaacccggttaccggtttaaaccgccgttaaaccggggttcccgggttaccccgttaccggggtttaacccgggttaccggtaaccgggtaaaccggtaaccggtaaacgggttaccggtaccgtaacgttaccggaaaccggttaccggtaaacgttcggggtacgccggtaccgtacccgtaacgtcgttaaccgtttcgg

SEQ ID NO: 275387 - DNA, 894 bp, Homo sapiens
  misc_feature: GYAE6OF02J2W3B.9.50.E06.1.454.CMB.1.raw
  modified_base (747)..(747): a, c, t, g, unknown or other
  misc_feature (747)..(747): n is a, c, g, or t
tcagtgatacgtctcacgaccggtgctcgatttagatctactgacaacacacaagggggaggaactgctcagttaggacccaggacgggaaccagtggaacgcccagctcagtcttctcttcctcctgctactctggcctccagtacttccgaccgggtagtaaggtttgtcgttacgaccaactacgttcctccgacgcccctacccttggttcctttgtaccgtaccggaagggggaaaactccgcccctaacccgttcttacccgtggaccgaacgggtccctaggttaccaagggttacgttcccgtttaagggctccctttaccgtttaacgggcccttaagggttaacaccaaaaccgtaaccggaaaccgttcgggaccacggggtcccctcccggtaacggtcccttcctactaactttccttaagcggtaacttccggaccttaaccgtaacccggtaacggaaccgggttccccagtttccggaaccctttccgaccccggtaacgtcccggttttaacggtcccgaaggggttcccggacggttaacgggttccgggtcgtaaaacccggggttacacccgggttacccttttacccaacgggtttccccgaaccgtaccttaaccggacgttaaccggaaccgtaacggttaaaccggtccgtaaacggtttccctaaacggggttattttaccgggtttcggtaactttacgtttacgtaacgtttcggaaccncggtacgtacggtacgtacgtaccgtaccggttcggtaccgtaccgggtaccggttaccggaacggtaacgttaaccgacggtgtaacctaacggacgtacgaccggttacgccgttacggacctacgtcgtaacttcgtcggtccc

SEQ ID NO: 275388 - DNA, 564 bp, Homo sapiens
  misc_feature: GYAE6OF02IQSGU.9.50.E06.1.454.CMB.1.raw
  modified_base (201)..(201): a, c, t, g, unknown or other
  misc_feature (201)..(201): n is a, c, g, or t
  modified_base (210)..(210): a, c, t, g, unknown or other
  misc_feature (210)..(210): n is a, c, g, or t
  modified_base (239)..(239): a, c, t, g, unknown or other
  misc_feature (239)..(239): n is a, c, g, or t
  modified_base (398)..(398): a, c, t, g, unknown or other
  misc_feature (398)..(398): n is a, c, g, or t
  modified_base (524)..(524): a, c, t, g, unknown or other
  misc_feature (524)..(524): n is a, c, g, or t
  modified_base (546)..(546): a, c, t, g, unknown or other
  misc_feature (546)..(546): n is a, c, g, or t
tcagtgatacgtctcacgaccggtgctcgatttagatctactgacaacacacaaggggggaggaactgctcagttaggacccagagggaaccatggaagccccagctcagcttctcttcctcctgctactctggctcccagattccaccggagaagttgtgttgacacagtctcagccacctgtctttgctccgagggaangccaccctntcctgcagggccagtcagagtcttagganctcttagcctggtatcaacagaaacctggacctaggcctccgagctcactatctatgatcgacaactccgaaacgtacgggacctacgtcggacactcccagccgtaggttcagtggactaggtgggtctggggactaacgacttcacttctacacctntacgagcaagactacgagtcagaagtatttgacttagtttaatactgtacagtacaggacgtacgtaccacgtcggccgtcgtaaccgttcggaacgtaacgggtaaccaagtacggataacgtanaacgacgaacgttgaggtaccngtaccgactatcgttacg

SEQ ID NO: 275389 - DNA, 671 bp, Homo sapiens
  misc_feature: GYAE6OF02G6DAA.9.50.E06.1.454.CMB.1.raw
  modified_base (205)..(205): a, c, t, g, unknown or other
  misc_feature (205)..(205): n is a, c, g, or t
tcagtgatacgtctcacgaccggtgctcgatttagatctactgacaacacacaagggggaggaactgctcagttaggacccagagggaaccatggaagccccagctcagcttctcttcctcctgctactctggctcccagacttccaccggagaagttgtgttgacacagtctccagcccacctgtctttgctccgaggggaaancgcccaccctctcctgcagggccagtcagagtcttaggagtcctccttagccttaggtatcaacaagaaacctggaccaggcctcccgaggcctcctcattctatgatcgaccatacccaacgcgggccctacgtcggaccacgtaccccgagtcccgtaaggttccagggttcggactagggtcgggtacgtggggaactagtacctttccgaaccttcctaccgaccctagtcgacgccgaagtaacgtacggtaccgtccgtaggtaaacgtttattttcggaaccttttaggttttaaccttacgtggtaccagcgttacggtagtacgcctaacggtcggtacccgttcgggtaccggttcggaacccggtaaagggacccgtaaggtcggaactaggtaacccgaaaggtccgtaacggtggtaccggtacctcgaacccgtaccttagttcccgttacg

SEQ ID NO: 275390 - DNA, 769 bp, Homo sapiens
  misc_feature: GYAE6OF02J0EZC.9.50.E06.1.454.CMB.1.raw
  modified_base (214)..(214): a, c, t, g, unknown or other
  misc_feature (214)..(214): n is a, c, g, or t
  modified_base (762)..(762): a, c, t, g, unknown or other
  misc_feature (762)..(762): n is a, c, g, or t
tcagtgatacgtctcacgaccggtgctcgatttagatctactgacaacacacaagggggaggaactgctcagttaggacccagagggaaccatggaagccccagctcagcttctcttcctcctgctactctggctcccagattccaccggagaagttgtgttgacacagtctccagcccacccttgttcctttgtcctaccggaagggggaaancgaccccacccttctccgtggaccgacggggtccctaggtaccaaggtacgttccggttagggacgtcctttacccgttaaggcccttagggttaacctaccgtaaacgaacggtaaaaccccgttgggacccgtaagggcccttaccccgtaagggtccctttacccgacctacttaccgttagttaggactcggacctacgtacccgaacggtacggccaacgttggacctaccgtccccgagtccggttaaggtcaagggtcgacggtacgttacgggggttcagggtacctaagtcccgttctaacgtccctaacgaccgtaccgtacgaacggtcctaacggtaccgtaaggtccgtacggttaactaaggtttagtttaccgtagtttaaaggttttactaccgggttacttacgaacgtcgttaacgtacggtactaccggtaacggtcgtaccgggtaccgtccggttacggaacgttaacgacgtagcgaactacggacgaggtaccgtacgtaggtccgactaccggacctagttacncggttac

SEQ ID NO: 275391 - DNA, 652 bp, Homo sapiens
  misc_feature: GYAE6OF02FPVHH.9.50.E06.1.454.CMB.1.raw
tcagtgatacgtctcacgaccggtgctcgatttagatctactgacaacacacaagggggaggaactgctcagttaggacccagagggaaccatggaagccccagctcagcttctcttcctcctgctactctggctcccagattccaccggagaagttgtgttgacacagtctccagccaccctgtctttgtctccaggggaaagagccaccctctcctgcagggccagtcagagtcttaggagctccttagcctggtatcaacagaaacctggccaggctcccaggctcctcatctatgatgcatccaacgcgggccacgtggccactccccgagacccgtaggttaccgaggtcggcgtaggtcggggtcgtagggggtacacggtacctttcaccgttcctaccaccactccgacgactaagaacctagacgtacctaggtaaacgttattttcggacttaagttttactttaccgttagtactacgcgtaacggtcgtaaggcctaacgttcgggtacccgttacggggtacccggttccgggaacccggaaacggggtaacccgtaagggtacggaccgtaacgtaccgaaacggtacgtaaccgtaggtacggtaccttacggaccctaccgtacttccgttaccgg

SEQ ID NO: 275392 - DNA, 687 bp, Homo sapiens
  misc_feature: GYAE6OF02II12H.9.50.E06.1.454.CMB.1.raw
  modified_base (210)..(210): a, c, t, g, unknown or other
  misc_feature (210)..(210): n is a, c, g, or t
  modified_base (342)..(342): a, c, t, g, unknown or other
  misc_feature (342)..(342): n is a, c, g, or t
tcagtgatacgtctcacgaccggtgctcgatttagatctactgacaacacacaagggggaggaactgctcagttaggacccagagggaaccatggaagccccagctcagcttctccttcctcctgctactctggctcccagattcccaccggagaagtttgtgttgacacagtcctccagcccaccctgtcttttgtctcgaggggaaangccaccctctcctgcagggccagtcagagttcgttaggagcttccttagccttggtactcaaactacgaaacctggaccagggcctaccccgaggcctcctcacttctagtcgatcgacaactccgaaaacncgggaccacgtggacctaacgtccccagaccgtaggtttcgaggtcgggacgtagggtcgggttacgtaggggaacctaggtaaccctttccaccttcccgtacaaccacttccgacgtaccaggtaactaacggactaccgtaaggtaaggtttactttaggactttaaagtttttactacgttcgttacaaggtctaagggtccgtaagaccgtacgttcgggtcccgtacgggttaccggttacggaacccggtaaagggtaaccggaagtacggtaccaagttaacgaacgacgttaaacgtgggttcgaccggtacgtaccctaacgtacgttccgtacg

SEQ ID NO: 275393 - DNA, 757 bp, Homo sapiens
  misc_feature: GYAE6OF02IMVGC.9.50.E06.1.454.CMB.1.raw
  modified_base (201)..(201): a, c, t, g, unknown or other
  misc_feature (201)..(201): n is a, c, g, or t
  modified_base (210)..(210): a, c, t, g, unknown or other
  misc_feature (210)..(210): n is a, c, g, or t
  modified_base (236)..(236): a, c, t, g, unknown or other
  misc_feature (236)..(236): n is a, c, g, or t
  modified_base (245)..(245): a, c, t, g, unknown or other
  misc_feature (245)..(245): n is a, c, g, or t
  modified_base (289)..(289): a, c, t, g, unknown or other
  misc_feature (289)..(289): n is a, c, g, or t
tcagtgatacgtctcacgaccggtgctcgatttagatctactgacaacacacaagggggaggaactgctcagttaggacccagagggaaccatggaagccccagctcagcttctcttcctcctgctactctggctcccagattccaccggagaagttgtgttgacacagtctccagccacctgtctttgctcgaggggaangccaccctntcctgcaggccagtcagagtctaggngtctcctancctggtactcaacagaacctggaccaggcctcccgaggctaccncatctatgaatgacactaccaacgacggaccacgtggacacttcccgagccgtaggttacacggtggacgtaggttggggtactacggggactaggtaactttccgaacttcctaccactaaatcgaacgtaccgaaagaacgtaaggaactcccgttaaggtaaacggtttaacgtttttacggtccgtttaaaaggttttttaaacgtttaacgtttacggttaaccgtaacggtaaccggtacggtaccgtttaacggtaacccgtaaacgggttcgggtacccggtttaaccggggttaacccgggtttacccggaaaccgggtaaaccggggtaaaccgttaaacggggttaacgggtaaaccggtaaacggttaaccgaaaacgggtaaccggttaaacggttaacggttacggggtaccgtaccggttaaccggaacccgttaacgtaccgttttaaccgg

SEQ ID NO: 275394 - DNA, 777 bp, Homo sapiens
  misc_feature: GYAE6OF02JZMQL.9.50.E06.1.454.CMB.1.raw
  modified_base (209)..(209): a, c, t, g, unknown or other
  misc_feature (209)..(209): n is a, c, g, or t
  modified_base (729)..(729): a, c, t, g, unknown or other
  misc_feature (729)..(729): n is a, c, g, or t
  modified_base (747)..(747): a, c, t, g, unknown or other
  misc_feature (747)..(747): n is a, c, g, or t
  modified_base (760)..(760): a, c, t, g, unknown or other
  misc_feature (760)..(760): n is a, c, g, or t
tcagtgatacgtctcacgaccggtgctcgatttagatctactgacaacacacaagggggaggaactgctcagttaggacccagagggaaccatggaagccccagctcagcttctcttcctcctgctactctggctcccagattccaccggagaagttgtgttgacacagtctccagcctaccctgttctttcgtctccaaggggaaacncgccaaccctctcctgcgagggcctagtcaggacgttccttagggactccttccttaaggccttagggtactaccaaacgtaacggtaaaccgttcggaccgaacgggtcctacccggaacggtcccttacccgtactaactaccgttaagtcggtaacttcgaccctaagttacccaaacggtacgggtacccctaaggtcggaacctaccgttaccccgaacggtcccgttaaacggtttcaacgggtccgggtcgtaacggggtttcgggtacccggttaagggggaaaccctagggttaaccctttcgtaaacccgtttccgtaaccaacccgtacgttaccggaacgtcgtaaacggtaaccggtaacggtaacgttcccggtaaagttaacgtttaacgttttccggactttaaagttttacgtacgttacgttaacgcgtaacgcgttacgtaacgttaccacgtcgggtaccctgggttaaccgtccggaaggacgtaacaggtcgaacgtnaacggactaggtaaccgngttcggcgtaacnctaacgtactcgttacg

SEQ ID NO: 275395 - DNA, 614 bp, Homo sapiens
  misc_feature: GYAE6OF02HP3ED.9.50.E06.1.454.CMB.1.raw
  modified_base (206)..(206): a, c, t, g, unknown or other
  misc_feature (206)..(206): n is a, c, g, or t
  modified_base (243)..(243): a, c, t, g, unknown or other
  misc_feature (243)..(243): n is a, c, g, or t
  modified_base (502)..(502): a, c, t, g, unknown or other
  misc_feature (502)..(502): n is a, c, g, or t
tcagtgatacgtctcacgaccggtgctcgatttagatctactgacaacacacaagggggaggaactgctcagttaggacccagagggaaccatggaagccccagctcagcttctcttcctcctgctactctggctcccagattccaccggagaagttgtgttgacacagtctccagccaccctgttctttgtctccgaggggaaancgccaccctctcctgcagggccagtcagagtctaggngctcctagcctggtatcaacagaaaccgtggaccaggcctaccccgaggccttcctcatctatggatgaccatacccgaacgacgggcctaacgtggacctacgtccccgagcccgtaggttaccagggttcggacgtaggttcgggtcgtagggactacgtacttcacctcctacacctatcgaacgacaaggtactaagacgtactagtagttattttcgaacttagttttacttacgttgtacagtcgagcgtaanaccgaacgttcggaccgtacgggttccgtacggaacgtaaccgggacgtaaggcggtaacgacgtacgaacggccgtaacgtggtacggctacgtacccactacgtcttccg

SEQ ID NO: 275396 - DNA, 731 bp, Homo sapiens
  misc_feature: GYAE6OF02FIFZF.9.50.E06.1.454.CMB.1.raw
  modified_base (205)..(205): a, c, t, g, unknown or other
  misc_feature (205)..(205): n is a, c, g, or t
  modified_base (244)..(244): a, c, t, g, unknown or other
  misc_feature (244)..(244): n is a, c, g, or t
tcagtgatacgtctcacgaccggtgctcgatttagatctactgacaacacacaagggggaggaactgctcagttaggacccagagggaaccatggaagccccagctcagcttctcttcctcctgctactctggctcccagattccaccggagaagttgtgttgacacagtctccagccaccctgtctttgtctccgaggggaaanagccaccctctcctgcagggccagtcagagtcttagganctcttagcctggtatcaacagaaacctggaccaggcctccccgaggcctcctcatctatgatgcatccaacgacgggcccagtggccacgtccccagtcccgtaggtttccagggttcgggacgtaggggttcggggtcgtacggggaacctaggtaccctttaccgaaccttcccgttaaccaacccctagttacccgaacggccgtaaacgtaaccgttaaagggaaccggtcccgttaaggtaaacgtttacgttttttcggaacccttttaaaggttttttaaccttttaaccgttacggttacctaacggtaccgttaacggtaccggttaacgaccgtaaaccggttcgggtaccccgtttacgggtacccggtttaccgggaccggtaaacgggaacccgtaagggtcggaacgtaacggtacgaacggtaccgtaacgttgggtacgtccgtacggaccctaacgtacgttccgttacg

SEQ ID NO: 275397 - DNA, 834 bp, Homo sapiens
  misc_feature: GYAE6OF02H7D9Q.9.50.E06.1.454.CMB.1.raw
  modified_base (207)..(207): a, c, t, g, unknown or other
  misc_feature (207)..(207): n is a, c, g, or t
tcagtgatacgtctcacgaccggtgctcgatttagatctactgacaacacacaagggggaggaactgctcagttaggacccagagggaaccatggaagccccagctcagcttctcttcctcctgctactctggcctccagacttccgaccggagaagttgtgttgacacagtctccagccacctgttctttgtctccgaggggaaanacgcccaccctctcctgcgagggccagtcagtacgttcgttaggacgtcttaccgttagccgttggtactacaacgaacgtaaaccgtcggaccgacggcctaccccgaggccttccgtctaacttctacgtgacgttcgactaccgtaccgaaccgacgggaccctacggtacgggacctaccgtaccccgaacggtaccggtaacggttcgaacgggtacgggcgttaagggggttccggggttaccggttagggggaacctacggtttacctttacccgtaccgttaccctaccgaaccctacgtaccgtaacgaccggtaacgttaaaccgtaacgggtaccgtaccgggttaagtaaacggtttttacgttttacgggaacgtttttaagtttttaaccgtttaacgttcgtttaacggacgtacggtaacggttacggtaacgtacccgttaaaccggttccgggtacccggttaccgggttacccggttacgggaaaacccggtaaaccggggtaacgttaaacgggtaccgggaacctaacggttaaccggaaacggtaccggtaaacgttcgggtacggtaccgtaccgtacccgtaacgttaccgttcgttaacccg

SEQ ID NO: 275398 - DNA, 758 bp, Homo sapiens
  misc_feature: GYAE6OF02JI593.9.50.E06.1.454.CMB.1.raw
  modified_base (164)..(164): a, c, t, g, unknown or other
  misc_feature (164)..(164): n is a, c, g, or t
  modified_base (722)..(722): a, c, t, g, unknown or other
  misc_feature (722)..(722): n is a, c, g, or t
tcagtgatacgtctcacgaccggtgctcgatttagatctactgacaacacacaagggggaggaactgctcagttaggacccagagggaaccatggaagccccagctcagcttctctttcctcctgctactctggctccagacttccaccggagaagttgtgttnacactagtcctcagcccaccttgttcctttagtctaccgaggggtaacagcccaccctctcctgcacgggccagtcagcgtacttaggactcctccttagccttggacttcaacgaaccgtaaacctcgggaccaacggtcctccccagggtcttcctacaattctatcgatacgctaacacccgaaacgtccggccaacgtggacctaaccgtcccgaacgccggttcgttacgagttccggaaccggttggtccgggttcggtaaacgggactacgggtaccctttacccgtaccttccgtaaccaaccttacgttaaccgaccgaccgtaaataacccggtactaccggtacttaacggaagtttacgtttacggtattaaacgttttttacttaaacggtctaaacggtcgacctacggttccgtaacgtacccgtaacggtggtaccccgttaggttacgggttacccgtaaccggggaacgttaaccccgggtaaaggttcggaaacggtactaaaccgggttaaacgaccggtttacgtaacccgggtttnacggtaccgaacccggtaacttccgttaccggttac

SEQ ID NO: 275399 - DNA, 676 bp, Homo sapiens
  misc_feature: GYAE6OF02JGIH2.9.50.E06.1.454.CMB.1.raw
  modified_base (204)..(204): a, c, t, g, unknown or other
  misc_feature (204)..(204): n is a, c, g, or t
tcagtgatacgtctcacgaccggtgctcgatttagatctactgacaacacacaagggggaggaactgctcagttaggacccagagggaaccatggaagccccagctcagcttctcttcctcctgctactctggctccagattccaccggagaagttgtgttgacacagtctccagccaccctgtctttgtctaccgaggggaanacgcccaccctctcctcgcgacgggccagtcgagtagtccttaggacgtccttaccgttagccttggtactacaacaacgaaaccgtggaccaggcctaccccgaggccttcctacattacctagtggactcgactactaccgaacgacgggacccacgtcggaccacctacccgacgtaccgtacggttcgagggtcggacgtagggttcggggtcgaggggactacgttaccttcgaccttaccgtacacctacttacgagtaccaagttaacgtcggacgtacgtaagtagttacttttacgacgtttaagttttactacgttgtaactgacgtgtacgtacgacgtaccgtcgggtacccgttcggtacgttaccggaacgtaaccggaccgtaaggttcgaacgttaacgtacgaaacggtcgtaacgttcggacggtcgtaccgaccgtaacgtctttccgtacgg

SEQ ID NO: 275400 - DNA, 611 bp, Homo sapiens
  misc_feature: GYAE6OF02I6CPZ.9.50.E06.1.454.CMB.1.raw
  modified_base (170)..(170): a, c, t, g, unknown or other
  misc_feature (170)..(170): n is a, c, g, or t
  modified_base (209)..(209): a, c, t, g, unknown or other
  misc_feature (209)..(209): n is a, c, g, or t
  modified_base (280)..(280): a, c, t, g, unknown or other
  misc_feature (280)..(280): n is a, c, g, or t
  modified_base (299)..(299): a, c, t, g, unknown or other
  misc_feature (299)..(299): n is a, c, g, or t
  modified_base (306)..(306): a, c, t, g, unknown or other
  misc_feature (306)..(306): n is a, c, g, or t
  modified_base (308)..(309): a, c, t, g, unknown or other
  misc_feature (308)..(309): n is a, c, g, or t
  modified_base (314)..(314): a, c, t, g, unknown or other
  misc_feature (314)..(314): n is a, c, g, or t
  modified_base (378)..(378): a, c, t, g, unknown or other
  misc_feature (378)..(378): n is a, c, g, or t
  modified_base (478)..(478): a, c, t, g, unknown or other
  misc_feature (478)..(478): n is a, c, g, or t
  modified_base (488)..(488): a, c, t, g, unknown or other
  misc_feature (488)..(488): n is a, c, g, or t
tcagtgatacgtctcacgaccggtgctcgatttagatctactgacaacacacaagggggaggaactgctcagttaggacccagagggaaccatggaagccccagctcagcttctcttcctcctgctactctggctcccagacttccgaccggagaagtttgtgttgacanagtctccagccaccctgttctttgtctccgaggggaaanacgcccaccctctcctgcagggccagtcagcgtcttaggacgtctccgtagccgtgtactcaacagaaccnggccacggctccagctccnattctangnngcacnccaacgacggccagcggccactcccacgtccaggtccaggtcgcgaggttcgggtctacggganacgttcctctacgtcctcccaacattccgacgaccagtacctaaggacgaccttaggaacttattttcgaactttaggtttaccttacggttgtaaccgngtcgacggtntaacgctaacgtcggtccgttacgggtaccgccggactaacgggacccgtaaggtggaactagtaccgaacggcgtaaccggtgggttaccgcggttaacgaccgttacgtcgtttacgttcg

SEQ ID NO: 275401 - DNA, 707 bp, Homo sapiens
  misc_feature: GYAE6OF02JV3W1.9.50.E06.1.454.CMB.1.raw
  modified_base (204)..(204): a, c, t, g, unknown or other
  misc_feature (204)..(204): n is a, c, g, or t
  modified_base (244)..(244): a, c, t, g, unknown or other
  misc_feature (244)..(244): n is a, c, g, or t
tcagtgatacgtctcacgaccggtgctcgatttagatctactgacaacacacaagggggaggaactgctcagttaggacccagagggaaccatggaagccccagctcagcttctcttcctcctgctactctggctcccagattccaccggagaagttgtgttgacacagtctccagccaccctgtctttgtctccaggggaaanacgcccaccctctcctgccagggccagtcagagtcttagngctccttagcctggtatcaacagtaaaccgtgaccaggcctcccagggtcctcctacattcctatcgatcgaccatacccaacgtacgggtcctaaggtttcggacaccgttaccccgacgtccgtaggttccgaggttcggcgtaggtcggtacgtagggactagtaccgtttcaacgttcctccaacgtactacgacgtacgaacgtaacgtacggacgtaccgtaaggtaacgttagttttacggacgtttaagtttactttaccgtcggttaccgtaggtaccgtagtaccggtaacgtaccgtaaccgtccggtaccgttaccggggtaaccggttaccgggtaaacccggtaaccgggtaaccgtaaacggtcggtaaccgtaacgtaacgtaaccggtaaccggtaaccgtcggtacgggtcctaccggtacctaacccgtacgttaaccgttcgg

SEQ ID NO: 275402 - DNA, 591 bp, Homo sapiens
  misc_feature: GYAE6OF02HH0Q2.9.50.E06.1.454.CMB.1.raw
  modified_base (204)..(204): a, c, t, g, unknown or other
  misc_feature (204)..(204): n is a, c, g, or t
  modified_base (547)..(547): a, c, t, g, unknown or other
  misc_feature (547)..(547): n is a, c, g, or t
tcagtgatacgtctcacgaccggtgctcgatttagatctactgacaacacacaagggggaggaactgctcagttaggacccagagggaaccatggaagccccagctcagcttctcttcctcctgctactctggctcccagattccaccggagaagttgtgttgacacagtctccagccaccctgtctttgtctccaggggaaanagccaccctctcctgcagggccagtcagagtcttaggagctctagcctggtatcaacagaaacctggaccaggctcccagcctctcatctatgatgcactccaacgacgggccagtcggacactccccagcctaggttcaggtgcaggtgggtctagggacagtaccttacacttctaccacctatccgacgacaagaactaacggacgtaccgtaggtaaagttacgttttacgactttaaggtttttactttacgttgtacgtacgtcgaacggtcgtacgacctaacgtcggtaccgttcggtacggtaccggaccgaacgggacgaagtcggaactaanacgaacgcgtaacgtggttcgacgtcggaccacgtatcgttacg

SEQ ID NO: 275403 - DNA, 866 bp, Homo sapiens
  misc_feature: GYAE6OF02H8QMM.9.50.E06.1.454.CMB.1.raw
  modified_base (211)..(211): a, c, t, g, unknown or other
  misc_feature (211)..(211): n is a, c, g, or t
tcagtgatacgtctcacgaccggtgctcgatttagatctactgacaacacacaagggggaggaactgctcagttaggacccagagggaaccatggaagccccagctcagcttctcttcctcctgctactctggctcccagacttccaccggagaagttgtgttgacacagtcctccagccctaccttgttctttgtctacgaaggggaaanacgccctaccctctccgtgccgacgggccagtcagtacgtcgttaggacgtccttccttagccgtaggtaactacaacgaacgaaccgtggaccctaagggccctacccgaggtcccttcctacgaacttctaagtcgtaacgtcgacctaaccgtaccgaaaccggaccgggtaccctacggtaccggtaccctaacccgttaccccgacggtacccggtaaggttaccgtacgggtcgacggtacgggttgggtaccggtacggggtaaccttacggttaccctttaccgaaccgtttcccaaccgtaacccgtaacgtacccgaccgggttaaccaaccgggttaaaccgtaacggaaccggttaaccgttaaagggttaaaccttttccggtttttaacggtaaccttttaaggtttttaaaccgtacccgtttaggtaaacccgtaggtaacccgtaagggtaccgttaaaccgtaccgtaaccgttcgggtacccggttaccgggttaaccggtacccgggaaaccgttaaccgggaaacccttaaggggtacccggtaagttaaccgtaaccgggtaaacccgttaacggtacccggtttagggacgttaccgtaccggaaccctacgttaccgttccgtttaaccgg

SEQ ID NO: 275404 - DNA, 746 bp, Homo sapiens
  misc_feature: GYAE6OF02HVPKZ.9.50.E06.1.454.CMB.1.raw
  modified_base (565)..(565): a, c, t, g, unknown or other
  misc_feature (565)..(565): n is a, c, g, or t
  modified_base (716)..(716): a, c, t, g, unknown or other
  misc_feature (716)..(716): n is a, c, g, or t
tcagtgatacgtctcacgaccggtgctcgatttagatctactgacaacacacaaggggggaggaactgctcagttaggacccagagggaaccatggaagccccagctcagcttctcttcctcctgctactctggctccagacttccacggagaagttgtgttgacacagtctccagccacctgtctttgactaccgaggggaaacacgccaccctctccgtagcgagggccaggtccagacgtcttaagggatctccgttagcctgggtaacactaaacgaaggaaaacctgggaccaggcctaccccgaggccttcctacgacttaccgtaatgaagttcgacctaactacccgaaaacgcggggaccccaaccgtggcctaaactccccgaacggacctaacggggtttccaacgggttacggggaccgtacggggttcggggtacgttacggggaaccaagggtaaccctttaccgaaccgttccttaacccaacctacttaccgaacgtccggtaaaacggtactaaagggaccgtaccgttagaaacgttacggtttttnaacggttaagtttttacttaacgtagttacaacggccgtaaggtaccgttaacgaccgtaaccgtacggggtaccgttcccggtaaacggttccggaaacgaaccgggtaacaaacgggttcaacgtacgaacgtaaagccggttaaacgnggttaacggtcgcgaccaacctagtcgtcg

SEQ ID NO: 275405 - DNA, 728 bp, Homo sapiens
  misc_feature: GYAE6OF02JF9L3.9.50.E06.1.454.CMB.1.raw
  modified_base (207)..(207): a, c, t, g, unknown or other
  misc_feature (207)..(207): n is a, c, g, or t
  modified_base (344)..(344): a, c, t, g, unknown or other
  misc_feature (344)..(344): n is a, c, g, or t
tcagtgatacgtctcacgaccggtgctcgatttagatctactgacaacacacaagggggaggaactgctcagttaggacccagagggaaccatggaagccccagctcagcttctcttcctcctgctactctggcctcccagtattccacggagtaagttgtgtcgacacagtctccacgccacctgtccttgtctaccgagggaaancgcccacccgtctccgtgcgacgggccagtcagtacgtgttcggacctacctacggtacgcctacggtaaccaacgacgtaactccgtacggaccgacggtcctaccccgacggtccttccgtacttacgttttagnggtaactggacctacgtaccgaaaccgacggtccctacggtacgggccgtacccgacggtaccgtaggttaccgaggtcggacgtacggtcgggtcgtacgggacacggtacttacgactcctaccgactacgtcacgacgtacgtaccgacgacgtaccgttaagaagtttactttacgttacgtttacgtttttaacttacgttacgtacgtacgtcgtacgtacggtcgtacgtaacgttcgtccgttccgttacgttacggttacggacggtaacggtaaccggtacggtacggaaccggtaccggtaacggtaaccggttacggtacggtacgtaccgtacggtacctaaccgtacgttacgttaccttacgttacccg

SEQ ID NO: 275406 - DNA, 796 bp, Homo sapiens
  misc_feature: GYAE6OF02GDQ6T.9.50.E06.1.454.CMB.1.raw
  modified_base (152)..(152): a, c, t, g, unknown or other
  misc_feature (152)..(152): n is a, c, g, or t
  modified_base (203)..(203): a, c, t, g, unknown or other
  misc_feature (203)..(203): n is a, c, g, or t
tcagtgatacgtctcacgaccggtgctcgatttagatctactgacaacacacaagggggaggaactgctcagttaggacccagagggaaccatggaagccccagctcagcttctcttcctcctgctactctggctcccagattccaccgganaagttgtgttgacacagtctccagcccaccctgtctttgctccgagggaanagcccaccctctcctgcgagggcctagccgtaggacgttaccgttaggacgtcttccgttaacgccgttggtactcaaacgaacgtaaaccgtcggccgaacgggtcctaccccgacgggtacctccctaccgacttacgttacgtagtatcgctactaccaaccggaccgggacctacgtcggacctacgtacccccacggtccgtacggttcgtacggtggtaccgtagggttccggggtcgtacggggacgtacggtaaccttcgtacctccctaccgaaccctactaccggactacgaactacgtaaccggtacgtacgtacgtaacggttagttttcgtaaggtttacgttttacgtttaacgttcggtaacttaggaccgtaacgggtacgttacggaaccgttaccggtccggggtaacccggttccgggtaacccgggttacccgggtaaacccggtaaccgggtaaacgtaaccggggtacggttaacccgaagtaacccggtaaccgggtaacccgtaacggttaccgggtacgggaccggtttacgaaccccggtaaccggttacgtttacccgtttaccgg

SEQ ID NO: 275407 - DNA, 902 bp, Homo sapiens
  misc_feature: GYAE6OF02HAQ4E.9.50.E06.1.454.CMB.1.raw
  modified_base (206)..(206): a, c, t, g, unknown or other
  misc_feature (206)..(206): n is a, c, g, or t
tcagtgatacgtctcacgaccggtgctcgatttagatctactgacaacacacaagggggaggaactgctcagttaggacccagagggaaccatggaagccccagctcagcttctcttcctcctgctactctggctcccagattccaccggagaagttgtgttgacacagtctccagcccaccctgtctttgtctccgaggggaaangccaccctctcctgcagggccagtcagagtcttaggacgctccttagcctggtatacaacaagaacctggccaggcctcccgaggctcctcatctatgatcgacactaccgaaacgacgggccctacgcggacctacctaccccgacgtacccgtaggtttaccagggtcgggaccgtaggggttcggggtaccgttagggggaacctaacggttacccgttttaccggaaccctttacccgttaccccgtaacccgtacgttaacccgaacgggtaccgtaaaacggtacccgttaaacgggtaacccgtacccgtttaaaggggtaaaaccgttttacgttttttaccgggaaccgttttaaaaggtttttttaaccttttaaacccggttggtttaacccggaacggttaacccggtaacgggttaaccggttaaccggtaaaccgttaacccgggttacggggtaaccccgggttttaacccgggggttaacccgggttttaacccggggaaaccccggtaaaaccggggggttaaaccccggttaaaaaggggttccggggtaaaaaccttacccgggttaaaccgggtaaacgggtaaccccgggttaaaaccggtttcgggggttaaccgggtcccgtttaaccggggtaacccctaaccccggtttaacgtttccccgttttaccggg

SEQ ID NO: 275408 - DNA, 783 bp, Homo sapiens
  misc_feature: GYAE6OF02IK9UK.9.50.E06.1.454.CMB.1.raw
  modified_base (209)..(209): a, c, t, g, unknown or other
  misc_feature (209)..(209): n is a, c, g, or t
tcagtgatacgtctcacgaccggtgctcgatttagatctactgacaacacacaagggggaggaactgctcagttaggacccagagggaaccatggaagccccagctcagcttctcttcctcctgctactctggcctcccagacttccaccggagaagttgtgttgacacagtctccagcccaccctgttctttgtctccgaggggaaanacgcccaccctctacctgcgagggccaggtacaggagttcttagggacgtccttccgttagccgtaggttaactacgaaaccgaacggtaaaccgtcggacccgaacggtcctacccccgagggtcccttcccgtcctaacttcttaactacggtacgttcgacctactaacccgaaccggtaccggggacccaccgtcgggactaacctaccccgacgaccgtacggttaccgtagggtcggtacgtagggttacgggtccgtaggggaccgtaacgttacgttaccctaccgtccgtaccctaccgtaacgtaccgacgtaccgtaacgtaccgtaacgtacgaccgttaacggtaagtttacgttttacgttaacgtttagttttaacgttaccgttcgtaacgtacgtcggtaacgttacgtaacggtaccttaaaccggtcggtaccggttaccggttacggttcccggaaaccggtaagggaaaccgtaaggtacggtaactaacgtaccgaacggtaacgtaacgtcggtacggtcgttaccggacctaccgtacgttaccgtaccg

SEQ ID NO: 275409 - DNA, 691 bp, Homo sapiens
  misc_feature: GYAE6OF02H31LR.9.50.E06.1.454.CMB.1.raw
tcagtgatacgtctcacgaccggtgctcgatttagatctactgacaacacacaagggggaggaactgctcagttaggacccagagggaaccatggaagccccagctcagcttctcttcctcctgctactctggctcccagattccaccggagaagttgtgttgacacagtctccagccaccctgtctttgtctccgaggggaaagagcccaccctctcctgcagggccagtcagagtcgttaggagctccttagcctggtatcaacagaaacctggccaggcctcccaggctcctcatctatgatgcatcccgaacgcgggtccacgtgggcctactccccacgcctaacgggtttcgaggtcggacgtacggtcggggtttacgcgggggaacacggtaccttaccgtaccttccgtaccacctacttaccacgcaaggtaccttagggacgtaccgtaacggaaggttacgttttttggacctttaaggttttttaactttacgttacgtttacaacgccgttaacggtccgttaaggaccgtaacgttaccgggtcccgtttccggggtacccggttaccggtaacccggtaaccgggaacccgtaacggtacgggaacctaacggtaccgaaacggtaccgtaacgtaggttcggccgttacgacccgtacgttacgttccgttacg

SEQ ID NO: 275410 - DNA, 616 bp, Homo sapiens
  misc_feature: GYAE6OF02HN35P.9.50.E06.1.454.CMB.1.raw
  modified_base (152)..(152): a, c, t, g, unknown or other
  misc_feature (152)..(152): n is a, c, g, or t
  modified_base (205)..(205): a, c, t, g, unknown or other
  misc_feature (205)..(205): n is a, c, g, or t
  modified_base (462)..(462): a, c, t, g, unknown or other
  misc_feature (462)..(462): n is a, c, g, or t
  modified_base (476)..(476): a, c, t, g, unknown or other
  misc_feature (476)..(476): n is a, c, g, or t
tcagtgatacgtctcacgaccggtgctcgatttagatctactgacaacacacaagggggaggaactgctcagttaggacccagagggaaccatggaagccccagctcagcttctcttcctcctgctactctggctcccagattccaccgganaagttgtgttgacacagtctccagcccaccctgtctttgctccgaggggaaancgccaccctctcctgcagggccagtcagagtcttaggacgtcttcctagcctggtatcaacagaacctggccaggcctcccgagctcctcatctatgatcgacactccaacgcgggccagtggaccacgtccccagccgtaggttccaggtcggactaggtcgggtactagggacagtaccttcactctacaccatcagacagacgtacgagacctagtaacgttatttacgacttaagtttacttacgtcgtacanacgtagaccggtanacgtaaccgtgtacccgtacggtacggttaccggaaccgtaacgggaacccgtaagtacggtaacctaggtaccgaaacggtaccgtaacgttgggtaaccggtacgtaccggaaccctaccggttactacgttacccgg

SEQ ID NO: 275411 - DNA, 814 bp, Homo sapiens
  misc_feature: GYAE6OF02FLRIR.9.50.E06.1.454.CMB.1.raw
  modified_base (243)..(243): a, c, t, g, unknown or other
  misc_feature (243)..(243): n is a, c, g, or t
tcagtgatacgtctcacgaccggtgctcgatttagatctactgacaacacacaagggggaggaactgctcagttaggacccagagggaaccatggaagccccagctcagcttctcctcctcctgctactctggcctcccagattccaccggagaagttgtgttgacacagtctccagccacctgtctttgtctccgagggaatcgcccaccctctcctgcgcgggccagtcagagtcttaggngtccttccttacgccttggtactcaacacgtaaaccgtcggaccaggccctcccgacggtccctcctacaacttcgtagttgaacgttggaccctaacgttaaccccgaaacggtacggggacccctacgggtacgtaccccgtaccgttcccccgaaccggtacccgtaacgggtttacccgtaggggtaccgggggtaccctaagggggtttccgggggtttaacccgggtacgggggaaaacccgttacgggtttaacccggttttaccccctacccgttcccggtaccctaaccccgtataccggtaacgaccgtaacgtaacgttaaccggacgttacccgtaaggtaaccgttacttttaacgggtacctttaaaggttttactttaccggtcgttacgtacggttacgaccgggttactaccggtaccgtaacgtccggtaccgtaccggttaccgtaccgggtaccgaaccgggtaaccgtaacggtacggtactaacggtaactaaccggtaacggaaccgtttaggccgtacgtacggtaccgacctacgtaccgttaccg

SEQ ID NO: 275412 - DNA, 724 bp, Homo sapiens
  misc_feature: GYAE6OF02JE4R5.9.50.E06.1.454.CMB.1.raw
  modified_base (205)..(205): a, c, t, g, unknown or other
  misc_feature (205)..(205): n is a, c, g, or t
tcagtgatacgtctcacgaccggtgctcgatttagatctactgacaacacacaagggggaggaactgctcagttaggacccagagggaaccatggaagccccagctcagcttctcttcctcctgctactctggctcccagattccaccggagaagttgtgttgacacagtctccagccaccctgtctttgtctccgaggggaaanagcccaccctctcctgcagggccagtcagtagtcttaggacgtcctccttagcctggtactcaacagaaacctggaccaggcctcccaggcctcctcattctatgtatgacacgtaccaacgacggggacccaccgtacgggctaccgtccccgacggacccgtagggtttccagggttcgggtccgtaggttcggggtactacgggggtaacctacgtaccttaccgacctttcctaccgtaaccctagtacccgagtacccgaacgtaaccgtaaggaccgttaccgtacggtaaaaggtttcgtttttacggtaccgtttaaggtttttaacttacccgttggttacctagggtcctaacggtacgttaacgaccgtacgttaccgggtccgttaaccgggtcggttacccggaaccggaacgggtaaccgtaacggtacggaaccgtaggtaccgaacggtaccgtaaccgttaggtacggtaccgttccgaccgtaacgtccgtttcttaccgg

SEQ ID NO: 275413 - DNA, 626 bp, Homo sapiens
  misc_feature: GYAE6OF02I1B80.9.50.E06.1.454.CMB.1.raw
  modified_base (202)..(202): a, c, t, g, unknown or other
  misc_feature (202)..(202): n is a, c, g, or t
  modified_base (237)..(237): a, c, t, g, unknown or other
  misc_feature (237)..(237): n is a, c, g, or t
  modified_base (282)..(282): a, c, t, g, unknown or other
  misc_feature (282)..(282): n is a, c, g, or t
  modified_base (296)..(296): a, c, t, g, unknown or other
  misc_feature (296)..(296): n is a, c, g, or t
tcagtgatacgtctcacgaccggtgctcgatttagatctactgacaacacacaagggggaggaactgctcagttaggacccagagggaaccatggaagccccagctcagcttctcttcctcctgctactctggctcccagattccaccggagaagttgtgttgacacagtctccagccacctgtctttgtctccaggggaangccacctctctgcaggccagtcagagtcttagganctcctagcctggtatcaacagaaacctgccagctccagcctcctnatctatgatcgganactccaagacgggcctaacctcgggtaccactaccccgtagacccgtaggtttcaaggtgggtccgtaaggttggggtcgttcggggaactacgtaaccgtttccaacttctaccaccagtcaggacaacgtagtacgacgtaccgtagaagttactttcgacttaagttttacttaacgttcgtactacggtccgagtacgtaactcgtaaccggtcggtaccgttaccgggtaccggttccgggaacgtaaccggggacctaaggtcggaactaacggttccgaaagtcaacggttggacggttcgactaccgacttcggtccttacg

SEQ ID NO: 275414 - DNA, 725 bp, Homo sapiens
  misc_feature: GYAE6OF02JGQW4.9.50.E06.1.454.CMB.1.raw
  modified_base (208)..(208): a, c, t, g, unknown or other
  misc_feature (208)..(208): n is a, c, g, or t
tcagtgatacgtctcacgaccggtgctcgatttagatctactgacaacacacaagggggaggaactgctcagttaggacccagagggaaccatggaagccccagctcagcttctcttcctcctgctactctggcctcccagacttccaccggagtaacgttgtgttgacacagtctccagccacctgtctttgtctccgagggaaacncgaccaccctctcctgccagggccagtcagtgtcttaggctctccgttagccgtgtatcaacgagaacctggaccaaggtcctacccgaggtcctacctcacttctacgtgactgcctaagtacccgaagcggcctacgtcgcacctccaggtccgtaaggttcaagggtccggagtcgggtcgggtacgtaggggacctaaggtaccctttcgaccgttccaccgtactatccgaacgtacgtaaacggtaccgtaacggacgtaccgtaggttaaacgttacgttttacggacgttttaacgttttactttaaccgttggtaaccgtaggtaccgtaggttacccggttacgaaccgtaaccgggttacgggttcccggtaacggttaccgggttacccggaacccggtaacgggtaaacctacgggttaacggtaaccgtaaccggtaagaccggtaaccgtacgggtttacgacggttaccgtaccggaccgaacgttaccggttacgttccg

SEQ ID NO: 275415 - DNA, 610 bp, Homo sapiens
  misc_feature: GYAE6OF02GDL2X.9.50.E06.1.454.CMB.1.raw
  modified_base (200)..(200): a, c, t, g, unknown or other
  misc_feature (200)..(200): n is a, c, g, or t
  modified_base (209)..(209): a, c, t, g, unknown or other
  misc_feature (209)..(209): n is a, c, g, or t
  modified_base (227)..(227): a, c, t, g, unknown or other
  misc_feature (227)..(227): n is a, c, g, or t
  modified_base (234)..(234): a, c, t, g, unknown or other
  misc_feature (234)..(234): n is a, c, g, or t
  modified_base (247)..(247): a, c, t, g, unknown or other
  misc_feature (247)..(247): n is a, c, g, or t
  modified_base (252)..(252): a, c, t, g, unknown or other
  misc_feature (252)..(252): n is a, c, g, or t
  modified_base (337)..(337): a, c, t, g, unknown or other
  misc_feature (337)..(337): n is a, c, g, or t
  modified_base (339)..(339): a, c, t, g, unknown or other
  misc_feature (339)..(339): n is a, c, g, or t
tcagtgatacgtctcacgaccggtgctcgatttagatctactgacaacacacaagggggaggaactgctcagttaggacccagaggaaccatggaagccccagctcagcttctacttcctcctgctactctggctccagattccacggagaagttgtgttgacacagtctccagccacctgtctttgctccgagggaaangccaccgtntcctgcagggcagtcagntctaggnctctagctggatnaacanaaacctggaccagctaccaggctacctctatcctatcgatcgcataccaagacggccacgtgctactacccgagccgtagtcagngngacgtggcgtcggacgtagacttcacttccgtaccaactataccgagtacgtaacgaacgtacgtacgtaccgtaagtaagtaacgtttgaccgttaagtttacgtttacgtactaccgtaagtacgacgtacgtacgtacctaaacgtccggtaccttaccgggaccgtacggtaaccgtaacggtaaccgaacggttacggaaccgtaacgtacgtaacgaacggtaacgttacgacggtacgtaacgtaccgacgtactacgttaccg

SEQ ID NO: 275416 - DNA, 878 bp, Homo sapiens
  misc_feature: GYAE6OF02GGXPU.9.50.E06.1.454.CMB.1.raw
  modified_base (865)..(865): a, c, t, g, unknown or other
  misc_feature (865)..(865): n is a, c, g, or t
tcagtgatacgtctcacgaccggtgctcgatttagatctactgacaacacacaagggggaggaactgctcagttaggacccagagggaaccatggaagccccagctcagcttctcttcctcctgctactctggcctcccagtacttcccaccggagtaagttgtgttcgacactagtcctccgacgccctacccttcgttctttcgtacctcccggtaagggggaaaacgacgaccctaccctcctccgtacggacgacgggaccaggttaccaaggtacgtttacgttaacggtacgtacctttacccgttaacgggcccgttagggttaacttaacccgaaaacccgaaaccggtaaaaacccgtcggggaacccgtaaacgggtcccccttacccccggaacgggtcccttaccccgttaacctaacttacccgttaaggttacggaaacgttcggaccttaaaccgtaccccgaaacggtaccgggaccctaacggtccggactaaccggtccccgtagacccggtaacggtttacgaacgggtccggtagggacgggtttacggggtacggtacgggaaccttacgtaccgtttcccgtaaccgttccctacaaccgtacgtacgaactagaacgaccgtaagacgtaccgtaaggtacttacgtttgtaacgtttatttaactttacgcggttacgatacgaagtttacgaacgttccgtaaccgtccgttaccgggtaaccgtacccggttacggaaacccggtaaacgggaaccgtaacggtaccggaacggaaaccttaacgggaacccgtaaacgggtaccgttacgcgggtacctaccggattaaccccggttnttacccggtaccg

SEQ ID NO: 275417 - DNA, 682 bp, Homo sapiens
  misc_feature: GYAE6OF02I8ZJP.9.50.E06.1.454.CMB.1.raw
tcagtgatacgtctcacgaccggtgctcgatttagatctactgacaacacacaagggggaggaactgctcagttaggacccagagggaaccatggaagccccagctcagcttctcttcctcctgctactctggctccagattccaccggagaagttgtgttgacacagtctccagccaccctgtctttgtctccgaggggaagagccacctctcctgcagggccagtcagtacgttcgtaggagtcttccttagcctggtactacaacgacgtaaaccgtcggccaggcctcccgaggcctccgtacaacttcttacgtgtacgttgacctactaccgaacggtacggccacgtcggaccactacccgagtaccggtaggttccgaggtggtacggtggttcgggtacgtacgggacgacgtaccgttacaccttacgtaccactacgactacgactacgacgtagacgtacgtacggaagttacgtttacgtacgttaagttttacttaacgttcgtacgtacgacggtacgttacgtacgtacccgtaacgttcggtcccgttacgggttaccggtaccggtaccggaacgggtaaccgagggtcggtaacggtaataaccgaaggacccgttaagtaccgggtacggtcggtacgacccgaaccgttacgtcgttaccg

SEQ ID NO: 275418 - DNA, 842 bp, Homo sapiens
  misc_feature: GYAE6OF02JBU7Z.9.50.E06.1.454.CMB.1.raw
  modified_base (98)..(98): a, c, t, g, unknown or other
  misc_feature (98)..(98): n is a, c, g, or t
  modified_base (208)..(208): a, c, t, g, unknown or other
  misc_feature (208)..(208): n is a, c, g, or t
  modified_base (357)..(357): a, c, t, g, unknown or other
  misc_feature (357)..(357): n is a, c, g, or t
tcagtgatacgtctcacgaccggtgctcgatttagatctactgacaacacacaagggggaggaactgctcagttaggacccagagggaaccatggaanccccagctcagcttctcttcctcctgctactcgtggcctccagacttccgaccggagtaagttgtgtgacacgagtctccagccacctgttctttgtcctacgagggaancgcctaccctctccgtgcgacgggaccagtaccgagtacgtcgttaaggacgtcctacgtttacgccgttaggtactactaaacgaacgtaaaccgtcggacctacgggacctaccccgaggtcctacccgtactacgtttactaagtntaacgtcgtaacctaccgtaaccgaacggaaccgggtaccctaacggtccggtaacctacccgacccgtaacggtacccgttaacggtttaccgaacgggtcgggttaccgtaaaggggggtcggttaccggtaaacggggtacctaacggttaccctttccgaacccgtttaccgtaccctaacgttccgtacctaaacgtccgtaaaccgtaacgtaaccggtacgttaccggtaagtaaactttaccgtttacggtaaccgttttaattttacgttcttaacggtacctagaccgtaacgtacgggttaaccgaccgtaaccggttcgggtaacccggtttaccgggtaacccgtaccggaaaccgggtaaaccggaaccggttaacgggttaaccgaccgtaacggttaacggtaaccggtaacggttaccttgggggttaacctcggtaccgtaaccccgactttaccggtcctttaccg

SEQ ID NO: 275419 - DNA, 633 bp, Homo sapiens
  misc_feature: GYAE6OF02FUY7U.9.50.E06.1.454.CMB.1.raw
  modified_base (244)..(244): a, c, t, g, unknown or other
  misc_feature (244)..(244): n is a, c, g, or t
  modified_base (263)..(263): a, c, t, g, unknown or other
  misc_feature (263)..(263): n is a, c, g, or t
  modified_base (290)..(291): a, c, t, g, unknown or other
  misc_feature (290)..(291): n is a, c, g, or t
  modified_base (300)..(300): a, c, t, g, unknown or other
  misc_feature (300)..(300): n is a, c, g, or t
  modified_base (493)..(493): a, c, t, g, unknown or other
  misc_feature (493)..(493): n is a, c, g, or t
tcagtgatacgtctcacgaccggtgctcgatttagatctactgacaacacacaagggggaggaactgctcagttaggacccagagggaaccatggaagccccagctcagcttctcttcctcctgctactctggcctcccagattccaccggagaagttgtgttgacacagtctccagcccaccctgtctttgtctccgaggggaaaacgcctaccctctcctgcagggccagtcagatctaggnctccttagctgtactcaanacgaactcggcagcctccgagctcctnntctatgacngaccatccaacgtgggcccacgtgaccacgttccccagtccgaaggtttccaggtcgtacgacggttggggtaccttagggaacgaacgtacctttccaaccgttccgtaccaaccgtactacgacggacgtacgtaaccgttaggaaccgtccgtaaggtaacgttatttcggtacttagtttacgtttacncgtactacgcgtacgacttacgacctaacgttcggcccgttaggtaccgttcggaccgtaaccggacgtaacggtcgtacgtacgtacgaacgtacggtaacgtcgtaggccgttacgacgtaccctacgttcgttaccg

SEQ ID NO: 275420 - DNA, 781 bp, Homo sapiens
  misc_feature: GYAE6OF02HN6Q7.9.50.E06.1.454.CMB.1.raw
  modified_base (204)..(204): a, c, t, g, unknown or other
  misc_feature (204)..(204): n is a, c, g, or t
tcagtgatacgtctcacgaccggtgctcgatttagatctactgacaacacacaagggggaggaactgctcagttaggacccagagggaaccatggaagccccagctcagcttctcttcctcgtgctactctggcctcccagattcccacggagaagttgtgttgacacagtcctccagcccacctgttctttgctcgagggaanacgcccacctctccgtggccgacgggccagtccgagtacgtcttaagggcgcttccgtagtccgttaggtactccgaacgtaacggtaaacccgtggacccgacgggtcccctacccggaacggttcctcctacctacttacctgtaggtacaccgtactaccgtaaccaacgggtaccgcctaacgtacgccacctacccgacgtccggtagttaccgaggtcgacggtacgggttcggtacggtaaccggacgtaacgtaccgtttcccgaaccgttacccgtaaccaccgtaacgaccggaacaacgtaaaccggacgtaacggaccttacgtaaagttacgttatttcggaattttaacgtttatacggttccgtacgtacgtaccgtacgggttactaaccggtaccgtaacgggttcccggtaccggtaaccgggttccggttaacccggaaccgggttaaacgggaaccgttaaccggtacgaaccggttaacgttaaccggaaaccggtcggtttaaccggagggttaccggacgtccgttaaaacccgcgtttacgttacggtttccg

SEQ ID NO: 275421 - DNA, 653 bp, Homo sapiens
  misc_feature: GYAE6OF02FQ0DQ.9.50.E06.1.454.CMB.1.raw
  modified_base (203)..(203): a, c, t, g, unknown or other
  misc_feature (203)..(203): n is a, c, g, or t
  modified_base (261)..(261): a, c, t, g, unknown or other
  misc_feature (261)..(261): n is a, c, g, or t
  modified_base (296)..(296): a, c, t, g, unknown or other
  misc_feature (296)..(296): n is a, c, g, or t
  modified_base (313)..(313): a, c, t, g, unknown or other
  misc_feature (313)..(313): n is a, c, g, or t
tcagtgatacgtctcacgaccggtgctcgatttagatctactgacaacacacaagggggaggaactgctcagttaggacccagagggaaccatggaagccccagctcagcttctcttcctcctgctactctggctcccagattccaccggagaagttgtgttgacacagtctccagccaccctgtctttgtctccaggggaangccaccctctcctgcagggccagtcagagtcttaggatctccttagcctggtatcaanagaacctggccaggcctccgagctcctcatctagnatcgacactccgaacgngggcccacgtggaccacgtcccgagccgtaggttcaaggtcggactaggtcgggtctagggacagtaccttcgacttccacaccgtatcgaacgacgaagtaacgtacggacgtccgttagaacgttactttaggacctttaagttttaacgttacgttcgtactacgtaccgtaagttaccgtaacgtaccgtaaacgttccgggtacccgttacggggtacccgtttacgggaacccgtaaacgggtaaccgaagggtccggtaacgtaccgttaacgaaacggtaacgtaaccgttgggtacggtccgttacgacccaaccgttagtccttaaccgg

SEQ ID NO: 275422 - DNA, 644 bp, Homo sapiens
  misc_feature: GYAE6OF02IFD1T.9.50.E06.1.454.CMB.1.raw
  modified_base (200)..(200): a, c, t, g, unknown or other
  misc_feature (200)..(200): n is a, c, g, or t
  modified_base (297)..(297): a, c, t, g, unknown or other
  misc_feature (297)..(297): n is a, c, g, or t
tcagtgatacgtctcacgaccggtgctcgatttagatctactgacaacacacaagggggaggaactgctcagttaggacccagagggaaccatggaagccccagctcagcttctcttcctctgctactctggctcccagattccacggagaagttgtgttgacactagtctccagccacctgtctttgctccgagggaancgccacctctcctgcagggccagtcagagtcttaggactctccttagcctaggtaactcgaactaagaaacctggaccaggcctccgaggcctcctnaattcaagttcggaattcgacactcccgaacgagggtcccaacgtcggactaaccgtccccgagtaccgtaaggtttcaaggttggacctagggtcgggtacgtaggggaacctaggtacctttccgacttccgacctaaccgtaataccgaacgtcaaacgaacgtacgacgttaccgtagtaacgttagttttacggtacttaagttttacttacgtcgtacgtacgactagtcgtaacgtcgtacgtcggtacgtcggtaccgttcggaaccgaacggtacgtacggtacgtacgtaactacgaacgcgtaacgtgtacgcgtaccgacgtactactgttaccg

SEQ ID NO: 275423 - DNA, 871 bp, Homo sapiens
  misc_feature: GYAE6OF02ILWHX.9.50.E06.1.454.CMB.1.raw
  modified_base (249)..(249): a, c, t, g, unknown or other
  misc_feature (249)..(249): n is a, c, g, or t
tcagtgatacgtctcacgaccggtgctcgatttagatctactgacaacacacaagggggaggaactgctcagttaggacccagagggaaccatggaagccccagctcagcttctcttcctcctgctactctggctcccagattccaccggagtaagttgtgttgacacagtcctccacgccaccctgttctttgcctcgaaggggaaagacgcccaccctctcctgcagggccagtcagagtcttaggngctcctagcctaggtactacaacaacgaaccgtggaccgacggcctcccgacggtccttccctacacttactatcggtacttcgactactacccgaacgaccggggccctaacgtcggacctaccgtaccccacggtcccggtaacggttctacggggtcggaccgggtaaggggttcgggtaccggtaggggtaaacctacgggtaccttacccgtaccctttcccgtaacctaacccgtaacctacgacgtaaccggtaaacgtaaccggtttaacgggtaaccggtaccggtttaacggtaaaacgggtttttccgtttttaaggtaccctttttaaagggtttttaacctttaaccgtttccgggttaacgtaccggtacgttaacgggtaaccggttaaccgggtaacccggtaaccgggttacccggggttacccgggttaaccccggggtttaacccgggttaacccggtaaccccgggtaaacggggaacccgttaaacgggttccgggaaactaaccgggtaaccgtaaaccgggtaacggttaacgggttacggtacccggggtttaacctccgggtaaaccccgtaccccgttagttaccggtttacccgg

SEQ ID NO: 275424 - DNA, 688 bp, Homo sapiens
  misc_feature: GYAE6OF02I9VX5.9.50.E06.1.454.CMB.1.raw
  modified_base (340)..(340): a, c, t, g, unknown or other
  misc_feature (340)..(340): n is a, c, g, or t
  modified_base (385)..(385): a, c, t, g, unknown or other
  misc_feature (385)..(385): n is a, c, g, or t
  modified_base (480)..(480): a, c, t, g, unknown or other
  misc_feature (480)..(480): n is a, c, g, or t
  modified_base (564)..(564): a, c, t, g, unknown or other
  misc_feature (564)..(564): n is a, c, g, or t
  modified_base (570)..(570): a, c, t, g, unknown or other
  misc_feature (570)..(570): n is a, c, g, or t
tcagtgatacgtctcacgaccggtgctcgatttagatctactgacaacacacaagggggagaactgctcagttaggaccaggagggaaccatggaacgccccagctcagcttctcttcctcctgctactctcggcctccagattccacggagtaagttgtgttgacacagtctcacgccaccgtgttctttgcctaccgaaggggaacacgcccacctctccgtgcgacggccagtcgagtacgtcgttaggactaccgtcgttacgccgtagtactacaacaacggaacctcggacctacggcctacccgagtcctcctactacgttctaacggttacnctaccttaacgacccgaaacggtccgggaccctagtcccggtacncccgacccgtaccgtagtaaccggtccggtgtccggaacgttgggtcgggttaccggtgggaacctaagtccgtttcctaacgccgttaaacccnctaaccgtacgaacgacgtaacggtaactcggacgttctaacggttaagttcttacgtacgtttaatttagttctacgctacgntacggntaccgcgtacggtccggtaccgtgggtaccgtaccggaacgtaaccggtacgtaggaccgtaccgaagtaaccggagtaccgagttaccggcgtacgtcgtactacgtcgttccttcg

SEQ ID NO: 275425 - DNA, 748 bp, Homo sapiens
  misc_feature: GYAE6OF02G811Z.9.50.E06.1.454.CMB.1.raw
  modified_base (208)..(208): a, c, t, g, unknown or other
  misc_feature (208)..(208): n is a, c, g, or t
  modified_base (223)..(223): a, c, t, g, unknown or other
  misc_feature (223)..(223): n is a, c, g, or t
  modified_base (237)..(237): a, c, t, g, unknown or other
  misc_feature (237)..(237): n is a, c, g, or t
  modified_base (248)..(248): a, c, t, g, unknown or other
  misc_feature (248)..(248): n is a, c, g, or t
tcagtgatacgtctcacgaccggtgctcgatttagatctactgacaacacacaagggggaggaactgctcagttaggacccagagggaaccatggaagccccagctcagcttctcttcctctgctactctggcctccagattccaccggagaagttgtgttcgacacagtctccagcccaccctgtctttgtcctccgaaggggaaanacgccaccctctccngcagggcagtcagntactagggacncctcgttaagccttaggtactacgaaacgaacgtaaaccgtcggaccgtacggtcctaccccggaaggcccttacccgtacaacgttaccgtaacgtacggaacgtacggactaaccgtaccgaaacggtaacgggccctaaacggtcgggacctacgtacccaacgtcctagggtacaaggcgggtacagggttcggtacggtacggacgtaacgtcctacgaccgtacctaccaacgtacgtaacgaccgtacgtaacgtaacggtacgaaccggtcgtaacggttaaaggttctttaccgtaaggtttacgttttacttaacgtacgttacccaaggtccgacggttaacgtacgacgtaacggtcggaccgttaccgggtcgtaccgaacggtaacgggtccgtaaagggtacggtaacctaaggtacccggtaaagccgttaaacccgggtggtacgggtacctaggtaccccgaaacgttcgtaccgtttaacg

SEQ ID NO: 275426 - DNA, 681 bp, Homo sapiens
  misc_feature: GYAE6OF02GKZBJ.9.50.E06.1.454.CMB.1.raw
  modified_base (237)..(237): a, c, t, g, unknown or other
  misc_feature (237)..(237): n is a, c, g, or t
  modified_base (245)..(245): a, c, t, g, unknown or other
  misc_feature (245)..(245): n is a, c, g, or t
  modified_base (673)..(673): a, c, t, g, unknown or other
  misc_feature (673)..(673): n is a, c, g, or t
tcagtgatacgtctcacgaccggtgctcgatttagatctactgacaacacacaaggggggaggaactgctcagttaggacccagagggaaccatggaagccccagctcagcttctcttcctcctgctactctggctcccagattccaccggagaagttgtgttgacacagtctccagcccaccctgtctttgtctccgaggggaacagcccaccctctcctgcgagggccagtcagngtctaggnctccttagcctagtactacaacacgaacctggaccacggctcccgagtcctcctcattctatgatcgactactaccgaacgacggacccacgtcgactaccgtccccgagaccgtacggtactacgggtcggtacggtacgggttcgggtacgtacggggtaactacggttaaccctttccgaacccttccgtacccgtaaccacgttacccgacgaccgtaacgtaaccggtaacgaccggtaccttagggtaacgtttacgttttcgaacgtttagttttaaccttagtcgtacgtacgtaccgtacggtccgtaacgcgttaaccgggtccgtaccgtaccgggtacgttaccggaacgtaacggaccgtagtacggacaagtaccaacggccgtaacgtcggtacggactaccggacctacgtntcgtaccg

SEQ ID NO: 275427 - DNA, 839 bp, Homo sapiens
  misc_feature: GYAE6OF02FFP7H.9.50.E06.1.454.CMB.1.raw
  modified_base (659)..(659): a, c, t, g, unknown or other
  misc_feature (659)..(659): n is a, c, g, or t
  modified_base (811)..(811): a, c, t, g, unknown or other
  misc_feature (811)..(811): n is a, c, g, or t
  modified_base (822)..(822): a, c, t, g, unknown or other
  misc_feature (822)..(822): n is a, c, g, or t
tcagtgatacgtctcacgaccggtgctcgatttagatctactgacaacacacaagggggagaactgctcagttaggaccagagggaaccataggaagcccccaagtcacacgttcttcttccttcctcgtcgtactcttcgacgtcccacgtagtcctaccggacggaagttaggttgttagtacactacgtacgtacctacgaccaccccttacgttcgtttcgttacgtacccgtacggggaaaagggtacgacccgtaacccttcccttaccgttccgacggaccgggccggtacttacggacggttacgttacgttaaccggtaggtaccgttaccgtttacgttaccgtacggttaacgttaaccttaaacccgaaggtaaaacccggtcggtaccggaacggaccgtttacccccgacgggtaccgttacccctacgttacctttaacctacggttaaaggtccgtaacaccggtaaccttacccgaaaaccgtaacgggggcccgttaacctacgggtcggtaaacccttaccccggaccggtactaccgggtttacgtacggtacgggtccgacggttacggggttcggacggacttacgtaactaccctttacgatcccgtaacaacgtcgtaaccgtcgaaccggtaanacggtaacgaccgttagtaacgtttactgttaactacggtttaatacgttcgactgtacgtacgtacgtagtaccgtataccgacgttcggtaaccggtcgtacgaacgggtaacctagggtacgacgtacgtacgacggtacctacgggtnacggtctaccncgtacgcttactgtacc

SEQ ID NO: 275428 - DNA, 601 bp, Homo sapiens
  misc_feature: GYAE6OF02INK7J.9.50.E06.1.454.CMB.1.raw
  modified_base (146)..(146): a, c, t, g, unknown or other
  misc_feature (146)..(146): n is a, c, g, or t
  modified_base (164)..(164): a, c, t, g, unknown or other
  misc_feature (164)..(164): n is a, c, g, or t
  modified_base (207)..(207): a, c, t, g, unknown or other
  misc_feature (207)..(207): n is a, c, g, or t
  modified_base (217)..(217): a, c, t, g, unknown or other
  misc_feature (217)..(217): n is a, c, g, or t
  modified_base (238)..(238): a, c, t, g, unknown or other
  misc_feature (238)..(238): n is a, c, g, or t
  modified_base (277)..(277): a, c, t, g, unknown or other
  misc_feature (277)..(277): n is a, c, g, or t
  modified_base (367)..(367): a, c, t, g, unknown or other
  misc_feature (367)..(367): n is a, c, g, or t
  modified_base (396)..(396): a, c, t, g, unknown or other
  misc_feature (396)..(396): n is a, c, g, or t
  modified_base (419)..(419): a, c, t, g, unknown or other
  misc_feature (419)..(419): n is a, c, g, or t
  modified_base (444)..(444): a, c, t, g, unknown or other
  misc_feature (444)..(444): n is a, c, g, or t
  modified_base (462)..(462): a, c, t, g, unknown or other
  misc_feature (462)..(462): n is a, c, g, or t
  modified_base (465)..(465): a, c, t, g, unknown or other
  misc_feature (465)..(465): n is a, c, g, or t
  modified_base (469)..(469): a, c, t, g, unknown or other
  misc_feature (469)..(469): n is a, c, g, or t
  modified_base (487)..(487): a, c, t, g, unknown or other
  misc_feature (487)..(487): n is a, c, g, or t
  modified_base (589)..(589): a, c, t, g, unknown or other
  misc_feature (589)..(589): n is a, c, g, or t
tcagtgatacgtctcacgaccggtgctcgatttagatctactgacaacacacaagggggaggaactgctcagttaggacccagacgggaaccagtggaagccccagcctcgagcttctcttcctcctgctactcgtggctaccagnttccgacggagaagttgngttagacacagtctccagcctacctgtcttgctacgagggaanacgcctaccncgtcctgctacgggcagtacngtagcttagggatctcgtagcttggaactcacgagaacngcaggcctccgagcctcctacactctactgactgacctaactccggaacagggcttaagcgacacgccaggccttaggtcagtcggacgnggttacgcctaggggaatcgacgtttacncttacgcaccgatccaatcgaanaccgttgcgcttaggaactgtttancgttagtttactactgtntancgtnttaacgggcacttacggntccggtaacgtcgacgttcggaccgttaacggagtaacgtaccgtaaggcccaaaggtacccaaaccggttgcgggttaacgcggttacccgacgtttaacnccgtttaaccgg

SEQ ID NO: 275429 - DNA, 766 bp, Homo sapiens
  misc_feature: GYAE6OF02HVTEX.9.50.E06.1.454.CMB.1.raw
  modified_base (204)..(204): a, c, t, g, unknown or other
  misc_feature (204)..(204): n is a, c, g, or t
tcagtgatacgtctcacgaccggtgctcgatttagatctactgacaacacacaaggggggaggaactgctcagttaggacccagagggaaccatggaagccccagctcagcttctcttcctcctgctactctggctccagattccaccggagaagttgtgttgacacagtctccagcccacctgtctttgtctacgaggggaanacgcccaccctctacctgccgtagggccagtcagtagtcttaggagtccttccgttagccgtggtacactaacgaacgtaaacctcggaccacggtaccttaccgacggtccctaccctactacgttacttacgtacgtatacggtacctaactacccgtaaaacggccggtacccgtacgtacggggcctaccgtaccccggaacgtaccggttacgggtttaccaggggtttccggtacgtagggttcgggtttaccggtgggaacgtacggtaaccttccgtaaccgtctaaccgaccctaactacggacttaacgaacggtaacgtaacggtaccggtacgtaaaggttaaccgtttagttttacgacggttaaactttttaacgcctttaacggtactacggtacgacggttaaccggtactaaccgggtaccgtcggtaccggtaccggtttaaccggtcggaaaccggaacgggtaacgtacgggttagacccggttataaccggaacggtactaacggtggtaccaggtaccgtacctaacggtactcttacgg

SEQ ID NO: 275430 - DNA, 734 bp, Homo sapiens
  misc_feature: GYAE6OF02GURHX.9.50.E06.1.454.CMB.1.raw
  modified_base (212)..(212): a, c, t, g, unknown or other
  misc_feature (212)..(212): n is a, c, g, or t
  modified_base (580)..(580): a, c, t, g, unknown or other
  misc_feature (580)..(580): n is a, c, g, or t
tcagtgatacgtctcacgaccggtgctcgatttagatctactgacaacacacaagggggagactgctcagttaggacccagagggaaccatggaagccccagctcaagcttctcttcctcctgctactctggcctcccagacttccacggagtaagttgtgttggaacagagtctccagccctacctgttctttggcctacggaagggaacngcccacccgtctcctgacgaggcctaggtcagtagtcgttaggactcgttcctacgccttggtactacaaacgagaaacctcggaccaacggtcctaccgaggcctcctacgtacttccgtaatagactaggacctactacccaaaggtaccggccaacgtcggactaacgtccccgaagtacccggtaggttaccgagggttggaaccgtagggttacgggtcgtaggggaaccaggttaccgttacaccctttaccgaccctaaccactacgacggtaccctaaagtacccgttaaggaccggtaccttaagggtaaatttacgttacggacttttaaagtttacggttaacttcggacgttacgntaacggtacgttacgaccgtagtccggttcccgtacggggtaaccgttcggaaaccggaacgggaaccgttaagggtcgaaacgtaacccgttagaaacggtacaaaccgggttgacgggtcctaacggaaccgtaaccttacgcgtttacccg

SEQ ID NO: 275431 - DNA, 968 bp, Homo sapiens
  misc_feature: GYAE6OF02GJ302.9.50.E06.1.454.CMB.1.raw
  modified_base (146)..(146): a, c, t, g, unknown or other
  misc_feature (146)..(146): n is a, c, g, or t
tcagtgatacgtctcacgaccggtgctcgatttagatctactgacaacacacaagggggagaactgctcagttaggacccagagggaaccatggaacgccccagctcagctttctccttcctcctgctactctggcctcccgagtnttcccgacggagtaacgttgtgttgaaccacgtacgtcctccgacgtccctacccgttggttcctttttaggtaccctaccgggtaaacggggggaaaacgtcccgtcccccgtaaccccttctcccgttcggaccggaacgggtccctagtaccggtaacggtacggttaccggttaagggtacctaccccgtttacccgtttaacggcccgttttaaggggtaacctaaccaaacggaacccggtaaacccgtcgggacccggtacggccccgttacccgcggttcctcccgtaactattactacgttagtacgtccgaacctaccgtaaccgaacggtaccgggtccgtaacggtccgtaccgtacctccccggacttacgggttaccgttaggtaacggtcggtaccggttcgggttcgggttaaccgttacgggtaacctaccggttaccgttacccgtccgtaaccgtccctaaccgtacgttaccgaaccgtaccgaaacgtacgaaccggttacgacggtttaaacgttaaagttttacgtttccgggtttaaccgttttaacggtttttacccgttaaggttacccgtttacggaacccggttacgttacgggtaaccggttaaccggtacccgttttaacggggtcccggtaaccgggtttccgggttaaacccggttccggggaaaacccgggttaaaccgggaacggttaacgttaccggtaaacggttaacggaaccgttaacccggtaccggttagtaccggttacccgtcggtaacccgtaacgtcccgttttacgccgtttaacgg

SEQ ID NO: 275432 - DNA, 765 bp, Homo sapiens
  misc_feature: GYAE6OF02HBPCL.9.50.E06.1.454.CMB.1.raw
  modified_base (200)..(200): a, c, t, g, unknown or other
  misc_feature (200)..(200): n is a, c, g, or t
  modified_base (211)..(211): a, c, t, g, unknown or other
  misc_feature (211)..(211): n is a, c, g, or t
tcagtgatacgtctcacgaccggtgctcgatttagatctactgacaacacacaaggggaggaactgctcagttaggacccagagggaaccatggaagccccagctcagcttctcttcctcctgctactctggctcccagattccgacggagaagttgtgttgacacagtctccagcccacctgtctttgctcgagggaancgcctaccctncctgcgacggcctagtcgagtacgttcgttaaggctccttaccgttagccttggtactacgaaacgacgtaaaccgtcggaccgaacggcccttacccgaggtcccttacccttacgaacttaccttagtacgtacgttacgacgttaacccaccgtaaacggtccgggaccctaccggtacgtaccgtaccgaccccggtaacggccgttacgggtaccgtacgggtaccggtacgtacgggttcggttacgtacggggaacttaacggtaccgtttacccgtaacgtttcccgtacctaaaccgtacgtaacccgacgttaaacgaacggtacctaaacgggtaccgtacgttaacggttaagtttaccgttttagaaacgtttttacgttaagtttaccgtaacggttctaacgtccggtaacgtacggttaacgaccgtaccggttccggtccgttaccgggttacgtaccggaaccgtaacgtaccgtacgacgtaacgtcgaacgtaacgcgtaacgtggtacgacgctaacgtacctagtcgttacg

SEQ ID NO: 275433 - DNA, 818 bp, Homo sapiens
  misc_feature: GYAE6OF02G1VRU.9.50.E06.1.454.CMB.1.raw
tcagtgatacgtctcacgaccggtgctcgatttagatctactgacaacacacaagggggagactgctcagttaggacccagagggaaccatggaagccccagctcgagcttctacttcctcctgctactctgcgtcccagacttccaccggagaagttgtgttagacacagtcctccagcccacctgtctttgcgtccgaaggggaaagcgcccacccgttctccgtaggacgaccgggtcctaagtctaacgagttccgttagggactcctaccctttaggccgttaggtactaccaaacgaacgtaaaccgcggaccgacggtacctcccgaggacccttccgagtacttacgttagtgaacgtcgacctaacgttacccgaaacggacgggaccctaacggtcgggacctaccgttaccccacggaacccgtacggttccggtaagggcggtaccggttaaggggtttaccggggtacgttacggggaaccttaacgttaccttacctaccgtttaccccgaaccaaccccggttaattaccggaacgaccgtaaaaccgtcggtaaaccggtacccgtaccgttaaacgggttaaacggtttacgttttaccgggtaaacttttaacgggttaaaccgttttaccgaagttccgtacgtaacccgtaggtaccgtaccgtaccgtaaacgttcccgggtaacgttcccggggttacggttaccgaacccgggaacggtaccggtaacgtacggaaccgtaacgtacaacggtacgtaaccgttgggtaccgcgtaccacggtactacgtcttcg

SEQ ID NO: 275434 - DNA, 672 bp, Homo sapiens
  misc_feature: GYAE6OF02GWEV7.9.50.E06.1.454.CMB.1.raw
  modified_base (171)..(171): a, c, t, g, unknown or other
  misc_feature (171)..(171): n is a, c, g, or t
  modified_base (210)..(210): a, c, t, g, unknown or other
  misc_feature (210)..(210): n is a, c, g, or t
  modified_base (220)..(220): a, c, t, g, unknown or other
  misc_feature (220)..(220): n is a, c, g, or t
  modified_base (282)..(282): a, c, t, g, unknown or other
  misc_feature (282)..(282): n is a, c, g, or t
  modified_base (527)..(527): a, c, t, g, unknown or other
  misc_feature (527)..(527): n is a, c, g, or t
  modified_base (556)..(556): a, c, t, g, unknown or other
  misc_feature (556)..(556): n is a, c, g, or t
tcagtgatacgtctcacgaccggtgctcgatttagatctactgacaacacacaagggggaggaactgctcagttaggacccagagggaaccatggaagccccagcttcagcttctcgttcctcctgctactctcggctcccagtacttccaccggagaagttgtgttgacncagtctccagccaccctgtctttgtctccgaggggaacngcccaccctntccctagcacgggccaggtcaggacgtcttaggagccttcctagtccgtggtactccgaaanacggaacctcggtaccaggtcctcccacggtcctcctcgtatcctaatcgatcgactacctaccaaccgacgggaccctagtcgggccctaccgttaccccgagtccccgtaaggttaccgaaggttcggctaacggggtttccgggcgttaacggggacgtacgtacccgttacctaactcccgtcaaacctataccgacgtacaggtaacctacgacgttaccgtagtaagttactttacggntttaggtttacttacgtgtcacgtaccgngtacgtacgcaacggtcggtccgtaccgtcggttaccaagtacgggacgttaacggtacgaacggtctaacgaccgtcgaaccgtgaacggttcaacggtctaccgtatcgttacg

SEQ ID NO: 275435 - DNA, 290 bp, Homo sapiens
  misc_feature: GYAE6OF01BPGEZ.1.76.G10.1.454.CMB.1.raw
  modified_base (285)..(290): a, c, t, g, unknown or other
  misc_feature (285)..(290): n is a, c, g, or t
tcagacgagtgcgtcacgaccggtgctcgatttagtcactcatacagggccactggcatccctgacaggttcagtggcagtgggtctgggacagacttcactctcacaatcagcagactggagcctgaagattttgcagtgtattactgtcaccagtatggtagttcacctcgaacttttggccaggggaccaggctggagatcaaacgaactgtggctgcaccatctgtcttcatcttccacctcctcacgcactcgtctgagcgggctggcaaggcgcatagnnnnnn

SEQ ID NO: 275436 - DNA, 477 bp, Homo sapiens
  misc_feature: GYAE6OF02HWB27.1.76.G10.1.454.CMB.1.raw
  modified_base (124)..(124): a, c, t, g, unknown or other
  misc_feature (124)..(124): n is a, c, g, or t
  modified_base (196)..(196): a, c, t, g, unknown or other
  misc_feature (196)..(196): n is a, c, g, or t
  modified_base (246)..(246): a, c, t, g, unknown or other
  misc_feature (246)..(246): n is a, c, g, or t
  modified_base (283)..(283): a, c, t, g, unknown or other
  misc_feature (283)..(283): n is a, c, g, or t
  modified_base (286)..(286): a, c, t, g, unknown or other
  misc_feature (286)..(286): n is a, c, g, or t
  modified_base (290)..(290): a, c, t, g, unknown or other
  misc_feature (290)..(290): n is a, c, g, or t
  modified_base (295)..(295): a, c, t, g, unknown or other
  misc_feature (295)..(295): n is a, c, g, or t
  modified_base (300)..(300): a, c, t, g, unknown or other
  misc_feature (300)..(300): n is a, c, g, or t
  modified_base (306)..(306): a, c, t, g, unknown or other
  misc_feature (306)..(306): n is a, c, g, or t
  modified_base (310)..(311): a, c, t, g, unknown or other
  misc_feature (310)..(311): n is a, c, g, or t
  modified_base (313)..(313): a, c, t, g, unknown or other
  misc_feature (313)..(313): n is a, c, g, or t
  modified_base (316)..(316): a, c, t, g, unknown or other
  misc_feature (316)..(316): n is a, c, g, or t
  modified_base (318)..(318): a, c, t, g, unknown or other
  misc_feature (318)..(318): n is a, c, g, or t
  modified_base (323)..(323): a, c, t, g, unknown or other
  misc_feature (323)..(323): n is a, c, g, or t
  modified_base (328)..(328): a, c, t, g, unknown or other
  misc_feature (328)..(328): n is a, c, g, or t
  modified_base (339)..(339): a, c, t, g, unknown or other
  misc_feature (339)..(339): n is a, c, g, or t
  modified_base (343)..(343): a, c, t, g, unknown or other
  misc_feature (343)..(343): n is a, c, g, or t
  modified_base (369)..(369): a, c, t, g, unknown or other
  misc_feature (369)..(369): n is a, c, g, or t
  modified_base (385)..(385): a, c, t, g, unknown or other
  misc_feature (385)..(385): n is a, c, g, or t
tcagacgagtgcgtcacgaccggtgctcgatttagtcactcatacagggccactggcatccctgacaggttcagtggcagtgggtctgggacagacttcactctcacaatcagctagactggancctgaagtactttgcagtgtattactgtcacagtatggtagttcactgaactttggcagggccaggctgganatcaaagactgtggctgccacatctgtctcatccgtccgcagtcagaacnctactcgtctgagcggctgacgaaggcgactatgcancgnctangcatnacgtntcgatnacgnngntgnanctatnacgtntgactgtctcncgtntatcgtcgtcgtcgtactatagactnacacgtgtacgtgtgntgtctacgtcgtacgtactacgtactcactcgtactaacgacgtacgtcgtacgtacgtagtagtagtacgtactacgacgtagtcgcgacg

SEQ ID NO: 275437 - DNA, 264 bp, Homo sapiens
  misc_feature: GYAE6OF01D7ADX.8.81.H04.1.454.CMB.1.raw
  modified_base (261)..(264): a, c, t, g, unknown or other
  misc_feature (261)..(264): n is a, c, g, or t
tcagctcgcgtgtccacgaccggtgctcgatttagtagtgtagattcgcgggaagatgaagacagacttcactctcaccatcagcagcctgcagcctgatgattttgctacttattactgccaacagtatagtactttttctccggacacttttggccgggggaccaagctggagatcaaacgaactgtggctgcaccatctgtcttcatcttcccgccatctgagacacgcgagctgagcgggctggcaaggcgcatagnnnn

SEQ ID NO: 275438 - DNA, 135 bp, Homo sapiens
  misc_feature: GYAE6OF01A9ZUL.8.81.H04.1.454.CMB.1.raw
  modified_base (135)..(135): a, c, t, g, unknown or other
  misc_feature (135)..(135): n is a, c, g, or t
tcagctcgcgtgtccacgaccggtgctcgatttagtagtgtagattcgcgggctccgagagcacagcggccctgggctgcctggtcaaggactacttccgacacgcgagctgagcgggctggcaaggcgcatagn

SEQ ID NO: 275439 - DNA, 262 bp, Homo sapiens
  misc_feature: GYAE6OF01D43HO.8.81.H04.1.454.CMB.1.raw
  modified_base (259)..(262): a, c, t, g, unknown or other
  misc_feature (259)..(262): n is a, c, g, or t
tcagctcgcgtgtccacgaccggtgctcgatttagtagtgtagattcgcgggaagatgaagacagacttcactctcaccatcagcagcctgcagcctgatgattttgctacttattactgccaacagtatagtacttttctccggacacttttggccggggaccaagctggagatcaaacgaactgtggctgcaccatctgtcttcatcttcccgccatctgagacacgcgagctgagcgggctggcaaggcgcatagnnnn

SEQ ID NO: 275440 - DNA, 264 bp, Homo sapiens; identical to SEQ ID NO: 275437
  misc_feature: GYAE6OF01A5M5R.8.81.H04.1.454.CMB.1.raw
  modified_base (261)..(264): a, c, t, g, unknown or other
  misc_feature (261)..(264): n is a, c, g, or t

SEQ ID NO: 275441 - DNA, 170 bp, Homo sapiens
  misc_feature: GYAE6OF01BOUOX.8.81.H04.1.454.CMB.1.raw
  modified_base (153)..(170): a, c, t, g, unknown or other
  misc_feature (153)..(170): n is a, c, g, or t
tcagctcgcgtgtccacgaccggtgctcgatttagtagtgtagattcgcgggggaccaagctggagatcaaacgaactgtggctgcaccatctgtcttcatccttcccgccatctgagcacgcgagctgagcgggctggcaaggtcgcatagnnnnnnnnnnnnnnnnnn

SEQ ID NO: 275442 - DNA, 269 bp, Homo sapiens
  misc_feature: GYAE6OF01AKLW1.8.81.H04.1.454.CMB.1.raw
  modified_base (263)..(269): a, c, t, g, unknown or other
  misc_feature (263)..(269): n is a, c, g, or t
tcagctcgcgtgtccacgaccggtgctcgatttagtagtgtagattcgcgggaagatgaagacagacttcactctcaccatcagcagcctgcagcctgatgattttgctacttattactgccaacagtatagttactttttctccggacacgttttggccgggggaccaagctggagatcaaacgaactgtggctgcaccatctgtcttcatccttcccgccatctgagacacgcggctgagcgggctggcaaggcgcatagnnnnnnn

SEQ ID NO: 275443 - DNA, 293 bp, Homo sapiens
  misc_feature: GYAE6OF01B46Q7.8.81.H04.1.454.CMB.1.raw
  modified_base (142)..(142): a, c, t, g, unknown or other
  misc_feature (142)..(142): n is a, c, g, or t
  modified_base (259)..(259): a, c, t, g, unknown or other
  misc_feature (259)..(259): n is a, c, g, or t
  modified_base (266)..(293): a, c, t, g, unknown or other
  misc_feature (266)..(293): n is a, c, g, or t
tcagctcgcgtgtccacgaccggtgctcgatttagtagtgtagattcgcgggaagatgaagacagacttcactctcaccatcagcagcctgcagcctgatgattttgctacttattactgccaacagtatagtactttttcnccggacacttttggccgggggaccaagctggagatcaaacgaactgtggctgcaccatctgtcttcatcttcccgcaatctgacgacacgcgagctgagcgggctggaccaaggtcncaatagnnnnnnnnnnnnnnnnnnnnnnnnnnnn

SEQ ID NO: 275444 - DNA, 152 bp, Homo sapiens
  misc_feature: GYAE6OF02FX30K.8.81.H04.1.454.CMB.1.raw
  modified_base (152)..(152): a, c, t, g, unknown or other
  misc_feature (152)..(152): n is a, c, g, or t
tcagctcgcgtgtccacgaccggtgctcgatttagtagtgtagattcgcgggggaccaagctggagatcaaacgaactgtggctgcaccatctgtcttcatcttcccgccatctgagacacgcgagctgagcgggctggcaaggcgcatagn

SEQ ID NO: 275445 - DNA, 187 bp, Homo sapiens
  misc_feature: GYAE6OF02HTF18.8.81.H04.1.454.CMB.1.raw
  modified_base (152)..(187): a, c, t, g, unknown or other
  misc_feature (152)..(187): n is a, c, g, or t
tcagctcgcgtgtccacgaccggtgctcgatttagtagtgtagattcgcgggggaccaagctggagatcaaacgaactgtggctgcaccatctgtcttcatccttcccgccatctgagcacgcgagctgagcgggctggcaaggcgcatagnnnnnnnnnnnnnnnnnnnnnnnnnnnnnnnnnnnn

SEQ ID NO: 275446 - DNA, 153 bp, Homo sapiens
  misc_feature: GYAE6OF02ILU91.8.81.H04.1.454.CMB.1.raw
  modified_base (152)..(153): a, c, t, g, unknown or other
  misc_feature (152)..(153): n is a, c, g, or t
tcagctcgcgtgtccacgaccggtgctcgatttagtagtgtagattcgcgggggaccaagctggagatcaaacgaactgtggctgcaccatctgtcttcatcttcccgccatctgagacacgcgagctgagcgggctggcaaggcgcatagnn

SEQ ID NO: 275447 - DNA, 262 bp, Homo sapiens
  misc_feature: GYAE6OF02GUAVN.8.81.H04.1.454.CMB.1.raw
  modified_base (261)..(262): a, c, t, g, unknown or other
  misc_feature (261)..(262): n is a, c, g, or t
tcagctcgcgtgtccacgaccggtgctcgatttagtagtgtagattcgcgggaagatgaagacagacttcactctcaccatcagcagcctgcagcctgatgattttgctacttattactgccaacagtatagtactttttctccggacacttttggccgggggaccaagctggagatcaaacgaactgtggctgcaccatctgtcttcatcttcccgccatctgagacacgcgagctgagcgggctggcaaggcgcatagnn

SEQ ID NO: 275448 - DNA, 228 bp, Homo sapiens
  misc_feature: GYAE6OF01CR0VU.18.71.G05.1.454.CMB.1.raw
  modified_base (218)..(218): a, c, t, g, unknown or other
  misc_feature (218)..(218): n is a, c, g, or t
  modified_base (224)..(228): a, c, t, g, unknown or other
  misc_feature (224)..(228): n is a, c, g, or t
tcagtacgagtatgcacgaccggtgctcgatttagtgtcgtcgcaagagagagggtggaggctgaggatgttggagtttattactgcatgcaaggtacacactggccgctcacgctcggcggagggaccagggtggagatgaaacgaactgtggctgcaccatctgtcttcatcttcccgccatctgacatactcgtactgagcgggctggcaaggcncatagnnnnn

SEQ ID NO: 275449 - DNA, 226 bp, Homo sapiens
  misc_feature: GYAE6OF01ET85I.18.71.G05.1.454.CMB.1.raw
  modified_base (223)..(226): a, c, t, g, unknown or other
  misc_feature (223)..(226): n is a, c, g, or t
tcagtacgagtatgcacgaccggtgctcgatttagtgtcgtcgcaagagagagggtggaggctgaggatgttggagtttattactgcatgcaaggtacacactggccgctcacgctcggcggagggaccagggtggagatgaaacgaactgtggctgcaccatctgtcttcatcttcccgccattgacatactcgtactgagcgggctggcaaggcgcatagnnnn

SEQ ID NO: 275450 - DNA, 225 bp, Homo sapiens
  misc_feature: GYAE6OF01CJW1N.18.71.G05.1.454.CMB.1.raw
  modified_base (224)..(225): a, c, t, g, unknown or other
  misc_feature (224)..(225): n is a, c, g, or t
tcagtacgagtatgcacgaccggtgctcgatttagtgtcgtcgcaagagagagggtggaggctgaggatgttggagtttattactgcatgcaaggtacacactggccgctcacgctcggcggagggaccagggtggagatgaaacgaactgtggctgcaccatctgtcttcatcttcccgccatctgacatactcgtactgagcgggctggcaaggcgcatagnn

SEQ ID NO: 275451 - DNA, 225 bp, Homo sapiens
  misc_feature: GYAE6OF01DJZR4.18.71.G05.1.454.CMB.1.raw
  modified_base (223)..(225): a, c, t, g, unknown or other
  misc_feature (223)..(225): n is a, c, g, or t
tcagtacgagtatgcacgaccggtgctcgatttagtgtcgtcgcaagagagagggtggaggctgaggatgttggagtttattactgcatgcaaggtacacactggccgctcacgctcggcggaggaccagggtggagatgaaacgaactgtggctgcaccatctgtcttcatcttcccgccatctgacatactcgtactgagcgggctggcaaggcgcatagnnn

SEQ ID NO: 275452 - DNA, 226 bp, Homo sapiens
  misc_feature: GYAE6OF01EQHIE.18.71.G05.1.454.CMB.1.raw
  modified_base (225)..(226): a, c, t, g, unknown or other
  misc_feature (225)..(226): n is a, c, g, or t
tcagtacgagtatgcacgaccggtgctcgatttagtgtcgtcgcaagagagaggggtggaggctgaggatgttggagtttattactgcatgcaaggtacacactggccgctcacgctcggcggagggaccagggtggagatgaaacgaactgtggctgcaccatctgtcttcatcttcccgccatctgacatactcgtactgagcgggctggcaaggcgcatagnn

SEQ ID NO: 275453 - DNA, 227 bp, Homo sapiens
  misc_feature: GYAE6OF01APRP2.18.71.G05.1.454.CMB.1.raw
  modified_base (225)..(227): a, c, t, g, unknown or other
  misc_feature (225)..(227): n is a, c, g, or t
tcagtacgagtatgcacgaccggtgctcgatttagtgtcgtcgcaagagagaggggtggaggctgaggatgttggagtttattactgcatgcaaggtacacactggccgctcacgctcggcggagggaccagggtggagatgaaacgaactgtggctgcaccatctgtcttcatcttcccgccatctgacatactcgtactgagcgggctggcaaggcgcatagnnn

SEQ ID NO: 275454 - DNA, 227 bp, Homo sapiens; identical to SEQ ID NO: 275453
  misc_feature: GYAE6OF01AX1QY.18.71.G05.1.454.CMB.1.raw
  modified_base (225)..(227): a, c, t, g, unknown or other
  misc_feature (225)..(227): n is a, c, g, or t

SEQ ID NO: 275455 - DNA, 224 bp, Homo sapiens
  misc_feature: GYAE6OF01D989P.18.71.G05.1.454.CMB.1.raw
  modified_base (224)..(224): a, c, t, g, unknown or other
  misc_feature (224)..(224): n is a, c, g, or t
tcagtacgagtatgcacgaccggtgctcgatttagtgtcgtcgcaagagagaggggtggaggctgaggatgttggagtttattactgcatgcaaggtacacactggccgctcacgctcggcggagggaccagggtggagatgaaacgaactgtggctgcaccatctgtcttcatcttcccgccatctgacataccgtactgagcgggctggcaaggcgcatagn

SEQ ID NO: 275456 - DNA, 231 bp, Homo sapiens
  misc_feature: GYAE6OF01DBB14.18.71.G05.1.454.CMB.1.raw
  modified_base (225)..(231): a, c, t, g, unknown or other
  misc_feature (225)..(231): n is a, c, g, or t
tcagtacgagtatgcacgaccggtgctcgatttagtgtcgtcgcaagagagaggggtggaggctgaggatgttggagtttattactgcatgcaaggtacacactggccgctcacgctcggcggagggaccagggtggagatgaaacgaactgtggctgcaccatctgtcttcatcttcccgccatctgacatactcgtactgagcgggctggcaaggcgcatagnnnnnnn

SEQ ID NO: 275457 - DNA, 226 bp, Homo sapiens; identical to SEQ ID NO: 275452
  misc_feature: GYAE6OF01DZE4P.18.71.G05.1.454.CMB.1.raw
  modified_base (225)..(226): a, c, t, g, unknown or other
  misc_feature (225)..(226): n is a, c, g, or t

SEQ ID NO: 275458 - DNA, 228 bp, Homo sapiens
  misc_feature: GYAE6OF01DC62P.18.71.G05.1.454.CMB.1.raw
  modified_base (225)..(228): a, c, t, g, unknown or other
  misc_feature (225)..(228): n is a, c, g, or t
tcagtacgagtatgcacgaccggtgctcgatttagtgtcgtcgcaagagagaggggtggaggctgaggatgttggagtttattactgcatgcaaggtacacactggccgctcacgctcggcggagggaccagggtggagatgaaacgaactgtggctgcaccatctgtcttcatcttcccgccatctgacatactcgtactgagcgggctggcaaggcgcatagnnnn

SEQ ID NO: 275459 - DNA, 228 bp, Homo sapiens
  misc_feature: GYAE6OF01BFU53.18.71.G05.1.454.CMB.1.raw
  modified_base (225)..(228): a, c, t, g, unknown or other
  misc_feature (225)..(228): n is a, c, g, or t
tcagtacgagtatgcacgaccggtgctcgatttagtgtcgtcgcaagagagaggggtggaggctgaggatgttggagtttattactgcatgcaaggtacacactggccgctcacgctcggcggagggaccagggtggagatgaaacgaactgtggctgcaccatctgtcttcatcttcccgccacctgacatactcgtactgagcgggctggcaaggcgcatagnnnn

SEQ ID NO: 275460 - DNA, 229 bp, Homo sapiens
  misc_feature: GYAE6OF01DPVAE.18.71.G05.1.454.CMB.1.raw
  modified_base (223)..(229): a, c, t, g, unknown or other
  misc_feature (223)..(229): n is a, c, g, or t
tcagtacgagtatgcacgaccggtgctcgatttagtgtcgtcgcaagagagagggtggaggctgaggatgttggagtttattactgcatgcaaggtacacactggccgctcacgctcggcggagggaccagggtggagatgaaacgaactgtggctgcaccatctgtcttcatcttcccgccatctgacatactctactgagcgggctggcaaggcgcatagnnnnnnn

SEQ ID NO: 275461 - DNA, 227 bp, Homo sapiens; identical to SEQ ID NO: 275453
  misc_feature: GYAE6OF01ENP2Y.18.71.G05.1.454.CMB.1.raw
  modified_base (225)..(227): a, c, t, g, unknown or other
  misc_feature (225)..(227): n is a, c, g, or t

SEQ ID NO: 275462 - DNA, 223 bp, Homo sapiens
  misc_feature: GYAE6OF01C4NJH.18.71.G05.1.454.CMB.1.raw
  modified_base (221)..(223): a, c, t, g, unknown or other
  misc_feature (221)..(223): n is a, c, g, or t
tcagtacgagtatgcacgaccggtgctcgatttagtgtcgtcgcaagagagagggtggaggctgaggatgttggagtttattactgcatgcaaggtacacactggccgctcacgctcggcggaggaccagggtggagatgaaacgaactgtggctgcaccatctgtcttcatcttcccgcatctgacatactcgtactgagcggctggcaaggcgcatagnnn

SEQ ID NO: 275463 - DNA, 228 bp, Homo sapiens; identical to SEQ ID NO: 275458
  misc_feature: GYAE6OF01A9XVE.18.71.G05.1.454.CMB.1.raw
  modified_base (225)..(228): a, c, t, g, unknown or other
  misc_feature (225)..(228): n is a, c, g, or t

SEQ ID NO: 275464 - DNA, 226 bp, Homo sapiens; identical to SEQ ID NO: 275452
  misc_feature: GYAE6OF01C01MK.18.71.G05.1.454.CMB.1.raw
  modified_base (225)..(226): a, c, t, g, unknown or other
  misc_feature (225)..(226): n is a, c, g, or t

SEQ ID NO: 275465 - DNA, 228 bp, Homo sapiens; identical to SEQ ID NO: 275458
  misc_feature: GYAE6OF01C3OH2.18.71.G05.1.454.CMB.1.raw
  modified_base (225)..(228): a, c, t, g, unknown or other
  misc_feature (225)..(228): n is a, c, g, or t

SEQ ID NO: 275466 - DNA, 226 bp, Homo sapiens; identical to SEQ ID NO: 275452
  misc_feature: GYAE6OF01D2IR3.18.71.G05.1.454.CMB.1.raw
  modified_base (225)..(226): a, c, t, g, unknown or other
  misc_feature (225)..(226): n is a, c, g, or t

SEQ ID NO: 275467 - DNA, 225 bp, Homo sapiens; identical to SEQ ID NO: 275450
  misc_feature: GYAE6OF01CXSMX.18.71.G05.1.454.CMB.1.raw
  modified_base (224)..(225): a, c, t, g, unknown or other
  misc_feature (224)..(225): n is a, c, g, or t

SEQ ID NO: 275468 - DNA, 227 bp, Homo sapiens; identical to SEQ ID NO: 275453
  misc_feature: GYAE6OF01C9L6M.18.71.G05.1.454.CMB.1.raw
  modified_base (225)..(227): a, c, t, g, unknown or other
  misc_feature (225)..(227): n is a, c, g, or t

SEQ ID NO: 275469 - DNA, 229 bp, Homo sapiens
  misc_feature: GYAE6OF01EAV9U.18.71.G05.1.454.CMB.1.raw
  modified_base (225)..(229): a, c, t, g, unknown or other
  misc_feature (225)..(229): n is a, c, g, or t
tcagtacgagtatgcacgaccggtgctcgatttagtgtcgtcgcaagagagaggggtggaggctgaggatgttggagtttattactgcatgcaaggtacacactggccgctcacgctcggcggagggaccagggtggagatgaaacgaactgtggctgcaccatctgtcttcatcttcccgccatctgacatactcgtactgagcgggctggcaaggcgcatagnnnnn

SEQ ID NO: 275470 - DNA, 226 bp, Homo sapiens; identical to SEQ ID NO: 275452
  misc_feature: GYAE6OF01E36IC.18.71.G05.1.454.CMB.1.raw
  modified_base (225)..(226): a, c, t, g, unknown or other
  misc_feature (225)..(226): n is a, c, g, or t

SEQ ID NO: 275471 - DNA, 224 bp, Homo sapiens
  misc_feature: GYAE6OF01C7MQ8.18.71.G05.1.454.CMB.1.raw
  modified_base (223)..(224): a, c, t, g, unknown or other
  misc_feature (223)..(224): n is a, c, g, or t
tcagtacgagtatgcacgaccggtgctcgatttagtgtcgtcgcaagagagaggggtggaggctgaggatgttggagtttattactgcatgcaaggtacacactggccgctcacgctcggcggagggaccagggtggagatgaaacgaactgtggctgcaccatctgtcttcatcttcccgcatctgacatctcgtactgagcgggctggcaaggcgcatagnn

SEQ ID NO: 275472 - DNA, 229 bp, Homo sapiens
  misc_feature: GYAE6OF01DRO3A.18.71.G05.1.454.CMB.1.raw
  modified_base (218)..(218): a, c, t, g, unknown or other
  misc_feature (218)..(218): n is a, c, g, or t
  modified_base (224)..(229): a, c, t, g, unknown or other
  misc_feature (224)..(229): n is a, c, g, or t
tcagtacgagtatgcacgaccggtgctcgatttagtgtcgtcgcaagagagaggggtggaggctgaggatgttggagtttattactgcatgcaaggtacacactggccgctcacgctcggcggagggaccagggtggagatgaaacgaactgtggctgcaccatctgtcttcatcttcccgcatctgacatactcgtactgagcgggctggcaaggcncatagnnnnnn

SEQ ID NO: 275473 - DNA, 228 bp, Homo sapiens; identical to SEQ ID NO: 275458
  misc_feature: GYAE6OF01D7XU2.18.71.G05.1.454.CMB.1.raw
  modified_base (225)..(228): a, c, t, g, unknown or other
  misc_feature (225)..(228): n is a, c, g, or t

SEQ ID NO: 275474 - DNA, 227 bp, Homo sapiens; identical to SEQ ID NO: 275453
  misc_feature: GYAE6OF01EKIPN.18.71.G05.1.454.CMB.1.raw
  modified_base (225)..(227): a, c, t, g, unknown or other
  misc_feature (225)..(227): n is a, c, g, or t

SEQ ID NO: 275475 - DNA, 228 bp, Homo sapiens; identical to SEQ ID NO: 275458
  misc_feature: GYAE6OF01CMMD5.18.71.G05.1.454.CMB.1.raw
  modified_base (225)..(228): a, c, t, g, unknown or other
  misc_feature (225)..(228): n is a, c, g, or t

SEQ ID NO: 275476 - DNA, 224 bp, Homo sapiens
  misc_feature: GYAE6OF01D29L5.18.71.G05.1.454.CMB.1.raw
  modified_base (223)..(224): a, c, t, g, unknown or other
  misc_feature (223)..(224): n is a, c, g, or t
tcagtacgagtatgcacgaccggtgctcgatttagtgtcgtcgcaagagagaggggtggaggctgaggatgttggagtttattactgcatgcaaggtacacactggccgctcacgctcggcggagggaccagggtggagatgaaacgaactgtggctgcaccatctgtcttcatcttcccgcatctgacatactcgtactgagcggctggcaaggcgcatagnn

SEQ ID NO: 275477 - DNA, 229 bp, Homo sapiens; identical to SEQ ID NO: 275469
  misc_feature: GYAE6OF01DGQZ7.18.71.G05.1.454.CMB.1.raw
  modified_base (225)..(229): a, c, t, g, unknown or other
  misc_feature (225)..(229): n is a, c, g, or t

SEQ ID NO: 275478 - DNA, 228 bp, Homo sapiens; identical to SEQ ID NO: 275458
  misc_feature: GYAE6OF01CPH95.18.71.G05.1.454.CMB.1.raw
  modified_base (225)..(228): a, c, t, g, unknown or other
  misc_feature (225)..(228): n is a, c, g, or t

SEQ ID NO: 275479 - DNA, 229 bp, Homo sapiens; identical to SEQ ID NO: 275469
  misc_feature: GYAE6OF01BJZPX.18.71.G05.1.454.CMB.1.raw
  modified_base (225)..(229): a, c, t, g, unknown or other
  misc_feature (225)..(229): n is a, c, g, or t

SEQ ID NO: 275480 - DNA, 257 bp, Homo sapiens
  misc_feature: GYAE6OF01A6T9J.18.71.G05.1.454.CMB.1.raw
  modified_base (225)..(225): a, c, t, g, unknown or other
  misc_feature (225)..(225): n is a, c, g, or t
  modified_base (228)..(228): a, c, t, g, unknown or other
  misc_feature (228)..(228): n is a, c, g, or t
  modified_base (231)..(257): a, c, t, g, unknown or other
  misc_feature (231)..(257): n is a, c, g, or t
tcagtacgagtatgcacgaccggtgctcgatttagtgtcgtcgcaagagagagggggtggaggctgaggatgttggagtttattactgcatgcaaggtacacactggcccgctcacgctcggcggagggaccagggtggagatgaaacgactgtggctgcaccatctgtcttcatccttcccgcatcctgaccatacctcgtactgagccgggactggcaaggcncanagnnnnnnnnnnnnnnnnnnnnnnnnnnn

SEQ ID NO: 275481 - DNA, 227 bp, Homo sapiens; identical to SEQ ID NO: 275453
  misc_feature: GYAE6OF01AR4ZN.18.71.G05.1.454.CMB.1.raw
  modified_base (225)..(227): a, c, t, g, unknown or other
  misc_feature (225)..(227): n is a, c, g, or t

SEQ ID NO: 275482 - DNA, 228 bp, Homo sapiens; identical to SEQ ID NO: 275458
  misc_feature: GYAE6OF01AZVCI.18.71.G05.1.454.CMB.1.raw
  modified_base (225)..(228): a, c, t, g, unknown or other
  misc_feature (225)..(228): n is a, c, g, or t

SEQ ID NO: 275483 - DNA, 237 bp, Homo sapiens
  misc_feature: GYAE6OF01B120F.18.71.G05.1.454.CMB.1.raw
  modified_base (230)..(237): a, c, t, g, unknown or other
  misc_feature (230)..(237): n is a, c, g, or t
tcagtacgagtatgcacgaccggtgctcgatttagtgtcgtcgcaagagagaggggtggaggctgaggatgttggagtttattactgcatgcaaggtacacactggccgctcacgctcggcggagggaccagggtggagatagaaacgaactgtggctgcaccatctgtcttcatccttcccgccatctgacatactcgtactgagcggctggacaaggcgctaagtagnnnnnnnn

SEQ ID NO: 275484 - DNA, 228 bp, Homo sapiens
  misc_feature: GYAE6OF01BGAMW.18.71.G05.1.454.CMB.1.raw
  modified_base (223)..(228): a, c, t, g, unknown or other
  misc_feature (223)..(228): n is a, c, g, or t
tcagtacgagtatgcacgaccggtgctcgatttagtgtcgtcgcaagagagagggtggaggctgaggatgttggagtttattactgcatgcaaggtacacactggccgctcacgctcggcggagggaccagggtggagatgaaacgaactgtggctgcaccatctgtcttcatcttcccgcatctgacatactcgtactgagcgggctggcaaggcgcatagnnnnnn

SEQ ID NO: 275485 - DNA, 264 bp, Homo sapiens
  misc_feature: GYAE6OF01DZXPX.18.71.G05.1.454.CMB.1.raw
  modified_base (166)..(166): a, c, t, g, unknown or other
  misc_feature (166)..(166): n is a, c, g, or t
  modified_base (221)..(223): a, c, t, g, unknown or other
  misc_feature (221)..(223): n is a, c, g, or t
  modified_base (225)..(264): a, c, t, g, unknown or other
  misc_feature (225)..(264): n is a, c, g, or t
tcagtacgagtatgcacgaccggtgctcgatttagtgtcgtcgcaagagagaggggtggaggctgaggatgttggagtttatactgcatgcaaggtacacactggccgctcacgctcggcggaggaccagggtgagatgaaacgactgtggctgcacatctgtctnatctccgcatctgacatactcgtactgacgcgggtctggacaaggcgacagtagnnncnnnnnnnnnnnnnnnnnnnnnnnnnnnnnnnnnnnnnnnn

SEQ ID NO: 275486 - DNA, 230 bp, Homo sapiens
  misc_feature: GYAE6OF01CAK6J.18.71.G05.1.454.CMB.1.raw
  modified_base (219)..(219): a, c, t, g, unknown or other
  misc_feature (219)..(219): n is a, c, g, or t
  modified_base (225)..(230): a, c, t, g, unknown or other
  misc_feature (225)..(230): n is a, c, g, or t
tcagtacgagtatgcacgaccggtgctcgatttagtgtcgtcgcaagagagaggggtggaggctgaggatgttggagtttattactgcatgcaaggtacacactggccgctcacgctcggcggagggaccagggtggagatgaaacgaactgtggctgcaccatctgtcttcatcttcccgccatctgacatactcgtactgagcgggctggcaaggcncatagnnnnnn

SEQ ID NO: 275487 - DNA, 238 bp, Homo sapiens
  misc_feature: GYAE6OF01D0CL1.18.71.G05.1.454.CMB.1.raw
  modified_base (230)..(238): a, c, t, g, unknown or other
  misc_feature (230)..(238): n is a, c, g, or t
tcagtacgagtatgcacgaccggtgctcgatttagtgtcgtcgcaagagagaggggtggaggctgaggatgttggagtttattactgcatgcaaggtacacactggccgctcacgctcggcgggagggaccgagggtggagatgaaacgaactgtggctgcaccatctgtcttcattccttcccgcatctgacatactcgtactgaggcgggctgggcaaggcacatagnnnnnnnnn

SEQ ID NO: 275488 - DNA, 226 bp, Homo sapiens
  misc_feature: GYAE6OF01CD0H7.18.71.G05.1.454.CMB.1.raw
  modified_base (224)..(226): a, c, t, g, unknown or other
  misc_feature (224)..(226): n is a, c, g, or t
tcagtacgagtatgcacgaccggtgctcgatttagtgtcgtcgcaagagagaggggtggaggctgaggatgttggagtttattactgcatgcaaggtacacactggccgctcacgctcggcggagggaccagggtggagatagaaacgaactgtggctgcaccatctgtcttcatctcccgcatctgacatactcgtactgagcgggctggcaaggcgcatagnnn

SEQ ID NO: 275489 - DNA, 227 bp, Homo sapiens
  misc_feature: GYAE6OF01ARQFM.18.71.G05.1.454.CMB.1.raw
  modified_base (224)..(227): a, c, t, g, unknown or other
  misc_feature (224)..(227): n is a, c, g, or t
tcagtacgagtatgcacgaccggtgctcgatttagtgtcgtcgcaagagagaggggtggaggctgaggatgttggagtttattactgcatgcaaggtacacactggccgctcacgctcggcggagggaccagggtggagatgaaacgaactgtggctgcaccatctgtcttcatcttcccgcatctgacatactcgtactgagcgggctggcaaggcgcatagnnnn

SEQ ID NO: 275490 - DNA, 226 bp, Homo sapiens
  misc_feature: GYAE6OF01EI0UM.18.71.G05.1.454.CMB.1.raw
  modified_base (218)..(218): a, c, t, g, unknown or other
  misc_feature (218)..(218): n is a, c, g, or t
  modified_base (224)..(226): a, c, t, g, unknown or other
  misc_feature (224)..(226): n is a, c, g, or t
tcagtacgagtatgcacgaccggtgctcgatttagtgtcgtcgcaagagagaggggtggaggctgaggatgttggagtttattactgcatgcaaggtacacactggccgctcacgctcggcggagggaccagggtggagatgaaacgaactgtggctgcaccatctgtcttcatcttcccgcatctgacatactcgtactgagcgggctggcaaggcncatagnnn

SEQ ID NO: 275491 - DNA, 237 bp, Homo sapiens
  misc_feature: GYAE6OF01BAQ2G.18.71.G05.1.454.CMB.1.raw
  modified_base (205)..(205): a, c, t, g, unknown or other
  misc_feature (205)..(205): n is a, c, g, or t
  modified_base (230)..(237): a, c, t, g, unknown or other
  misc_feature (230)..(237): n is a, c, g, or t
tcagtacgagtatgcacgaccggtgctcgatttagtgtcgtcgcaagagagaggggtggaggctgaggatgttggagtttattactgcatgcaaggtacacactggccgctcacgctcgggcggagggaccaggggtggagatggaaaacgaactgtggctgcaccatctgtcttcatccttcccgcatctgacatactcgtacngagcgggctggacaaggcgcatagnnnnnnnn

SEQ ID NO: 275492 - DNA, 229 bp, Homo sapiens
  misc_feature: GYAE6OF01BHJFO.18.71.G05.1.454.CMB.1.raw
  modified_base (225)..(229): a, c, t, g, unknown or other
  misc_feature (225)..(229): n is a, c, g, or t
tcagtacgagtatgcacgaccggtgctcgatttagtgtcgtcgcaagagagaggggtggaggctgaggatgttggagtttattactgcatgcaaggtacacactggccgctcacgctcggcggagggaccagggtggagatgaaacgaactgtggctgcaccatctgtcttcatcttctcgccatctgacatactcgtactgagcgggctggcaaggcgcatagnnnnn

SEQ ID NO: 275493 - DNA, 242 bp, Homo sapiens
  misc_feature: GYAE6OF01DPAU3.18.71.G05.1.454.CMB.1.raw
  modified_base (227)..(227): a, c, t, g, unknown or other
  misc_feature (227)..(227): n is a, c, g, or t
  modified_base (233)..(242): a, c, t, g, unknown or other
  misc_feature (233)..(242): n is a, c, g, or t
tcagtacgagtatgcacgaccggtgctcgatttagtgtcgtcgcaagagagaggggtggaggctgaggatgttggagtttattactgcatgcaaggtacacactggccgctcacgctcgggcggagggaccggggtggagatagaaacgaactggtggctgccaccatctgtcttcatccttcccgcatctagacatactcgtactggaggcggctggacaaggcgntaatgnnnnnnnnnn

SEQ ID NO: 275494 - DNA, 230 bp, Homo sapiens
  misc_feature: GYAE6OF01E18G6.18.71.G05.1.454.CMB.1.raw
  modified_base (226)..(230): a, c, t, g, unknown or other
  misc_feature (226)..(230): n is a, c, g, or t
tcagtacgagtatgcacgaccggtgctcgatttagtgtcgtcgcaagagagaggggtggaggctgaggatgttggagtttattactgcatgcaaggtacacactggccgctcacgctcggcggagggaccagggtggagatgaaacgaactgtggctgcaccatctgtcttcatccttcccgccatctgacatactcgtactgagcgggctggcaaggcgcatagnnnnn

SEQ ID NO: 275495 - DNA, 239 bp, Homo sapiens
  misc_feature: GYAE6OF01CRQ9Y.18.71.G05.1.454.CMB.1.raw
  modified_base (222)..(222): a, c, t, g, unknown or other
  misc_feature (222)..(222): n is a, c, g, or t
  modified_base (230)..(239): a, c, t, g, unknown or other
  misc_feature (230)..(239): n is a, c, g, or t
tcagtacgagtatgcacgaccggtgctcgatttagtgtcgtcgcaagagagaggggtggaggctgaggatgttggagtttattactgcatgcaaggtacacactggccgctcacgctcgggcggagggaccagggtggagatgaaacgactgtggctgcaccatctgtcttcatccttcccgcatctgactatactcgtactgagcgggctgggcaagggcncaagtagnnnnnnnnnn

SEQ ID NO: 275496 - DNA, 229 bp, Homo sapiens
  misc_feature: GYAE6OF01DIT1Y.18.71.G05.1.454.CMB.1.raw
  modified_base (218)..(218): a, c, t, g, unknown or other
  misc_feature (218)..(218): n is a, c, g, or t
  modified_base (224)..(229): a, c, t, g, unknown or other
  misc_feature (224)..(229): n is a, c, g, or t
tcagtacgagtatgcacgaccggtgctcgatttagtgtcgtcgcaagagagaggggtggaggctgaggatgttggagtttattactgcatgcaaggtacacactggccgctcacgctcggcggagggaccagggtggagatagaaacgactgtggctgcaccatctgtcttcatcttcccgcatctgacatactcgtactgagcgggctggcaaggcncatagnnnnnn

SEQ ID NO: 275497 - DNA, 256 bp, Homo sapiens
  misc_feature: GYAE6OF01D5VK0.18.71.G05.1.454.CMB.1.raw
  modified_base (108)..(108): a, c, t, g, unknown or other
  misc_feature (108)..(108): n is a, c, g, or t
  modified_base (137)..(137): a, c, t, g, unknown or other
  misc_feature (137)..(137): n is a, c, g, or t
  modified_base (177)..(177): a, c, t, g, unknown or other
  misc_feature (177)..(177): n is a, c, g, or t
  modified_base (197)..(197): a, c, t, g, unknown or other
  misc_feature (197)..(197): n is a, c, g, or t
  modified_base (222)..(222): a, c, t, g, unknown or other
  misc_feature (222)..(222): n is a, c, g, or t
  modified_base (232)..(232): a, c, t, g, unknown or other
  misc_feature (232)..(232): n is a, c, g, or t
  modified_base (237)..(237): a, c, t, g, unknown or other
  misc_feature (237)..(237): n is a, c, g, or t
  modified_base (240)..(256): a, c, t, g, unknown or other
  misc_feature (240)..(256): n is a, c, g, or t
tcagtacgagtatgcacgaccggtgctcgatttagtgtcgtcgcaagagagaggggtggaggctgaggatgttggatttattactgcatgcaaggtacacactggccnctcacgctcggcggaggaccagggtgganatagaaacgactggtggcctgaccaccattctgtacttcnttcccttcccgctaattcanactattcgtacgtcgtgcgcggtcngacgaacgcntaagngcnnnnnnnnnnnnnnnnn

SEQ ID NO: 275498 - DNA, 228 bp, Homo sapiens
  misc_feature: GYAE6OF01BTUKD.18.71.G05.1.454.CMB.1.raw
  modified_base (224)..(228): a, c, t, g, unknown or other
  misc_feature (224)..(228): n is a, c, g, or t
tcagtacgagtatgcacgaccggtgctcgatttagtgtcgtcgcaagagagaggggtggaggctgaggatgttggagtttattactgcatgcaaggtacacactggccgctcacgctcggcggagggaccagggtggagatgaaacgaactgtggctgcaccatctgtcttcatcttcccgcatctgacatactcgtactgagcgggctggcaaggcgcatagnnnnn

SEQ ID NO: 275499 - DNA, 239 bp, Homo sapiens
  misc_feature: GYAE6OF01CJ4PY.18.71.G05.1.454.CMB.1.raw
  modified_base (226)..(239): a, c, t, g, unknown or other
  misc_feature (226)..(239): n is a, c, g, or t
tcagtacgagtatgcacgaccggtgctcgatttagtgtcgtcgcaagagagaggggtggaggctgaggatgttggagtttattactgcatgcaaggtacacactggccgctcacgctcggcggagggaccagggtggagatagaaacgaactgtggctgcaccatctgtcttcatcttcccgccatctgacatactcgtactgaggcggctggcaaggcgcatagnnnnnnnnnnnnnn

SEQ ID NO: 275500 - DNA, 290 bp, Homo sapiens
  misc_feature: GYAE6OF01CPILI.18.71.G05.1.454.CMB.1.raw
  modified_base (267)..(290): a, c, t, g, unknown or other
  misc_feature (267)..(290): n is a, c, g, or t
tcagtacgagtatgcacgaccggtgctcgatttagtgtcgtcgcaagagagaggggtggaggctgaggatgttggagtttattactgcatgacaaggtacacactggccgctcacgctcgggcggagggccagggtggagatagaaacgaactgtggctgcaccatcgtagttccttcacttcctttcccgaccctaattccgtagactaattaccgttcgtaacgtggaccggcggggtccgtagggcgaagggtccactagtagnnnnnnnnnnnnnnnnnnnnnnnn

SEQ ID NO: 275501 - DNA, 228 bp, Homo sapiens; identical to SEQ ID NO: 275458
  misc_feature: GYAE6OF02IXNWQ.18.71.G05.1.454.CMB.1.raw
  modified_base (225)..(228): a, c, t, g, unknown or other
  misc_feature (225)..(228): n is a, c, g, or t

SEQ ID NO: 275502 - DNA, 226 bp, Homo sapiens
  misc_feature: GYAE6OF02G407L.18.71.G05.1.454.CMB.1.raw
  modified_base (224)..(226): a, c, t, g, unknown or other
  misc_feature (224)..(226): n is a, c, g, or t
tcagtacgagtatgcacgaccggtgctcgatttagtgtcgtcgcaagagagagggtggaggctgaggatgttggagtttattactgcatgcaaggtacacactggccgctcacgctcggcggagggaccagggtggagatgaaacgaactgtggctgcaccatctgtcttcatcttcccgccatctgacatactcgtactgagcgggctggcaaggcgcatagnnn

SEQ ID NO: 275503 - DNA, 226 bp, Homo sapiens; identical to SEQ ID NO: 275452
  misc_feature: GYAE6OF02IZXGS.18.71.G05.1.454.CMB.1.raw
  modified_base (225)..(226): a, c, t, g, unknown or other
  misc_feature (225)..(226): n is a, c, g, or t

SEQ ID NO: 275504 - DNA, 228 bp, Homo sapiens; identical to SEQ ID NO: 275458
  misc_feature: GYAE6OF02IYZNG.18.71.G05.1.454.CMB.1.raw
  modified_base (225)..(228): a, c, t, g, unknown or other
  misc_feature (225)..(228): n is a, c, g, or t

SEQ ID NO: 275505 - DNA, 277 bp, Homo sapiens
  misc_feature: GYAE6OF02H6YEZ.18.71.G05.1.454.CMB.1.raw
  modified_base (221)..(277): a, c, t, g, unknown or other
  misc_feature (221)..(277): n is a, c, g, or t
tcagtacgagtatgcacgaccggtgctcgatttagtgtcgtcgcaagagagagggtggaggctgaggatgttggagtttattactgcatgcaaggtacacactggccgctcacgctcggcggaggacagggtggagatgaaacgactgtggctgcacatctgtcttcatcttcccgcatctgacatactcgtactgagcgggctggacaaggcgcagtagnnnnnnnnnnnnnnnnnnnnnnnnnnnnnnnnnnnnnnnnnnnnnnnnnnnnnnnnn

SEQ ID NO: 275506 - DNA, 227 bp, Homo sapiens
  misc_feature: GYAE6OF02GOA5I.18.71.G05.1.454.CMB.1.raw
  modified_base (225)..(227): a, c, t, g, unknown or other
  misc_feature (225)..(227): n is a, c, g, or t
tcagtacgagtatgcacgaccggtgctcgatttagtgtcgtcgcaagagagaggggtggaggctgaggatgttggagtttattactgcatgcaaggtacacactggccgctcacgctcgacggagggaccagggtggagatgaaacgaactgtggctgcaccatctgtcttcatcttctcgccatctgacatactcgtactgagcgggctggcaaggcgcatagnnn

SEQ ID NO: 275507 - DNA, 225 bp, Homo sapiens; identical to SEQ ID NO: 275450
  misc_feature: GYAE6OF02HYM8F.18.71.G05.1.454.CMB.1.raw
  modified_base (224)..(225): a, c, t, g, unknown or other
  misc_feature (224)..(225): n is a, c, g, or t

SEQ ID NO: 275508 - DNA, 225 bp, Homo sapiens
  misc_feature: GYAE6OF02JG5GX.18.71.G05.1.454.CMB.1.raw
  modified_base (225)..(225): a, c, t, g, unknown or other
  misc_feature (225)..(225): n is a, c, g, or t
tcagtacgagtatgcacgaccggtgctcgatttagtgtcgtcgcaagagagaggggtggaggctgaggatgttggagtttattactgcatgcaaggtacacactggccgctcacgctcggcggagggaccagggtggagatgaaacgaactgtggctgcaccatctgtcttcatcttcccgccatctgacatactcgtactgagcgggctggcaaggcgcatagn

SEQ ID NO: 275509 - DNA, 232 bp, Homo sapiens
  misc_feature: GYAE6OF02I6188.18.71.G05.1.454.CMB.1.raw
  modified_base (225)..(232): a, c, t, g, unknown or other
  misc_feature (225)..(232): n is a, c, g, or t
tcagtacgagtatgcacgaccggtgctcgatttagtgtcgtcgcaagagagaggggtggaggctgaggatgttggagtttattactgcatgcaaggtacacactggccgctcacgctcggcggagggaccagggtggagatgaaacgaactgtggctgcaccatctgtcttcatcttcccgccatctgacatactcgtactgagcgggctggcaaggcgcatagnnnnnnnn

SEQ ID NO: 275510 - DNA, 224 bp, Homo sapiens
  misc_feature: GYAE6OF02IAWMO.18.71.G05.1.454.CMB.1.raw
  modified_base (224)..(224): a, c, t, g, unknown or other
  misc_feature (224)..(224): n is a, c, g, or t
tcagtacgagtatgcacgaccggtgctcgatttagtgtcgtcgcaagagagagggtggaggctgaggatgttggagtttattactgcatgcaaggtacacactggccgctcacgctcggcggagggaccagggtggagatgaaacgaactgtggctgcaccatctgtcttcatcttcccgccatctgacatactcgtactgagcgggctggcaaggcgcatagn

SEQ ID NO: 275511 - DNA, 229 bp, Homo sapiens; identical to SEQ ID NO: 275469
  misc_feature: GYAE6OF02I1NJF.18.71.G05.1.454.CMB.1.raw
  modified_base (225)..(229): a, c, t, g, unknown or other
  misc_feature (225)..(229): n is a, c, g, or t

SEQ ID NO: 275512 - DNA, 225 bp, Homo sapiens; identical to SEQ ID NO: 275508
  misc_feature: GYAE6OF02H2KVQ.18.71.G05.1.454.CMB.1.raw
  modified_base (225)..(225): a, c, t, g, unknown or other
  misc_feature (225)..(225): n is a, c, g, or t

SEQ ID NO: 275513 - DNA, 227 bp, Homo sapiens; identical to SEQ ID NO: 275453
  misc_feature: GYAE6OF02IZ33T.18.71.G05.1.454.CMB.1.raw
  modified_base (225)..(227): a, c, t, g, unknown or other
  misc_feature (225)..(227): n is a, c, g, or t

SEQ ID NO: 275514 - DNA, 227 bp, Homo sapiens; identical to SEQ ID NO: 275453
  misc_feature: GYAE6OF02G9UZV.18.71.G05.1.454.CMB.1.raw
  modified_base (225)..(227): a, c, t, g, unknown or other
  misc_feature (225)..(227): n is a, c, g, or t

SEQ ID NO: 275515 - DNA, 228 bp, Homo sapiens
  misc_feature: GYAE6OF02H04RP.18.71.G05.1.454.CMB.1.raw
  modified_base (224)..(228): a, c, t, g, unknown or other
  misc_feature (224)..(228): n is a, c, g, or t
tcagtacgagtatgcacgaccggtgctcgatttagtgtcgtcgcaagagagagggtggaggctgaggatgttggagtttattactgcatgcaaggtacacactggccgctcacgctcggcggagggaccagggtggagatgaaacgaactgtggctgcaccatctgtcttcatccttcccgcatctgacatactcgtactgagcgggctggcaaggcgcatagnnnnn

SEQ ID NO: 275516 - DNA, 226 bp, Homo sapiens; identical to SEQ ID NO: 275502
  misc_feature: GYAE6OF02FRNBX.18.71.G05.1.454.CMB.1.raw
  modified_base (224)..(226): a, c, t, g, unknown or other
  misc_feature (224)..(226): n is a, c, g, or t

SEQ ID NO: 275517 - DNA, 227 bp, Homo sapiens
  misc_feature: GYAE6OF02HVD90.18.71.G05.1.454.CMB.1.raw
  modified_base (224)..(227): a, c, t, g, unknown or other
  misc_feature (224)..(227): n is a, c, g, or t
tcagtacgagtatgcacgaccggtgctcgatttagtgtcgtcgcaagagagagggtggaggctgaggatgttggagtttattactgcatgcaaggtacacactggccgctcacgctcggcggagggaccagggtggagatgaaacgaactgtggctgcaccatctgtcttcatcttcccgccatctgacatactcgtactgagcgggctggcaaggcgcatagnnnn

SEQ ID NO: 275518 - DNA, 227 bp, Homo sapiens; identical to SEQ ID NO: 275453
  misc_feature: GYAE6OF02FO1GH.18.71.G05.1.454.CMB.1.raw
  modified_base (225)..(227): a, c, t, g, unknown or other
  misc_feature (225)..(227): n is a, c, g, or t

SEQ ID NO: 275519 - DNA, 226 bp, Homo sapiens; identical to SEQ ID NO: 275452
  misc_feature: GYAE6OF02G7LQE.18.71.G05.1.454.CMB.1.raw
  modified_base (225)..(226): a, c, t, g, unknown or other
  misc_feature (225)..(226): n is a, c, g, or t

SEQ ID NO: 275520 - DNA, 226 bp, Homo sapiens; identical to SEQ ID NO: 275452
  misc_feature: GYAE6OF02HIVY9.18.71.G05.1.454.CMB.1.raw
  modified_base (225)..(226): a, c, t, g, unknown or other
  misc_feature (225)..(226): n is a, c, g, or t

SEQ ID NO: 275521 - DNA, 227 bp, Homo sapiens; identical to SEQ ID NO: 275517
  misc_feature: GYAE6OF02HPSU4.18.71.G05.1.454.CMB.1.raw
  modified_base (224)..(227): a, c, t, g, unknown or other
  misc_feature (224)..(227): n is a, c, g, or t

SEQ ID NO: 275522 - DNA, 226 bp, Homo sapiens; identical to SEQ ID NO: 275452
  misc_feature: GYAE6OF02JBBSX.18.71.G05.1.454.CMB.1.raw
  modified_base (225)..(226): a, c, t, g, unknown or other
  misc_feature (225)..(226): n is a, c, g, or t

SEQ ID NO: 275523 - DNA, 232 bp, Homo sapiens
  misc_feature: GYAE6OF02JMFZN.18.71.G05.1.454.CMB.1.raw
  modified_base (225)..(232): a, c, t, g, unknown or other
  misc_feature (225)..(232): n is a, c, g, or t
tcagtacgagtatgcacgaccggtgctcgatttagtgtcgtcgcaagagagagggtggaggctgaggatgttggagtttattactgcatgcaaggtacacactggccgctcacgctcggcggagggaccagggtggagatgaaacgaactgtggctgcaccatctgtcttcatcttcccgccatctgacatactcgtactgagcgggctaggcaaggcgcatagnnnnnnnn

SEQ ID NO: 275524 - DNA, 228 bp, Homo sapiens
  misc_feature: GYAE6OF02GB9QA.18.71.G05.1.454.CMB.1.raw
  modified_base (224)..(228): a, c, t, g, unknown or other
  misc_feature (224)..(228): n is a, c, g, or t
tcagtacgagtatgcacgaccggtgctcgatttagtgtcgtcgcaagagagaggggtggaggctgaggatgttggagtttattactgcatgcaaggtacacactggccgctcacgctcggcggagggaccagggtggagatgaaacgaactgtggctgcaccatctgtcttcatcttcccgccatctgacatactcgtactgagcggctggcaaggcgcatagnnnnn

SEQ ID NO: 275525 - DNA, 227 bp, Homo sapiens; identical to SEQ ID NO: 275453
  misc_feature: GYAE6OF02FIDT5.18.71.G05.1.454.CMB.1.raw
  modified_base (225)..(227): a, c, t, g, unknown or other
  misc_feature (225)..(227): n is a, c, g, or t

SEQ ID NO: 275526 - DNA, 238 bp, Homo sapiens
  misc_feature: GYAE6OF02HORG3.18.71.G05.1.454.CMB.1.raw
  modified_base (224)..(238): a, c, t, g, unknown or other
  misc_feature (224)..(238): n is a, c, g, or t
tcagtacgagtatgcacgaccggtgctcgatttagtgtcgtcgcaagagagaggggtggaggctgaggatgttggagtttattactgcatgcaaggtacacactggccgctcacgctcggcggaggaccagggtggagatgaaacgaactgtggctgcaccatctgtcttcatcttcccgccatctgacatactcgtactgagcgggctggcaaggcgcatagnnnnnnnnnnnnnnn

SEQ ID NO: 275527 - DNA, 228 bp, Homo sapiens; identical to SEQ ID NO: 275458
  misc_feature: GYAE6OF02F28K8.18.71.G05.1.454.CMB.1.raw
  modified_base (225)..(228): a, c, t, g, unknown or other
  misc_feature (225)..(228): n is a, c, g, or t

SEQ ID NO: 275528 - DNA, 228 bp, Homo sapiens
  misc_feature: GYAE6OF02HQ4VZ.18.71.G05.1.454.CMB.1.raw
  modified_base (225)..(228): a, c, t, g, unknown or other
  misc_feature (225)..(228): n is a, c, g, or t
tcagtacgagtatgcacgaccggtgctcgatttagtgtcgtcgcaagagagaggggtggaggctgaggatgttggagtttattactgcatgcaaggtacacactggccgctcacgctcggcggagggaccagggtggagatagaaacgaactgtggctgcaccatctgtcttcatcttcccgcatctgacatactcgtactgagcgggctggcaaggcgcatagnnnn

SEQ ID NO: 275529 - DNA, 227 bp, Homo sapiens; identical to SEQ ID NO: 275453
  misc_feature: GYAE6OF02FKPU0.18.71.G05.1.454.CMB.1.raw
  modified_base (225)..(227): a, c, t, g, unknown or other
  misc_feature (225)..(227): n is a, c, g, or t

SEQ ID NO: 275530 - DNA, 227 bp, Homo sapiens; identical to SEQ ID NO: 275453
  misc_feature: GYAE6OF02IMLM5.18.71.G05.1.454.CMB.1.raw
  modified_base (225)..(227): a, c, t, g, unknown or other
  misc_feature (225)..(227): n is a, c, g, or t

SEQ ID NO: 275531 - DNA, 231 bp, Homo sapiens
  misc_feature: GYAE6OF02JUSON.18.71.G05.1.454.CMB.1.raw
  modified_base (218)..(218): a, c, t, g, unknown or other
  misc_feature (218)..(218): n is a, c, g, or t
  modified_base (224)..(231): a, c, t, g, unknown or other
  misc_feature (224)..(231): n is a, c, g, or t
tcagtacgagtatgcacgaccggtgctcgatttagtgtcgtcgcaagagagaggggtggaggctgaggatgttggagtttattactgcatgcaaggtacacactggccgctcacgctcggcggagggaccagggtggagatgaaacgaactgtggctgcaccatctgtcttcatccttcccgcatctgacatactcgtactgagcggctggcaaggcncatagnnnnnnnn

SEQ ID NO: 275532 - DNA, 240 bp, Homo sapiens
  misc_feature: GYAE6OF02G60O2.18.71.G05.1.454.CMB.1.raw
  modified_base (229)..(240): a, c, t, g, unknown or other
  misc_feature (229)..(240): n is a, c, g, or t
tcagtacgagtatgcacgaccggtgctcgatttagtgtcgtcgcaagagagaggggtggaggctgaggatgttggagtttattactgcatgcaaggtacacactggccgctcacgctcggcggaggaccagggtggagatagaaacgaactgtggctgcaccatctgtcttcatcttcccgcatctgacatactcgtactgaggcgggctgggcaagggcacaagtagnnnnnnnnnnnn

SEQ ID NO: 275533 - DNA, 234 bp, Homo sapiens
  misc_feature: GYAE6OF02JBMJJ.18.71.G05.1.454.CMB.1.raw
  modified_base (225)..(234): a, c, t, g, unknown or other
  misc_feature (225)..(234): n is a, c, g, or t
tcagtacgagtatgcacgaccggtgctcgatttagtgtcgtcgcaagagagaggggtggaggctgaggatgttggagtttattactgcatgcaaggtacacactggccgctcacgctcggcggagggaccagggtggagatgaaacgaactgtggctgcaccatctgtcttcatcttcccgccatctgacatactcgtactgagcgggctggcaaggcgcatagnnnnnnnnnn

SEQ ID NO: 275534 - DNA, 238 bp, Homo sapiens
  misc_feature: GYAE6OF02GRO47.18.71.G05.1.454.CMB.1.raw
  modified_base (226)..(238): a, c, t, g, unknown or other
  misc_feature (226)..(238): n is a, c, g, or t
tcagtacgagtatgcacgaccggtgctcgatttagtgtcgtcgcaagagagaggggtggaggctgaggatgttggagtttattactgcatgcaaggtacacactggccgctcacgctcggcggagggaccagggtggagatagaaacgaactgtggctgcaccatctgtcttcatcttcccgcatctgacatactcgtactgagcgggctggacaaggcgcatagnnnnnnnnnnnnn

SEQ ID NO: 275535 - DNA, 227 bp, Homo sapiens; identical to SEQ ID NO: 275489
  misc_feature: GYAE6OF02GTU8J.18.71.G05.1.454.CMB.1.raw
  modified_base (224)..(227): a, c, t, g, unknown or other
  misc_feature (224)..(227): n is a, c, g, or t

SEQ ID NO: 275536 - DNA, 260 bp, Homo sapiens
  misc_feature: GYAE6OF02H4WYE.18.71.G05.1.454.CMB.1.raw
  modified_base (202)..(202): a, c, t, g, unknown or other
  misc_feature (202)..(202): n is a, c, g, or t
  modified_base (237)..(237): a, c, t, g, unknown or other
  misc_feature (237)..(237): n is a, c, g, or t
  modified_base (239)..(260): a, c, t, g, unknown or other
  misc_feature (239)..(260): n is a, c, g, or t
tcagtacgagtatgcacgaccggtgctcgatttagtgtcgtcgcaagagagaggggtggaggctgaggatgttggagtttattactgcatgcaaggtacacactggccgctcacgctcgggcggagggaccaggggtggagatgaaacgactggtggctgcacatctgtcttcatccttcccgcatctgacatactcgtacnggacggcgggtctgggacctaagggctacaagtgncnnnnnnnnnnnnnnnnnnnnnn

SEQ ID NO: 275537 - DNA, 232 bp, Homo sapiens
  misc_feature: GYAE6OF02HNEKC.18.71.G05.1.454.CMB.1.raw
  modified_base (205)..(205): a, c, t, g, unknown or other
  misc_feature (205)..(205): n is a, c, g, or t
  modified_base (215)..(215): a, c, t, g, unknown or other
  misc_feature (215)..(215): n is a, c, g, or t
  modified_base (221)..(232): a, c, t, g, unknown or other
  misc_feature (221)..(232): n is a, c, g, or t
tcagtacgagtatgcacgaccggtgctcgatttagtgtcgtcgcaagagagaggggtggaggctgaggatgttggagtttattactgcatgcaaggtacacactggccgctcacgctcggcggaggaccagggtggagatgaaacgaactgtggctgcaccatctgtcttcatctcccgcatctgacatactcgtactgagcggntggcaaggcncatagnnnnnnnnnnnn

SEQ ID NO: 275538 - DNA, 228 bp, Homo sapiens; identical to SEQ ID NO: 275458
  misc_feature: GYAE6OF02G9D7E.18.71.G05.1.454.CMB.1.raw
  modified_base (225)..(228): a, c, t, g, unknown or other
  misc_feature (225)..(228): n is a, c, g, or t

SEQ ID NO: 275539 - DNA, 231 bp, Homo sapiens
  misc_feature: GYAE6OF02GKZHH.18.71.G05.1.454.CMB.1.raw
  modified_base (223)..(231): a, c, t, g, unknown or other
  misc_feature (223)..(231): n is a, c, g, or t
tcagtacgagtatgcacgaccggtgctcgatttagtgtcgtcgcaagagagaggggtggaggctgaggatgttggagtttattactgcatgcaaggtacacactggccgctcacgctcggcggagggaccagggtggagatgaaacgaactgtggctgcacatctgtcttcatcttcccgcatctgacatactcgtactgagcgggctggcaaggcgcatagnnnnnnnnn

SEQ ID NO: 275540 - DNA, 246 bp, Homo sapiens
  misc_feature: GYAE6OF02HELZA.18.71.G05.1.454.CMB.1.raw
  modified_base (225)..(246): a, c, t, g, unknown or other
  misc_feature (225)..(246): n is a, c, g, or t
tcagtacgagtatgcacgaccggtgctcgatttagtgtcgtcgcaagagagaggggtggaggctgaggatgttggagtttattactgcatgcaaggtacacactggccgctcacgctcggcggagggaccagggtggagatgaaacgaactgtggctgcaccatctgtcttcatcttcccgccatctgacatactcgtactgagcgggctggcaaggcgcatagnnnnnnnnnnnnnnnnnnnnnn

SEQ ID NO: 275541 - DNA, 240 bp, Homo sapiens
  misc_feature: GYAE6OF02GZW2B.18.71.G05.1.454.CMB.1.raw
  modified_base (224)..(240): a, c, t, g, unknown or other
  misc_feature (224)..(240): n is a, c, g, or t
tcagtacgagtatgcacgaccggtgctcgatttagtgtcgtcgcaagagagaggggtggaggctgaggatgttggagtttattactgcatgcaaggtacacactggccgctcacgctcggcggagggaccagggtggagatgaaacgaactgtggctgcaccatctgtcttcatcttcccgcatctgacatactctactgagcggctggcaaggcgacaatagnnnnnnnnnnnnnnnnn

SEQ ID NO: 275542 - DNA, 347 bp, Homo sapiens
  misc_feature: GYAE6OF02H36WF.18.71.G05.1.454.CMB.1.raw
  modified_base (146)..(146): a, c, t, g, unknown or other
  misc_feature (146)..(146): n is a, c, g, or t
  modified_base (243)..(243): a, c, t, g, unknown or other
  misc_feature (243)..(243): n is a, c, g, or t
  modified_base (257)..(257): a, c, t, g, unknown or other
  misc_feature (257)..(257): n is a, c, g, or t
  modified_base (281)..(347): a, c, t, g, unknown or other
  misc_feature (281)..(347): n is a, c, g, or t
tcagtacgagtatgcacgaccggtgctcgatttagtgtcgtcgcaagagagaggggtgggaggctgagggatgttgggagtttatactgcatgcaaggtacacactggccgctcacgcgtcgggcgggagggaccgaggggtgganagtaggaaaaacgtaacgtgggtggcgtcgacgacctattcgttcggtcttacacttcccgttccccgaccagttctgactattaccgtcgtaacgngacgggccgggtcncgggaacgaacggcgactaagtgnnnnnnnnnnnnnnnnnnnnnnnnnnnnnnnnnnnnnnnnnnnnnnnnnnnnnnnnnnnnnnnnnnn

SEQ ID NO: 275543 - DNA, 253 bp, Homo sapiens
  misc_feature: GYAE6OF02FX9CK.18.71.G05.1.454.CMB.1.raw
  modified_base (109)..(109): a, c, t, g, unknown or other
  misc_feature (109)..(109): n is a, c, g, or t
  modified_base (220)..(220): a, c, t, g, unknown or other
  misc_feature (220)..(220): n is a, c, g, or t
  modified_base (226)..(226): a, c, t, g, unknown or other
  misc_feature (226)..(226): n is a, c, g, or t
  modified_base (228)..(253): a, c, t, g, unknown or other
  misc_feature (228)..(253): n is a, c, g, or t
tcagtacgagtatgcacgaccggtgctcgatttagtgtcgtcgcaagagagaggggtggaggctgaggatgttggagtttattactgcatgcaaggtacacactggccnctcacgctcggcggagggaccagggtggagatgaaacgaactgtggctgcaccgatctgtcttcatccttcccgcatctgacatactcgtactgagcgggctggcaaggcncatagnannnnnnnnnnnnnnnnnnnnnnnnnn

SEQ ID NO: 275544 - DNA, 134 bp, Homo sapiens
  misc_feature: GYAE6OF01DEZ4J.3.14.B03.1.454.CMB.1.raw
  modified_base (128)..(134): a, c, t, g, unknown or other
  misc_feature (128)..(134): n is a, c, g, or t
tcagagacgcactccacgaccggtgctcgatttagtgtgagtagttccgcgggctggcaaggcgcatagctgcctggtcaaggactacttccgagtgcgtctctgagcgggctggcaaggcgcatagnnnnnnn

SEQ ID NO: 275545 - DNA, 509 bp, Homo sapiens
  misc_feature: GYAE6OF01E1ONE.3.14.B03.1.454.CMB.1.raw
  modified_base (199)..(199): a, c, t, g, unknown or other
  misc_feature (199)..(199): n is a, c, g, or t
tcagagacgcactccacgaccggtgctcgatttagtgtgagtagttccgcggggaggacgtgctcgagttaggaccagacggaaccatggaagccccagcgcagcttctcttcctcctgctactctggctcccagacaccactggagaaatagtgatgacgcagtctccagccaccctgtctgtgtctccaggggaaangccaccatctcctgcagggccagtcagactattagaagcaacttagcctggtaccagcagaacctggccaggctcccaggctcctcatctatggtgcatcccaccagggccacgtggtactccccgagccctaggttcaggtggcaggtgggtctgggacaggagttcactctcacctatcagcagcctgcagtcagtaagtattttgctattttattctgtcagcagtataatactggcctcgtgacgttcgggccgggtacagggtgagagtcgaaagtacgtgtggctcggcaccatcgtgtcttac

SEQ ID NO: 275546 - DNA, 499 bp, Homo sapiens
  misc_feature: GYAE6OF01CMY62.3.14.B03.1.454.CMB.1.raw
  modified_base (200)..(200): a, c, t, g, unknown or other
  misc_feature (200)..(200): n is a, c, g, or t
  modified_base (299)..(299): a, c, t, g, unknown or other
  misc_feature (299)..(299): n is a, c, g, or t
  modified_base (393)..(393): a, c, t, g, unknown or other
  misc_feature (393)..(393): n is a, c, g, or t
  modified_base (482)..(482): a, c, t, g, unknown or other
  misc_feature (482)..(482): n is a, c, g, or t
tcagagacgcactccacgaccggtgctcgatttagtgtgagtagttccgcgggggaggaactgctcagttaggacccagacggaaccatggaagccccagcgcagcttctcttcctcctgctactctggctcccagacaccactggagaaatagtgatgacgcagtctccagccaccctgtctgtgtctccaggggaaanagccaccatctcctgcagggccagtcagactattagaagcaacttagcctagtaccagcaagaaacctggccaggctcccaggctcctcatctatggtncatccaccagggccactggtatcccagccaggttcagtgcagtgggtctgggacagagttcactctcaccatcagcagcctgcagtctgaagtntttgctactttatttctgtcagctagtaataataactggccttcgtgacgttcacggccggggacagggtgagatacgaaacgtactgngcgtcgacacatctgtc

SEQ ID NO: 275547 - DNA, 516 bp, Homo sapiens
  misc_feature: GYAE6OF01BY9HA.3.14.B03.1.454.CMB.1.raw
  modified_base (200)..(200): a, c, t, g, unknown or other
  misc_feature (200)..(200): n is a, c, g, or t
tcagagacgcactccacgaccggtgctcgatttagtgtgagtagttccgcgggggaggaactgctcagttaggacccagacggaaccatggaagccccagcgcagcttctcttcctcctgctactctggctcccagacaccactggagaaatagtgatgacgcagtctccagccaccctgtctgtgtctccaggggaaanagccaccatctcctgcagggccagtcagactattagaagcaacttagcctggtaccagcagaaacctggccaggctcccaggctcctcatctatggtgcatccaccagggccactcgtatcccagccaggttcagtggcaggtggtctgggacagagttcactctcaccatcagtagtctacaacctgaagtatttgctaacttactactgtcaacagagttacgactaccctcgctcactttcggcggacgggaccgaaggtggagatacaaacgaacgtgtggcgtgacaccatctgttcttctatcttacccg

SEQ ID NO: 275548 - DNA, 498 bp, Homo sapiens
  misc_feature: GYAE6OF01DW1DO.3.14.B03.1.454.CMB.1.raw
  modified_base (200)..(200): a, c, t, g, unknown or other
  misc_feature (200)..(200): n is a, c, g, or t
tcagagacgcactccacgaccggtgctcgatttagtgtgagtagttccgcgggggaggaactgctcagttaggacccagacggaaccatggaagccccagcgcagcttctcttcctcctgctactctggctcccagacaccactggagaaatagtgatgacgcagtctccagccaccctgtctgtgtctccaggggaaanagccaccatctcctgcagggccagtcagactattagaagcaacttagcctggtaccagcagaaacctggccaggctccaggctcctcatctatggtgcatccaccagggccactggtactcccagccaggttcagtggcaggtggtctgggacagagttcactctcaccatcagcagcctgcagtctagaagtattttgcttactttatttctgtcagctagtataatactgtcctcggtggtacgttcggccggggacaggtggagagtcaaagactggcgctgcacatctgtcttc

SEQ ID NO: 275549 - DNA, 621 bp, Homo sapiens
  misc_feature: GYAE6OF01CRNYO.3.14.B03.1.454.CMB.1.raw
  modified_base (202)..(202): a, c, t, g, unknown or other
  misc_feature (202)..(202): n is a, c, g, or t
  modified_base (292)..(292): a, c, t, g, unknown or other
  misc_feature (292)..(292): n is a, c, g, or t
  modified_base (303)..(303): a, c, t, g, unknown or other
  misc_feature (303)..(303): n is a, c, g, or t
  modified_base (419)..(419): a, c, t, g, unknown or other
  misc_feature (419)..(419): n is a, c, g, or t
tcagagacgcactccacgaccggtgctcgatttagtgtgagtagttccgcgggggaggaactgctcagttaggacccagacggaaccatggaagccccagcgcagcttctcttcctcctgctactctggctcccagacaccactggagaaatagtgatgacgcagtctccagccaccctgtctgtgtctccgaaggggaaanagccaccatctcctgcagggccagtcagactatagaagcaacttagcctggtaccagacaagaaacctggccaggcctcccaggcctccncatctatggtncatccacgacggccacgtggtactccgagcctaggttcaggtggacgtaggtggtcgtagggactagtacgttcacttctaccaacctatcagcagcctgactagtctagaagttntttacgactttaactttatttctagtacagtactaagttaataaactaccgttcggacccttacgggtacgggtaccggtccgggggtaccgggggaacgtaaggggtacggaacgtaacgtaacggtaaaaccggtacgttcgggtacgggtactacggtacccgaaaccgttagtttccggttagtttcccgtttaaccg

SEQ ID NO: 275550 - DNA, 515 bp, Homo sapiens
  misc_feature: GYAE6OF01A8X84.3.14.B03.1.454.CMB.1.raw
tcagagacgcactccacgaccggtgctcgatttagtgtgagtagttccgcgggggaggaactgctcagttaggacccagacggaaccatggaagccccagcgcagcttctcttcctcctgctactctggctcccagacaccactggagaaatagtgatgacgcagtctccagccaccctgtctgtgtctccaggggaaagagccaccatctcctgcagggccagtcagactattagaagcaacttagcctggtaccagcagaaacctggccaggctcccaggctcctcatctatggtgcatccaccagggccactggtatcccagccaggttcagtggcagtgggtctgggacagtagttcactctcaccatcagcagcctgcagtctgaagtatttgctactttatttctgtctagtctagtttaacaccttggtccttaggtaagttttcgggacctacggggaccaaggcgtggagacgtcaaacgactggtcggctgcactatctgtcttc

SEQ ID NO: 275551 - DNA, 519 bp, Homo sapiens
  misc_feature: GYAE6OF01C7SH9.3.14.B03.1.454.CMB.1.raw
  modified_base (205)..(205): a, c, t, g, unknown or other
  misc_feature (205)..(205): n is a, c, g, or t
  modified_base (305)..(305): a, c, t, g, unknown or other
  misc_feature (305)..(305): n is a, c, g, or t
  modified_base (384)..(384): a, c, t, g, unknown or other
  misc_feature (384)..(384): n is a, c, g, or t
  modified_base (406)..(406): a, c, t, g, unknown or other
  misc_feature (406)..(406): n is a, c, g, or t
  modified_base (480)..(480): a, c, t, g, unknown or other
  misc_feature (480)..(480): n is a, c, g, or t
  modified_base (501)..(501): a, c, t, g, unknown or other
  misc_feature (501)..(501): n is a, c, g, or t
  modified_base (504)..(504): a, c, t, g, unknown or other
  misc_feature (504)..(504): n is a, c, g, or t
  modified_base (510)..(510): a, c, t, g, unknown or other
  misc_feature (510)..(510): n is a, c, g, or t
tcagagacgcactccacgaccggtgctcgatttagtgtgagtagttccgcgggggaggaactgctcagttaggacccagacggaaccatggaagccccagcgcagcttctcttcctcctgctactctggcctcccagaccaccactggaagaaatagtgatgacgcagtctccagcccaccctgtctgtgtctccgaggggaaangccacatctctgcagggccagtcagactattagaagcaaacttgcctaggtaccagacaagaaacctggaccaggcctccaggtctcctcatctatggtncatccaccgagggccatggactcccagccaggttcaggtggcaggtggtctggacaggtactcactctcaccatcagcncgcctgctagtctagaaagttnttttgcttactttattctgtcagtctaagtaataatacgtcggtcctcgtggtacggttcggcggggactaggnggagacgtacgaaagacgtgngcngccacntctgtctac

SEQ ID NO: 275552 - DNA, 556 bp, Homo sapiens
  misc_feature: GYAE6OF01BRSYP.3.14.B03.1.454.CMB.1.raw
  modified_base (201)..(201): a, c, t, g, unknown or other
  misc_feature (201)..(201): n is a, c, g, or t
  modified_base (289)..(289): a, c, t, g, unknown or other
  misc_feature (289)..(289): n is a, c, g, or t
  modified_base (308)..(308): a, c, t, g, unknown or other
  misc_feature (308)..(308): n is a, c, g, or t
tcagagacgcactccacgaccggtgctcgatttagtgtgagtagttccgcgggggaggaactggctcagttaggacccagacggaaccatggaagccccagcgcagcttctcttcctcctgctactctggtctcccagacaccactggagaaatagtgatgacgcagtctccagccacctgtctgtgtctccaggggaaanagccaccatctcctgcagggccagtcagactattagaagcaacttgcctggtaccagcagaaacctggccaggcctcccaggctcctnatctatggtgcatccacgngggccagtggtactcccagccaggttcagtggcaggtggctgggacaggagttcactctcacatcagcagcctgcagtctgaagtattttgctatttatttcgtgtcagtcagttataatacgtggacccttcggtacggacggttccgggaccggggtaacgtaagggtcggaaagtaccgtaacgtaaaacggtacgttggtacggtacgtacggactaacccgtatttccgtggttaccttaccg

SEQ ID NO: 275553 - DNA, 780 bp, Homo sapiens
  misc_feature: GYAE6OF01BIZFP.3.14.B03.1.454.CMB.1.raw
  modified_base (201)..(201): a, c, t, g, unknown or other
  misc_feature (201)..(201): n is a, c, g, or t
  modified_base (303)..(303): a, c, t, g, unknown or other
  misc_feature (303)..(303): n is a, c, g, or t
tcagagacgcactccacgaccggtgctcgatttagtgtgagtagttccgcgggggaggaactgctcagttaggacccagacggaaccatggaagccccagcgcagcttctcttcctcctgctactctggctcccagacaccactggagaaatagtgatgacgcagtctccagccaccctgtctgtgtctccgaggggaaangccaccatctcctgcagggccagtcagactattagaagcaacttagcctggtaccagacaagaaacctggccaggctcccgaggcctcctcatctagtggtncactcccaccgacgggcctacgtcggtactcccgagcccgtaggttcaggtggctaggttgggtcgtaggggactaggtacgtttaccaccgttcctacgaaccctattccgaacggcctaccggtcccttacggccgtaacgttccgttaagggtaaacgtttagttttttccggaacccttttaaacgttttttaacgttttccgttacggttacctaacggttaaccgtaaagttttaaacgttaaaacgttaacccggttaccggggtacccccgttttaccggggttacggggttaacccggggttttacccggggggaaccccggggggttaaaccggtaaaggggggtttacggggaaacggttaaaccgggttaaccggtaaaaacccgggttacggttacggggtaccgggttacgtaccgggtaccctaaccccgtagtttcccggttagtttaccctttaacccgg

SEQ ID NO: 275554 - DNA, 552 bp, Homo sapiens
  misc_feature: GYAE6OF01ELGTS.3.14.B03.1.454.CMB.1.raw
  modified_base (200)..(200): a, c, t, g, unknown or other
  misc_feature (200)..(200): n is a, c, g, or t
  modified_base (413)..(413): a, c, t, g, unknown or other
  misc_feature (413)..(413): n is a, c, g, or t
  modified_base (428)..(428): a, c, t, g, unknown or other
  misc_feature (428)..(428): n is a, c, g, or t
  modified_base (523)..(523): a, c, t, g, unknown or other
  misc_feature (523)..(523): n is a, c, g, or t
tcagagacgcactccacgaccggtgctcgatttagtgtgagtagttccgcgggggaggaactgctcagttaggacccagacggaaccatggaagccccagcgcagcttctcttcctcctgctactctggctcccagacaccactggagaaatagtgatgacgcagtctccagccaccctgtctgtgtctccaggggaaangccacatctcctgcagggccagtcagactattagaagcaacttagcctggtaccagcagaaacctggccaggctcccgaggctcctcatctatggtgcatcccaccaggggcccacgtggtactcccagcctaggttcaggtggctaggtcgggtcgtggggacaggtagttccacgttctcacctatcacgcacgcctgcagtctagaagtnttttgcttacttttntttctgtcagtcagttataatacgtcgtccgtcgtggtaccggttcgggaccggggtaaccgtagggtggaagtacgtacgaaacggtacgtggnggtcgcgtacacctatcgttgtcgttacc

SEQ ID NO: 275555 - DNA, 537 bp, Homo sapiens
  misc_feature: GYAE6OF01DAH9Z.3.14.B03.1.454.CMB.1.raw
  modified_base (200)..(200): a, c, t, g, unknown or other
  misc_feature (200)..(200): n is a, c, g, or t
  modified_base (298)..(298): a, c, t, g, unknown or other
  misc_feature (298)..(298): n is a, c, g, or t
  modified_base (393)..(393): a, c, t, g, unknown or other
  misc_feature (393)..(393): n is a, c, g, or t
tcagagacgcactccacgaccggtgctcgatttagtgtgagtagttccgcgggggaggaactgctcagttaggacccagacggaaccatggaagccccagcgcagcttctcttcctcctgctactctggctcccagacaccactggagaaatagtgatgacgcagtctccagccaccctgtctgtgtctccaggggaaanagccaccatctcctgcagggccagtcagactattagaagcaaacttagcctggtaccagcagaaacctggccaggctccaggctcctcatctatggtncatccacaggccatggtatcccagccaggttcagtgcagtgggtctgggacagtacgtcactctacaccatcagcagcctgcagtctagtaagtnttttgcttacttttattctgtcagtctagttaataataacgtgtcctcgtaggtacggttcgggaccggggtacctaagggtggaagacgtacgtaaaacggtacgttggtacggtctagtccaacctattcgtgttcttaccg

SEQ ID NO: 275556 - DNA, 760 bp, Homo sapiens
  misc_feature: GYAE6OF01BE4C5.3.14.B03.1.454.CMB.1.raw
  modified_base (200)..(200): a, c, t, g, unknown or other
  misc_feature (200)..(200): n is a, c, g, or t
tcagagacgcactccacgaccggtgctcgatttagtgtgagtagttccgcgggggaggaactgctcagttaggacccagacggaaccatggaagccccagcgcagcttctcttcctcctgctactctggctcccagactacccccggagaaattcttttgacgcagtctccaggcaccctgtctttgtctccgagggganagagccaccctctcctgcagggccagtccgagtgtcagcagccaaccacttagcctggtaccagcagacgacctggccaggcctcccgaggcctcctcactccagtggtgccactccaaacgacgggcccaacgtcggccaactacccccgaggaacctacgggtttaccaagggttcggaccgtaagggttcggggttacgtacgggaaaactacggtacctttaccaaccttcctaccgaacccgtaataccgagggtaccaacggacgttacgggacgtacccttaaggaaacgtaccgttttaggacctttaagggtttttaactttaacgttcgtttaccgttaggaaccgttaaggttagttacgggtttaacctttaccgttaacgtttcgtttacgggttaaccttaacgggttttcccggggaccgggtacccggggttaaaccgtaaagggggttcggtaaacggttaacgtaacccggtaaaaggttaccgttacgggacggtaccgttacggacctaaccttacgtttacgttcggttacctttaccg

SEQ ID NO: 275557 - DNA, 545 bp, Homo sapiens
  misc_feature: GYAE6OF01DL2IG.3.14.B03.1.454.CMB.1.raw
  modified_base (200)..(200): a, c, t, g, unknown or other
  misc_feature (200)..(200): n is a, c, g, or t
  modified_base (238)..(238): a, c, t, g, unknown or other
  misc_feature (238)..(238): n is a, c, g, or t
  modified_base (403)..(403): a, c, t, g, unknown or other
  misc_feature (403)..(403): n is a, c, g, or t
tcagagacgcactccacgaccggtgctcgatttagtgtgagtagttccgcgggggaggaactgctcagttaggacccagacggaaccatggaagccccagcgcagcttctcttcctcctgctactctggctcccagacaccactggagaaatagtgatgacgcagtctccagccaccctgtctgtgtctcgaggggaaanagccaccatctcctgcagggccagtcagactatagaancaacttgcctggtaccagcagaaacctggccaggctcccaggctcctcatctatggtgcactccaccgagggccacgtggtactcccagccaggttcagtggctaggtgggtctgggacaggtagttcactctacaccatcagcacgcctgctagtctagtaatnttttgcttacgtttattctgtcagtctaattaataactacgtcggtcctcggtggtaccgttcggggaccggggtacgtagggtcggagtacgtacggaaagtacgtggtacgggtctacggtcaacgtatcgtgttcttac

SEQ ID NO: 275558 - DNA, 608 bp, Homo sapiens
  misc_feature: GYAE6OF01BIILS.3.14.B03.1.454.CMB.1.raw
  modified_base (200)..(200): a, c, t, g, unknown or other
  misc_feature (200)..(200): n is a, c, g, or t
  modified_base (301)..(301): a, c, t, g, unknown or other
  misc_feature (301)..(301): n is a, c, g, or t
tcagagacgcactccacgaccggtgctcgatttagtgtgagtagttccggcgggggaggaactgctcagttaggacccagacggaaccataggaagccccagcgcagcttctcttcctctgctactctggctcccagacaccacgtggagaaatagtgatgacgcagtctccagccacctgtctgtgtctcgaggggaangccacatctcctgcgagggccagtcagactatagagctaacttgcctggtaccagacaagaacctggccaggcctccgaggcctcctcactctagtggtcnctagtccacgagggcctacgtggtactcccgagccgtaggttcaggtcggactaggtcgggtctaggggactaggtacgttacacttcctacaaccgtatccgacgcctacgtcctagactagtctagtaagttcttttcgactttacgttttagtttcgtacgtactagtacgtaagttaacttaaacgttacgtacggtccttaccgggttacgggtaccggttcggggaccggggtacgtagggtcggaacgtacgtaccgtaaaggtcgtggtcgtcgtcgactacgtatcgttcgtcgtacg

SEQ ID NO: 275559 - DNA, 580 bp, Homo sapiens
  misc_feature: GYAE6OF01EEYO6.3.14.B03.1.454.CMB.1.raw
  modified_base (201)..(201): a, c, t, g, unknown or other
  misc_feature (201)..(201): n is a, c, g, or t
  modified_base (298)..(298): a, c, t, g, unknown or other
  misc_feature (298)..(298): n is a, c, g, or t
  modified_base (376)..(376): a, c, t, g, unknown or other
  misc_feature (376)..(376): n is a, c, g, or t
tcagagacgcactccacgaccggtgctcgatttagtgtgagtagttccgcgggggaggaactgctcagttaggacccagacggaaccatggaagccccagcgcagcttctcttcctcctgctactctggctcccagacaccactggagaaatagtgatgacgcagtctccagccaccctgtctgtgtctccgaggggaaangccaccatctcctgcagggccagtcagactatagaagcaacttagcctggtaccagcagaacctggccaggctcccaggcctcctcatctagtggtncatcccaccgagggcctacgtggtactcccgagcctaggttcagtggcaggtgggtctgggacaggagttccacttcncaccatcagcacgccgtgctagtctagtaagtattttgacttacttttattcgtggtactagtctagttaataacgttaacgtcggtacccttaccgggttagggtaccggttccgggaccggggtaaccgtagggtacggaagtacgtacgtaaacggtacgtggtacggtacgtcgtacctacctattcgttgtccttaccg

SEQ ID NO: 275560 - DNA, 513 bp, Homo sapiens
  misc_feature: GYAE6OF01EOJF3.3.14.B03.1.454.CMB.1.raw
  modified_base (200)..(200): a, c, t, g, unknown or other
  misc_feature (200)..(200): n is a, c, g, or t
  modified_base (497)..(497): a, c, t, g, unknown or other
  misc_feature (497)..(497): n is a, c, g, or t
tcagagacgcactccacgaccggtgctcgatttagtgtgagtagttccgcgggggaggaactgctcagttaggacccagacggaaccatggaagccccagcgcagcttctcttcctcctgctactctggctcccagacaccactggagaaatagtgatgacgcagtctccagccaccctgtctgtgtctccaggggaaangccaccatctcctgcagggccagtcagactattagaagcaacttagcctggtaccagcagaaacctggccaggcctcccaggcctcctcatctatggtgcatcccaccagggccactggtactcccagccaggttcagtggcaggtgggtctgggacaggtagttcactctcaccatcagcagcctgcagtctagaagtatttgctacttttatttctgtcagctaagtataatactggtcctcgtggtacgttcgggccggggacagggtggagacgtacgaaacgacgtgtcggntgcacatctgtcttac

SEQ ID NO: 275561 - DNA, 705 bp, Homo sapiens
  misc_feature: GYAE6OF01AZYN3.3.14.B03.1.454.CMB.1.raw
  modified_base (194)..(194): a, c, t, g, unknown or other
  misc_feature (194)..(194): n is a, c, g, or t
  modified_base (203)..(203): a, c, t, g, unknown or other
  misc_feature (203)..(203): n is a, c, g, or t
tcagagacgcactccacgaccggtgctcgatttagtgtgagtagttccgcgggggaggaacgtggctcagttaggacccagacggaaccatggaagcccagcgcagcttctcttcctcctgctactctggctcccagaccaccactggagaaagtagtagactagacgcagtctccagccacctgtctgtgtcncgagggaangccacgatctctgcaggccagtcagtactagttagacgctaagttagcctaggtaccagtacaacgtaaacctggaccaacggtccgtacccgagggtccctccgtcacttctacgtcggtcgcctactacccgaacggacggcctaccgttcggtacctccccgacgtacccgtacggttcaacggtcggacctagggttcgggtacgtacgggaacgtacggtacggtttacccacgttcctaccgaacccgtagttaccgaacgtccctaacgtccctaggacctaacggtcctaggtaacgttacgttttcgacctttaacgttttacgttcgtacgttacaagttaccgtaagtttaacttaaacgtaaccgtcgggtacccttcgggttacggtaccgggttaccgggacccggggtacgaacgggtcggaacgtaacgtaccgaaacgtacggttggacggtacctcggacctacgtattctacggttcctaccg

SEQ ID NO: 275562 - DNA, 561 bp, Homo sapiens
  misc_feature: GYAE6OF01EB829.3.14.B03.1.454.CMB.1.raw
  modified_base (300)..(300): a, c, t, g, unknown or other
  misc_feature (300)..(300): n is a, c, g, or t
tcagagacgcactccacgaccggtgctcgatttagtgtgagtagttccgcgggggaggaactgctcagttaggacccagacggaaccatggaagccccagcgcagcttctcttcctcctgctactctggctcccagacaccactggagaaatagtgatgacgcagtctccagccaccctgtctgtgtctccgaggggaaagagccaccatcctcctgcagggccagtcagactattagaagcaacttagcctggtaccagcagaaacctggccaggctcccaggctcctcatctatggtncatccacagggccactggtactcccagcccaggttcagtggcaggtgggtctgggacaggtagttcactctcacctatcagccagtcctggactagtctagtaagtattttcgactttacttttatttctgttacagtactagtataaacgtacgtcggtcccttcggtcggtacggttccggggaccggggtaccaagggtggagtacgtacgaaacggaacgtggtacggtctacgacgtaccattctcgttcttaccg

SEQ ID NO: 275563 - DNA, 780 bp, Homo sapiens
  misc_feature: GYAE6OF01CW1AZ.3.14.B03.1.454.CMB.1.raw
  modified_base (206)..(206): a, c, t, g, unknown or other
  misc_feature (206)..(206): n is a, c, g, or t
  modified_base (246)..(246): a, c, t, g, unknown or other
  misc_feature (246)..(246): n is a, c, g, or t
tcagagacgcactccacgaccggtgctcgatttagtgtgagtagttccgcgggggaggaactgctcagttaggacccagacggaaccatggaagcccagcgcagcttctcttcctcctgctactctggcctcccagacaccacgtggaagaaatagtgatgacgcagtctccacgcccacctgtctgtcgtctacgaaggggaaancgaccacatctcctgcgagggccagtcagactaataaganactaacttacgcctaggtaccagactacgaaacgtggacacggcctccgaggtcctacctctataccgtagtggtcgactaacgtacccgaaccgtcgggaccctacgttcgggtaacctcccgaaggtcccgtagggttaccgacggtacggaccgttaagggtcgggtttccgaagggggaactaggttaacgttcctaaccttaccgtaaccaacccttaatcccgaagtaccgtaccgtacgtcggtaacgtacgttacgtaacggtaaagttacgttttaccgtactttaacgtttttacttacgttacgtaacctagggtaccttaaaggttaaacgttaaagttaaccgttcgggtacccgttccggttaacggggtaccggggtttaccgggggaacccgggtaacgggttaaacgggtacgggtaaccggaaacgttaaacccgggaaaacgtacgggtttaacgggacggttacccggactaccggtaaaccgttctaaccggtttcgtcccgttttaaacccg

SEQ ID NO: 275564 - DNA, 559 bp, Homo sapiens
  misc_feature: GYAE6OF01D5G4A.3.14.B03.1.454.CMB.1.raw
  modified_base (201)..(201): a, c, t, g, unknown or other
  misc_feature (201)..(201): n is a, c, g, or t
tcagagacgcactccacgaccggtgctcgatttagtgtgagtagttccgcgggggaggaactgctcagttaggacccagacggaaccatggaagccccagcgcagcttctcttcctcctgctactctggctcccagacaccactggagaaatagtgatgacgcagtctccagccaccctgtctgtgtctccgaggggaaangccaccatctcctgcagggccagtcagactattagaagcaacttagcctggtaccagcagaaacctggccagctcccaggctcctcatctagtggtgcatccaccgaggccacgtggtactcccgagccaggttcaggtggcgaggtgggtctgggaactaggtacgttcacgtctcacatcagcacgtccgtgctagttcctaggtaagttattttgactttactttatttctgtcagtctaagtaataattaccgtaggtcccttacggtggtaaccgggttccgggaccggggtacgtaagggtcggaagtacgtacgaaacgagttcgtagggtctacgcactattctgtcgtc

SEQ ID NO: 275565 - DNA, 789 bp, Homo sapiens
  misc_feature: GYAE6OF01DTCEL.3.14.B03.1.454.CMB.1.raw
  modified_base (223)..(223): a, c, t, g, unknown or other
  misc_feature (223)..(223): n is a, c, g, or t
  modified_base (274)..(274): a, c, t, g, unknown or other
  misc_feature (274)..(274): n is a, c, g, or t
tcagagacgcactccacgaccggtgctcgatttagtgtgagtagttccgcggggggacgacgtgctcagttaggacccagacggaaccatgggaacgccccgagcggctacgtctttctcgttccgtcctgcctactctggcctcccagaccacgacgtggagaaagtgtgaatgacggcagtactcgaagccaccctggtcctggtgtacgtccgagggaancgcccgacctatccgccgtgactacggtccagtacagtacttatacgaacncgtaacttgcctagggtacccagcaaggaacctggacctagggccttacccggaggtccttccccgtacgtaactttcgtaacgtacgggtacaacctaacgtccccgaaacggacgggtaccctaccgttacgggtaaccaccccgaacgcccgtaagggttaccaacgggtacgggaccgtaagggttcggggtacgtacggggaacacggtacgttaccctacgtactacggaaccctagtacgacggcctaacggtcccgtaagtccgttaggtaccgtaaggtaacgtttacgtttaccgtacttttaacgtttttcgttacgtacggtacctaggtaaccctaaagtttacctaaacgttacggttcccggggtacttaccgggttacggtaaccgggttccgggtaccggggtaaccgtaagggtcggtaaagtaccggtaacgtaaacggtacggtcggtcggtaccgtacgtaccttaacctaggtcccttcgttcccttaaccgg

SEQ ID NO: 275566 - DNA, 808 bp, Homo sapiens
  misc_feature: GYAE6OF01DXG48.3.14.B03.1.454.CMB.1.raw
  modified_base (226)..(226): a, c, t, g, unknown or other
  misc_feature (226)..(226): n is a, c, g, or t
  modified_base (241)..(241): a, c, t, g, unknown or other
  misc_feature (241)..(241): n is a, c, g, or t
  modified_base (490)..(490): a, c, t, g, unknown or other
  misc_feature (490)..(490): n is a, c, g, or t
  modified_base (635)..(635): a, c, t, g, unknown or other
  misc_feature (635)..(635): n is a, c, g, or t
  modified_base (795)..(795): a, c, t, g, unknown or other
  misc_feature (795)..(795): n is a, c, g, or t
tcagagacgcactccacgaccggtgctcgattttagtgtgagtagttccggcggggggtagggaactgctcaggttacggaccccaggacggtaaccagtggaacgccccgagcgcacgccttcgtcttcctcctgcctaactctcgcctcccagacaccacgtggaagaaagtgtgatacgacgctagtctccacgccacctgtctgtcgtacacggaagggaancgaccacatcctccngcgacggccagtcagtactaatagaacgctaactcgctaggtaccagacgaacgaaaccgtggaccgacgcctacccgaggtcctacctactactactacgtacgggtctacaactccccgaacgacgggacctaacgttcggtaacctaccccgaagcccgttaaggttaccgaaggttcgggaccgttaacggggtggtttaccggagggggaaactacggttaaccggttacctaaccccgtttanaccccgtaaaaccagttaacccaagggccctaaacgggtccctaaggtcctaaggttacctaagggtaaattttacggtttttccaacgtttttaaacttttgttacccgtaggtactaaacggtaccgtaaagggttttaaaanaaaaccgtttccgggtaccgggtaaccccgttaggggtttaccggggtaacggtttccccggggggaccgggtaaacccggttagggaaacggtaacgtaaccggtaaacgtaaacgtaacggtcgtaaggtccgaacgttaccacttaaagttccgttnttacggttacccc

SEQ ID NO: 275567 - DNA, 640 bp, Homo sapiens
  misc_feature: GYAE6OF01DD7IN.3.14.B03.1.454.CMB.1.raw
  modified_base (201)..(201): a, c, t, g, unknown or other
  misc_feature (201)..(201): n is a, c, g, or t
tcagagacgcactccacgaccggtgctcgatttagtgtgagtagttccgcgggggaggaactgctcagttaggacccagacggaaccatggaagccccagcgcagcttctcttcctcctgctactctggctcccagacaccactggagaaatagtgatgacgcagtctccagccaccctgtctgtgtctccgaggggaaangccaccatcctcctgcagggccagtcagactattagaagcaacttgcctaggtaccagacaacgaaacctggccaggcctacccgaggcctcctcatactagtggtcactactcccaccgagggcctacgtcggtactccccgagcccgtaggttcaggtggcgtagggtcgggtctagggactaggtacgttccacttctacaccatccgaacgctacggtcccgttagggaacgttctaaggaacgtaccttcgtagtactttaggttttactaccgttcgtacacgtacttagttaacttaacgtttaccggtcgggtaccggttagggtacccggtttaccgggaccggtaaacggggtaccgtaaagggtacggtaaactaccgaaaacggtcgttaggtcgactgacctacgattcgtacgttcttctacccg

SEQ ID NO: 275568 - DNA, 771 bp, Homo sapiens
  misc_feature: GYAE6OF01E4MHU.3.14.B03.1.454.CMB.1.raw
  modified_base (211)..(211): a, c, t, g, unknown or other
  misc_feature (211)..(211): n is a, c, g, or t
  modified_base (229)..(229): a, c, t, g, unknown or other
  misc_feature (229)..(229): n is a, c, g, or t
tcagagacgcactccacgaccggtgctcgatttagtgtgagtagttccgcgggggaggaactgctcagttaggacccagacggaaccatggaagccccagcgcagcttctcttcctcctgctactctggcctcccagacaccatggaagaaatagtgatgacgcagtcctccagcccaccttgtcctgtgtccgtaccggaaggggaaacncgccacctagtcctccgngcgacggccagtacagtaactagtaacgacgactaacgttacgccgtacggtaccagaccgaaacgaaccgtcggacccgacggtccctacccgaggtccctacgtactacgtacgtagtcgacgacctaccgaccggaccggtacgaccttacggtaccgaccgtaccgacgtacggtaggtcggaggtcggtacggtaggtcgggtactacggtacgtacgtacgtaccaccttaccacctacgacgacgcgaccgtacgccgtagtacgttaagttagttaacgttagtttacttacctttacgtttaacttttgtaccgtaagtactaagttaacgtaaagttaaccttaaaccgggtcccgttaccgggttaccgggttaccgggttaaccggggtacccggggtaccggggtaacgggtaacggtaagggtaaccgaaaccgtaaccggtaaacgtaccgggttaacggtccgggtacctaccggtacccgtaccgtttaccgtacgttttacccgttccgttcccgtttaacccc

SEQ ID NO: 275569 - DNA, 622 bp, Homo sapiens
  misc_feature: GYAE6OF01D4YO3.3.14.B03.1.454.CMB.1.raw
  modified_base (210)..(210): a, c, t, g, unknown or other
  misc_feature (210)..(210): n is a, c, g, or t
  modified_base (438)..(438): a, c, t, g, unknown or other
  misc_feature (438)..(438): n is a, c, g, or t
tcagagacgcactccacgaccggtgctcgatttagtgtgagtagttccgcgggggaggaacctgctcagttaggacccagacggaaccatgggaagcccccagcggccagcttctcttcctcctgcctactctgggcctcccagacaccactggagaaatagtgatgacgcagtctccagcccaccctgtctgtgtctccgaggggaaanagccaccatctcctgcaggggccagtcagactatagaagcaacttgcctggtaccagcaagaaacctggaccaggcctcccaggcctcctcatctagtggtgcatcccaccgacgggccctacgtcggtactccccgagccctaggttcaggtggctagggtcgggtctaggggacaggtacgttccacttcctacacctatccagccagcctgctagtctagtaatnttttcgctttacttttatttctgtacagtactaagttaactaattacgtcgggtacccgttacgggtcggtacccgggttcggggacccgggggtaaccgtaggggtcgggaagtaacgtaaccgtaaaccggtacggttggtacgggctacggtaccaaccgtagtttctcggttcttacccg

SEQ ID NO: 275570 - DNA, 611 bp, Homo sapiens
  misc_feature: GYAE6OF01DFH86.3.14.B03.1.454.CMB.1.raw
  modified_base (200)..(200): a, c, t, g, unknown or other
  misc_feature (200)..(200): n is a, c, g, or t
  modified_base (305)..(305): a, c, t, g, unknown or other
  misc_feature (305)..(305): n is a, c, g, or t
  modified_base (413)..(413): a, c, t, g, unknown or other
  misc_feature (413)..(413): n is a, c, g, or t
tcagagacgcactccacgaccggtgctcgatttagtgtgagtagttccgcgggggaggaactgctcagttaggacccagacggaaccatggaagccccagcgcagcttctcttcctcctgctactctggctcccagacaccactggagaaatagtgatgacgcagtctccagccaccctgtctgtgtctccaggggaaanagccaccatctcctgcagggccagtcagactattagaagcaacttagcctaggtaacccagcaagaaacctggcccaggctcccgaggcctcctcatctatggtncatccaccagggccactggtactcccagcctaggttcagtcggctaggtgggtactgggacaggtacgttcactctacaccatcgagcagcctgcagtctagtaagtnttttcgacttacttttattcttgttacagtactaagttaattaacgttaacgtcgggtacccgttccgggttcgggttaacccgggttccgggggacccgggggtaaaccgtaaggggtcgggtaacggtaacgtaaccgaaaacggtacgttgggtacggactcggtaccgtacctattcgttcgttcctttacccg

SEQ ID NO: 275571 - DNA, 574 bp, Homo sapiens
  misc_feature: GYAE6OF01BUC3J.3.14.B03.1.454.CMB.1.raw
  modified_base (201)..(201): a, c, t, g, unknown or other
  misc_feature (201)..(201): n is a, c, g, or t
  modified_base (425)..(425): a, c, t, g, unknown or other
  misc_feature (425)..(425): n is a, c, g, or t
tcagagacgcactccacgaccggtgctcgatttagtgtgagtagttccgcgggggaggaactgctcagttaggacccagacggaaccatggaagccccagcgcagcttctcttcctcctgctactctggctcccagacaccactggagaaatagtgatgacgcagtctccagccaccctgtctgtgtctccgaggggaaangccaccatctcctgcagggccagtcagactattagaagcaacttagcctggtaccagcaagaaacctggccaggcctcccaggcctcctcatctagtggtgcatccacgacgggcctacgtggtactcccgagcccgtaggttcaggtcggactagggttgggtctagggactaggtacgttcactctacaccatcagtcacgtcctgctgtacgtagaagttnttttcgcttaacttttgtttctgtactagctaagtactaagtacgtcggtccttcggtgggtaccgttcggggaccgggtacgtaagggtggagtagtaccgaaacggtacgtggtacggtctcgactaccgtatccttgtccttaccg

SEQ ID NO: 275572 - DNA, 615 bp, Homo sapiens
  misc_feature: GYAE6OF01BJNCE.3.14.B03.1.454.CMB.1.raw
  modified_base (202)..(202): a, c, t, g, unknown or other
  misc_feature (202)..(202): n is a, c, g, or t
  modified_base (241)..(241): a, c, t, g, unknown or other
  misc_feature (241)..(241): n is a, c, g, or t
  modified_base (319)..(319): a, c, t, g, unknown or other
  misc_feature (319)..(319): n is a, c, g, or t
  modified_base (465)..(465): a, c, t, g, unknown or other
  misc_feature (465)..(465): n is a, c, g, or t
tcagagacgcactccacgaccggtgctcgatttagtgtgagtagttccgcgggggaggaactgctcagttaggacccagacggaaccatggaagccccagcgcagcttctcttcctcctgctactctggctcccagacaccactggagaaatagtgatgacgcagtctccagcccaccctgtctgtgtctccgaggggaaancgccaccatctcctgcagggccagtcagactattagaancaacttagcctggtaccagcagaacctggccaggcctcccgaggtcctcctcattctagtggtcgcactcccgaccgngggccctacgtggtactcccgagccgtaaggttccaaggtcggactagggtcggggtctaggggaacctaggtacgtttcaccgttcctccgaacctatccacgcacgcctgctagtctagaagttagtttcgactttaacttttntttcgtgttacagtactaagttaataacgtacgtcggtaccgttccggtaggtaccgggttccggggacccggggtaacgtaggggtggtaagacggtaaccgaaacggtacgtggacggtgtacgaccaccgtattcgtgttccttacg

SEQ ID NO: 275573 - DNA, 718 bp, Homo sapiens
  misc_feature: GYAE6OF01BKD2X.3.14.B03.1.454.CMB.1.raw
  modified_base (200)..(200): a, c, t, g, unknown or other
  misc_feature (200)..(200): n is a, c, g, or t
  modified_base (241)..(241): a, c, t, g, unknown or other
  misc_feature (241)..(241): n is a, c, g, or t
  modified_base (299)..(299): a, c, t, g, unknown or other
  misc_feature (299)..(299): n is a, c, g, or t
tcagagacgcactccacgaccggtgctcgatttagtgtgagtagttccgcgggggaggaactgctcagttaggacccagacggaaccatggaagccccagcgcagcttctcttcctcctgctactctggctcccagaccaccactggagaaatagtgatgacgcagtctccagccacctgtctgtgtctccgaggggaancgccaccatcctccgtgcgagggccagtcagactatagaancaacttagcctggtaccagcagaacctggcaggctccaggctcctcatctagtggtcnccactcccgaccgagggccctagtcggtaactcccagccgtaggtcaggtggcgtagggtcggtcgtaggggactaggtacgtttaccacgttctaccaccgtagttaccgacgtacgtacgtccgtggtacgtacgttaccgtaaggtaaacgtttacgttttacggaccttttaaccgtttttacgttttacgtcgtttaccgtaacggtacttaaaggtttaacttaaaccgttacccggttacggggtccccgtttaaccgggtacgggttacccggggttaccggggtacccgggggttaaaccggaaggggttcgggtaacgggtaaccgttaaccggtaaaaccgtacggttcggtaccggtaccgtaccggaccgtaccgttacggtttacgtcccgttaccgttaaccgg

SEQ ID NO: 275574 - DNA, 780 bp, Homo sapiens
  misc_feature: GYAE6OF01CVMW0.3.14.B03.1.454.CMB.1.raw
  modified_base (183)..(183): a, c, t, g, unknown or other
  misc_feature (183)..(183): n is a, c, g, or t
  modified_base (211)..(211): a, c, t, g, unknown or other
  misc_feature (211)..(211): n is a, c, g, or t
  modified_base (770)..(770): a, c, t, g, unknown or other
  misc_feature (770)..(770): n is a, c, g, or t
tcagagacgcactccacgaccggtgctcgatttagtgtgagtagttccggcgggggaggaactgctcagttaggacccagacggaaccatggaagccccagcgcagcttctcttcctcctgctactctggcctcccagaccaccacgtggaagaaatagtgatgacgcagtcctccacgcccnccctgtctgtcgtcctcgaaggggaacncgacccacatcctccgtgacgacggccagtcagactatagaagctaacgtcgccgtagtaaccagacgaacgaacgtcgacccgagccctccgacggccttccgactatacgtagtcggtcgacctactaccgtacccggaggccctacggttcggaacctcccgacgtacccgtaggttaccgagggttacgacgtagggtcgggtagtacgggtactacgtacgtttccctaacttccccgtaactacccgtagttaccgaccggtaccgtaccgtccgtacgtaccgtacgttaaccggtagtaacgtttagtttaccgtttacctttaacttttcgttaccgtacgttacgtaacgttaacgttaacgttaaacgttaacgttacccggtttacccggtacccggttaccgggttaccgggttacccgggggttaccggggaacccgggttaaaccgggtaacggggacggtaagtaacccggtaaacggtaaacggtcgttaacgggtaccgggaccttacggaacccgttacgttaccgtttctacccgtttntaacccccgg

SEQ ID NO: 275575 - DNA, 594 bp, Homo sapiens
  misc_feature: GYAE6OF01AMTQH.3.14.B03.1.454.CMB.1.raw
  modified_base (203)..(203): a, c, t, g, unknown or other
  misc_feature (203)..(203): n is a, c, g, or t
  modified_base (306)..(306): a, c, t, g, unknown or other
  misc_feature (306)..(306): n is a, c, g, or t
  modified_base (447)..(447): a, c, t, g, unknown or other
  misc_feature (447)..(447): n is a, c, g, or t
tcagagacgcactccacgaccggtgctcgatttagtgtgagtagttccgcgggggaggaactgctcagttaggacccagacggaaccatggaagccccagcgcagcttctcttcctcctgctactctggctcccagacaccactggagaaatagtgatgacgcagtctccagccaccctgtctgtgtctccgaagggggaaanagccaccatcctcctgcagggccagtcagactatagaagcaaccttgcctggtaccagcaagaacctggaccaggcctcccgaggcctcctcatctagtggtncactcccaccgagggccacgtcggtactcccgagccctagggttcaggtggctagggtcgggtctgggactggtacgttccacttctccacctatcgacgcacgcctcgcagtctagtaagttattttcgacttacttttntttctgtcagtctaagttactaagtacgtcggtcccgttcggtcggtaccggttccggggaccggggtacgtagggtacggacgtaacgtacgaaacggtaacgtcggtacggtaccgtcgtaccaccgtattccgtgttcttaccg

SEQ ID NO: 275576 - DNA, 669 bp, Homo sapiens
  misc_feature: GYAE6OF01EQGEF.3.14.B03.1.454.CMB.1.raw
  modified_base (202)..(202): a, c, t, g, unknown or other
  misc_feature (202)..(202): n is a, c, g, or t
  modified_base (306)..(306): a, c, t, g, unknown or other
  misc_feature (306)..(306): n is a, c, g, or t
tcagagacgcactccacgaccggtgctcgatttagtgtgagtagttccgcgggggaggaactgctcagttaggacccagacggaaccatggaagccccagcgcagcttctcttcctcctgctactctggctcccagacaccactggagaaatagtgatgacgcagtctccagcccaccctgtctgtgtctccgaggggaaangccaccatctcctgcagggccagtcagactatagaagcaacttagcctggtaccagcaagaaacctggccaggcctacccgaggtcctcctacatctagtggtncatcccacgtacgggccaacgtggtactcccagtcccgaggttcaggtgggacaggtcggggtctaggggacctaggtacgtttccgaacttccgtaccaaccctaattccgaggtccctaacggtccctcggacgtacgttctaaggtaagtttactttacgtactttactttttatttacctcgttaccgagtactaagtttaacgtaacgttaaccgtcgggttaacccttccgggttacgggtaccggttccgggggtacccgggtacggtaagggttacggaacggtaacgtaaccggaaacggtacggttcggtacggtcgtaccgtaccgtaacgtacttcgttgttcctttaccg

SEQ ID NO: 275577 - DNA, 648 bp, Homo sapiens
  misc_feature: GYAE6OF01C3ZZO.3.14.B03.1.454.CMB.1.raw
  modified_base (203)..(203): a, c, t, g, unknown or other
  misc_feature (203)..(203): n is a, c, g, or t
tcagagacgcactccacgaccggtgctcgatttagtgtgagtagttccgcgggggaggaactgctcagttaggacccagacggaaccatggaagccccagcgcagcttctcttcctcctgctactctggctcccagacaccactggagaaatagtgatgacgcagtctccagcccaccctgtctgtcgtctccgaggggaaanagccaccatcctcctgcagggccagtcagactattagaagcaaatgcctaggtaccagacacgaaaccgtggcctaggctcccgaggcctcctcattctagtggtcgactactacccaccgagggccctacgtcggtactccccgagcctaggttccaggtcggcgtaggtcggtacgtgggacagtacgtcactcgtacaccagtccagcacgcctgccgtagtcgtagtaagttacttttcgtccttatttttacttcgttacgtactagtacgttaagttaaattaacgtaacgtcggtcccgttacggttcggggttaccggtccggggtacccgggggaaccgtaaagggtcgggtaacgtaaccgtaaacggtaaaccggtaacgttcggtccgggtactacgtacccgaaccttagttccttcggttctttaaccccg

SEQ ID NO: 275578 - DNA, 685 bp, Homo sapiens
  misc_feature: GYAE6OF01BCP5S.3.14.B03.1.454.CMB.1.raw
  modified_base (202)..(202): a, c, t, g, unknown or other
  misc_feature (202)..(202): n is a, c, g, or t
  modified_base (241)..(241): a, c, t, g, unknown or other
  misc_feature (241)..(241): n is a, c, g, or t
tcagagacgcactccacgaccggtgctcgatttagtgtgagtagttccgcgggggaggaactgctcagttaggacccagacggaaccatggaagccccagcgcagcttctcttcctcctgctactctggctcccagacaccactggagaaatagtgatgacgcagtctccagcccaccctgtctgtgtctccgaggggaaanagccaccatcctcctgcagggccagtcagactatagaancaacttgcctgaccagcagaacctgccagcctccaggtctctcatctatggtcgcacgttcccaccgagggcccacgttggtacctccccgagcccgtagggttcaacggtggacctagggtcgggtctagggaccaggtactttccgacttcctaccacccgtaatcccgaaggtacacggtcccgtggtaccgtaacggttccgttaaggtaaacgtttacgtttttacggtacctttaacgttttttaacgtttccgttacgtacgtacgtaccggttaagttaacttaaacgtaaccgttcgggtacccgtttccggtacggtaccgggttcccggggaccggggtaccgaacgggttcgggaacgtacgtaaccggtaaaacggtacgttgggacgtacccgtacggtaccgacccgtacgttaccgttggttcctccg

SEQ ID NO: 275579 - DNA, 750 bp, Homo sapiens
  misc_feature: GYAE6OF01BTY2M.3.14.B03.1.454.CMB.1.raw
  modified_base (201)..(201): a, c, t, g, unknown or other
  misc_feature (201)..(201): n is a, c, g, or t
  modified_base (308)..(308): a, c, t, g, unknown or other
  misc_feature (308)..(308): n is a, c, g, or t
  modified_base (325)..(325): a, c, t, g, unknown or other
  misc_feature (325)..(325): n is a, c, g, or t
tcagagacgcactccacgaccggtgctcgatttagtgtgagtagttccgcgggggaggaactgctcagttaggacccagacggaaccatggaagccccagcgcagcttctcttcctcctgctactctggctcccagacaccactggagaaatagtgatgacgcagtctccagcccacctgtctgtgtctccgaggggaaanacgccaccatctctgcgaggccagtcagacttaagtagaagactaacttagcctaggtaccagacaagtaaacctgggaccaggccctacccgaggtcctcccgtanacttactagttggtacncctaactccaaccgtcgggacctacgtcgtaacctcccgagccgtagttcgaggtcggacgtagggtcgggtcgacggggtactacgggtacttacccgacttccgtaccaaccgtaacgtccgaacggccacgggttccacggtacctaggttaccgtaagtaacgtttattttccggtacccttttaactttttaccgtttcttcggttaactaacggttacctttaaaaggtttaactttaaaccgttaacggttccggggttaaccccgtttaccgggggttaacgggttacccggggtttaccccggggaccgggggtaacccggtaaagggtccgggaaaacggtccgtaaaaccgtaaacggtacgttgggtaccggactccgggtaaaccacgtacgtttccttggtcccttaaccg

SEQ ID NO: 275580 - DNA, 797 bp, Homo sapiens
  misc_feature: GYAE6OF01A0REU.3.14.B03.1.454.CMB.1.raw
  modified_base (208)..(208): a, c, t, g, unknown or other
  misc_feature (208)..(208): n is a, c, g, or t
  modified_base (222)..(222): a, c, t, g, unknown or other
  misc_feature (222)..(222): n is a, c, g, or t
tcagagacgcactccacgaccggtgctcgatttagtgtgagtagttccgcgggggaggaactgctcagttaggacccagacggaaccatggaagccccagcgcagcttctcttcctcctgctactctggctcccagaccaccactggaagaaactgtgatgacgcagtcctccgagtcccacctgtctgtcgtcctccgaggggaaancgccacatcctccngcagggccagtcagtacttataagaagcctaacgttagccgtacggtaaccagtaccgtaacgtaaacccgtcggacccaacgggtcctacccgacggtccctcccgtactaccgtaccgtaagttcggtcgtaccaccgttacccgaaccggacgggtccctaacgttaccggtaccttaccccgagtcccgtaacgtttcgaacggtcggaacgtaggttcgggtcgtacggtaacgtacggttaaccttccgtaccgttccgttaacccgaacccgttacgaacccgtacggtacgtaaccgtccggtcgaccgttacggttacgtaacgtaagtttacgtttcgtacgtttaacgttttacgttacgttaacgtactaccgttaacgttacgtttaaccgtaccgttaccgggtacggtttaacgggtttacgtttaccgggaccggttaaccggggcgtaacggttcggtaacgggtaaccgtacggtaaacccgtaaacggtacggttcggccggttaactacccggtaaccctaccggttaaactccgttaccgttccggttaacccg

SEQ ID NO: 275581 - DNA, 636 bp, Homo sapiens
  misc_feature: GYAE6OF01BL994.3.14.B03.1.454.CMB.1.raw
  modified_base (386)..(386): a, c, t, g, unknown or other
  misc_feature (386)..(386): n is a, c, g, or t
  modified_base (604)..(604): a, c, t, g, unknown or other
  misc_feature (604)..(604): n is a, c, g, or t
tcagagacgcactccacgaccggtgctcgatttagtgtgagtagttccgcgggggaggaactgctcagttaggacccagacggaaccatggaagccccagcgcagctttctcttcctcctgctactctggctcccagacaccactggagaaatagtgatgacgcagtctccagccaccctgtctgtgtctccgaggggaaagagccaccatctcctgcaggccagtcagactattagaagcaacttagcctggtaccagacaagaaacctggccaggcctcccgaggcctcctacatcctagtggtgcacgtcccaaccgacgggacccagtcggttactcccagcccgtaggttcacggtggcagggttcgggtcgtggggaacnggtacggttccaacgtctcccacctagtccagccagtcctgacctagtcgtagaagttacttttacgacttaacttttactttcgtgtactacgctaagttaactaaacgttaccgtcggtaccccttcgggttacgggtaacccgggtttcggggacccggggtaactaacgggggtagtaacggtaaccgtacgaaacgttacggtcggtaccggntccgacacctaggttccttcggttcttacccg

SEQ ID NO: 275582 - DNA, 864 bp, Homo sapiens
  misc_feature: GYAE6OF01BVIEU.3.14.B03.1.454.CMB.1.raw
  modified_base (210)..(210): a, c, t, g, unknown or other
  misc_feature (210)..(210): n is a, c, g, or t
tcagagacgcactccacgaccggtgctcgatttagtgtgagtagttccgcgggggaggaactgctcagttaggacccagacggaaccatggaagccccagcgcagcttctcttcctcctgctactctggctcccagaccaccactggagaaatagtgaatgacgcagtcctccagcccaccctgtctgtcgtcctaccggaaggggaaancgccaccatcctcctgcgacgggccaggtcaggtagttacgttaggtacaccgtaaacttacggccgttacggacccgaagtcctaagtttacgttttccggttacggacccgtacggtcccttaccccggacggtccccttaccgtcctagtaccgttaggttcgggttacgcccgtacccgtacccccggaacccggggtaccctacgtttaccggttacccgttaccccggaacgggtacccgttaacggttacggacggttcggaaccgttggggttcgggtacccgtacggaaccgtaggtaacgttcccgaaccttccgtcccaaactacgttacgaacgccctcgggtaccgttcgggaacttacggtaaccggaacgttactttaccggatttacgtttaacgtttactaccgttacgaacgtacgtacgttaaagttttaacgttaagtttaccggtccggggttaaccgggtcggttaacccgggttcggtaacccggaaacggggttaaaccgtaaagggggtaaaaccctaaagttaaacccgggtaaacgggtaacccgtttgggggtaacctaccggtaacccgggtaacccttacgttaacggttcccctttaagttttcccggaaccttttaccccgg

SEQ ID NO: 275583 - DNA, 673 bp, Homo sapiens
  misc_feature: GYAE6OF01DSBMD.3.14.B03.1.454.CMB.1.raw
  modified_base (201)..(201): a, c, t, g, unknown or other
  misc_feature (201)..(201): n is a, c, g, or t
  modified_base (466)..(466): a, c, t, g, unknown or other
  misc_feature (466)..(466): n is a, c, g, or t
tcagagacgcactccacgaccggtgctcgatttagtgtgagtagttccgcgggggaggaactgctcagttaggacccagacggaaccatggaagccccagcgcagcttctcttcctcctgctactctggctcccagacaccactggagaaatagtgatgacgcagtctccagccaccctgtctgtgtctccgaggggaaanagccacatcctcctgccagggccagtcagactattagaagctaacttgcctaggtaccagcaagaaacctggaccaggcctcccgaggctcctcatctagtggtcgcactcccaccgagggcctacgttggtactcccagcctaggttcaggtggcaggtcgggtcgtgggacagtagtccacgtcctacaccaatcgacgacacgtcctgactagttcgtaaggtaaagttcttttcgactttacgttttatttcgttacgttntacgtactaagttaaacttaacgttaaccgtcgggtccgttccgggtaacgggttacccgggtttcccggggggaacccgggggtaacccgtaaggggttacgggtaacgtaacggtaaaccggtaaaaaccgggttacgttcgggtcggtaccggtaccggaacccttaacccgtaagttttccgttaccgtttccgtttaacccg

SEQ ID NO: 275584 - DNA, 803 bp, Homo sapiens
  misc_feature: GYAE6OF01CYGSL.3.14.B03.1.454.CMB.1.raw
  modified_base (162)..(162): a, c, t, g, unknown or other
  misc_feature (162)..(162): n is a, c, g, or t
  modified_base (569)..(569): a, c, t, g, unknown or other
  misc_feature (569)..(569): n is a, c, g, or t
tcagagacgcactccacgaccggtgctcgatttagtgtgagtagttccgcggggggaggaactgctcagttaggacccagacggaaccatggaacgccccagcgcagcttctcttcctcctgcctactctggcctcccagaccaccacgtggaagaaatagngatgacgcagtcctccacgccctacccttgtcttgtacgttccgtaccgaagggggaaacacgcccaacccattcctcctgaccgacgggccaggtccaagtaacttagttaggaacgtactaacttagccgtaggtaaccacggacaaaccggaaaccgttcgggaccctaacggggtcccttccccgaacggggtccttacccccgttagtaacgtttccgttaaggttcgggtaccgacctaaccgttcccccaaccggacggggtcccctaacgttcgggttaacctccccggacgtcccgttaagggtttcacggggttcggaccgtttaggggtcggggttaccgtaggggtaccacggttacgtttccgaccttcgttaccaccgtattccaacggtacncggttacctgaccgttactcggtaagtaagttcttttttacgaccttttactttttacttcgttcgttacactaacgttaagttaacgtaaccttacggtccgtccgttaccgggttacgggttacccggggttcggggacccggggttaaagacggggtaacggaagtaccgtaaccgggtaaacgtaggttcggtacgaccgtagtaccctagtctacgttcgttccttacg

SEQ ID NO: 275585 - DNA, 742 bp, Homo sapiens
  misc_feature: GYAE6OF01DGWP8.3.14.B03.1.454.CMB.1.raw
  modified_base (150)..(150): a, c, t, g, unknown or other
  misc_feature (150)..(150): n is a, c, g, or t
  modified_base (201)..(201): a, c, t, g, unknown or other
  misc_feature (201)..(201): n is a, c, g, or t
  modified_base (231)..(231): a, c, t, g, unknown or other
  misc_feature (231)..(231): n is a, c, g, or t
  modified_base (431)..(431): a, c, t, g, unknown or other
  misc_feature (431)..(431): n is a, c, g, or t
  modified_base (449)..(449): a, c, t, g, unknown or other
  misc_feature (449)..(449): n is a, c, g, or t
  modified_base (722)..(722): a, c, t, g, unknown or other
  misc_feature (722)..(722): n is a, c, g, or t
tcagagacgcactccacgaccggtgctcgatttagtgtgagtagttccgcggggaggaactgctcagttaggacccagacggaaccatggaagccccagcgcagcttctcttcctcctgctactctcggccctacgacgaccacctaggnggaaataagttagagtagtacgacgacgtcgtccacgccgaaccctccgtnttcgtacgtcgttaccgaacgggaaggacncctaccaactctcctcgacgcggaccgacgtacgacgacgtaattaagtaacgacgtaactaacgtcgtaccggtaacgacgacgaacgaaaccgtacgtcccggacgtaccgtacccacggaccttccctacgtacgttacgttacggtggtcgctaacctacccgtacccggaccggacgtaccttacggtacacccncgaaccgtgtacgtacgnggtctaggtcggtgtacggcgaagtcgttcgactcgtctaaaccagtacgcgacgacgtccgtagtacgacgttacgtagtaagttacttacgttacttacgttttatttccgtagtacgttacgacttagttaaacgttaacgtaccgtacgtccgttaccggtacgggttaccggtaccggggtacccgggaacggaccggtagggtaacgtactaaaccggtaaaccggtaagttcggtaacgttaccggtcacggtaaccttacggttntacgttccgtcttaaccccg

SEQ ID NO: 275586 - DNA, 851 bp, Homo sapiens
  misc_feature: GYAE6OF01AG2OH.3.14.B03.1.454.CMB.1.raw
  modified_base (165)..(165): a, c, t, g, unknown or other
  misc_feature (165)..(165): n is a, c, g, or t
tcagagacgcactccacgaccggtgctcgatttagtgtgagtagttccgcgggggaggaactgctcagttacggacccagacggaaccatggaagcccccagcgcagtcttctccttccctcctgctactctggcctccccagaccaccacgtggaataaatgtnaatggacgctaacgtcctaccacgcccaccgtgtcgtgtcgttcctaccggaaggggaacacgtcccaccgtatcccttaccgcgacggacggtacccgtaagtcgtaaacggtacttaacggttaagaacggtaccttaaaccgttaccgtccggttaccggtaccaggtaccgaaaacggtaacccgtccggaccggaccgtaccctacccggtaggtccccttacgcctaactccggttacgtccgggtacaccgtaccctacccggaacccggttacggacccgtaccgtaaggtccccgtacccggtaccgtacggtagttacccggaggtaccggtggtacggtacggggtacggtacggtacggtagttcccgtacctataccggttacccaaccgtcgtaaccgtaacgtccgtacgtaccgtacgtaccgttacggtacggttacgttaaacggttacttttacgtactttaaccgttttccttaggtacgtacgtagttaaccgttacgtacttaacgttcgttcccgggtaccgttcgggttacggtaccggtacccggggtaccggtaaggttacgggccgtaaagttaaccgggtaacttaacccggaggttacccgggtataccccgttacggtacccttacggttaccggttacctgttaaaccctcccgg

SEQ ID NO: 275587 - DNA, 809 bp, Homo sapiens
  misc_feature: GYAE6OF01DU1C2.3.14.B03.1.454.CMB.1.raw
  modified_base (205)..(205): a, c, t, g, unknown or other
  misc_feature (205)..(205): n is a, c, g, or t
tcagagacgcactccacgaccggtgctcgatttagtgtgagtagttccgcgggggaggaactgctcagttaggacccagacggaaccatggaagccccagcgcagcttctcttcctcctgctactctggctcccagacaccactggaagaaatagtgatgacgcagtcctccagccaccctggtctgtcgtcaccgaggggaaanacgccaccactcctccgtgcgacgggccagtcagtacttaagtacgaagactaacgttgcctaggtaaccagaccgaacgtaaccgtcggacccgacggtcctacccgaggtccctccctacgtaacttcgttagttcgggtacacctaaccgtccccgaaccggacgggtacccctaacggttacggtaaccctccccgaacgtcccgtaggtttaccgaggtacggacgtagggtcgggtacgtagggaactaggttacgttccaccgttcgaccactacgtacgacgacgacgtccgtgacgtacgttacgtaagtaagtttcgttttactacttttaaccgttttatttccgtacgttacgtaacgtaacttaaacgtaacgtttaaaccttaccgggttacccgttacccggtttaccgggttacggggttaaccccggggtttcccggggggaacccggggttaaacccggtaaagggggtccgggtaaagttaaccgggtaaaccggtaaaaccgggttcggtttacccgggttacggtacccgtaccggtaccggttaacccttaggtttccccttggtttaccctttaaccccgg

SEQ ID NO: 275588 - DNA, 716 bp, Homo sapiens
  misc_feature: GYAE6OF01C0ZCP.3.14.B03.1.454.CMB.1.raw
  modified_base (98)..(98): a, c, t, g, unknown or other
  misc_feature (98)..(98): n is a, c, g, or t
  modified_base (130)..(130): a, c, t, g, unknown or other
  misc_feature (130)..(130): n is a, c, g, or t
  modified_base (167)..(167): a, c, t, g, unknown or other
  misc_feature (167)..(167): n is a, c, g, or t
  modified_base (202)..(202): a, c, t, g, unknown or other
  misc_feature (202)..(202): n is a, c, g, or t
  modified_base (214)..(214): a, c, t, g, unknown or other
  misc_feature (214)..(214): n is a, c, g, or t
  modified_base (222)..(222): a, c, t, g, unknown or other
  misc_feature (222)..(222): n is a, c, g, or t
  modified_base (229)..(229): a, c, t, g, unknown or other
  misc_feature (229)..(229): n is a, c, g, or t
  modified_base (348)..(348): a, c, t, g, unknown or other
  misc_feature (348)..(348): n is a, c, g, or t
  modified_base (354)..(354): a, c, t, g, unknown or other
  misc_feature (354)..(354): n is a, c, g, or t
  modified_base (411)..(411): a, c, t, g, unknown or other
  misc_feature (411)..(411): n is a, c, g, or t
  modified_base (481)..(481): a, c, t, g, unknown or other
  misc_feature (481)..(481): n is a, c, g, or t
  modified_base (543)..(543): a, c, t, g, unknown or other
  misc_feature (543)..(543): n is a, c, g, or t
  modified_base (688)..(688): a, c, t, g, unknown or other
  misc_feature (688)..(688): n is a, c, g, or t
  modified_base (697)..(697): a, c, t, g, unknown or other
  misc_feature (697)..(697): n is a, c, g, or t
tcagagacgcactccacgaccggtgctcgatttagtgtgagtagttccggcgggggaggaactgctcagttaggacccaggacggaaccagtggaacnccccagcgcagtcttctctcctctgctactcngcctccagacaccacgtggaataaatgtgatcgacgntacgtccaccacgcccaccgttgtactgtcgtacncggaaaggaacncaccactntcctcgnggacgacggtcagtgaagtactaagtacgactaacttacgtacggcttaggacaacgaccaaaccggtactgggacctacggtccaaccgtaggtcccctccattacttcgtggttacncgtacnccgtaaccgcggtaccggcctacgttacgaccctccgaaaggttccgtaggttaccncggtttgggaccttgggggtacggagtcggaaaccgtgtaacctcgactccgtaacacggtacacgtacncgtacgacgtcgatacgttcgtaaagtccgtttagtttacgtcttttacgtttcgtaccggnttaacccggtagtaaccttaagttaacctaacggttaacccggtccggtccggttaaggtcccgggggttaaccgggtaccgggtacgggtacgtacgggttacgaacgttacgggaactacgacgtgggttaccagttacccgngttaacctnttaccggtcctcggttacc

SEQ ID NO: 275589 - DNA, 311 bp, Homo sapiens
  misc_feature: GYAE6OF02JF81P.3.14.B03.1.454.CMB.1.raw
  modified_base (309)..(311): a, c, t, g, unknown or other
  misc_feature (309)..(311): n is a, c, g, or t
tcagagacgcactccacgaccggtgctcgatttagtgtgagtagtttgggtttaggggagctctgtgaccgaccgcagacacggccatgtattactgtgcgagggcactataactatggttattccgatgctttgatgtctggggccaagggacagtggtcaccgtctcttcagcctccaccaagggcccatcggtcttccccctggcaccctcctccaagagcacctctgggggcacagcggccctgggctgcctggtcaaggactacttccgagtgcgtctctgagcgggctggcaaggcgcatagnnn

SEQ ID NO: 275590 - DNA, 516 bp, Homo sapiens
  misc_feature: GYAE6OF02F5ITT.3.14.B03.1.454.CMB.1.raw
  modified_base (200)..(200): a, c, t, g, unknown or other
  misc_feature (200)..(200): n is a, c, g, or t
  modified_base (282)..(282): a, c, t, g, unknown or other
  misc_feature (282)..(282): n is a, c, g, or t
  modified_base (350)..(350): a, c, t, g, unknown or other
  misc_feature (350)..(350): n is a, c, g, or t
tcagagacgcactccacgaccggtgctcgatttagtgtgagtagttccgcgggggaggaactgctcagttaggacccagacggaaccatggaagccccagcgcagcttctcttcctcctgctactctggctcccagacaccactggagaaatagtgatgacgcagtctccagccaccctgtctgtgtctccaggggaaanagccaccatctcctgcagggccagtcagactatagagcaacttgcctggaccagcagaacctggccaggctcccaggctccnatctatggtgcatccaccgagggccagtggtactcccagccaggttcaggtgcagtgggtctgggacngagttcactctcaccatcagcagcctgcagtctagaagtattttgactacttttatttcttgtcagtctaagttataatacgtgtcctcgtggtaccgttcgggaccggggacagggtcgaagacgtacgaaacgtacgtaggtgcgtggcctaccatctgtcttc

SEQ ID NO: 275591 - DNA, 338 bp, Homo sapiens
  misc_feature: GYAE6OF02GEVCC.3.14.B03.1.454.CMB.1.raw
  modified_base (317)..(338): a, c, t, g, unknown or other
  misc_feature (317)..(338): n is a, c, g, or t
tcagagacgcactccacgaccggtgctcgatttagtgtgagtagtttgggtttagggggagctctcgtgaccgccgcagacacggccatgtattactggtcgcgagggcatataacgtatggttattccgatgcttttgatcgtctggggccaagggacagtggtcaccgtctcttcagccctccaccaagggcccactcggtcttccccctggcaccctcctccaagagcacctctgggggcacagcggccctgggctgcctggtacaaggactactccgagttgcgtctctgagcgggctggcaaggcgcatagnnnnnnnnnnnnnnnnnnnnnn

SEQ ID NO: 275592 - DNA, 544 bp, Homo sapiens
  misc_feature: GYAE6OF02GHJ3P.3.14.B03.1.454.CMB.1.raw
  modified_base (200)..(200): a, c, t, g, unknown or other
  misc_feature (200)..(200): n is a, c, g, or t
tcagagacgcactccacgaccggtgctcgatttagtgtgagtagttccgcgggggaggaactgctcagttaggacccagacggaaccatggaagccccagcgcagcttctcttcctcctgctactctggctcccagacaccactggagaaatagtgatgacgcagtctccagccaccctgtctgtgtctccaggggaaangccaccatctcctgcagggccagtcagactattagaagcaacttagcctggtaccagcagaaacctggccaggctcccaggctcctcatctatggtgcatccaccagggccactggtatcccagccaggttcagtgcagtgggtctgggacagagttcactctcaccatcagcagcctgcagtctagaagtattttcgcttacttttatttctgtctagtactagttaataattaacgtcggaccttccgtgggaccgttccggggaccgggggtaccaagggtggaaggtacgtacgaaacggtaacgtgtacggcttggacctaccgatcgttgtccttacg

SEQ ID NO: 275593 - DNA, 190 bp, Homo sapiens
  misc_feature: GYAE6OF02FEQYY.3.14.B03.1.454.CMB.1.raw
  modified_base (167)..(190): a, c, t, g, unknown or other
  misc_feature (167)..(190): n is a, c, g, or t
tcagagacgcactccacgaccggtgctcgatttagtgtgagtagttccgcgggcacgaccggtgctcgatttagtgtgagtagttccgcgggctggcaaggcgcatagctgcctggtcaaggactacttccgagtgcgtctctgagcgggctggcaaggcgcatagnnnnnnnnnnnnnnnnnnnnnnnn

SEQ ID NO: 275594 - DNA, 521 bp, Homo sapiens
  misc_feature: GYAE6OF02GKZK5.3.14.B03.1.454.CMB.1.raw
tcagagacgcactccacgaccggtgctcgatttagtgtgagtagttccgcgggggaggaactgctcagttaggacccagacggaaccatggaagccccagcgcagcttctcttcctcctgctactctggctcccagacaccactggagaaatagtgatgacgcagtctccagccaccctgtctgtgtctccaggggaaagagccaccatctcctgcagggccagtcagactattagaagcaacttagcctggtaccagcagaaacctggccaggctcccaggctcctcatctatggtgcatcccaccagggcccacgtggtactcccagccaggttcagtggcaggtgggtctgggacaggtacgttcactctcacctatcagcagcctgcagtctagaagtatttgcttagtttattactgtcagtcagtataatactgtcctccgtacgttcggaccaagggaccaaggtacgaactacgtaaacgactggtaggtactgacacgtatctgtcttctcg

SEQ ID NO: 275595 - DNA, 496 bp, Homo sapiens
  misc_feature: GYAE6OF02JAS6X.3.14.B03.1.454.CMB.1.raw
  modified_base (198)..(198): a, c, t, g, unknown or other
  misc_feature (198)..(198): n is a, c, g, or t
  modified_base (488)..(488): a, c, t, g, unknown or other
  misc_feature (488)..(488): n is a, c, g, or t
tcagagacgcactccacgaccggtgctcgatttagtgtgagtagttccgcggggagaactgctcagttaggacccagacggaaccatggaagccccagcgcagcttctcttcctcctgctactctggctcccagacaccactggagaaatagtgatgacgcagtctccagccaccctgtctgtgtctccaggggaaanagccaccatctcctgcagggccagtcagactattagaagcaacttagcctggtaccagcagaaacctggccaggctcccaggctcctcatctatggtgcatccaccagggccactggtatcccagccaggttcagtggctagtgggtctgggacagagttcactctcaccatcagcagcctgcagtctagaagtattttgacttattttatttctgtctagctaagttataataactgcctcgtgacgttcggccgggacaggtgagatacaacgactggtgctgccacntcttgctc

SEQ ID NO: 275596 - DNA, 487 bp, Homo sapiens
  misc_feature: GYAE6OF02GC61J.3.14.B03.1.454.CMB.1.raw
  modified_base (200)..(200): a, c, t, g, unknown or other
  misc_feature (200)..(200): n is a, c, g, or t
tcagagacgcactccacgaccggtgctcgatttagtgtgagtagttccgcgggggaggaactgctcagttaggacccagacggaaccatggaagccccagcgcagcttctcttcctcctgctactctggctcccagacaccactggagaaatagtgatgacgcagtctccagccaccctgtctgtgtctccaggggaaanagccaccatctcctgcagggccagtcagactattagaagcaacttagcctggtaccagcagaaacctggccaggctcccaggctcctcatctatggtgcatccaccagggccactggtatcccagccaggttcagtggcagtggtctgggacagagttcactctcaccatcagcagcctgcagtctgaagtatttgctactttatttctgtcagtcagtataatactgcctcgtgacgttcggcgggacaggtgagagtcaacgactgtggctgcacatctgtcttc

SEQ ID NO: 275597 - DNA, 514 bp, Homo sapiens
  misc_feature: GYAE6OF02IO34O.3.14.B03.1.454.CMB.1.raw
  modified_base (200)..(200): a, c, t, g, unknown or other
  misc_feature (200)..(200): n is a, c, g, or t
  modified_base (373)..(373): a, c, t, g, unknown or other
  misc_feature (373)..(373): n is a, c, g, or t
  modified_base (416)..(416): a, c, t, g, unknown or other
  misc_feature (416)..(416): n is a, c, g, or t
tcagagacgcactccacgaccggtgctcgatttagtgtgagtagttccgcgggggaggaactgctcagttaggacccagacggaaccatggaagccccagcgcagcttctcttcctcctgctactctggctcccagacaccactggagaaatagtgatgacgcagtctccagccaccctgtctgtgtctccaggggaaanagccaccatctcctgcagggccagtcagactattagaagcaacttagcctggtaccagcagaaacctggccaggctcccaggctctcatctatggtgcatccaccagggccactggtactcccagccaggttcaggtggcaggtgggtctgggacaggagttcactctcaccntcagcagcctgcagtctagaagtatttgcttacttttattctntcagctagtataatactgtcctcgtgacgttcggccggggaccgaagggtgagacgtacgaaacgtacgtgtaggctcgcctaccagtcttcgtctac

SEQ ID NO: 275598 - DNA, 514 bp, Homo sapiens
  misc_feature: GYAE6OF02IV17W.3.14.B03.1.454.CMB.1.raw
  modified_base (200)..(200): a, c, t, g, unknown or other
  misc_feature (200)..(200): n is a, c, g, or t
  modified_base (492)..(492): a, c, t, g, unknown or other
  misc_feature (492)..(492): n is a, c, g, or t
tcagagacgcactccacgaccggtgctcgatttagtgtgagtagttccgcgggggaggaactgctcagttaggacccagacggaaccatggaagccccagcgcagcttctcttcctcctgctactctggctcccagacaccactggagaaatagtgatgacgcagtctccagccaccctgtctgtgtctccaggggaaanagccaccatctcctgcagggccagtcagactattagaagcaacttagcctggtaccagcagaaacctggccaggctcccaggctcctcatctatggtgcatccaccagggccactggatcccagccaggttcagtgcaggtgggtctgggacagagttcactctcaccatcagcagcctgcagtctagaagttattttgacttacttttattcttgttcagtcagtattaaatactgcctcgtgtacgttcgggaccggggacgaggtggagagtacaaacgagtagtaggntcggcaccgatcgtcgtcttcg

SEQ ID NO: 275599 - DNA, 492 bp, Homo sapiens
  misc_feature: GYAE6OF02JBBJ5.3.14.B03.1.454.CMB.1.raw
  modified_base (356)..(356): a, c, t, g, unknown or other
  misc_feature (356)..(356): n is a, c, g, or t
  modified_base (367)..(367): a, c, t, g, unknown or other
  misc_feature (367)..(367): n is a, c, g, or t
  modified_base (394)..(394): a, c, t, g, unknown or other
  misc_feature (394)..(394): n is a, c, g, or t
  modified_base (455)..(455): a, c, t, g, unknown or other
  misc_feature (455)..(455): n is a, c, g, or t
  modified_base (484)..(484): a, c, t, g, unknown or other
  misc_feature (484)..(484): n is a, c, g, or t
  modified_base (488)..(488): a, c, t, g, unknown or other
  misc_feature (488)..(488): n is a, c, g, or t
tcagagacgcactccacgaccggtgctcgatttagtgtgagtagttccgcgggggaggaactgctcagttaggacccagacggaaccatggaagccccagcgcagcttctcttcctcctgctactctggctcccagacaccactggagaaatagtgatgacgcagtctccagccaccctgtctgtgtctccaggggaaagagccaccatctcctgcagggccagtcagactattagaagcaacttagcctggtaccagcagaaacctggccaggctcccaggctcctcatctatggtgcatcccaccagggccactggtactcccagccaggttcagtggcagtgggtctgggacngagttcactcncacatcagcagcctgcagtctgaagtnttttgcttactttatttctgtcagctagtataatactgcctcgtgacgtcggcgggacagnggagagtcgaacgtacgtgtgcgtgcacntctntctc

SEQ ID NO: 275600 - DNA, 580 bp, Homo sapiens
  misc_feature: GYAE6OF02IFICX.3.14.B03.1.454.CMB.1.raw
  modified_base (200)..(200): a, c, t, g, unknown or other
  misc_feature (200)..(200): n is a, c, g, or t
  modified_base (238)..(238): a, c, t, g, unknown or other
  misc_feature (238)..(238): n is a, c, g, or t
  modified_base (299)..(299): a, c, t, g, unknown or other
  misc_feature (299)..(299): n is a, c, g, or t
  modified_base (349)..(349): a, c, t, g, unknown or other
  misc_feature (349)..(349): n is a, c, g, or t
tcagagacgcactccacgaccggtgctcgatttagtgtgagtagttccgcgggggaggaactgctcagttaggacccagacggaaccatggaagccccagcgcagcttctcttcctcctgctactctggctcccagacaccactggagaaatagtgatgacgcagtctccagccacctgtctgtgtctccgaggggaaangccaacatctcctgcagggccagtcagactattagaancaaacttagcctggtaccagcagaaacctggccaggctcccaggcctcctcatctatggtncatccaccagggccatggtactcccagccaggttcagtggcaggtggtcngggacaggagttcacgtctaccaacctatcaggacagccgtgccagttcagtaacgtattttgacttactttttaattcttgttacacgtactaagttaataaagttactcgggtaccctccggttaggtaaccggtttcgggaccgggggaaccgtaagggtcggaagtacgtaacgaaacgtaacgtaggttcggcttacggaccaaccgtagtcctggttaccttacg

SEQ ID NO: 275601 - DNA, 646 bp, Homo sapiens
  misc_feature: GYAE6OF02I2LXS.3.14.B03.1.454.CMB.1.raw
  modified_base (200)..(200): a, c, t, g, unknown or other
  misc_feature (200)..(200): n is a, c, g, or t
  modified_base (424)..(424): a, c, t, g, unknown or other
  misc_feature (424)..(424): n is a, c, g, or t
tcagagacgcactccacgaccggtgctcgatttagtgtgagtagttccgcgggggagggaacgtgctcagttaggacccagacggaaccatggaagccccagcgcagcttctcttcctcctgctactctggctcccagacaccactggagaaatagtgatgacgcagtctcagccacctgtctgtgtctccaggggaaanagccaccatctcctgcaggccagtcagactattagagcaacttagcctggtaccagcagaacctggccagctccaggctcctgactctaagtggtcgcactccacgtacgggcctacgtcggtactccccgagcctaggttacagtcggacaggttgggtacgtgggactaggtacgttcaacgtcgtaccaaccgtatcgacgtcacgtcctacgactacgtntaggtaagtacgttttgcttaacttttagtttacgttcgttacgtagtacgtaagtttactaaacgttaacgtcggtaccgttaccgggttgttaaccgggttcgggtaaccgggggttaccgggtaacggttcgggaacgttaacggttaacgtaaaccggtaacgttacggttacggtacgtacggtacgtaacccgaactttacgtcggttaccttacg

SEQ ID NO: 275602 - DNA, 534 bp, Homo sapiens
  misc_feature: GYAE6OF02JE5N9.3.14.B03.1.454.CMB.1.raw
  modified_base (199)..(199): a, c, t, g, unknown or other
  misc_feature (199)..(199): n is a, c, g, or t
  modified_base (419)..(419): a, c, t, g, unknown or other
  misc_feature (419)..(419): n is a, c, g, or t
  modified_base (490)..(490): a, c, t, g, unknown or other
  misc_feature (490)..(490): n is a, c, g, or t
tcagagacgcactccacgaccggtgctcgatttagtgtgagtagttccgcgggggaggaactgctcagttaggacccagacggaaccatggaagccccagcgcagcttctcttcctcctgctactctggctcccagacaccactggagaaatagtgatgacgcagtctccagccacctgtctgtgtctccaggggaaanagccacatctcctgcagggccagtcagactatagaagcaacttagcctaggtaccagcaagaaacctggccaggctcccaggctcctcatctatggtgcatccaccgagggcccagtggtactccccgagccctagggttccaggttcgggcaggttgggtctggggactaggtacgttccaactctacacctatcagcagcctgctagtctagtaagtnttttgcttacttttatttctgtcagctagtataactacgtgcctcgtggtacgttcgggccgggactaggngagactcgaaacgtacgtggtagtcgtgccacgactctgtctac

SEQ ID NO: 275603 - DNA, 557 bp, Homo sapiens
  misc_feature: GYAE6OF02GFFW1.3.14.B03.1.454.CMB.1.raw
  modified_base (201)..(201): a, c, t, g, unknown or other
  misc_feature (201)..(201): n is a, c, g, or t
  modified_base (408)..(408): a, c, t, g, unknown or other
  misc_feature (408)..(408): n is a, c, g, or t
tcagagacgcactccacgaccggtgctcgatttagtgtgagtagttccgcgggggaggaactgctcagttaggacccagacggaaccatggaagccccagcgcagcttctcttcctcctgctactctggctcccagacaccactggagaaatagtgatgacgcagtctccagccaccctgtctgtgtctccgaggggaaangccaccatctcctgcagggccagtcagactattagaagcaacttagcctggtaccagcagaaacctggccaggctcccaggcctcctcatctatggtgcatcccacagggcccactggtactcccgagcctagggttcaggtggctaggtgggtctggggacaggacgttcactctacacctatcagcagcctgcagtctagaagtntttgcttacttttatttctgtcagtctagttataattacgtcgtcccttacggtggtaccggttcgggaccgggggtactaagggtggacgtaacgtacgaaacggtacgtggtacggcgtacggacctaccgatccgttgtcttaccg

SEQ ID NO: 275604 - DNA, 494 bp, Homo sapiens
  misc_feature: GYAE6OF02ISAG1.3.14.B03.1.454.CMB.1.raw
  modified_base (201)..(201): a, c, t, g, unknown or other
  misc_feature (201)..(201): n is a, c, g, or t
  modified_base (394)..(394): a, c, t, g, unknown or other
  misc_feature (394)..(394): n is a, c, g, or t
  modified_base (492)..(492): a, c, t, g, unknown or other
  misc_feature (492)..(492): n is a, c, g, or t
tcagagacgcactccacgaccggtgctcgatttagtgtgagtagttccgcgggggaggaactgctcagttaggacccagacggaaccatggaagccccagcgcagcttctcttcctcctgctactctggctcccagacaccactggagaaatagtgatgacgcagtctccagccaccctgtctgtgtctccgaggggaaangccaccatctcctgcagggccagtcagactattagaagcaacttagcctggtaccagcagaaacctggccagctcccaggctcctcatctatggtgcatccaccagggccactggtatcccagccaggttcagtggcaggtgggtctgggacaggagttcacgtctcaccatcagcagcctgcagtctgaagntttgactattttattctgtcagctagtataatactgcctcgtggtacgtcggacggggacaggtgagagtacgaacgagtgtgcgtgcacagtctgtntc

SEQ ID NO: 275605 - DNA, 563 bp, Homo sapiens
  misc_feature: GYAE6OF02JH6Z3.3.14.B03.1.454.CMB.1.raw
  modified_base (206)..(206): a, c, t, g, unknown or other
  misc_feature (206)..(206): n is a, c, g, or t
  modified_base (333)..(333): a, c, t, g, unknown or other
  misc_feature (333)..(333): n is a, c, g, or t
  modified_base (363)..(363): a, c, t, g, unknown or other
  misc_feature (363)..(363): n is a, c, g, or t
  modified_base (372)..(372): a, c, t, g, unknown or other
  misc_feature (372)..(372): n is a, c, g, or t
  modified_base (381)..(381): a, c, t, g, unknown or other
  misc_feature (381)..(381): n is a, c, g, or t
tcagagacgcactccacgaccggtgctcgattttagtgtgagtagttccgcgggggaggaactggctcagttaggacccagacggaaccatggaaggccccagcgcagcttctcttcctcctgctactctggtcctcccagacaccactggagaaatgtgatgacgcagtctccagccacctgtctgtacgtctccgaggggaaanagccaccatctcctgcgagggccaggtcagactatagaagcaacttagcctggtaccagcagaacctggaccaggtcctcccaggcctctcatctagtgtgcatccgaccgagggcccagtggtacncccagccaggttcaggtggctagtgggtcngggacaggnttcactccncaccatcagcacgcctgcagtctagaagtatttgacttacttttattctcgtcagactagttaataactacgtcgaccgttcgtcggacgttcgggaccggggtaccgagggtggaacgtacgtaacgtaaacgtacgttggtcggtcgtacggtaccaccgtacgtcgttacgttcttacg

SEQ ID NO: 275606 - DNA, 655 bp, Homo sapiens
  misc_feature: GYAE6OF02JBNEK.3.14.B03.1.454.CMB.1.raw
  modified_base (496)..(496): a, c, t, g, unknown or other
  misc_feature (496)..(496): n is a, c, g, or t
tcagagacgcactccacgaccggtgctcgatttagtgtgagtagttccgcggggagggaacgtgctcagttaggacccagacggaaccatggaagccccagcgcagcttctcttcctcctgctactctggctcccagacaccactggagaaatagtgatgacgcagtctccagccaccctgtctgtgtctccgaggggaagacgccaccatctcctgcagggccagtcagactatagaagcaacttagcctggtaccagcaagaaacctggccaggcctcccgaggcctcctctatcgtaagttggtcgacctactacccgaccacggggccctaacgtcggtaactccccagtcccgtagggttcaggtcgacgtagggtcggtacgtgggactaggtacgttactacgtctccgaaccgtatccgaacgtcccaagtccgtaggcctaagttaccgtgtaaacgttacttttcggtacttacttttttaacttnttcgtacttaggcttaagtattaataaccgtcgtaccgtccgttaggtaccggttcggaccggggtaaccgaggttacggagtaacgtaaccgtaaagttacgggtaccgtaagggttcttacgggacctaaccggtagttacgtagtttacccgtacg

SEQ ID NO: 275607 - DNA, 558 bp, Homo sapiens
  misc_feature: GYAE6OF02HDT68.3.14.B03.1.454.CMB.1.raw
  modified_base (201)..(201): a, c, t, g, unknown or other
  misc_feature (201)..(201): n is a, c, g, or t
  modified_base (239)..(239): a, c, t, g, unknown or other
  misc_feature (239)..(239): n is a, c, g, or t
  modified_base (325)..(325): a, c, t, g, unknown or other
  misc_feature (325)..(325): n is a, c, g, or t
  modified_base (418)..(418): a, c, t, g, unknown or other
  misc_feature (418)..(418): n is a, c, g, or t
tcagagacgcactccacgaccggtgctcgatttagtgtgagtagttccgcgggggaggaactgctcagttaggacccagacggaaccatggaagccccagcgcagcttctcttcctcctgctactctggctcccagacaccactggagaaatagtgatgacgcagtctccagccaccctgtctgtgtctccagggggaaanagccaccatcctcctgcagggccagtcagactatagancaacttagcctggtaccagcagaacctggccaggctcccaggcctcctcatctagtggtgcatcccaccgagggccacgtggtacncccagccaggttcagtggcagtgggtctgggacagtagttcactctcaccatcagcagcctgcagtcagtagtatttgcttacttttactttntgtctagctagtattaatacgtcgtccttcggtacggtacgggttccgggaccggggtacgagggtacggaaggtacgtaaccgaaaccggtacgtacggtcggtacgtacggacaccgtataccgttcggtaccttacg

SEQ ID NO: 275608 - DNA, 592 bp, Homo sapiens
  misc_feature: GYAE6OF02GJDP6.3.14.B03.1.454.CMB.1.raw
  modified_base (201)..(201): a, c, t, g, unknown or other
  misc_feature (201)..(201): n is a, c, g, or t
tcagagacgcactccacgaccggtgctcgatttagtgtgagtagttccgcgggggaggaactgctcagttaggacccagagggaaccatggaagccccagctcagcttctcttcctcctgctactctggctcccagataccgaccggagaaattgtgttgacacagtctccagccaccctgtctttgtctccaggggaaanagccaccctctcctgcagggccagtcagagtgttagcagctaacttagcctggtatcaacagtaaacctggccaggctccaggctcctcatctatgatgcatccaacagggccactggcatcccagccagttcagtgctagtgggtcagggacagacttcacttcacaccatcagtacgcctagacgctagaagtattttgactagtactattacttagtacaactagtcgtggacaacgtcggtcccgttgtacgggtaccgttccgggaccgtaacgggaccgtaaggtacggtaaacttccgaaacccggtaacgtacggttacggaccgttacgacccgtacccgtacgttaccgttccgtttaccgttaccgtaccgtttaccccg

SEQ ID NO: 275609 - DNA, 614 bp, Homo sapiens
  misc_feature: GYAE6OF02F7J1P.3.14.B03.1.454.CMB.1.raw
  modified_base (202)..(202): a, c, t, g, unknown or other
  misc_feature (202)..(202): n is a, c, g, or t
  modified_base (304)..(304): a, c, t, g, unknown or other
  misc_feature (304)..(304): n is a, c, g, or t
tcagagacgcactccacgaccggtgctcgatttagtgtgagtagttccgcgggggaggaactgctcagttaggacccagacggaaccatggaagccccagcgcagcttctcttcctcctgctactctggctcccagacaccactggagaaatagtgatgacgcagtctccagccaccctgtctgtgtctccgaaggggaaanagccaccatctcctgcagggccagtcagactatagaagcaacttagcctggtaccagcaagaaacctggccaggcctcccgaggcctcctcatctagtggtncactccaccgagggccagtggtactccagccaggttcagtggcaggtggtctgggacagtagttcactcacacatcagcagcctgctagtactaggaaacttagttttgaccttactttttagtttctgtacagtactaagttaaataaattaacgtcggtaccgttaccgggttacgggtaccggttccggggacccgggggtaaccgtaaggggttcggaacggtaacgttaaccggaaaacggtaaccggttaggtacggggtacttaccggacctaccgttaacgttcgtttacgttaccttaccg

SEQ ID NO: 275610 - DNA, 592 bp, Homo sapiens
  misc_feature: GYAE6OF02G4ADR.3.14.B03.1.454.CMB.1.raw
  modified_base (201)..(201): a, c, t, g, unknown or other
  misc_feature (201)..(201): n is a, c, g, or t
  modified_base (420)..(420): a, c, t, g, unknown or other
  misc_feature (420)..(420): n is a, c, g, or t
  modified_base (432)..(432): a, c, t, g, unknown or other
  misc_feature (432)..(432): n is a, c, g, or t
  modified_base (497)..(497): a, c, t, g, unknown or other
  misc_feature (497)..(497): n is a, c, g, or t
  modified_base (583)..(583): a, c, t, g, unknown or other
  misc_feature (583)..(583): n is a, c, g, or t
tcagagacgcactccacgaccggtgctcgatttagtgtgagtagttccgcgggggaggaactgctcagttaggacccagacggaaccatggaagccccagcgcagcttctcttcctcctgctactctggctcccagacaccactggagaaatagtgatgacgcagtctccagccaccctgtctgtgtctccgaggggaaancgccaccatcctcctagcagggccagtcagactatagagcaacttagcctaggtaccagcagaaacctggccagcctccaggctcctcatctagtggtcaccactcccgaaccgagggtcccctaagtcggtactccccgaagcccgtaggttccaggtcggctaggtcgggtcgtagggacaggtacgttcacttcgacacctatcagcacgcctgcngtctagtaagtnttttacgcttaactttatttctggttacagtactaagtaattaaacttacgtcgcctttaccggngggttaaccggttcggaccggggtaaccagggtagtacgaacgtacgaaacgtacgtaggtcgtctacggccctacgacttcggtnttccttacg

SEQ ID NO: 275611 - DNA, 619 bp, Homo sapiens
  misc_feature: GYAE6OF02HDQGS.3.14.B03.1.454.CMB.1.raw
  modified_base (202)..(202): a, c, t, g, unknown or other
  misc_feature (202)..(202): n is a, c, g, or t
  modified_base (296)..(296): a, c, t, g, unknown or other
  misc_feature (296)..(296): n is a, c, g, or t
  modified_base (308)..(308): a, c, t, g, unknown or other
  misc_feature (308)..(308): n is a, c, g, or t
  modified_base (614)..(614): a, c, t, g, unknown or other
  misc_feature (614)..(614): n is a, c, g, or t
tcagagacgcactccacgaccggtgctcgatttagtgtgagtagttccgcgggggaggaactgctcagttaggacccagacggaaccatggaagccccagcgcagcttctcttcctcctgctactctggctcccagacaccactggagaaatagtgatgacgcagtctccacgccaccctgtctgtgtcgtccaggggaaanagcccaccatctcctggcagggccaggtcagactattagaagctaacttagccgtaggtaccagacagaacctggccaggctcccaggctcctnatctagtggtcnctactccgaccgagggccacgtcggtactcccgagtcctaggttcaggtcgggctagggtgggtactgggaactaggtacgttcaccttctccaacctagtacgacgtcacgtcctgactagtacgttagaagtttacttttacggacctttaacgtttttatttacgtacgttactacgtactaagttaactaacgtacgtcggtacccgttcggtcggtaccggtaccgggaccggggtaactagggtcgacgtacgtacgtaaacggtacgtggtcgacgtacgactaccgtagtcttacgtnttacc

SEQ ID NO: 275612 - DNA, 612 bp, Homo sapiens
  misc_feature: GYAE6OF02ILASC.3.14.B03.1.454.CMB.1.raw
  modified_base (147)..(147): a, c, t, g, unknown or other
  misc_feature (147)..(147): n is a, c, g, or t
  modified_base (202)..(202): a, c, t, g, unknown or other
  misc_feature (202)..(202): n is a, c, g, or t
  modified_base (305)..(305): a, c, t, g, unknown or other
  misc_feature (305)..(305): n is a, c, g, or t
  modified_base (372)..(372): a, c, t, g, unknown or other
  misc_feature (372)..(372): n is a, c, g, or t
  modified_base (376)..(376): a, c, t, g, unknown or other
  misc_feature (376)..(376): n is a, c, g, or t
  modified_base (379)..(379): a, c, t, g, unknown or other
  misc_feature (379)..(379): n is a, c, g, or t
  modified_base (387)..(387): a, c, t, g, unknown or other
  misc_feature (387)..(387): n is a, c, g, or t
  modified_base (393)..(394): a, c, t, g, unknown or other
  misc_feature (393)..(394): n is a, c, g, or t
tcagagacgcactccacgaccggtgctcgatttagtgtgagtagttccgcgggggaggaactgctcagttaggacccagacggaaccatggaagccccagcgcagcttctcttcctctgctactctggctcccagacaccactgganaaatgtgatgacgcagtctccagccaccctgtctgtgtctaccgaggggaaaacngcccacctatcctccgtagccacgggcctaagtcagactattagaacgcaaacttgcctggtaccagccaggaaaccttggccaggcctacccaggtctcctnatcatggtcacatccacgacggccaacgtgtactccagcctaggttcagtggcaggtggctggcagnttcntcncacgtcancacgcnnctagtctagatattcgacttactttacgttctcgtacgactctaagttaacttaacgttaccgtacggtacccgttaccggttacggtacccgggttacccgggaacccggggtaaccgtacgggtaggtaaccgtaccgtaaccggtaaaccggtaacggttacggtacggtacgttaccgaccgtaccgttacgtaccgttaccgttaccgttacg

SEQ ID NO: 275613 - DNA, 614 bp, Homo sapiens
  misc_feature: GYAE6OF02GTV0P.3.14.B03.1.454.CMB.1.raw
  modified_base (202)..(202): a, c, t, g, unknown or other
  misc_feature (202)..(202): n is a, c, g, or t
  modified_base (306)..(306): a, c, t, g, unknown or other
  misc_feature (306)..(306): n is a, c, g, or t
  modified_base (331)..(331): a, c, t, g, unknown or other
  misc_feature (331)..(331): n is a, c, g, or t
  modified_base (363)..(363): a, c, t, g, unknown or other
  misc_feature (363)..(363): n is a, c, g, or t
  modified_base (394)..(394): a, c, t, g, unknown or other
  misc_feature (394)..(394): n is a, c, g, or t
tcagagacgcactccacgaccggtgctcgatttagtgtgagtagttccgcgggggaggaactgctcagttaggacccagacggaaccatggaagccccagcgcagcttctcttcctcctgctactctggctcccagacaccactggagaaatagtgatgacgcagtctccagcccaccctgtctgtgtctccgaggggaaangcccaccatctcctgcagggccagtcagactatagaagcaacttagcctggtaccagcaagaaacctggccaggcctccccgaggcctcctcactctagtggtncatcccaccgagggccagtggtacncccgagcctaggtcaggtggctaggtgggtcngggacaggtacttcactctacaccatcagcncgccgtgcagtctaggtattctttcgacttacttttcgttcttgtactagtactaagttaataaactacgtcgtcccgttacgggttacgggtccggttaccgggggacccggggtaacgtaaggggtacggtaacggtaacgtaaccggtaaaaccggtacgttacgggtacggtaccgtacggtaccctaccgttacttcggttccgttaccttaccg

SEQ ID NO: 275614 - DNA, 586 bp, Homo sapiens
  misc_feature: GYAE6OF02GURP4.3.14.B03.1.454.CMB.1.raw
  modified_base (200)..(200): a, c, t, g, unknown or other
  misc_feature (200)..(200): n is a, c, g, or t
  modified_base (410)..(410): a, c, t, g, unknown or other
  misc_feature (410)..(410): n is a, c, g, or t
tcagagacgcactccacgaccggtgctcgatttagtgtgagtagttccgcgggggaggaactgctcagttaggacccagacggaaccatggaagccccagcgcagcttctcttcctcctgctactctggctcccagacaccactggagaaatagtgatgacgcagtctccagccaccctgtctgtgtctccaggggaaanagccaccatctcctgcagggccagtcagactattagaagcaacttagcctggtaccagcagaacctggccaggctcccaggctcctcatctatggtgcatccaccgagggccacgtggtactcccgagcccaggttccaggtcggcaggttcgggtctgggacaggtagttcactctacaccatccagcagcctgctagtctagtaagtnttttgcttacttttattcgtgtctagctagttattaacgtaactcggtccctacgggttaggtaccggtttccgggaccgggggtaccgtaaggggtcgaacggtacggtacgaaaccggtaacgtcggttacggtcctacggtaccgaaccgtacgttacttggttcccttaccg

SEQ ID NO: 275615 - DNA, 592 bp, Homo sapiens
  misc_feature: GYAE6OF02HL9MQ.3.14.B03.1.454.CMB.1.raw
  modified_base (200)..(200): a, c, t, g, unknown or other
  misc_feature (200)..(200): n is a, c, g, or t
  modified_base (356)..(356): a, c, t, g, unknown or other
  misc_feature (356)..(356): n is a, c, g, or t
tcagagacgcactccacgaccggtgctcgatttagtgtgagtagttccgcgggggaggaactgctcagttaggacccagacggaaccatggaagccccagcgcagcttctcttcctcctgctactctggctcccagacaccactggagaaatagtgatgacgcagtctccagccaccctgtctgtgtctccaggggaaangccacatctcctgcagggccagtcagactatagaagcaacttgcctggtaccagcagaacctggccaggctcccgaggctcctcatctagtggtgcactccacgagggccctacgtggtactcccagtccgtaggttcagtcggcgaggtgggtcngggactaggtagttcactctcgacctatcagcagcctgcagtctagtaagtagtttgacttacttttattcgtgtctagtactagttaataagttacgtggtccgttccgggtggtaccggttccgggacccgggggtacgtaaggggtacgaacggtaacgtaaccggaaacggtaacggttcgggtacggtcgttacgacccgtaaccgttacgtccgttacgttaccttaccg

SEQ ID NO: 275616 - DNA, 785 bp, Homo sapiens
  misc_feature: GYAE6OF02GN8XV.3.14.B03.1.454.CMB.1.raw
  modified_base (199)..(199): a, c, t, g, unknown or other
  misc_feature (199)..(199): n is a, c, g, or t
tcagagacgcactccacgaccggtgctcgatttagtgtgagtagttccgcgggggaggaactgctcagttaggacccagacggaaccatggaagccccagcgcagcttctcttcctcctgctactctggctcccagacaccactggagaaatagtgatgacgcagtctccagccaccctgtctgtgtctccaggggaanagccacatctcctgcagggccagtcagactattagagctaattagcctggtaccagcagaacctggccaggctcccgaggcttcctcattcagtggtcgctatctaacgacgggtccagtcggcacgtttcccgagtcctaagggtttccaagggttcgggacctaagggtttacgggaacgttaaggtacgggggtaactacgggtaaccctttacgaacccgtttccttacccgaacccgtaacgttaccgtaaggttaaccggtacccgttaacggtaaccggtaccgttaacgggtaaaggttaacgttttttcggaaccgttaacgtttaccgtttaaacttttaacggtttacgttaacgtaaaccgtacggttaccggttacggtaccgtaaaccggttccggtaccccgtttaccgggttacgggttaacccggtttcccggggaccggtaaaccggggtaccggtaaacgggttaacgggtaaacgttaacccgggaaacccggttaaccgttaccgggttaccggtaaccgttccggtaacccggtacccgtaacgttacccgttacggtttaccc

SEQ ID NO: 275617 - DNA, 565 bp, Homo sapiens
  misc_feature: GYAE6OF02HQAU9.3.14.B03.1.454.CMB.1.raw
  modified_base (201)..(201): a, c, t, g, unknown or other
  misc_feature (201)..(201): n is a, c, g, or t
  modified_base (378)..(378): a, c, t, g, unknown or other
  misc_feature (378)..(378): n is a, c, g, or t
  modified_base (411)..(411): a, c, t, g, unknown or other
  misc_feature (411)..(411): n is a, c, g, or t
  modified_base (428)..(428): a, c, t, g, unknown or other
  misc_feature (428)..(428): n is a, c, g, or t
tcagagacgcactccacgaccggtgctcgatttagtgtgagtagttccgcgggggaggaactgctcagttaggacccagacggaaccatggaagccccagcgcagcttctcttcctcctgctactctggctcccagacaccactggagaaatagtgatgacgcagtctccagccaccctgtctgtgtctccgaggggaaangccacatcctcctgcagggccagtcagactatagaagcaacttgcctggaccagcagaacctggccaggctcccaggcctcctcatctatggtgcactccacgcgggccacgtggtactcccgagtccaggttcaggtgctaggtgggtctgggacaggacgtttcactctacaccntcagtcacgtccgtagctagttctaggaagttnttttagcttaatttttntcgtgtacagtactaggttaactaacgttacgcggtcctacgggtcggtaccggttcgggaccgggtacaagggtcggaagtacgtacgaaacggtatggtacgtcgtacgaccgacctagttccgtgttacctacg

SEQ ID NO: 275618 - DNA, 532 bp, Homo sapiens
  misc_feature: GYAE6OF02FHJR3.3.14.B03.1.454.CMB.1.raw
  modified_base (200)..(200): a, c, t, g, unknown or other
  misc_feature (200)..(200): n is a, c, g, or t
  modified_base (296)..(296): a, c, t, g, unknown or other
  misc_feature (296)..(296): n is a, c, g, or t
  modified_base (377)..(377): a, c, t, g, unknown or other
  misc_feature (377)..(377): n is a, c, g, or t
  modified_base (423)..(423): a, c, t, g, unknown or other
  misc_feature (423)..(423): n is a, c, g, or t
tcagagacgcactccacgaccggtgctcgatttagtgtgagtagttccgcgggggaggaactgctcagttaggacccagacggaaccatggaagccccagcgcagcttctcttcctcctgctactctggctcccagacaccactggagaaatagtgatgacgcagtctccagccaccctgtctgtgtctccaggggaaanagccaccatctcctgcagggccagtcagactattagaagcaacttagcctggtaccagcagaacctggccaggctcccaggctcctcatctatggngcatcccaccaggggcccacgtggtactccccgagccaggttcaggtggcagtgggtctgggacagagttcactctcaccntccagcagtcctgcagtctaggtaatatttgcttactttatttctntcagtcagtataagtactgccttcggtaggaccgtttcggccggggtaccgagggtcggacgtagtacgaaacgtacgtgtacggctcgcacgtactcttgtccttacg

SEQ ID NO: 275619 - DNA, 836 bp, Homo sapiens
  misc_feature: GYAE6OF02JS9X8.3.14.B03.1.454.CMB.1.raw
tcagagacgcactccacgaccggtgctcgatttagtgtgagtagttccgcgggggaggaacgtgctcagttaggaccagacggaaccatggaagccccagcgcagcttctcttcctcctgctactctggcctcccagaccaccacgtggaacgaaatagtgatgacgcagtctccagccaccctgtctggtgtctccgaaggggaaacagcccaaccatctcccgtgccgagggccctaaggtccaaggaaccttagttaacggaacgcctaaactttacggccccgttaagggtaacccaggtaccgaaaggtaaaccccgttgggaccctaaccggggccttacccccgaaggggttcccttccccgtactacgttaccgttaacggtccggttacgacctaacgttacccgaaccgacggggtacccctagtaccggtactaccccggacggtaccctaacggggtttacacggttaccggacgtacgggttaccgggggtcgacggggtaaacctaggtaccgttttaccgaacccgttcctaccctaaaccgtacgtaccgtacgtccgtacgtccgtacgtacgtacgtaccgtacgaaacgttcgttacgtcgttacgtttattaacgttcgtacgtacgtacgttaacgttacgttccgttaccgtttacgtaccgtttcgtttaacgttaccggtttaacggtttcgggaaccgggttccgggtaacggttaagggttacggtaacgggttaacgttaacccggtaaacgttaccgggtacgttacggtacgttacccggtacccgtaacgttacgttacgttaccg

SEQ ID NO: 275620 - DNA, 697 bp, Homo sapiens
  misc_feature: GYAE6OF02J2TGC.3.14.B03.1.454.CMB.1.raw
  modified_base (189)..(189): a, c, t, g, unknown or other
  misc_feature (189)..(189): n is a, c, g, or t
  modified_base (201)..(201): a, c, t, g, unknown or other
  misc_feature (201)..(201): n is a, c, g, or t
  modified_base (306)..(306): a, c, t, g, unknown or other
  misc_feature (306)..(306): n is a, c, g, or t
  modified_base (384)..(384): a, c, t, g, unknown or other
  misc_feature (384)..(384): n is a, c, g, or t
  modified_base (411)..(411): a, c, t, g, unknown or other
  misc_feature (411)..(411): n is a, c, g, or t
tcagagacgcactccacgaccggtgctcgatttagtgtgagtagttccgcggggaggaactgctcagttaggacccagacggaaccatggaagccccagcgcagcttctcttcctcctgctactctggctcccagacaccactggagaatagtgatgacgcagtctccagccaccctgtcctgtcgtcnccgaggggaacncgccactatcctccgtgcagggccagtccagactatagaagcaacgttgccgttaggaccagcagaaccgtggccaggcctccaggtcctctcatctagtcggtncactccaaccgtgggccctacgtcggactccccgaagtccgaaggttcgagtcggcgtaggtcggtcgtacgggaacngggtacttccgaacttcgtccaacgtntaccgagcacggaccttcgactagtaccgtaagtaacgttacgttttcgacgttttaccgttttatttccgtacgtacgtacgtataaacgtttaacgtaaacgttaccgttacccgggtccgttacccgggtttacgggccggtttacccggggaaccgggtacccggttaaaccgggtgggtaaaccggttaccgaaacccggttaaaccggtacggttaaccggtacggtaccgttaccggtacccgacgttaaccccggtgttttaccggtccgtttaaccc

SEQ ID NO: 275621 - DNA, 667 bp, Homo sapiens
  misc_feature: GYAE6OF02FT7I6.3.14.B03.1.454.CMB.1.raw
  modified_base (201)..(201): a, c, t, g, unknown or other
  misc_feature (201)..(201): n is a, c, g, or t
  modified_base (294)..(294): a, c, t, g, unknown or other
  misc_feature (294)..(294): n is a, c, g, or t
  modified_base (325)..(325): a, c, t, g, unknown or other
  misc_feature (325)..(325): n is a, c, g, or t
tcagagacgcactccacgaccggtgctcgatttagtgtgagtagttccgcgggggaggaactgctcagttaggacccagacggaaccatggaagccccagcgcagcttctcttcctcctgctactctggctcccagacaccactggagaaatagtgatgacgcagtctccagccaccctgtctgtgtctccgaggggaaangccaccatctctgcaggccagtcagactatagagcaacttgcctggtaccagcaagaacctggccaggctcccgagctcctcatctagtggtncctatcccgacgacgggccctagtcggtacncccgagcctaggttcgagtggccgtagggttcggtcgtacgggactaggtacgttccacgttcctaccgacctagtccgacgcgacgtcccgtagacgtagttccaaggttaactttgttttacgtacctttagtttttacgtttcgttacgtcctaagttaccgtaagtttaaagtaacgttaaccggttcggtaccccggtttacgggtaccggggtttaccggttaccccgggggaccggggttaacgaggggttcgaaaggtaccgtaaaacgaaacggtacggttcggacggttacctcggaaccgttaccgtagtccgttaccgttccttaaccgg

SEQ ID NO: 275622 - DNA, 704 bp, Homo sapiens
  misc_feature: GYAE6OF02HWGA1.3.14.B03.1.454.CMB.1.raw
  modified_base (201)..(201): a, c, t, g, unknown or other
  misc_feature (201)..(201): n is a, c, g, or t
  modified_base (242)..(242): a, c, t, g, unknown or other
  misc_feature (242)..(242): n is a, c, g, or t
  modified_base (448)..(448): a, c, t, g, unknown or other
  misc_feature (448)..(448): n is a, c, g, or t
tcagagacgcactccacgaccggtgctcgatttagtgtgagtagttccgcgggggaggaactgctcagttaggacccagacggaaccatggaagccccagcgcagcttctcttcctcctgctactctggctcccagacaccactggagaaatagtgatgacgcagtctccagccaccctgtctgtgtctaccgaggggaangccaccatcctcctggcacgggccagtcagactattagaanctaacttagctagaccagcaagaacctggaccaggcctcccgaggccttccactactctagtggtagcactacccaccgacgggccctacgttcggtacctacccgagtcccgtagggttaccaggtcgggacgtacgggttcggggtcgtaggggactaaggtcgtttaccacttccgtaccaaccgtacgtacgagaccgtacnccccgttaggaccgtagttacgtacggtaagtttctttttacgaacctttacgtttttatttccgtaggtacaaggtcttaaagtttaaataacgttaaccggtccggttacccggtccgggtttaagggtacccgggttaccggggacccgggggttaagtaacggggtacgggaacgttacgtaaaccggaaaacggtcggttacggtacggtacggacgaccgtaacctaggtttccttacgtcctttaaccg

SEQ ID NO: 275623 - DNA, 703 bp, Homo sapiens
  misc_feature: GYAE6OF02F6QZS.3.14.B03.1.454.CMB.1.raw
  modified_base (200)..(200): a, c, t, g, unknown or other
  misc_feature (200)..(200): n is a, c, g, or t
tcagagacgcactccacgaccggtgctcgatttagtgtgagtagttccgcgggggaggaactgctcagttaggacccagacggaaccatggaagccccagcgcagcttctcttcctcctgctactctggctcccagacaccactggagaaatagtgatgacgcagtctccagccaccctgtctgtgtctcgaggggaaancgccacatctcctgcagggccagtcagtactatagaagctaaacttgcctggtaccagcagaaacctggccaggcctccgaggcctcctcattctagtggtcgacctactacccaccggacgggccctacgttcggtaacctccccgagcccgtaacgggtttccaagggttcggaccgtagggttcggggttccgtaggggacctagggtacgtttcccgaaccttccgtacctaaccctaagtccgaacgccgtacgcccgtggactacgttacgtagtaaaacgttcgttttcgtaacctttacgtttttagtttcgtattaccgtagtacgtaaagttaactaaacgttacgtcgtacccgttcggtacgggtaccgtccggggaccgggtaacgtaaggggtcgaacggtacgttaaccggaaaaccgggttacgtacgggtaggtacccgttacgggtaccctaaccgttaagttcccgttacgttaccctttaccg

SEQ ID NO: 275624 - DNA, 616 bp, Homo sapiens
  misc_feature: GYAE6OF02JK3J1.3.14.B03.1.454.CMB.1.raw
  modified_base (208)..(208): a, c, t, g, unknown or other
  misc_feature (208)..(208): n is a, c, g, or t
  modified_base (255)..(255): a, c, t, g, unknown or other
  misc_feature (255)..(255): n is a, c, g, or t
  modified_base (283)..(283): a, c, t, g, unknown or other
  misc_feature (283)..(283): n is a, c, g, or t
  modified_base (306)..(306): a, c, t, g, unknown or other
  misc_feature (306)..(306): n is a, c, g, or t
  modified_base (356)..(356): a, c, t, g, unknown or other
  misc_feature (356)..(356): n is a, c, g, or t
  modified_base (395)..(395): a, c, t, g, unknown or other
  misc_feature (395)..(395): n is a, c, g, or t
  modified_base (412)..(412): a, c, t, g, unknown or other
  misc_feature (412)..(412): n is a, c, g, or t
  modified_base (592)..(592): a, c, t, g, unknown or other
  misc_feature (592)..(592): n is a, c, g, or t
  modified_base (600)..(600): a, c, t, g, unknown or other
  misc_feature (600)..(600): n is a, c, g, or t
tcagagacgcactccacgaccggtgctcgatttagtgtgagtagttccgcgggggaggaactgctcagttaggacccagacggaaccatggaagccccagcgcagcttctcttcctctgctactctggcctcccagacaccacgtggacgaaatgtgatgaccgcagtcctccagcccaccctgtctgtcgtcctaccgaggggaaanacgcccaaccatcctaccgtgccgagggccagtcagacttatagacncaacttgcctaggaccagacacgaaccngaccgaggcctaccaggcctccncatactagtcggtacgccaactcccgacgacgggaccctacgtggtaccncccgaagccgtagtcagtcggcaggtcggtcgaggaccngtacgttccaccgtacncgaactcgtgacgaccaggcctggactagtctagtaacgtattaccgtacgttatttacgttcgtattcgactcgaagttaacgtacttacggtcgtacccgttacgtgggtaccggttaccgggtaccgggacgttagggagttacgaacggtacgaacgtacggtcgtacgtgtaccncgtaaccngttccgtagtacctcg

SEQ ID NO: 275625 - DNA, 804 bp, Homo sapiens
  misc_feature: GYAE6OF02HO6D1.3.14.B03.1.454.CMB.1.raw
  modified_base (201)..(201): a, c, t, g, unknown or other
  misc_feature (201)..(201): n is a, c, g, or t
  modified_base (210)..(210): a, c, t, g, unknown or other
  misc_feature (210)..(210): n is a, c, g, or t
tcagagacgcactccacgaccggtgctcgatttagtgtgagtagttccgcgggggaggaactgctcagttaggacccagacggaaccatggaagccccagcgcagcttctcttcctcctgctactctggctcccagacaccactggagaaatagtgatgacgcagtctcagcccacctgtctgtctctacgaggggaaaancgcctaacntcctctgcagggccagtcagactatagaagcaacttgccgtaggtaccagcaacgaacctggacacggctaccgacggctccgtctactctagtcggtcgcacttccacgtaccgggacctaccgtgtaccgtacccacggacctacgggtttaccacggtacggtccgtaagggttgggttaccgtgggtaccgaggtacggtttcaccttccgtctaacctataccgtacgacgaccgtacccgttacgccggtaagttcccggtaagtaacggttaacgttttacgtaaccgttttacccgttttttaaagttttccggtttacgttacgtaaaccggtaacgttaacgttttaaacgtaaacgtttaacccggttaccggttacccggttacccgggttaccgggttaaccgggtttacccgggggaaccccggggttaacccgggtaaccggggtttaaggggaaccgggttacggttaaacccggtaaaacccggttaaccgggttaaccgggttaccgggttaacgttcccgggtaaccggtaacccgttaaccggtaccgttttacggttaaccgttttaccccgg

SEQ ID NO: 275626 - DNA, 609 bp, Homo sapiens
  misc_feature: GYAE6OF02F4H3R.3.14.B03.1.454.CMB.1.raw
  modified_base (198)..(198): a, c, t, g, unknown or other
  misc_feature (198)..(198): n is a, c, g, or t
  modified_base (247)..(247): a, c, t, g, unknown or other
  misc_feature (247)..(247): n is a, c, g, or t
  modified_base (259)..(259): a, c, t, g, unknown or other
  misc_feature (259)..(259): n is a, c, g, or t
  modified_base (273)..(273): a, c, t, g, unknown or other
  misc_feature (273)..(273): n is a, c, g, or t
  modified_base (286)..(286): a, c, t, g, unknown or other
  misc_feature (286)..(286): n is a, c, g, or t
tcagagacgcactccacgaccggtgctcgatttagtgtgagtagttccgcgggggaggaactgctcagttaggacccagacggaaccatggaagccccagcgcagcttctcttcctcctgctactctggctcccagacaccactggagaaatagtgatgacgcagtctccagccaccctgtctgtgtctcgagggaangccacatctcctgcaggccagtcagactatagagcaacttgcctgaccngcagaacctgcnggctccgagctccncatctagtggtcncacgtcccacgacggcctacgttcgtactccccgagccgtaggttcgaggtcggcgtaggttcgggtcgtgggacaggtacgtttccgacgttaccgacctaaccagtaccacgtccgacggtccgtagactagttacgtaaggttaacgttagtttcgtacctttaacttttacgtttcttagtactagtcgtaagttaataacgttacgtcgtaccgttacggtcggtaccggttccgggaccgggtacgtagggtggtacgtacgtaacgtaacggtacgtaggtcgtacgtacgccgtacgtacgtctcgttacttccg

SEQ ID NO: 275627 - DNA, 629 bp, Homo sapiens
  misc_feature: GYAE6OF02GTUEX.3.14.B03.1.454.CMB.1.raw
  modified_base (198)..(198): a, c, t, g, unknown or other
  misc_feature (198)..(198): n is a, c, g, or t
  modified_base (232)..(232): a, c, t, g, unknown or other
  misc_feature (232)..(232): n is a, c, g, or t
  modified_base (287)..(287): a, c, t, g, unknown or other
  misc_feature (287)..(287): n is a, c, g, or t
  modified_base (326)..(326): a, c, t, g, unknown or other
  misc_feature (326)..(326): n is a, c, g, or t
tcagagacgcactccacgaccggtgctcgatttagtgtgagtagttccgcgggggagggaactgctcagttaggaccagacggaaccatggaagccccagcgcagcttctcttcctcctgctactctggctccagacaccactggagaaatagtgatgacgcagtctccagccacctgtctcgtgtctcgaggggaangccacgatctctgcaggcagtcagactatagacnctaactgctgaccagcaagaacctggccaggccaccgaggcctcctcactctagnggtcgactacgtccgacggacggcctacgtacggtaccnccgagtccgtaggttcgaggtcggacgttaggttcgggacgtagggacgtagtcgttacacttcgtacaccgtatcgacgcctacgcctagcgtacgtcgtaagtagttcgtttacgctttaacttttcttacgtggtaacgtatattaagttaattaacttacggtcgtaccgttacgggttacgtaccgggttaccggggaccgggtaacgtacggggtcaacggttaaccggaacggtaaacggttgtacgggttacggtacgtacgtacctaacgttcgttacgttaccgttcttaccg

SEQ ID NO: 275628 - DNA, 550 bp, Homo sapiens
  misc_feature: GYAE6OF02GCCNJ.3.14.B03.1.454.CMB.1.raw
  modified_base (201)..(201): a, c, t, g, unknown or other
  misc_feature (201)..(201): n is a, c, g, or t
  modified_base (303)..(303): a, c, t, g, unknown or other
  misc_feature (303)..(303): n is a, c, g, or t
  modified_base (328)..(328): a, c, t, g, unknown or other
  misc_feature (328)..(328): n is a, c, g, or t
  modified_base (353)..(353): a, c, t, g, unknown or other
  misc_feature (353)..(353): n is a, c, g, or t
  modified_base (375)..(375): a, c, t, g, unknown or other
  misc_feature (375)..(375): n is a, c, g, or t
  modified_base (389)..(389): a, c, t, g, unknown or other
  misc_feature (389)..(389): n is a, c, g, or t
  modified_base (424)..(424): a, c, t, g, unknown or other
  misc_feature (424)..(424): n is a, c, g, or t
tcagagacgcactccacgaccggtgctcgatttagtgtgagtagttccgcgggggaggaactgctcagttaggacccagacggaaccatggaagccccagcgcagcttctcttcctcctgctactctggctcccagacaccactggagaaatagtgatgacgcagtctccagccaccctgtctgtgtctccgaggggaaangccacatctcctgcagggccagtcagactattagaagcaacttagcctggtaccagcagaaacctggccaggcctcccgaggcctccgtcactctagtggtncactccgacgagggccagtggtacnccgagccaggttcagtgcagtggtntggacagagttcactctcaccntacagcagctagcnccgtagaatatttgctgttctatttattcgacaancgtcgtggactacgtcgtcccgtagtcggtacgttcggaccgtaagggtaccgagggtacggaaacgtccgaaaccgtaacgtagggtcggtacgtacggcctaaccgtgtcttacgtccttaccg

SEQ ID NO: 275629 - DNA, 840 bp, Homo sapiens
  misc_feature: GYAE6OF02GLI9Y.3.14.B03.1.454.CMB.1.raw
  modified_base (203)..(203): a, c, t, g, unknown or other
  misc_feature (203)..(203): n is a, c, g, or t
tcagagacgcactccacgaccggtgctcgatttagtgtgagtagttccgcgggggaggaactgctcagttaggacccagacggaaccatggaagccccagcgcagcttctcttcctcctgctactctggctcccagacaccactggagaaatagtgatgacgcagtctccagccaccctgtctgtgtcctacggaaggggaancgacccacctatcctcctgcgacgggaccagtcgacgtacttaagttaagaacgacctaaacgttacgtcccgttacggaccaggacaacggtaaaccgtcggaccgacggtccctacccgacggtcctccctactacttacgtaggtcgggtccacaccgtacccaaccgggaccgggtccctaacgttacggtaccctacccggacggtaccgttagggttaccgacgggtcgacgggttacgggttcgggtcggaacggggaactaggttaaccgtttacctaccgttcctaccctaaccgtacgtacgtacggaccgtcggtaccgtcggtacgtacgttacggtacgttaaagtttcgtttacgttaccttttaacgttttcgtttttactacggttactaacggtacgtttaagttaaaccgttaacggttaaccggttccgggttaccccggttttaccggggttaccgggggttacccgggttaccccggggggaacccggggttaaccgggtaacggggtacggggtaacggtaaccggtaaaacccggttaaaccggtacgggttaacgggtcggtaaccgttacggacccgtaccgttaacgttccggttaccgttacgttacccg

SEQ ID NO: 275630 - DNA, 739 bp, Homo sapiens
  misc_feature: GYAE6OF02IODAJ.3.14.B03.1.454.CMB.1.raw
  modified_base (164)..(164): a, c, t, g, unknown or other
  misc_feature (164)..(164): n is a, c, g, or t
  modified_base (199)..(199): a, c, t, g, unknown or other
  misc_feature (199)..(199): n is a, c, g, or t
  modified_base (346)..(346): a, c, t, g, unknown or other
  misc_feature (346)..(346): n is a, c, g, or t
  modified_base (401)..(401): a, c, t, g, unknown or other
  misc_feature (401)..(401): n is a, c, g, or t
  modified_base (501)..(501): a, c, t, g, unknown or other
  misc_feature (501)..(501): n is a, c, g, or t
tcagagacgcactccacgaccggtgctcgatttagtgtgagtagttccgcgggggaggaactgctcagttaggacccagacggaaccatggaagccccagcgcagcttctcttcctcctgctactctggctcccagacaccacgtggaagaatagtgatgacgnagtctccagccaccctgtctgtgtctcgagggaanacgccacatctaccgtgcgacggccagtcagtactagttaagaacgacctaacgtacgccgtacggtaaccagacaaaggaaccctcggacccgaaggtcccctacccgaggtccttaccctatactttacggtaagttcggggttnaacctaccgttaccaaaccccgggtcgggtacccaaccggtttacgggtaacccnccccgtacggacccgtaggttaccgaggtcggacgtttagggtcgggtcgacgggaccaaggtcttgacccttcaaccgcctaatcacgtcgacgtcgtncgtagttcgtaagtagtttactttacgtaccgtttattttccttagttcgtaataccggataaacgttattaaacttcggtacgttacccgttaccgggttcggggttaaccggttcccgggggaaccgggttacggtagggttacgtaaccggtagtaaaccgttaaaccggtcggttaacggcgtacggttacccgaccgaaccgttacgtttacggtttaccgtctttaaccccg

SEQ ID NO: 275631 - DNA, 825 bp, Homo sapiens
  misc_feature: GYAE6OF02GT8Z1.3.14.B03.1.454.CMB.1.raw
  modified_base (203)..(203): a, c, t, g, unknown or other
  misc_feature (203)..(203): n is a, c, g, or t
  modified_base (245)..(245): a, c, t, g, unknown or other
  misc_feature (245)..(245): n is a, c, g, or t
tcagagacgcactccacgaccggtgctcgatttagtgtgagtagttccgcgggggaggaactgctcagttaggacccagacggaaccatggaagccccagcgcagcttctcttcctcctgctactctggctcccagacaccactggagaaatgtgatgacgcagtcctccagcccaccctgtctgtgtctaccgaggggaaanacgccaccatcctcctgcgagggccagtcagactatagaacncaacgttagcctaggtaccaggcaacgaaaccgtggaccacgggtcctcccggaggtccctacctactacttacgtacgtcgggttcgacctaccgttaccccgaaccggacggggtacccctaaggttacgggtaaccctaccccgaacggtcccgtagggttaccgtaaggtcggggtaccgtagggttccggggttacggtacggggaaccgtaggttaaccgggtttaccctaaccgtttacccgtaacctaacccggtacgttacccggacgtaaccgtaacccggtccgtacggtaccgtaacgttacggttaacgggaacttttacgttttacgtaccttttaacgtttttacgttcgttacgtacgtaaggtaacctttaagtaaacgtttaaacgttaaccgtccggttaccgttacgggtacgttaacggttcccggggtaaccgggggtacccggggggtaaccgtagggggttacggaacgtaaaccggttaaacccgggaaaggttacgggttcggtaggttaccggtacgtaaccgttacccgtagttaccccggttgtttaaccc

SEQ ID NO: 275632 - DNA, 727 bp, Homo sapiens
  misc_feature: GYAE6OF02HH9UM.3.14.B03.1.454.CMB.1.raw
  modified_base (203)..(203): a, c, t, g, unknown or other
  misc_feature (203)..(203): n is a, c, g, or t
  modified_base (484)..(484): a, c, t, g, unknown or other
  misc_feature (484)..(484): n is a, c, g, or t
  modified_base (512)..(512): a, c, t, g, unknown or other
  misc_feature (512)..(512): n is a, c, g, or t
tcagagacgcactccacgaccggtgctcgatttagtgtgagtagttccgcgggggaggaactgctcagttaggacccagacggaaccatggaagcccccagcgcagcttctcttcctcctgctactctggctcccagacaccactggagaaatgtgatgacgcagtcctccagcccaccctgtctgtgtctccgaaggggaanacgccaccatcctcctgcagggccagtacagacttatagaagcaacttgcctcggtacagcaagaaacctggaccaggccctacccgaggtccctccgtcacttcctaagttggtacgactaccgtccccgaaccggacgggaccctacggttacgggttacctaccccgacgtacccgtaaggttacccgaggttacgggcgttaacgggttcggggtcgttaaggggacctaagggttacgttacctaccttctacccgaacctcgtaccgacgtaccncgtacctcgactacgtcgagtaagtttntttaccgtactttaacgtttttacttcgtttgaaccttacgtacgttaacgtttaacccgtacgttccggtaccgtttagggtttaacggtttaccgggaccgggtaaccgggtaaccgagttccggtaggtacgtaccgtaacggtaaaccggtggttcggtaacggtccgttacgtaccgtaaccgtcctttacggttccttacggtttaccc

SEQ ID NO: 275633 - DNA, 695 bp, Homo sapiens
  misc_feature: GYAE6OF02JX9F2.3.14.B03.1.454.CMB.1.raw
  modified_base (115)..(115): a, c, t, g, unknown or other
  misc_feature (115)..(115): n is a, c, g, or t
  modified_base (134)..(134): a, c, t, g, unknown or other
  misc_feature (134)..(134): n is a, c, g, or t
  modified_base (161)..(161): a, c, t, g, unknown or other
  misc_feature (161)..(161): n is a, c, g, or t
  modified_base (198)..(198): a, c, t, g, unknown or other
  misc_feature (198)..(198): n is a, c, g, or t
  modified_base (223)..(223): a, c, t, g, unknown or other
  misc_feature (223)..(223): n is a, c, g, or t
  modified_base (236)..(236): a, c, t, g, unknown or other
  misc_feature (236)..(236): n is a, c, g, or t
  modified_base (273)..(273): a, c, t, g, unknown or other
  misc_feature (273)..(273): n is a, c, g, or t
  modified_base (288)..(288): a, c, t, g, unknown or other
  misc_feature (288)..(288): n is a, c, g, or t
  modified_base (301)..(301): a, c, t, g, unknown or other
  misc_feature (301)..(301): n is a, c, g, or t
  modified_base (438)..(438): a, c, t, g, unknown or other
  misc_feature (438)..(438): n is a, c, g, or t
  modified_base (568)..(568): a, c, t, g, unknown or other
  misc_feature (568)..(568): n is a, c, g, or t
  modified_base (660)..(660): a, c, t, g, unknown or other
  misc_feature (660)..(660): n is a, c, g, or t
tcagagacgcactccacgaccggtgctcgatttagtgtgagtagttccgcgggggaggaactgctcagttaggacccagacggaccatggaagccccagcgcagcttctcttccnctgctactctggctcccanacaccactggagaattagtcgatgacncagtctcagcccacctgtctgtgtactccgagggaangccacatctcagcgaggtccacgtnagctatacgaagnaactttgcccttggactagcagaactgcgagtcctcncggtctccgataacncgttatccgggtntaccacgttccgaaaccgcgggaccttacggtacgggtaccctaccccggagtacccctagggtttaccagggtcgtcggaaccggttgggtaccgtaggaaccgagtacgttccgtaacttcggtacccaacggtnttaaccgagaaaccgtccggtcctacgggtacacggttcgtaagtaacgtttacggtttacaccggtttaattttacgttcgttggaactacgtataacggttaacttaacgttccgtaacgggttcccncggggttaacgtaccggtccgggtaaccggggttaccgaggttacgaggtaaccgttccggaaaacgttacttacgggacgtttaccgaacnccgttaccgttaatcccgggtttacttcccggttc

SEQ ID NO: 275634 - DNA, 629 bp, Homo sapiens
  misc_feature: GYAE6OF02H0V3D.3.14.B03.1.454.CMB.1.raw
  modified_base (202)..(202): a, c, t, g, unknown or other
  misc_feature (202)..(202): n is a, c, g, or t
  modified_base (296)..(296): a, c, t, g, unknown or other
  misc_feature (296)..(296): n is a, c, g, or t
  modified_base (306)..(306): a, c, t, g, unknown or other
  misc_feature (306)..(306): n is a, c, g, or t
  modified_base (458)..(458): a, c, t, g, unknown or other
  misc_feature (458)..(458): n is a, c, g, or t
tcagagacgcactccacgaccggtgctcgatttagtgtgagtagttccgcgggggaggaactgctcagttaggacccagacggaaccatggaagccccagcgcagcttctcttcctcctgctactctggctcccagacaccactggagaaatagtgatgacgcagtctccagccaccctgtctgtgtctccgaaggggaaanagccaccatcctcctgcgagggccagtcagactagtagaagctaacttaggcctggtaaccagcaagaaacctggccaggctcccaggctcctnatctatggtnacactccaccgagggccatcggtatcccgagccgtaggttccagtcggactacggtgggtctgggaactaggtacgtttccacttctaccgaacctatccagcagccgtgctagtctgtaaagttcgttttagcttaacttttactttcgtnttaccgagaccgtaagtaacttaataccgtcgggtcccttacggtacgggttacggttaccgggaccggggtaacgaacggggttaggacggtaacggtaaccgtaaaaccgtggttaacgggtacggtcgtacggtcccgtaaactacgtcgtttacggtctttaacccg

SEQ ID NO: 275635 - DNA, 756 bp, Homo sapiens
  misc_feature: GYAE6OF02H1DS3.3.14.B03.1.454.CMB.1.raw
  modified_base (176)..(176): a, c, t, g, unknown or other
  misc_feature (176)..(176): n is a, c, g, or t
  modified_base (207)..(207): a, c, t, g, unknown or other
  misc_feature (207)..(207): n is a, c, g, or t
  modified_base (324)..(324): a, c, t, g, unknown or other
  misc_feature (324)..(324): n is a, c, g, or t
  modified_base (381)..(381): a, c, t, g, unknown or other
  misc_feature (381)..(381): n is a, c, g, or t
  modified_base (501)..(501): a, c, t, g, unknown or other
  misc_feature (501)..(501): n is a, c, g, or t
  modified_base (505)..(505): a, c, t, g, unknown or other
  misc_feature (505)..(505): n is a, c, g, or t
  modified_base (565)..(565): a, c, t, g, unknown or other
  misc_feature (565)..(565): n is a, c, g, or t
  modified_base (572)..(572): a, c, t, g, unknown or other
  misc_feature (572)..(572): n is a, c, g, or t
tcagagacgcactccacgaccggtgctcgatttagtgtgagtagttccgcgggggaggaactgctcagttaggaccagacggaaccatggaagccccagcgcagcttctcttctcctgctactctgctccagacaacactggagtaaactgtgatgacgcacgtctccacgacccncctgttcctgtcgtccaccggaaggggaaanacggccctaacgcttcctcccgtagaccgaacggggtccaacgttcaacgacttaacgttaaggaaatcccgttaaattaccgcccggttaaggaccaacggcaacggttaaaaccncgggacaacgggtcccctacccgaggtccctcctaactctctaagtcggtcacgacnccgtacgaacggtccgtacgtcgacgtaccctacggacgtacggtagtacggtcggttaaacgcgggtacggttcggttacgggaacgtagtacgtacctcgtaccttccgcttaaccgngacncgtaccgtcgtctcggtacgtgtaacgtatttgttacgtactttgtttacctttacggtnttaacgngttaaccaggtttaaacttacccgtaaggttcccggttaccgttacgggtaacggtttccccgggttacggggaaccgggtccgggtaaagggttacggacgggtttaccgaaacgttaaccggaaggttcccggtagtcccgtacgtaccgaccgttaacggttccttacgttcgttaacccg

SEQ ID NO: 275636 - DNA, 714 bp, Homo sapiens
  misc_feature: GYAE6OF02JJBWB.3.14.B03.1.454.CMB.1.raw
  modified_base (162)..(162): a, c, t, g, unknown or other
  misc_feature (162)..(162): n is a, c, g, or t
  modified_base (201)..(201): a, c, t, g, unknown or other
  misc_feature (201)..(201): n is a, c, g, or t
  modified_base (257)..(257): a, c, t, g, unknown or other
  misc_feature (257)..(257): n is a, c, g, or t
  modified_base (275)..(275): a, c, t, g, unknown or other
  misc_feature (275)..(275): n is a, c, g, or t
  modified_base (555)..(555): a, c, t, g, unknown or other
  misc_feature (555)..(555): n is a, c, g, or t
tcagagacgcactccacgaccggtgctcgatttagtgtgagtagttccgcgggggaggaactgctcagttaggacccagacggaaccatggaagccccagcgcagcttctcttcctcctgctactctggctcccagacaccactggagaatagtcgatgacncagtctccagcccacctgctgtctcctacgaggggaaancgccacatctcctagcgaggccagtcgagactagtagagctaattggcctggaccngacaagtaacctcggacnggtcctcccgagtcgtcctacgacgtactaggtggtacgactaccgacccgaccgaccgggtacctaacggttacggtacctaccccggagtacccgtagggttaccgtacggtacgggaccgttaggggttcggggtacgtaacgggggtactaacggggtctttacccgtaacccgtaccgttaccgaacccgtacgtaccgacggtacgaccgttaccgttcgaccgttagtcgtaacttaggttccttacgtacttacgttttactacgttgtacngtttacgtaataagttacctaccgggttgccggttaccggttacggttacggggtacccggggacggtaccggtagggtacaacgggtaccgtaacggtaaccgtaaggttccggacgttcgtacggaccctaggtaccttcggttcgttactacccgg

SEQ ID NO: 275637 - DNA, 612 bp, Homo sapiens
  misc_feature: GYAE6OF02G0EBF.3.14.B03.1.454.CMB.1.raw
  modified_base (201)..(201): a, c, t, g, unknown or other
  misc_feature (201)..(201): n is a, c, g, or t
  modified_base (208)..(208): a, c, t, g, unknown or other
  misc_feature (208)..(208): n is a, c, g, or t
  modified_base (237)..(237): a, c, t, g, unknown or other
  misc_feature (237)..(237): n is a, c, g, or t
  modified_base (259)..(259): a, c, t, g, unknown or other
  misc_feature (259)..(259): n is a, c, g, or t
  modified_base (269)..(269): a, c, t, g, unknown or other
  misc_feature (269)..(269): n is a, c, g, or t
  modified_base (274)..(274): a, c, t, g, unknown or other
  misc_feature (274)..(274): n is a, c, g, or t
  modified_base (288)..(288): a, c, t, g, unknown or other
  misc_feature (288)..(288): n is a, c, g, or t
  modified_base (590)..(590): a, c, t, g, unknown or other
  misc_feature (590)..(590): n is a, c, g, or t
tcagagacgcactccacgaccggtgctcgatttagtgtgagtagttccgcgggggaggaactgctcagttaggacccagacggaaccatggaagccccagcgcagcttctcttcctcctgctactctggctcccagacacactggagaaatagtgatgacgcagtctccagcccacctgtcctgtcgtctcgaggggaaancgccacntcctcctgcgaggcagtcagactatagancaacttgcctgacagcagaacngcagcctccngctcncactctagtggtcncactccgacgacggtccacgtacgtacctcccgagtaccgtaggttcaggtcggctagggttcgggtacgtgggaacgaggtacgttcaccgtcctaccaccgtataccgcgactcgtacctgacttagtcgtagttaacggttacttttcgacctttacgtttttacgttcgtgtacctagtaccgtaagttaagttaaccgttacgtcccgtacggttccgtacggggttacggttacccgggtaaccgggacgtaacgggtggacgttaacgtacgaaacgtgtacggcgtcgtacctnaccgttatcttcggtacttacg

SEQ ID NO: 275638 - DNA, 784 bp, Homo sapiens
  misc_feature: GYAE6OF02GLWRQ.3.14.B03.1.454.CMB.1.raw
  modified_base (201)..(201): a, c, t, g, unknown or other
  misc_feature (201)..(201): n is a, c, g, or t
  modified_base (242)..(242): a, c, t, g, unknown or other
  misc_feature (242)..(242): n is a, c, g, or t
  modified_base (290)..(290): a, c, t, g, unknown or other
  misc_feature (290)..(290): n is a, c, g, or t
  modified_base (305)..(305): a, c, t, g, unknown or other
  misc_feature (305)..(305): n is a, c, g, or t
tcagagacgcactccacgaccggtgctcgatttagtgtgagtagttccgcgggggaggaactgctcagttaggacccagacggaaccatggaagccccagcgcagcttctcttcctcctgctactctggctcccagacaccactggagaaatagtgatgacgcagtctccagccaccctgtctgtgtctccgaaggggaanagccaccatcctcctgcgagggccagtcagactattagaancaagttgcctgaccagcaagaacctggccagcctcccgaggtcctccncactcgtagtggtcnctacctcccgacccggcctacgtcggtacctcccgagcccgtaggttaccacggtcggcgtacgggttcgggtaccgttacgggactaacggtacgttccctaaccgttcccgttaaccgaacccgttacgtaccgacggtaccgtaaccgggtacccggttacggggtaccgttacggtaaacggtaaaccggtacccttaccggttacggtaacgttttaaggtttttaacccgtttacgtttaccgggtaccctaaacggttaccgttaaaggttttaaacctttaaacgttttacccgggttacggggtacccgggtttaggggttaacccgggtttacccgggaaaccggtaaacgggggtaacccgtaaaggggtacggtaaacgttaccgggtaaaaaccggtccgttaacgggtccggactacggtacccgtaaccgtagttccgtcgtttacttaccgtaccttaccccg

SEQ ID NO: 275639 - DNA, 727 bp, Homo sapiens
  misc_feature: GYAE6OF02I70KX.3.14.B03.1.454.CMB.1.raw
  modified_base (199)..(199): a, c, t, g, unknown or other
  misc_feature (199)..(199): n is a, c, g, or t
tcagagacgcactccacgaccggtgctcgatttagtgtgagtagttccgcgggggaggaactgctcagttaggacccagacggaaccatggaagccccagcgcagcttctcttcctcctgctactctggctcccagacaccactggagaaatgtgatgacgcagtctccagcctaccctgtctgtagtctcgagggaangccacatctccgtgcgacggcagtcagactattagacgctaacgtgcctagtaccagacctaagaaaccgtggacctaggtcctcccgaggtcctaccgtacacttcctaagtcggttacgactaaccgtcccaaccggtacgggtaccctaacgttaggtaccctacccgaacggtcccgtaggttaccgaggttccgagtacgggtcgggtcgtacgggactagggttactaccgtacctcaccgacctagcgtacgccgaacgtccgtgacgtacgtccgtaaggtaacttaccttttgaaccgtttaacttttacgtttcgtacctacggtactaacgtacgttaaacgttaaccgttaccgggtacccgtaaccgtttaccggggtaccgggttaaccgggtccccgggtaaaccggggtaaccgaaggggttcgtaacgaaaccgtaacgggttaaaaccgtggttaaccggtcgtaccgtaccggtacctaccgttacgtccgttttagaaccctttcccg

SEQ ID NO: 275640 - DNA, 770 bp, Homo sapiens
  misc_feature: GYAE6OF02FWN2K.3.14.B03.1.454.CMB.1.raw
  modified_base (249)..(249): a, c, t, g, unknown or other
  misc_feature (249)..(249): n is a, c, g, or t
tcagagacgcactccacgaccggtgctcgatttagtgtgagtagttccgcgggggaggaactgctcagttaggacccagacggaaccatggaagccccagcgcagcttctcttcctcctgctactctggctcccagacaccactggaagaaatagtgatgacgcagtcctccagcccaccctgtctgtcgtctaccgaggggaaagcgccaccatcctcctgcgacgggccagtccagactattagaancaacttcgcctgtaccagcaagaaccgtggaccaggcctcccgaggtcctccctactactcgtacgttcggtcgacctactcccgaaccgtacgggaccctacgtcggtacctacccgacgtacctacgggttcagggtacggtcgagggttcggggtcgtacggggactaaggtacggtttaccaccgtttccgacctaacccgagttccgacgtacccgtacggtaccgtcgtaccgtacggttccgtaaggttaacgtttacgttttaccgtacctttaacctttttagtttacccgttaggttaccacgttaacgttaacgtttaaccgttaaacgtttaccggtcccggttaccgttaccgggttacgggtttacccggggtaccgggggtacccgggggtaacgggtaacggggttacgggaaaccgtaaccggtaaaccgtaaaccggttacggtcgggttaacggtccgttacggaaccctacgttaccttaccggtttcgttaaccttcccg

SEQ ID NO: 275641 - DNA, 928 bp, Homo sapiens
  misc_feature: GYAE6OF02JX9ZG.3.14.B03.1.454.CMB.1.raw
tcagagacgcactccacgaccggtgctcgatttagtgtgagtagttccgcgggggaggaactgctcagttaggacccagacggaaccatggaagccccagcgcagcttctcttcctcctgctactctggctcccagacaccactggagaaatagtgatgacgcagtctaccagcccaccctgtctgtgtctccgaaggggaacgacgcccaccatcctccgtgcgacgggccagtcacgtactattacgaacgtcctaacgttagccgtcggtaaccagaccgaagtaaaacccttcgggaccaacggcccttacccggaacgggtcctccccgtcaaccttactacggttcggtacgtcctaaccgtaccccgtaaccgtaaccgggggaccctaccggttaacggtttaacccttccccggaacggtacccgtacgggttttacggacgtttcggggtaccacggggttttcgggggaccggtttcggggaacgtaacggtagtttaccccgaaccttaccgttacccgtaaccggtacgttaacccggacgttaccgacccgggtacccttacggtaaccgtacgttcggttaaacgtaaccgggtttactttttacggtaaccctttaaacgttttttacgttttttcccggactttacccgtaagtacccgggtttaaagtttaactttaacccggtttaaaccggtacggggttaccccgtttacccggggttaaacgggttttaccccgggggtacccggggttaaccccgggggaacggttaacgggggtaccggttaacgggtaaccgttaaaccgggtaaacccgtttaaccggttaacggttaccgggtacccgggttaaccgtaccggtaaacccgttaccggttacgttttacccgggtacccttttaacccggg

SEQ ID NO: 275642 - DNA, 705 bp, Homo sapiens
  misc_feature: GYAE6OF02GARIC.3.14.B03.1.454.CMB.1.raw
  modified_base (139)..(139): a, c, t, g, unknown or other
  misc_feature (139)..(139): n is a, c, g, or t
  modified_base (205)..(205): a, c, t, g, unknown or other
  misc_feature (205)..(205): n is a, c, g, or t
  modified_base (324)..(324): a, c, t, g, unknown or other
  misc_feature (324)..(324): n is a, c, g, or t
  modified_base (338)..(338): a, c, t, g, unknown or other
  misc_feature (338)..(338): n is a, c, g, or t
tcagagacgcactccacgaccggtgctcgatttagtgtgagtagttccgcgggggaggaactgctcagttaggacccagacggaaccatggaagccccagcgcagcttctcttcctcctgctactctggctcccagacnccactggacgaaatagtgatgacgcagtctccagcccaccctgtctgttgtcctacgaggggaaancgccacatcgtcctgcgtaggggcccagtcaacgtacttattacggagacctaacttacgcgttacgtaccagacaaggtaaccctggccgtaacggccctacccgacggtccttcccncctaagtttaccgngttaacgggtctaccgaactcccgtaacggcggtcctacgttggaaccttcccgaaggtcttacggttacgaggtccggactgggttccggtaactggggaactcgggtacttacggacttccgtacgaccgtagtaccgtacgtacgacgtaccgtacgacgtcgttacgtacgtaggttagttacgtcgtttacgtttagttcgttcgtacgtagtactaagttaactttaaacgttacgtccggttaccgttaccgggttacgggtccggttaccgggaccgggttaaccgtagggtcggtaacgtacgtacgtaaacgtcggtacggtacgtcgacgtccgtactacgtcgttcgtacttacg

SEQ ID NO: 275643 - DNA, 206 bp, Homo sapiens
  misc_feature: GYAE6OF01CENP9.26.75.G09.1.454.CMB.1.raw
  modified_base (205)..(206): a, c, t, g, unknown or other
  misc_feature (205)..(206): n is a, c, g, or t
tcagagactatactcacgaccggtgctcgatttagtatagacatcagggggtcagacccagtcaggacacagcatggacatgagggtcccgctcagctcctggggctcctgctgctctggctcccaggaactgtggctgcaccatctgtcttcatcttcccgccatctaagtatagtctctgagcgggctggcaaggcgcatagnn

SEQ ID NO: 275644 - DNA, 213 bp, Homo sapiens
  misc_feature: GYAE6OF01CP097.26.75.G09.1.454.CMB.1.raw
  modified_base (207)..(213): a, c, t, g, unknown or other
  misc_feature (207)..(213): n is a, c, g, or t
tcagagactatactcacgaccggtgctcgatttagtatagacatcagggggtcagacccagtcaggacacagcatggacatgagggtccccgctcagctcctggggctcctgctgctctggctcccaggaactgtggctgcaccatctgtcttcatcttcccgccatctgaagtatagtctctgagcgggctggcaaggcgcatagnnnnnnn

SEQ ID NO: 275645 - DNA, 226 bp, Homo sapiens
  misc_feature: GYAE6OF01EAZ8V.26.75.G09.1.454.CMB.1.raw
  modified_base (210)..(226): a, c, t, g, unknown or other
  misc_feature (210)..(226): n is a, c, g, or t
tcagagactatactcacgaccggtgctcgatttagtatagacatcagggggtcgagacccagtcaggacacagcatggacatgagggtccccgctcagctcctggggctcctgctgctctggctcccaggaactgtggctgcaccatctgtacttcatcttcccgccatctgaagtatagtctctgagcgggctggcaaggcgcagtagnnnnnnnnnnnnnnnnn

SEQ ID NO: 275646 - DNA, 209 bp, Homo sapiens
  misc_feature: GYAE6OF01CLWRJ.26.75.G09.1.454.CMB.1.raw
  modified_base (207)..(209): a, c, t, g, unknown or other
  misc_feature (207)..(209): n is a, c, g, or t
tcagagactatactcacgaccggtgctcgatttagtatagacatcagggggtcagacccagtcaggacacagcatggacatgagggtccccgctcagctcctggggctcctgctgctctggctcccaggaactgtggctgcaccatctgtcttcatcttcccgccatctgaagtatagtctctgagcgggctggcaaggcgcatagnnn

SEQ ID NO: 275647 - DNA, 576 bp, Homo sapiens
  misc_feature: GYAE6OF01DALRX.26.75.G09.1.454.CMB.1.raw
  modified_base (369)..(369): a, c, t, g, unknown or other
  misc_feature (369)..(369): n is a, c, g, or t
tcagagactatactcacgaccggtgctcgatttagtatagacatcaggggagagctgctcagttaggacccagagggaaccatggaaaccccagcgcagcttctcttcctcctgctactctggctcccagattccaccgcagaaattgtgctgacgcagtctcccgggaccctgtctttgtctccagggggaaagagcccaccctctcctgcagggccagtcagagtgtagcaactactatttagcctggtaccaacagaagtctggccaggcctccccggctcctcatctaacggacactccaaccgggccacgtggcactccagacaggttcagtgcagtgggtctgagacagcttcactctcactntcagcagacgtggacgcctgtaagtatttgcgtagttagttattacgtgtcagtcgtagtatcgtactacctctacgtttcccgtagttacgttttcggaccgtacggggtaacctacggccgtaggtaactaacgtacgaaacggtaacgtaggtacggtctacgtacctacctacttacgttgtttccttccgtacgttaccccg

SEQ ID NO: 275648 - DNA, 506 bp, Homo sapiens
  misc_feature: GYAE6OF01B95VS.26.75.G09.1.454.CMB.1.raw
  modified_base (194)..(194): a, c, t, g, unknown or other
  misc_feature (194)..(194): n is a, c, g, or t
  modified_base (500)..(500): a, c, t, g, unknown or other
  misc_feature (500)..(500): n is a, c, g, or t
tcagagactatactcacgaccggtgctcgatttagtatagacatcaggggagagctgctcagttaggacccagagggaaccatggaaaccccagcgcagcttctcttcctcctgctactctggctcccagattccaccgcagaaattgtgctgacgcagtctcccgggaccctgtctttgtctccaggggaaanagccaccctctcctgcagggccagtcagagtgttagcaactactatttagcctggtaccaacagaagtctggccaggctccccggctcctcatctacggaacatccaaccgggccactggcatcccagacaggttcagtggcagtgggtctgagacagacttcactctcactatcagcagactggagcctgaagtatttgctagtgtattactgtcagcagtatgctacctcatttccgtgtacttttggcctaggggaccagctggatatacaaacgactgtggctcgcacctatctgtcttctnttcccg

SEQ ID NO: 275649 - DNA, 624 bp, Homo sapiens
  misc_feature: GYAE6OF01CUQBP.26.75.G09.1.454.CMB.1.raw
  modified_base (192)..(192): a, c, t, g, unknown or other
  misc_feature (192)..(192): n is a, c, g, or t
  modified_base (364)..(364): a, c, t, g, unknown or other
  misc_feature (364)..(364): n is a, c, g, or t
  modified_base (390)..(390): a, c, t, g, unknown or other
  misc_feature (390)..(390): n is a, c, g, or t
tcagagactatactcacgaccggtgctcgatttagtatagacatcaggggagagctgctcagttaggacccagagggaaccatggaaaccccagcgcagcttctcttcctcctgctactctggctcccagattccaccgcagaaattgtgctgacgcagtctcccgggacctgtcttgtctccaggggaaancgccaccctctcctgcagggccagtcagagtgttagcaactactatttagcctaggaccaacagaagtctggccagggcctcccggctcctcatctaacggaacactcccgaaaccggccaacgtggcaactcccgaagactaggttcaggtggcaaggtcgggctaggaanacacgtacttcaactctacacttaancgagcagacgtggacgtacgtagtaagttagtttgacgtagttagttaacttacgttcgtacagtcgtaagttactcgtaccttaccttacgttaccgtttaccggttacgttaccggtttaccgggaccggtaacgggtaaccacggtcgtacgtaagttaactaacgaaacgtacgtaggtacggtacgtacgaccacctacttacgttacgttaccttctacccgttcccg

SEQ ID NO: 275650 - DNA, 623 bp, Homo sapiens
  misc_feature: GYAE6OF01D1PN9.26.75.G09.1.454.CMB.1.raw
  modified_base (195)..(195): a, c, t, g, unknown or other
  misc_feature (195)..(195): n is a, c, g, or t
  modified_base (389)..(389): a, c, t, g, unknown or other
  misc_feature (389)..(389): n is a, c, g, or t
  modified_base (416)..(416): a, c, t, g, unknown or other
  misc_feature (416)..(416): n is a, c, g, or t
tcagagactatactcacgaccggtgctcgatttagtatagacatcaggggagagctgctcagttaggacccagagggaaccatggaaaccccagcgcagcttctcttcctcctgctactctggctcccagattccaccgcagaaattgtgctgacgcagtcctcccgggacctgtctttgtctccgaaggggaancgccaccctctcctgcagggccagtcagagtgttagcaactactatttagcctaggtaccaacagaagtctggccaggccctcccccggctcctcactccgtaacggaacacgtcccgaaaccgggccacgtggccactcccagactaggttcagtggctaggtggtctgagacagtacttcacttctcactancagcagacgtggacgccgtagtaagtntttgcgtagtagttattacgtgtacagtcgtagtactcgtacctaccttcttaccgtttcccggttacgttaccgttttcggaccgtacgggtaaccctaggtacgttaggtaacttaacgtaaccgtaaaacggtacgttaggtacggtctacggtacctaaccgttacttaccgttacgtttaccttccgttacgtttacccccg

SEQ ID NO: 275651 - DNA, 544 bp, Homo sapiens
  misc_feature: GYAE6OF01ELHPZ.26.75.G09.1.454.CMB.1.raw
  modified_base (194)..(194): a, c, t, g, unknown or other
  misc_feature (194)..(194): n is a, c, g, or t
  modified_base (289)..(289): a, c, t, g, unknown or other
  misc_feature (289)..(289): n is a, c, g, or t
  modified_base (396)..(396): a, c, t, g, unknown or other
  misc_feature (396)..(396): n is a, c, g, or t
tcagagactatactcacgaccggtgctcgatttagtatagacatcaggggagagctgctcagttaggacccagagggaaccatggaaaccccagcgcagcttctcttcctcctgctactctggctcccagattccaccgcagaaattgtgctgacgcagtctcccgggaccctgtctttgtctccaggggaaanagccaccctctcctgcagggccagtcagagtgttagtcgcggcttagcctggtaccagcagacacctgggcagacctcccaggctcctcatttangctgcatcccaccagggccacgtggtatcccagcctaggcaggtggcagtgggtctgggacagtcgttcactctcaccatcagcagcctgcagtctagaagtattgnactaattttactacgtgtacagactaatataactcctggccctccgtcttctacgttcgggacggaacgggacctaagggttcgagtactaccgaaaacgtacgttcggtcggactcggaccctaccgtaattccgttgttcttaccg

SEQ ID NO: 275652 - DNA, 606 bp, Homo sapiens
  misc_feature: GYAE6OF01EAS0W.26.75.G09.1.454.CMB.1.raw
  modified_base (196)..(196): a, c, t, g, unknown or other
  misc_feature (196)..(196): n is a, c, g, or t
tcagagactatactcacgaccggtgctcgatttagtatagacatcaggggagagctgctcagttaggacccagagggaaccatggaaaccccagcgcagcttctcttcctcctgctactctggctcccagattccaccgcagaaattgtgctgacgcagtctcccgggaccctgtctttgtctccgaggggaaagngcccaccctctcctgccgagggccagtcagagtgttagcaactactatttagcctaggtaccaacagaagtctggaccaggcctccccggctcctcactcgtaacggaacatacccgaaccggccacgtcggcactcccagacaggttcaggtcgacgtaggtgggtctagagacagtacttcactctcactatcagcagaccgtgacgtccgtagtaagtagtttacgactagttacgttacgttacgtgtacgagtacgtagttacgtcgtaccttaccgtcttaccgtttacccgtacgttaccgttttcggaccgtacgggaaccgtacggtacgtaggtacttactaacgtaaacgtacgtggtacggtctcgaccaccgtactacgttagtcttctcgttcccg

SEQ ID NO: 275653 - DNA, 608 bp, Homo sapiens
  misc_feature: GYAE6OF01AB2YV.26.75.G09.1.454.CMB.1.raw
  modified_base (194)..(194): a, c, t, g, unknown or other
  misc_feature (194)..(194): n is a, c, g, or t
tcagagactatactcacgaccggtgctcgatttagtatagacatcaggggagagctgctcagttaggacccagagggaaccatggaaaccccagcgcagcttctcttcctcctgctactctggctcccagattccaccgcagaaattgtgctgacgcagtctcccgggacctgtctttgtctccgaggggaaangcccaccctctcctgcagggccagtcagagtgttagcaactactattttagccttggtaaccaacagaacgtctggcccagggcctccccggctcctcactccgtaacggaacacgtcccgaaccgggccacgtggccactcccagtacctaggttcaggtggctaggtgggtctggacgacagacttcactctacactatcagcagcgtggacgtctagtagtatttgactagtagtattacgtgtacagctagtactcgtactacctctacgtttaccgttcgtaccgtttcggaccgtacgggtaacctacggtacgttacggtacttaacgtaccgtaaacgtacgttaggtacggtcgtacgtaccctaccgtaccttacgttacgttacccttccgtacgtttccccg

SEQ ID NO: 275654 - DNA, 211 bp, Homo sapiens
  misc_feature: GYAE6OF01D43YC.26.75.G09.1.454.CMB.1.raw
  modified_base (207)..(211): a, c, t, g, unknown or other
  misc_feature (207)..(211): n is a, c, g, or t
tcagagactatactcacgaccggtgctcgatttagtatagacatcagggggtcagacccagtcaggacacagcatggacatgagggtccccgctcagctcctggggctcctgctgctctggctcccaggaactgtggctgcaccatctgtcttcatccttcccgcatctgaagtatagtctctgagcgggctggcaaggcgcatagnnnnn

SEQ ID NO: 275655 - DNA, 552 bp, Homo sapiens
  misc_feature: GYAE6OF01ESHVV.26.75.G09.1.454.CMB.1.raw
  modified_base (194)..(194): a, c, t, g, unknown or other
  misc_feature (194)..(194): n is a, c, g, or t
  modified_base (380)..(380): a, c, t, g, unknown or other
  misc_feature (380)..(380): n is a, c, g, or t
tcagagactatactcacgaccggtgctcgatttagtatagacatcaggggagagctgctcagttaggacccagagggaaccatggaaaccccagcgcagcttctcttcctcctgctactctggctcccagattccaccgcagaaattgtgctgacgcagtctcccgggaccctgtctttgtctccaggggaaanagccaccctctcctgcagggccagtcagagtgttagcaactactatttagcctggtaccaacagaagtctggccaggcctccccggctcctcatcctacggaacactcccgaaaccgggccacgtcggcatcccagacaggttcagtggcaggtgggtctggagacagtacttcgactctcactancagcagacgtggacgcctagaagtatttgactagtgtattactgtctagctagtatcgtctacctctactttaccgtgttacgtttcggaccgtagggacctaagcgtaggatacgtactaaaccgtacgttggtacggctcgacacctactcttagtccttcgcttccccg

SEQ ID NO: 275656 - DNA, 579 bp, Homo sapiens
  misc_feature: GYAE6OF01A3TW9.26.75.G09.1.454.CMB.1.raw
  modified_base (194)..(194): a, c, t, g, unknown or other
  misc_feature (194)..(194): n is a, c, g, or t
tcagagactatactcacgaccggtgctcgatttagtatagacatcaggggagagctgctcagttaggacccagagggaaccatggaaaccccagcgcagcttctcttcctcctgctactctggctcccagattccaccgcagaaattgtgctgacgcagtctcccgggaccctgtctttgtctccgaggggaangccaccctctcctgcagggccagtcagagtgttacgcaactacttatttagcctaggtaaccaagagaagtctggccaggcctcccggctcctcatctaacggaacactacccgaaccgggccacgtcggcactcccgagacaggttcaggtggctaggtcggtctaggagacgagtaccttcacttctcactatcagcagactggacgctagagtagtttcgcgtagttgttattacgtgtactagcgtagtatcgtactacctctacgtttccgttagttaccgttttcggaccgtaacgggtacctagtcgtaggtattacgtacgtaaacgtacgtggtcgtcgtacgacacgtactcgttagttccttcgtcgttacccg

SEQ ID NO: 275657 - DNA, 216 bp, Homo sapiens
  misc_feature: GYAE6OF01BT5E0.26.75.G09.1.454.CMB.1.raw
  modified_base (175)..(175): a, c, t, g, unknown or other
  misc_feature (175)..(175): n is a, c, g, or t
  modified_base (207)..(216): a, c, t, g, unknown or other
  misc_feature (207)..(216): n is a, c, g, or t
tcagagactatactcacgaccggtgctcgatttagtatagacatcagggggtcagacccagtcaggacacagcatggacatgagggtccccgctcagctcctggggctcctgctgctctggctcccaggaactgtggctgcaccatctgtcttcatcttcccgccatctgaagtntagtctctgagcgggctggcaaggcgcatagnnnnnnnnnn

SEQ ID NO: 275658 - DNA, 703 bp, Homo sapiens
  misc_feature: GYAE6OF01B4W40.26.75.G09.1.454.CMB.1.raw
tcagagactatactcacgaccggtgctcgatttagtatagacatcaggggagagctgctcagttaggacccagagggaaccatggaaaccccagcgcagcttctcttcctcctgctactctggctcccagattccaccgcagaaattgtgctgacgcagtccgtcccgggaccctgtctttgtcgtaccgaggggaaagacgccaccctctcctgcacggaccagtcagagtgttagctaactacttattacgtccgtaggtaaccaacagaagtcgtcggccacggcctccccggcttcctcactaccgtacggaacctactacccgaaccgggccacgtcggccactacccaagtaccgtaggttcaggtcggacgtagggttggtcgagtagacagtaccttcgactcttcaatactacagcagtacgtggacgcgtagtagttagtttgacgttagttagttactttacgtcgtacagtccgtaagttactcgtacctacccttacgtttaccgtttcccgtttagtttaccggttttaccgggacccgggtaacggggaacccgttacggtaccggttacggtaacgtttaaccaaacgggttaaaacccgttaacggttcggttacggtccgttaccgtacccttaaccgttactttaccggttaccgtttcctttacccgttcgttttaccccccg

SEQ ID NO: 275659 - DNA, 799 bp, Homo sapiens
  misc_feature: GYAE6OF01EJDNE.26.75.G09.1.454.CMB.1.raw
  modified_base (191)..(191): a, c, t, g, unknown or other
  misc_feature (191)..(191): n is a, c, g, or t
  modified_base (287)..(287): a, c, t, g, unknown or other
  misc_feature (287)..(287): n is a, c, g, or t
  modified_base (445)..(445): a, c, t, g, unknown or other
  misc_feature (445)..(445): n is a, c, g, or t
tcagagactatactcacgaccggtgctcgatttagtatagacatcagggggagagctgctcagttaggacccagagggaaccatggaaaccccagcgcagcttctcttcctcctgctactctggctccagattccaccgcagaaattgtgctgacgcagtctcccgggacctgtctttgtctcaggggaangccaccctctcctgcagggccagtcagagtgttagcaactactatttacgccttaggtaaccaacgagaagtctagggcccagggcctcccccggnttcctcacttccgtaacggaactactcccgaaacccggggccaacggttggcctaacgtcccccgaaggtaccgtagggtttccaagggttcggaccgtaagggttcgggtacctaggaacgtactaggtaccctttacgaacttcctacaactttanaccgacggactaaggaccgttgggacgtacccgtaggtaaagttacgttttacggaccgttaaggttacgttaactttaaccgttacggttaaccgtaacggtaccgttaacggttaaccttacgttaacgttacggtaaccggttaccgggtaccccggttacccgttacccgttaaccccggtttacccggggaacccgtaaacgggggtacccgtaaaccgggtaccggttaaggggtaaaccgtaaaaccgtttaaaaccggaaacgtttacgggtacgggttaccgtaccggtacctaacccgttacgttacccgttacggtttaccctttccgtaccgtttacccccg

SEQ ID NO: 275660 - DNA, 737 bp, Homo sapiens
  misc_feature: GYAE6OF01AXDR4.26.75.G09.1.454.CMB.1.raw
  modified_base (153)..(153): a, c, t, g, unknown or other
  misc_feature (153)..(153): n is a, c, g, or t
  modified_base (432)..(432): a, c, t, g, unknown or other
  misc_feature (432)..(432): n is a, c, g, or t
  modified_base (453)..(453): a, c, t, g, unknown or other
  misc_feature (453)..(453): n is a, c, g, or t
  modified_base (459)..(459): a, c, t, g, unknown or other
  misc_feature (459)..(459): n is a, c, g, or t
tcagagactatactcacgaccggtgctcgatttagtatagacatcagggagagctgctcagttaggacccagagggaaccatggaaccccagcgcagcttctcttcctcctgctactctggctcccagcttccaccgcagaattgtgctgacncacgtcctcccgggaccctgttctttgtcctcgagggaagcgcccacctctccgtgcgacggtccagtcagtagtgtagcactattgttacgctcgtaacaacgaggaagttcgtcgaccgaccggtccgtcccccggtacttccctagtactaccgtaaccggaactaacccgtaccccgaaccggtaccctagtacccggcgaacttcccgagtaaccgtacggtcgtaacggtcggacgtaggttcggtacgtacgagaaccgtaagtccgttacncctaccgttacacttacgtanacgganacgtaacgtcgggacctacgtacgtagttacttagtactaggtacgttattccgttacggtgtaccgtagtaacggtcttaccgttcgtaaccttcgttaacccgttttccggttacgttaccggtttaccgggtaccggttaaccggtaaccgtccgtaacggttaaaggtaccttaacggtaaaccctaacggtacctttacgggactttaccggaccttaaccctagttacccttacgttaaccgtttcccgttaaacttcccggttaacccccg

SEQ ID NO: 275661 - DNA, 752 bp, Homo sapiens
  misc_feature: GYAE6OF01DS2TZ.26.75.G09.1.454.CMB.1.raw
tcagagactatactcacgaccggtgctcgatttagtatagacatcaggggagagctgctcagttaggacccagagggaaccatggaaaccccagcgcagcttctcttcctcctgctactctggctcccagattccaccgcagaaattgtgctgacgcagtcctcccgggaccctgttctttgtctccgaaggggaaacgacgccctaccctctccgtgcgacggccagtcagtagtgttagctaacttatatttacgcctacggtaccaaacagtaacgtctcggccacggccgtccccggctcccgtactactccgtaacgaacactacccgaaccgggccaccgtcggaccacgtacccgaagacgtacggttaccgaggttcggaccgtagggttcgggtaccgttaggaacgaaccgtaacgtacctttacccaccttaccgtccgtaaccttaccgtactaaccggacgtaacggtaccggtagggtaaccgtaccgttaaggtaacgtttacgtttcggtaacgtagggttttacgttacttttacgtagttacgacggtactacgggttaacttcgtacccttaccgttaccgtttaccgtttaccccgggttagttttacccgggtttaccgggtacccggtacgggtaaccgtaacggtccgttaaggtaactacgtaaccgtaaaccgtcgttagtacgtccgtacgacctaccgtattccttagtacttccgtcttacccg

SEQ ID NO: 275662 - DNA, 738 bp, Homo sapiens
  misc_feature: GYAE6OF01CEZKR.26.75.G09.1.454.CMB.1.raw
  modified_base (275)..(275): a, c, t, g, unknown or other
  misc_feature (275)..(275): n is a, c, g, or t
tcagagactatactcacgaccggtgctcgatttagtatagacatcaggggagagctgctcagttaggacccagagggaaccatggaaaccccagcgcagcttctcttcctcctgctactctggctcccagattccaccgcagaaattgtgctgacgcagtctcccgggcctgtctttgtctccgagggaacagccaccctctcctgcgacgggccagtcagtagtgttagactaactacttatttacgccgttacggtaccaacgtagaacgtcncggtaccgacggccgtacccccggcttacctccgataccgtaccggaaacacgtaacccgaacccggggtaccctacgtaccggaccacgttcccgaaggtaccgtacggttcgaggtacgggctaggtcgggttcctaggacgtacgaacggtaccttactacgtaccttaccaacgttacgtacgaacgctacgggtacgttcgggaacgtcgttaagtaacgttattttcgggacgttaagttcgttaacttacggttacgtacgaacgtacgtaacgttacgttcctacccgtttaacgtcccgtttaacgtttcccgggttacgtttaaccggttttcgggacccgtacgggaccttacggtaccgtaggtacttacgaaccgttaaacggtcgttaggtacggtctacgtaaccctacgttaacttcgttaccgtttcttaccgtcggtttaccccg

SEQ ID NO: 275663 - DNA, 875 bp, Homo sapiens
  misc_feature: GYAE6OF01B1ANW.26.75.G09.1.454.CMB.1.raw
tcagagactatactcacgaccggtgctcgatttagtatagacatcagggggagagcgtgctcagttaggacccagagggaaccatggaaaccccagcgcagcttctcttcctcctgctactctggctcccagattccaccgcagaaattgtgctgacgcagtctcccgggaccctgttcctttgtcctaccgagggggaaacgacgtcccacccctctcccgtgccgaggggcccagtcaagacgtgttagacaactactatttagccttaggtaccaaacagaacgttctggccgaggcctcccccggaccttcctcactactaaccgggaaccaacgtacccgaaacccggggccaccgtcggacacctacccagacgtacggttcgaaggttcggctaggtcgggtcgtagggaccaggtacggttaccacgttacctacgaaccctagttaccgacgggtactaacggtccccgtaggttaccccagggttacccgttaggaaacggttacttttacgggtacggttaaccttaaaacgtttttaacgtttacctttaccgggtacgtaaacggtaaccctaaaactttaaacggttttaaaccgttaaccccggtttaccgggtaacccccgttccccgggttaccctttaacccggttaacccggtttttacccggggggtaacggggtaaacccgggggttaaacccggtaaggggttttaacggaaaccggtaacgttaaaccggtaaaaaccccgggttaacgttccggggttaagggtccccgttaggaaccccggtaaaccttaccggttaccggtttacccggtttaccctttaacgttaccccttaccccggtttaccccgg

SEQ ID NO: 275664 - DNA, 215 bp, Homo sapiens
  misc_feature: GYAE6OF01BCT86.26.75.G09.1.454.CMB.1.raw
  modified_base (206)..(215): a, c, t, g, unknown or other
  misc_feature (206)..(215): n is a, c, g, or t
tcagagactatactcacgaccggtgctcgatttagtatagacatcagggggtcagacccagtcaggacacagcatggacatgagggtccccgctcagctcctggggctcctgctgctctggctcccaggaactgtggctgcaccatctgtcttcatcttcccgcatctgaagtatagtctctgagcgggctggcaaggcgcatagnnnnnnnnnn

SEQ ID NO: 275665 - DNA, 697 bp, Homo sapiens
  misc_feature: GYAE6OF01BXSLW.26.75.G09.1.454.CMB.1.raw
  modified_base (199)..(199): a, c, t, g, unknown or other
  misc_feature (199)..(199): n is a, c, g, or t
  modified_base (214)..(214): a, c, t, g, unknown or other
  misc_feature (214)..(214): n is a, c, g, or t
  modified_base (633)..(633): a, c, t, g, unknown or other
  misc_feature (633)..(633): n is a, c, g, or t
  modified_base (664)..(664): a, c, t, g, unknown or other
  misc_feature (664)..(664): n is a, c, g, or t
tcagagactatactcacgaccggtgctcgatttagtatagacatcaggggagagctgctcagttaggacccagagggaaccatggaaaaccccagcgcagcttctcttcctcctgctactctggctcccagacttccaccgcaagtaaattgtgctgacgcagtccgtcccggtacctgttcttgtctacgaagggaancgcctacctcgtccngcgacgggccagtacaggtagttcgttacgacctaaacttaacttatttacggccgttacggtaaccaaacgtaggtaacgttcgtcggaccgtacggtcccgtcccccggactcctacgaacttaccggtaaccggaacctaccgtacccgaacccgggtctaacgtcggaacctaccgtacccgaggtaccgtaggtaccgtggtacggacgtagggtcggtactagacggtactacggtactctaccgtactacgaacttacgcacgtacgtaacgtacggtacggtacctacgttaaggtaacgtttatttacggaccgtaagttcgttaacgtaccgtgtacgtagtacgtagtactcgtaccttaccttcgtaccgtttcgtacgtacgttccggacgtacggactagcgtanagtacctaaggaacctgtacgacgtctaacnccgtaactgtacgtattccgtactccgtacccg

SEQ ID NO: 275666 - DNA, 845 bp, Homo sapiens
  misc_feature: GYAE6OF01EA04U.26.75.G09.1.454.CMB.1.raw
  modified_base (158)..(158): a, c, t, g, unknown or other
  misc_feature (158)..(158): n is a, c, g, or t
  modified_base (200)..(200): a, c, t, g, unknown or other
  misc_feature (200)..(200): n is a, c, g, or t
tcagagactatactcacgaccggtgctcgatttagtatagacatcaggggagagctgctcagttaggacccagagggaaccatggaaaccccagcgcagcttctcttcctcctgctactctggctcccagacttccaccgcagaaattgtgctgacgnagtcctcccgggtaccctgtctttgtctaccgaaggggaaanacgtcccacccgtctcctgcgacgggccagtcagtagttgtagacctaaacttacttagtttacgcctaggtaacccaacgtaggaaacgttccgtacggacccgtacggaccccgttcccccgggtaccttcccttaccgtaacttaccgttaaaccgggaaccctaacgtacccccggaaaaccggggtccctaaccggttcggacctacgtaccccaaggtacccgtacgggtttaccgaagttacgggacgtacgggtttacgggtaccgttaggaaaccggtaccgtaacgggtaacccttttcccgaaaccgtttacccgttacctaacccgtttaaaccgttaccgaaacccggacgtaaccggtaaccggttacgggtaaccggtacccgtttaaggtaaacgtttagtttttacggaacgttaacgttagtttaaacttacgttggtacgtacgtaacgttagttacttacgtaccgttaccctttacgttaccgtttcccgttaggtttacccggtttcggaacccgggtaacggtaacctacggtacgtacggtaatacgtaaaccgaacgttacgtggtacgtctacgtactacccgttgttaccttacgtttccttacccgttacgtccccg

SEQ ID NO: 275667 - DNA, 669 bp, Homo sapiens
  misc_feature: GYAE6OF01BN0UR.26.75.G09.1.454.CMB.1.raw
  modified_base (193)..(193): a, c, t, g, unknown or other
  misc_feature (193)..(193): n is a, c, g, or t
tcagagactatactcacgaccggtgctcgatttagtatagacatcaggggagagctgctcagttaggacccagagggaaccatggaaaccccagcgcagcttctcttcctcctgctactctggctcccagattccaccgcaagaaattgtgctgacgcagtcctcccggacctgtctttgtctccgagggaangccaccctctcctgcgaggccagtcagtacgtgttacgctaaacgttacttattacgccgttacggtaaccaaagagtaaagttccgtcggcccacggtcccgtacccccggtctccctactactaccgtaacggaaccacgtaccccgaaaccgggcctacgtcggcaactcccgaggactacggttacgagtaggcgtaggtcggtcctgaacgacgacgtactcgtaactcgtactactaactcaagtcagtcgtaggacgtcgtaagtaagttagtttcgacgtagttagtactttacgtagtctaagtctaagtactcgtaccttacgttccttaccgtttccgtagttaccgtttcgggaccgtaacggtacctaagccgttagacgttaacgtaaccgtaaacgtacgttggtacggtcctacgaccttaacgtacttaccgttacgtttccgttacgtcgttccccgg

SEQ ID NO: 275668 - DNA, 219 bp, Homo sapiens
  misc_feature: GYAE6OF02HVR7G.26.75.G09.1.454.CMB.1.raw
  modified_base (208)..(219): a, c, t, g, unknown or other
  misc_feature (208)..(219): n is a, c, g, or t
tcagagactatactcacgaccggtgctcgatttagtatagacatcagggggtcgagacccagtcaggacacagcatggacatgagggtccccgctcagctcctggggctcctgctgctctggctcccaggaactgtggctgcaccatctgtcttcatcttcccgccatctgaagtatagtctctgagcgggctggcaaggcgcatagnnnnnnnnnnnn

SEQ ID NO: 275669 - DNA, 230 bp, Homo sapiens
  misc_feature: GYAE6OF02HHHRC.26.75.G09.1.454.CMB.1.raw
  modified_base (212)..(230): a, c, t, g, unknown or other
  misc_feature (212)..(230): n is a, c, g, or t
tcagagactatactcacgaccggtgctcgatttagtatagacatcgaagggggtcagacccagtcaggacacagcatggacatgagggtccccgctccagctcctggggctccgtgcctgctctggctcccaggaactgtggctgcaccatctgtcttcatcttcccgccatctgaagtatagtctctgagcgggctggcaaggcgcatagnnnnnnnnnnnnnnnnnnn

SEQ ID NO: 275670 - DNA, 246 bp, Homo sapiens
  misc_feature: GYAE6OF02GF4DK.26.75.G09.1.454.CMB.1.raw
  modified_base (213)..(214): a, c, t, g, unknown or other
  misc_feature (213)..(214): n is a, c, g, or t
  modified_base (216)..(246): a, c, t, g, unknown or other
  misc_feature (216)..(246): n is a, c, g, or t
tcagagactatactcacgaccggtgctcgatttagtatagacatcagggggtcaggacccagtcaggacacagcatggaccatgagggtccccgtctcagctcctggggctcctgctgctctggctcccaggaactgtggcctgcaccatctgtcttcatcttcccgccagtctgaagtatagtctctgagcgggctggcaaggcgcattagnnannnnnnnnnnnnnnnnnnnnnnnnnnnnnnn

SEQ ID NO: 275671 - DNA, 202 bp, Homo sapiens
  misc_feature: GYAE6OF02HCW4O.26.75.G09.1.454.CMB.1.raw
  modified_base (201)..(202): a, c, t, g, unknown or other
  misc_feature (201)..(202): n is a, c, g, or t
tcagagactatactcacgaccggtgctcgatttagtatagacatcagggtccgggagatcatgagggtgtccttgggttttgggggaagaggaagactgacggtcccccaggagttcaggtgctgggcacagcggccctgggctgcctggtcaaggactacttccagtatagtctctgagcgggctggcaaggcgcatagnn

SEQ ID NO: 275672 - DNA, 567 bp, Homo sapiens
  misc_feature: GYAE6OF02JX7K4.26.75.G09.1.454.CMB.1.raw
tcagagactatactcacgaccggtgctcgatttagtatagacatcaggggagagctgctcagttaggacccagagggaaccatggaaaccccagcgcagcttctcttcctcctgctactctggctcccagattccaccgcagaaattgtgctgacgcagtctcccgggaccctgtctttgtctccaggggaaagagccaccctctcctgcagggccagtcagagtgttagcaactactatttagcctggtaccacagaagtctggccaggctccccggctcctcatctacggaacatccaaccgggccactggcatcccagacaggttcagtggcagtgggtctgagacagactcactctcactatcagcagactggagcctagaagtatttgctagtagtattactgtcagctagtatgtctacctactactttcccgtgttacgttttcgggacccgtacgggggtaaccaacggtcgttacgggacttacgtacgtaaacggtaacgttaggtacggtacgttcgtaccacccgtattccgttacgttccttccgtacttcccg

SEQ ID NO: 275673 - DNA, 238 bp, Homo sapiens
  misc_feature: GYAE6OF02HJL10.26.75.G09.1.454.CMB.1.raw
  modified_base (209)..(238): a, c, t, g, unknown or other
  misc_feature (209)..(238): n is a, c, g, or t
tcagagactatactcacgaccggtgctcgatttagtatagacatcagggggtcagacccagtcaggacacagcagtggacatgagggtccccgcctcagctcctggggctcctgctgctctggctcccaggaactgtggctgcaccatctgtcttcatcttcccgccatctgaagtatagtctctgagcgggctggcaaggcgcatagnnnnnnnnnnnnnnnnnnnnnnnnnnnnnn

SEQ ID NO: 275674 - DNA, 546 bp, Homo sapiens
  misc_feature: GYAE6OF02F0YH2.26.75.G09.1.454.CMB.1.raw
  modified_base (195)..(195): a, c, t, g, unknown or other
  misc_feature (195)..(195): n is a, c, g, or t
tcagagactatactcacgaccggtgctcgatttagtatagacatcaggggagagctgctcagttaggacccagagggaaccatggaaaccccagcgcagcttctcttcctcctgctactctggctcccagattccaccgcagaaattgtgctgacgcagtctcccgggaccctgtctttgtctccaggggaaagngccaccctctcctgcagggccagtcagagtgttagcaactactatttagcctggtaccaacagaagtctggccaggctccccggctcctcatctacggaacatccaaccgggccactggcatcccagacaggttcagtgcagtgggtctgagacagacttcactctcactatcagcagactggacgcctagaagtattttgcagtgtattactgtcagctagtatgctacctctattcccgtagtacttttggccgtaacggggtaccaaggtctaggattacgtacgaaacgtaacgtaggtacggacttggacctaccgtacttcctacgttcttacctatttaccccg

SEQ ID NO: 275675 - DNA, 508 bp, Homo sapiens
  misc_feature: GYAE6OF02F2UKO.26.75.G09.1.454.CMB.1.raw
  modified_base (195)..(195): a, c, t, g, unknown or other
  misc_feature (195)..(195): n is a, c, g, or t
  modified_base (490)..(490): a, c, t, g, unknown or other
  misc_feature (490)..(490): n is a, c, g, or t
tcagagactatactcacgaccggtgctcgatttagtatagacatcaggggagagctgctcagttaggacccagagggaaccatggaaaccccagcgcagcttctcttcctcctgctactctggctcccagattccaccgcagaaattgtgctgacgcagtctcccgggaccctgtctttgtctccaggggaaagngccaccctctcctgcagggccagtcagagtgttagcaactactatttagcctggtaccaacagaagtctggccaggctccccggctcctcatctacggaacatccaaccgggccactggcatcccagacaggttcagtggcagtgggtctgagacagacttcactctcactatcagcagactggagcctgaagtattttgctagtgtattactgtcagctagtatgctaccttcatttccgtgtactttcggcctagggaccagctgatatacaacgtactgtggtctgcaccgntcctgtcttctattcccg

SEQ ID NO: 275676 - DNA, 519 bp, Homo sapiens
  misc_feature: GYAE6OF02HV09Z.26.75.G09.1.454.CMB.1.raw
  modified_base (194)..(194): a, c, t, g, unknown or other
  misc_feature (194)..(194): n is a, c, g, or t
  modified_base (255)..(255): a, c, t, g, unknown or other
  misc_feature (255)..(255): n is a, c, g, or t
tcagagactatactcacgaccggtgctcgatttagtatagacatcaggggagagctgctcagttaggacccagagggaaccatggaaaccccagcgcagcttctcttcctcctgctactctggctcccagattccaccgcagaaattgtgctgacgcagtctcccgggaccctgtctttgtctccaggggaaangccaccctctcctgcagggccagtcagagtgttagcaactactatttagcctggtaccaanagaagtctggccaggctccccggctcctcatctacggaacatcccaaccgggccactggcatcccagacaggttcagtggcaggtgggtctgagacagacttcacttctcactatcagcagactggagcctgaagtattttgctagttgtattacgtgtcagtcagtatgctacctctactttcccgtgtacttttggccgtagggaccagccgtgtatatacaacgtaactggtggctacgcaccatcctgtcttctattccc

SEQ ID NO: 275677 - DNA, 506 bp, Homo sapiens
  misc_feature: GYAE6OF02GB47I.26.75.G09.1.454.CMB.1.raw
  modified_base (194)..(194): a, c, t, g, unknown or other
  misc_feature (194)..(194): n is a, c, g, or t
  modified_base (491)..(491): a, c, t, g, unknown or other
  misc_feature (491)..(491): n is a, c, g, or t
  modified_base (502)..(502): a, c, t, g, unknown or other
  misc_feature (502)..(502): n is a, c, g, or t
tcagagactatactcacgaccggtgctcgatttagtatagacatcaggggagagctgctcagttaggacccagagggaaccatggaaaccccagcgcagcttctcttcctcctgctactctggctcccagattccaccgcagaaattgtgctgacgcagtctcccgggaccctgtctttgtctccaggggaaanagccaccctctcctgcagggccagtcagagtgttagcaactactatttagcctggtaccaacagaagtctggccaggctccccggctcctcatctacggaacatcccaaccgggccactggcatcccagacaggttcagtggcagtgggtctgagacagacttcactctcactatcagcagactggagctgaagtatttgctagtgtattactgtcagcagtatgctacctctactttcccgtgtacgttttggccgtagggaccaagcgtagatatacaacgactgtggctgcacnctctgtcttcntccg

SEQ ID NO: 275678 - DNA, 224 bp, Homo sapiens
  misc_feature: GYAE6OF02IU4M8.26.75.G09.1.454.CMB.1.raw
  modified_base (176)..(176): a, c, t, g, unknown or other
  misc_feature (176)..(176): n is a, c, g, or t
  modified_base (208)..(224): a, c, t, g, unknown or other
  misc_feature (208)..(224): n is a, c, g, or t
tcagagactatactcacgaccggtgctcgatttagtatagacatcagggggtcaggacccagtcaggacacagcatggacatgagggtccccgctcagctcctggggctcctgctgctctggctcccaggaactgtggctgcaccatctgtcttcatcttcccgccatctgaagtntagtctctgagcgggctggcaaggcgcatagnnnnnnnnnnnnnnnnn

SEQ ID NO: 275679 - DNA, 508 bp, Homo sapiens
  misc_feature: GYAE6OF02IUQRI.26.75.G09.1.454.CMB.1.raw
  modified_base (194)..(194): a, c, t, g, unknown or other
  misc_feature (194)..(194): n is a, c, g, or t
tcagagactatactcacgaccggtgctcgatttagtatagacatcaggggagagctgctcagttaggacccagagggaaccatggaaaccccagcgcagcttctcttcctcctgctactctggctcccagattccaccgcagaaattgtgctgacgcagtctcccgggaccctgtctttgtctccaggggaaangccaccctctcctgcagggccagtcagagtgttagcaactactatttagcctggtaccaacagaagtctggccaggcctccccggctcctcatctacggaacatccaaccgggccactggcatcccagacaggttcagtgcagtgggtctgagacagacttcactctcatatcagcagactggagcctagaagtattttgctagtgtattactgtcagcagtatgtacctacctctactttccgtgtacttttggaccgtacgggacaagctgatatacaaacgtactgtggctgacacatctgtcttcatccg

SEQ ID NO: 275680 - DNA, 508 bp, Homo sapiens
  misc_feature: GYAE6OF02GGRYY.26.75.G09.1.454.CMB.1.raw
  modified_base (194)..(194): a, c, t, g, unknown or other
  misc_feature (194)..(194): n is a, c, g, or t
tcagagactatactcacgaccggtgctcgatttagtatagacatcaggggagagctgctcagttaggacccagagggaaccatggaaaccccagcgcagcttctcttcctcctgctactctggctcccagattccaccgcagaaattgtgctgacgcagtctcccgggaccctgtctttgtctccaggggaaangccaccctctcctgcagggccagtcagagtgttagcaactactatttagcctggtaccaacagaagtctggccaggctccccggctcctcatctacggaacatccaaccgggccactggcatcccagacaggttcagtggcagtgggtctgagacagacttcactctcactatcagcagactggagcctgaagtattttgctagtgtattactgtcagcagtatgctacctctactttcccgtgtacttttcggccgtagggaccaagctaggatactacaacgtactagtggctgcacatctgtcttcattcc

SEQ ID NO: 275681 - DNA, 211 bp, Homo sapiens
  misc_feature: GYAE6OF02ITFU3.26.75.G09.1.454.CMB.1.raw
  modified_base (207)..(211): a, c, t, g, unknown or other
  misc_feature (207)..(211): n is a, c, g, or t
tcagagactatactcacgaccggtgctcgatttagtatagacatcagggggtcagacccagtcaggacacagcatggacatgagggtccccgctcagctcctggggctcctgctgctctggctcccaggaactgtggctgcaccatctgtcttcatcttcccgccatctgaagtatagtctctgagcgggctggcaaggcgcatagnnnnn

SEQ ID NO: 275682 - DNA, 771 bp, Homo sapiens
  misc_feature: GYAE6OF02JZ4I7.26.75.G09.1.454.CMB.1.raw
  modified_base (190)..(190): a, c, t, g, unknown or other
  misc_feature (190)..(190): n is a, c, g, or t
  modified_base (200)..(200): a, c, t, g, unknown or other
  misc_feature (200)..(200): n is a, c, g, or t
  modified_base (205)..(205): a, c, t, g, unknown or other
  misc_feature (205)..(205): n is a, c, g, or t
  modified_base (303)..(303): a, c, t, g, unknown or other
  misc_feature (303)..(303): n is a, c, g, or t
tcagagactatactcacgaccggtgctcgatttagtatagacatcagggagagctgctcagttaggaccagagggaaccatggaaacccagcgcagcttctcttcctcctgctactctcggctcccagacttccaccgcagaaattgtgctgacgcagtctcccgggacctgttcttgtctcgagggaancgccaccctntccgngcagggccagtcagtagtgttacgactaacttactatttacgccttaggtaaccaacaggtaacgtctggaccagggtcctacccccggcttccctanacttccgtaaccggaacctaccgtaccccggaaccgggtcccctaacgtcggacccttacccgtccgaagtaccggttccgtaagtcggtcgtacggttaggtcggttcgaagtacccgaagtccgttaccttacctaccgttcctagtacctaactccggaactacggaaccgttgtaacgggaccgttacgtaaggtttaaggttttaccgtcgttaacgtagggttttactttaaacgttcgttaccggtaatccggtaacgttaacttcgtaccgtaaccctttccgtttaacgttttccccggtttacgtacccggttttttagtacccggggaccggttaaaccggtaacgttaccgtcgggttaaacgttaacttacgaaacccggttaaggaacgtttcgggattaccggttaccacgttaccttagtcctttacgttacctacgttccctttaccccgg

SEQ ID NO: 275683 - DNA, 503 bp, Homo sapiens
  misc_feature: GYAE6OF02FOC8E.26.75.G09.1.454.CMB.1.raw
  modified_base (357)..(357): a, c, t, g, unknown or other
  misc_feature (357)..(357): n is a, c, g, or t
tcagagactatactcacgaccggtgctcgatttagtatagacatcaggggagagctgctcagttaggacccagagggaaccatggaaaccccagcgcagcttctcttcctcctgctactctggctcccagattccaccgcagaaattgtgctgacgcagtctcccgggaccctgtctttgtctccaggggaaagagccaccctctcctgcagggccagtcagagtgttagcaactactatttagcctggtaccaacagaagtctggccaggctccccggctcctcatctacggaacatccaaccgggccactggcatcccagacaggttcagtggcagtgggtctgagacagacttnactctcactatcagcagactggagcctgaagattttgcagtgtattactgtcagcagtatgctacctctactttccgtgtacttttggcctaggggaccaagctgatatacaacgaactgtggctgcaccatctgtcttcattccc

SEQ ID NO: 275684 - DNA, 749 bp, Homo sapiens
  misc_feature: GYAE6OF02JBECZ.26.75.G09.1.454.CMB.1.raw
  modified_base (193)..(193): a, c, t, g, unknown or other
  misc_feature (193)..(193): n is a, c, g, or t
  modified_base (205)..(205): a, c, t, g, unknown or other
  misc_feature (205)..(205): n is a, c, g, or t
tcagagactatactcacgaccggtgctcgatttagtatagacatcagggagagctgctcagttaggacccagagggaaccatggaaaccccagcgcagcttctcttcctcctgctactctggctcccagacttccaccgcagaaattgtgctgacgcagtcctcccgggaccctgtctttgtctcgagggaangccacctctccngcagggccagtcagagtgtagcaactactatttagcctggtaccaacagtaacgtctggccacggtcctcccccggtcttccctctactccgtaaccggaaccacttaccccggaaacccggggccctaacggtcggaccctactacccccgaaaggacctaacgggttccacggtcgggaccgtaagggttcggggtaccttagggaacgaactaaggtaccctttaccacttccgtcaacgttataccgagaccaacgtacgtgggaacgtacccgtagtaagttacgtttcgacgtagttacgttaattacgtagttacgagtactagttacttacgtccttaaccgttacttacccgttttacccggttacgttaccggtttttaccgggaacccggtaacggggtaaccctaaacggttaccgtaaggttaaccgttacgttaacggtaaaccggtaaacgttaccggtacgggtaccgttaccgtcccgtaaccgtacgtttaccgtaccggtttcctttacctaccgtttaccccgg

SEQ ID NO: 275685 - DNA, 552 bp, Homo sapiens
  misc_feature: GYAE6OF02IMLA8.26.75.G09.1.454.CMB.1.raw
  modified_base (193)..(193): a, c, t, g, unknown or other
  misc_feature (193)..(193): n is a, c, g, or t
  modified_base (278)..(278): a, c, t, g, unknown or other
  misc_feature (278)..(278): n is a, c, g, or t
  modified_base (283)..(283): a, c, t, g, unknown or other
  misc_feature (283)..(283): n is a, c, g, or t
tcagagactatactcacgaccggtgctcgatttagtatagacatcaggggagagctgctcagttaggacccagagggaaccatggaaaccccagcgcagcttctcttcctcctgctactctggctcccagattccaccgcagaaattgtgctgacgcagtctcccgggacctgtctttgtctccaggggaaangccaccctctcctgcagggccagtcagagtgttagcaactctatttagcctggtaccaacagaagtctggccaggcctccccggntcctnatcctacggaaccatcccgaaccgggccacgtggcactcccagacaggttcagtgcagtggctgagacagtacttcactctcactatcagcagactggacgcctagaagtatttgactagtgtattactgtacagtctagtatcgtactacctctacgtttcccgttgtacgtttcggaccgtacgggtaccaggtacgtagtaacttagtacgtaaacgtacgttaggtcggtcgtcgtacctacgtactcttcgtcttctattcccg

SEQ ID NO: 275686 - DNA, 537 bp, Homo sapiens
  misc_feature: GYAE6OF02F2YHF.26.75.G09.1.454.CMB.1.raw
  modified_base (234)..(234): a, c, t, g, unknown or other
  misc_feature (234)..(234): n is a, c, g, or t
  modified_base (258)..(258): a, c, t, g, unknown or other
  misc_feature (258)..(258): n is a, c, g, or t
  modified_base (289)..(289): a, c, t, g, unknown or other
  misc_feature (289)..(289): n is a, c, g, or t
  modified_base (392)..(392): a, c, t, g, unknown or other
  misc_feature (392)..(392): n is a, c, g, or t
tcagagactatactcacgaccggtgctcgatttagtatagacatcaggggagagctgctcagttaggacccagagggaaccatggaaaccccagcgcagcttctcttcctcctgctactctggctcccagataccactggagaaatagtgatgacgcagtctccagccaccctgtctgtgtctccaggggaaagagtcaccctctcctgcagggccagtcagagtgttagtcgnggcttagcctggtaccagcagacnccgtgggcagacctccaggctcctcatttangctgcatccaccagggccacgtggtactcccgagccagttcagtggcagtggtctgggactagagttcactctcaccatcagcagcctgctagtctagaagtnttgtgactaattttatactgtacagtactaatataactacctgccctcgctctacgtttcggcggtacggaccgtaagggtttgaacggtactaaccgaaacgtaacgttggtcgggtaccttaggaccctaccctagttacccg

SEQ ID NO: 275687 - DNA, 630 bp, Homo sapiens
  misc_feature: GYAE6OF02J1QQE.26.75.G09.1.454.CMB.1.raw
  modified_base (113)..(113): a, c, t, g, unknown or other
  misc_feature (113)..(113): n is a, c, g, or t
  modified_base (194)..(194): a, c, t, g, unknown or other
  misc_feature (194)..(194): n is a, c, g, or t
  modified_base (223)..(223): a, c, t, g, unknown or other
  misc_feature (223)..(223): n is a, c, g, or t
  modified_base (299)..(299): a, c, t, g, unknown or other
  misc_feature (299)..(299): n is a, c, g, or t
  modified_base (363)..(363): a, c, t, g, unknown or other
  misc_feature (363)..(363): n is a, c, g, or t
  modified_base (483)..(483): a, c, t, g, unknown or other
  misc_feature (483)..(483): n is a, c, g, or t
tcagagactatactcacgaccggtgctcgatttagtatagacatcaggggagagctgctcagttaggacccagagggaaccatggaaacccagcgcagcttctcttcctcctnctactctggctcccagacttccaccgcagaaattgtgctgacgcagtctcccgggacctgtctttgtctccgaggggaaangcccaccctctcctgcagggccagtcagngtgttagcaactactatttagccttggtaccaacagaagtctggccaggctccccggctcctcatcgtacggaacnctaccaaccgggccacgtcggcactccccaggacctacggttcaggtggccgtaggtcgggtcnggtagaaccaggtacctttcacgttctacgtaactagtccagtccgagtacggtcggacgtcctaggtaacgtagttttacgcgtagttagttacttacgtgtcgtacgtactagttacncgtacttaccttacgttaacctttccggttcgttaccgttttcggacggtaccgggtaacctaagtcgtagtacttatacgtaaacgacggttagtcgggtactcgtaaccgtaccttacgtcttcgttacttaccgtacttcccgg

SEQ ID NO: 275688 - DNA, 582 bp, Homo sapiens
  misc_feature: GYAE6OF02GR5MG.26.75.G09.1.454.CMB.1.raw
  modified_base (431)..(431): a, c, t, g, unknown or other
  misc_feature (431)..(431): n is a, c, g, or t
tcagagactatactcacgaccggtgctcgatttagtatagacatcagggggtcagacccagtcaggacacagcatggacatgagggtccccgctcagctcctggggctcctgctgctctggctcccaggtgtcaaatgtgacatccagatcgacccagtctccttccaggctgtctgcatctgtcggagacagagtccaccatccacgttgccgggccagtcagagtattgggtaggtggttggcctggtatcagacaagaaaccaggaacaataccctaagactcctaatctctcgaggtcgtgttgggtttaggaaaggtcggggtacccagtcaaggttcaggtggccgcggatcgtgggacagacttcactctcacatcgacggccgggcctccgagtcgtaggacgtactcgtagacctaaacttnttacgcgacctaacaatatagtactttaatttacttcctaccgtaggttccggttaccggaccgtacggggtaaccaagggtaggtacgtacgaaggtccgtaacgtggtacgggtctcggacctaccgtagttcctgttaccttcgtacc

SEQ ID NO: 275689 - DNA, 872 bp, Homo sapiens
  misc_feature: GYAE6OF02H59SW.26.75.G09.1.454.CMB.1.raw
  modified_base (223)..(223): a, c, t, g, unknown or other
  misc_feature (223)..(223): n is a, c, g, or t
tcagagactatactcacgaccggtgctcgatttagtatagacatcaggggagagctgctcagttaggacccagagggaaccatggaaaccccagcgcagcttctcttcctcctgctactctggctcccagattccaccgcagaaattgtgctgacgcagtctcccgggaccctgtctttgtctccgaggggaagagccaccctctcctgcagggccagtcagngtgttagcaactactattagcctggtaccaacagaatctaggccaggtccgtccccggctcctcactcgtacggaaccagtccccgaaccgggcctacgtcggacctactaccccgaacggtaccgtaacgggttaccgaagggttacgggaccggtaacggggttcggggttccgttaacgggtaaacggaaccgtaaacggttacccgttttaccctaaacccgttcccgttaccgtaaaccgtttacgttaccgtaacggtaccgtaccgtccccgtttacggccgtaacggtttaccgttaaggtaaacggtttacgttttttacggaacgtttaaggttttaaacgtttaacccgttgggttaacccagggttaaccttaaacgggtttaaaaacgtttaaaacccggtcggggttaacccctttaccggggttaacgggttaacccgggtttaccgggtaaacccgggtaaaacggggtaaccggtaaacggggttaaaacgggtaaacgtaaacccgggtaaaaacccgtacggttagggtaccggtaccggtaacggaaccccttacgtaccggttacctttacgggttacctttaccgaaccgttttccccggtaaccccgtaccttaaggttaacccgg

SEQ ID NO: 275690 - DNA, 213 bp, Homo sapiens
  misc_feature: GYAE6OF02FVWX4.26.75.G09.1.454.CMB.1.raw
  modified_base (208)..(213): a, c, t, g, unknown or other
  misc_feature (208)..(213): n is a, c, g, or t
tcagagactatactcacgaccggtgctcgatttagtatagacatcagggggtcagacccagtcaggacacagcatggacatgagggtccccgctcagctcctggggctcctgctgctctggctcccaggaactgtggctgcaccatctgtcttcatcttcccgccatctgaagtatagtctctgacgcgggctggcaaggcgcatagnnnnnn

SEQ ID NO: 275691 - DNA, 677 bp, Homo sapiens
  misc_feature: GYAE6OF02IQO0Y.26.75.G09.1.454.CMB.1.raw
  modified_base (366)..(366): a, c, t, g, unknown or other
  misc_feature (366)..(366): n is a, c, g, or t
  modified_base (655)..(655): a, c, t, g, unknown or other
  misc_feature (655)..(655): n is a, c, g, or t
tcagagactatactcacgaccggtgctcgatttagtatagacatcaggggagagctgctcagttaggacccagagggaaccatggaaaccccagcgcagcttctcttcctcctgctactctggctcccagattccaccgcagaaattgtgctgacgcagtctcccgggaccctgtctttgtctccgaggggaaagagccacccctctcctgcagggccagtcagagtgttagctaactactatttacgcctaggtaccaacagaacgttctggcccggacgtccccgcccgtcctccactcgtaccgaacaactaccgaacccggccgactacggcacctccaccgagacggttacgagtggacgnggtacggttcgataggaacgagtacgttaccacgttaccgttcacgttactacacgtacgacgtagtacgggtacgaccgtaggtaaggttacgtttttagcttacggttaggtttaacgtttacgttagttccgaaggtcgtaagggtttaactcggttaccgtaccttaccttagtttcccggttaccgtttgtttacccggttacggaaccgggtacgaacgtcttgggtactaactaccgtaaacgttacggagttcggtcgtacgtaccgaactctaccggttntcctacttccttccgtaccccg

SEQ ID NO: 275692 - DNA, 608 bp, Homo sapiens
  misc_feature: GYAE6OF02IDO2D.26.75.G09.1.454.CMB.1.raw
  modified_base (191)..(191): a, c, t, g, unknown or other
  misc_feature (191)..(191): n is a, c, g, or t
  modified_base (251)..(251): a, c, t, g, unknown or other
  misc_feature (251)..(251): n is a, c, g, or t
tcagagactatactcacgaccggtgctcgatttagtatagacatcaggggagagctgctcagttaggacccagagggaaccatggaaaccccagcgcagcttctcttcctcctgctactctggctcccagattccaccgcagaaattgtgctgacgcagtctcccgggacctgtctttgtctcaggggaangccacctctcctgcagggccagtcagagtgttagcaactactatttagcctggtaccaanagaagtctggccaggcctccccggctcctcatccgtaacggaacactacccgaaccgggccacgtggaccactccccgaagaccgtaggtttccaggttggacctaggttcgggtctaggacgtacgagtaccttcacttcgcaactatcagcagtcgtggagcctagaagttatttgactagtagttattacgtgtactagtctagtacgtcgtactacctcttactttccgtacgttacgtttacggaccgtacgggtaaccgtagtacgtaggacttacgtaaccgtaacggtacgtacggttcggacgttacgacctacgtacgttccgttcgtaccttaccgtacgttcccg

SEQ ID NO: 275693 - DNA, 669 bp, Homo sapiens
  misc_feature: GYAE6OF02G2ELE.26.75.G09.1.454.CMB.1.raw
  modified_base (196)..(196): a, c, t, g, unknown or other
  misc_feature (196)..(196): n is a, c, g, or t
  modified_base (288)..(288): a, c, t, g, unknown or other
  misc_feature (288)..(288): n is a, c, g, or t
tcagagactatactcacgaccggtgctcgatttagtatagacatcaggggagagctgctcagttaggacccagagggaaccatggaaaccccagcgcagcttctcttcctcctgctactctggctcccagattccaccgcagaaattgtgctgacgcagtcctcccgggaccctgtctttgtctccaaggggaaangccaccctctcctgcagggccagtcagagtgttagcaacttactatttacgccttaggtaaccaacagaagtctcggccaggcctccccggntcctcatccgtaacggaacactcccgaaccgggcctacgtcggacctactacccgaagacgtaggttccgaggtcggacctaagggtcgggtcctaggaacgactacgtaccttacgaaccttctacctaacgtttacaccaggtaccaacgtacgtacgggacgtacccgtagtaacgttacgtttacgaccgtaggttacgttacgtttaccgtgtacgtacgtcgttaagtacttacgtaccttaccgttcttacgtttccggttacgttacgtttcggacgtacggtacgtacggtacgtaacggaactacgtacgtcggtcgtacgtacgtacctacgtattcgtcgttacctaccgtcttaccgttcccgtaccg

SEQ ID NO: 275694 - DNA, 549 bp, Homo sapiens
  misc_feature: GYAE6OF02HQ8NN.26.75.G09.1.454.CMB.1.raw
  modified_base (394)..(394): a, c, t, g, unknown or other
  misc_feature (394)..(394): n is a, c, g, or t
tcagagactatactcacgaccggtgctcgatttagtatagacatcaggggagagctgctcagttaggacccagagggaaccatggaaaccccagcgcagcttctcttcctcctgctactctggctcccagattccaccgcagaaattgtgctgacgcagtctcccgggaccctgtctttgctccaggggaaagagccaccctctcctgcagggccagtcagagtgttagcaactactattagcctggtaccaacagaagtctggccaggctccccggctcctcatctacggaacatcccaaccgggccacgtggcatcccagactaggtcagtcggctaggtgggtctgagacagacttcactctcacttatcagcagactggagcctgaagtntttgcagttgtatttactgtcacgtctagtatcgtccttacctcttacgtttcccgttagtacgttttcggcccgtacgggtacccgaagcgtgtagtacgtacgaacgtacttcggtggctcgctaccacgttcttcgttcttcgtacttcccg

SEQ ID NO: 275695 - DNA, 664 bp, Homo sapiens
  misc_feature: GYAE6OF02F5VN4.26.75.G09.1.454.CMB.1.raw
  modified_base (198)..(198): a, c, t, g, unknown or other
  misc_feature (198)..(198): n is a, c, g, or t
tcagagactatactcacgaccggtgctcgatttagtatagacatcagggggagagctgctcagttagggacccagagggaaccatggaaaccccagcgcagcttctcttcctcctgctactctggctcccagacttccaccgcaagaaattgtgctgacgcagtctcccgggacctgtctttgtctccgaggggaaangcccaccctctcctgcagggccagtcagagtgttagcaactacttatttacgcctcggtaaccaacgagtaagtctcggcctacggccgtccccggctccctcactccgtacggaacacgtacccgaacccgggccacgtcggcctactccccgagtaccgacggttcaggttcggcgtaggtcggggtactaggaacgtaacgagtaccttcgaaccttcctactaaccttataccgtaacgactacggtacgttcggacgtaccgtagtaacgtacgtttcgacgtagttacgttaacttacgtacgtagtacgactagttacacgtccttaccttcttacgtttccgtcttacgtttcggaccgtagggacctaacgtcgtaggtactacgtaacgtaacgtaacgttcggtacggtcgtacgtaccgtaccgtattaccgtcgttaccttcgtacttccccg

SEQ ID NO: 275696 - DNA, 789 bp, Homo sapiens
  misc_feature: GYAE6OF02F5JDI.26.75.G09.1.454.CMB.1.raw
  modified_base (196)..(196): a, c, t, g, unknown or other
  misc_feature (196)..(196): n is a, c, g, or t
  modified_base (225)..(225): a, c, t, g, unknown or other
  misc_feature (225)..(225): n is a, c, g, or t
  modified_base (268)..(268): a, c, t, g, unknown or other
  misc_feature (268)..(268): n is a, c, g, or t
tcagagactatactcacgaccggtgctcgatttagtatagacatcaggggagagctgctcagttaggacccagagggaaccatggaaaccccagcgcagcttctcttcctcctgctactctggctcccagattccaccgcagaaattgtgctgacgcagtcctcccgggaccctgtctttgtctccgaggggaaancgccaccctctcctgcagggccagtcagngtgttagcaactactatttagcctaggtaccaacagaagtcgnggccaggcctccccggctcctcactcgacggaacacgtcccgaaccgggcctacgtcggaccacgtccccaagaccgtaggttacgaggtcggacgtacggttcggggtctaggaacgacgtaacggtaccttacgtaccttctacctaacttagtcaacgtacgtaacggtacgtagggtacgaccgtaggtaaacgttattttcggacgttaggttacgttaacgtttacgtcggttacgtaacggtaccgttaaggttaaccgttcggtaccctttaacccgtttaccgtttaccgttttacccggtttacggttttaacccggtttttccgggaacccgggttaaccgggggtaaccctaaacggttacccgggttaacgggttaaacttaccgttaaaccgtaaaaccggttaacggttacgggttaaccggtacccgttacggtaacccctaaccgtttaacgtttacccggttacggttttacccgttttacccgtaacccgttttccccccgg

SEQ ID NO: 275697 - DNA, 666 bp, Homo sapiens
  misc_feature: GYAE6OF02H7QZG.26.75.G09.1.454.CMB.1.raw
  modified_base (195)..(195): a, c, t, g, unknown or other
  misc_feature (195)..(195): n is a, c, g, or t
  modified_base (261)..(261): a, c, t, g, unknown or other
  misc_feature (261)..(261): n is a, c, g, or t
  modified_base (289)..(289): a, c, t, g, unknown or other
  misc_feature (289)..(289): n is a, c, g, or t
  modified_base (380)..(380): a, c, t, g, unknown or other
  misc_feature (380)..(380): n is a, c, g, or t
tcagagactatactcacgaccggtgctcgatttagtatagacatcagggggagagctgctcagttaggacccagagggaaccatggaaaccccagcgcagcttctcttcctcctgctactctggctcccagattccaccgcagaaattgtgctgacgcagtcctcccgggacctgtctttgtctccgaggggaanagccaccctctccgtgccgagggccagtcagagttgttagcaactactattagcctggtaaccaanagagtctggccaggcctcccggctcctnactctaacggaacactaccccgaaccgggccacgtcggccactaccccgagtacctagggttcaggtggacagggttcggtctgaacgacncgtacttcgactctacacttatacagcacgacgtggacgtccgtagaagttattttacgacgtagttagttactttacgttacgtacgtacgtacgtaacgttactcgtaccttaccttacgtttaccgttttacccggttcgtttaccgttttcgggtaccgggtaaccgggtaaccgtacggtacgttacggtactacgttaaccgtaaaccggtacgttacggtcggtaccgtaccgacctaccgtaacttccgttacgtttacctttccgtactttaccccg

SEQ ID NO: 275698 - DNA, 537 bp, Homo sapiens
  misc_feature: GYAE6OF02FYYQV.26.75.G09.1.454.CMB.1.raw
  modified_base (194)..(194): a, c, t, g, unknown or other
  misc_feature (194)..(194): n is a, c, g, or t
  modified_base (471)..(471): a, c, t, g, unknown or other
  misc_feature (471)..(471): n is a, c, g, or t
tcagagactatactcacgaccggtgctcgatttagtatagacatcaggggagagctgctcagttaggacccagagggaaccatggaaaccccagcgcagcttctcttcctcctgctactctggctcccagattccaccggagacattgttttgacacagtctccagccaccctgtctttgtctccaggggaaangccaccctctcctgcagggccagtcagagtgttggcagctacttagcctggtaccaacagaaacctggaccaggcctccgaggcctcctcatctatgatgcactccaacgacgggccacgtggccactcccagccaggttcagtggcagtgagtcgtgggacagtactcgactctcacatcagcacgctagacgtcctagtatatttgacctatttattactgtcagcagtcgtagacacgtcgccttctcgtacgtttcggacggtacgggaccgngggtacggacgtacgtcgaacggtacgaacgtggtcgacgtcgaccgtaccgtgttacctgttacc

SEQ ID NO: 275699 - DNA, 604 bp, Homo sapiens
  misc_feature: GYAE6OF02JKP8Q.26.75.G09.1.454.CMB.1.raw
tcagagactatactcacgaccggtgctcgatttagtatagacatcagggggtcagacccagtcaggacacagcatggacatgagggtccccgctcagctcctggggctcctgctgctctggctcccaggtgtcaaatgtgacatccagatgacccagtctccttccaggctgtctgcatctgtcggagacagagtcaccatcacttcggccgggccagtcagagtagttgggtaggttggttggcctggtatcgagcaagaaaccaggaacactaccaagtactccgtaatcctctacgaggccgttctagggtttaggaaacggtcggggtacccagtcaaggttcgagtcggccgcggagttcgagggacagtatcactctaccaccatcgacggtccggcctccgagttcacgtacggtactcgtacgtactaaccgtttattaccgtcgtaaccctaaacaagtactaggtaactttatttaccttaccgtccgtacgttccgttaccgggaccgtagggaacccgaaggttacggactagaacggtacgtaaccgtggttcgacgtcgaccgtacgtacttcgtacgtccttatacccg

SEQ ID NO: 275700 - DNA, 958 bp, Homo sapiens
  misc_feature: GYAE6OF02I4G63.26.75.G09.1.454.CMB.1.raw
  modified_base (192)..(192): a, c, t, g, unknown or other
  misc_feature (192)..(192): n is a, c, g, or t
  modified_base (205)..(205): a, c, t, g, unknown or other
  misc_feature (205)..(205): n is a, c, g, or t
  modified_base (342)..(342): a, c, t, g, unknown or other
  misc_feature (342)..(342): n is a, c, g, or t
tcagagactatactcacgaccggtgctcgatttagtatagacatcaggggagagctgctcagttaggacccagagggaaccatggaaaccccagcgcagcttctcttcctctgctactctggctcccagattccaccgcagaaattgtgctgacgcagtcctcccgggacctgtctttgctccgagggaaancgccacctctcgngacagggccagtcagagttgtagcaacgtactattacgcctaggtaaccaacagaacgttctcggaccacggcctaccccggcttacctcacttccgtaacggaacacgtacccgaaccgggtccacgtcggccacnccccccggggtttaaaaccgggttaaccccgggtttaaaccgggtttaacccggttaaccggggtttaacccgggttaacccgggtttaaccggggtttaacccggggtttaaccggttaacccgggtaaaccgggttaaacccggttaacccgggtttaaaccccggttttaacccgggttaaacccggtttaacccggtttaacccggttaaacccgggtttaaaccggttacccggttaaaccgggttaacccggttaaacccgggtttaaccgggttaacccggggttaacccggtttaaccccggtttaaacgggtttaaacccgggttttaaccgggttttaaccgggtaacccggtttaacgggtttaccgggtttaaaccgttaacccgggtttacgttaaccggttaacgttaccggttaacggttaccgttaacggttacccgttaaccgttacggttaccggtttaccggttacgttaccgggtttaccggtaaccggtaccgggttaacctacggtaccgttacgtacgttacgtaacggtacgtacgttcggtacgtaccgtacgtaccgtacgtacgtcgttacgtacgtacgtacgtaccg

SEQ ID NO: 275701 - DNA, 696 bp, Homo sapiens
  misc_feature: GYAE6OF02HFCXC.26.75.G09.1.454.CMB.1.raw
  modified_base (194)..(194): a, c, t, g, unknown or other
  misc_feature (194)..(194): n is a, c, g, or t
  modified_base (233)..(233): a, c, t, g, unknown or other
  misc_feature (233)..(233): n is a, c, g, or t
  modified_base (474)..(474): a, c, t, g, unknown or other
  misc_feature (474)..(474): n is a, c, g, or t
  modified_base (491)..(491): a, c, t, g, unknown or other
  misc_feature (491)..(491): n is a, c, g, or t
  modified_base (681)..(681): a, c, t, g, unknown or other
  misc_feature (681)..(681): n is a, c, g, or t
tcagagactatactcacgaccggtgctcgatttagtatagacatcagggggagagctgctcagttaggacccagagggaaccatggaaaccccagcgcagcttctcttcctcctgctactctggctcccagattccaccgcaagaaattgtgctgacgcagtcctcccggacctgtctttgctcgaggggaaancgcccacctctcctgcgacgggccagtcagagtggttanacaaacttactatttacgccgttaggtaacccaagtagaacgttcgtaggcccgaagggtccccttacccccgggcttacccctcgaacttcccgtaaaccggaacctaacgtcccccggaaaccgggcccaacgtcggacccaaccgtccccgagaaccgttagggttaccaaggttcgggactgggttacgggtactggaaactaccgagttacctttacgaacttctacaacgttacncgaacgcgaagtaccgnggaacgtccgtagtaagttacgtttacggacgttaagttacgttaactttacgtacgttacgtagtcttaaggtactacgtcctacgtacttcgtttaccgtgttaccgttcggaacggtacggtaacctaggtcgtagaacttacgtaacgtaacggtactggtcgtaccgacgactacgtctacgttnttcctacgtctcccg

SEQ ID NO: 275702 - DNA, 638 bp, Homo sapiens
  misc_feature: GYAE6OF02FN8PT.26.75.G09.1.454.CMB.1.raw
  modified_base (277)..(277): a, c, t, g, unknown or other
  misc_feature (277)..(277): n is a, c, g, or t
  modified_base (291)..(291): a, c, t, g, unknown or other
  misc_feature (291)..(291): n is a, c, g, or t
  modified_base (335)..(335): a, c, t, g, unknown or other
  misc_feature (335)..(335): n is a, c, g, or t
  modified_base (427)..(427): a, c, t, g, unknown or other
  misc_feature (427)..(427): n is a, c, g, or t
  modified_base (464)..(464): a, c, t, g, unknown or other
  misc_feature (464)..(464): n is a, c, g, or t
  modified_base (559)..(559): a, c, t, g, unknown or other
  misc_feature (559)..(559): n is a, c, g, or t
  modified_base (616)..(616): a, c, t, g, unknown or other
  misc_feature (616)..(616): n is a, c, g, or t
  modified_base (631)..(631): a, c, t, g, unknown or other
  misc_feature (631)..(631): n is a, c, g, or t
tcagagactatactcacgaccggtgctcgatttagtatagacatcaggggagagctgctcagttaggacccagagggaaccatggaaaccccagcgcagcttctcttcctcctgctactctgctccagattccaccgcagtaaattgtgctgacgcagtccgtcccggacctgttctttgtctccgaggggaaagcgccacctctcctgacgacgggccagtcagtagtgttacgtcgcgtcttagcctgaccagacacgacgccgtggcacgtccnccgaggcctacctntatttctgtctacgcacgtccaccggtcggcctacgtcgtaccnccgtacgtacgtacgttcgaggtcggacgtacggttcgggtcgtagggtacgtacgtacgttccgaaccttctaccaccgtatccgacgacncgtaccgtacgtcgtgtaccgtaggtatacggtttanacggttaaccttaaagtttaccttacgtcgtacgtaacgtaactaactttaacgtacgtacccgtgtccgtccgtacttcgttaccggtaccggnggtaacgtacggtagtacacggaatacccggaaagtccgtggccgtacgtcgtaccnccgttcgttacgttntacctcg

SEQ ID NO: 275703 - DNA, 747 bp, Homo sapiens
  misc_feature: GYAE6OF02HWN0L.26.75.G09.1.454.CMB.1.raw
  modified_base (196)..(196): a, c, t, g, unknown or other
  misc_feature (196)..(196): n is a, c, g, or t
  modified_base (282)..(282): a, c, t, g, unknown or other
  misc_feature (282)..(282): n is a, c, g, or t
tcagagactatactcacgaccggtgctcgatttagtatagacatcagggggagagctgctcagttaggacccagagggaaccatggaaaccccagcgcagcttctcttcctcctgctactctggctcccagattccaccgcagaaattgtgctgacgcagtctcccgggacctgtctttgtctccgaggggaaagngccaccctctcctgcagggccagtcagagtgtagcaactactatttagcctggtaaccaacagaagtctggccaggcctccccggnttcctcatctacggaactatacccaaccgggtccgactcggccactcccgaagcgaggttcagtaggcaggtcgggtctgagtacacgacttacgactcgtcaacgtatcgagtccgaaggtactagggacgtccgtaggtaaagtacgtttttaggtacctaaggtttaacggttacttttaacggtacggtacttaaacgggtaccgtaacgttaaggttacgcccggtttaaacccttcccgtttaacggtttttacccccggggttagttaaccccggtttttacgggggtaccgtaaccgggggggttaaaccctaaacggggtcccgtttaaacggggctttaaacgggtacccgtaaaaacggggttaaccctttacggggttacggtccggtaccgtacctaacccgggttacttaccgtttcccggtttcgtttttacccgaccggttttaccccg

SEQ ID NO: 275704 - DNA, 150 bp, Homo sapiens
  misc_feature: GYAE6OF01AQNZI.13.42.D09.1.454.CMB.1.raw
  modified_base (150)..(150): a, c, t, g, unknown or other
  misc_feature (150)..(150): n is a, c, g, or t
tcagtcacgtactacacgaccggtgctcgatttagacacatacgcagggaaggaccaaggtggaatcaaacgaactgtggctgcaccatctgtcttcatcttcccgccatctgatagtacgtgactgagcgggctggcaaggcgcatagn

SEQ ID NO: 275705 - DNA, 424 bp, Homo sapiens
  misc_feature: GYAE6OF01BRYZM.13.42.D09.1.454.CMB.1.raw
  modified_base (417)..(424): a, c, t, g, unknown or other
  misc_feature (417)..(424): n is a, c, g, or t
tcagtcacgtactacacgaccggtgctcgatttagacacatacgcagggaaaggggctggagtggattggggaaatctatcatagtgggaccacctactacagcccgtcctcaatagtcgcgtcaccatgtcagtggacgagcccaagaaccagttctccctgagcctgacctctgtgaccgccgcggactcggccctatacttctgtgcgagagatcgagatgtgtcatcgcggggcacttttgatatctggggccaagggtcgatggtcatcgtctcttcagcctccaccaagggcccatcggtcttccccctggcgccctgctccaggagcacctccgagagcacagcggccctgggctgcctggtcaaggctactcctagtacgtgactgagcgggctggcaaggcgcatagnnnnnnnn

SEQ ID NO: 275706 - DNA, 481 bp, Homo sapiens
  misc_feature: GYAE6OF01BU44B.13.42.D09.1.454.CMB.1.raw
  modified_base (468)..(481): a, c, t, g, unknown or other
  misc_feature (468)..(481): n is a, c, g, or t
tcagtcacgtactacacgaccggtgctcgatttagacacatacgcagggaaaggggctggagtggattggccatattaaggacagacctaatggcgcgacagcacactaccttgaatccgtcaaagacagattcatcatctcgagaggtgattccgacaacacggtgtctctccatatgagcagcctgaaaatcgaggacacaggcctatattactgtgcagtgagtgggccacgaccacgtacttttggagtggtgcgctccgacccgtcggggcccgggaacccgtggtcaccgtctcctcacgcctccaccgaacgggcccagtcggtccttccccgtggcctaccctccctaccaacgacgccacctcgtcgggggccacgacggccggcccgtcgggctcgccgtggtacaacggtactaccttcctagtacgtgactgacggcggctggcaaggcgcatagnnnnnnnnnnnnnn

SEQ ID NO: 275707 - DNA, 512 bp, Homo sapiens
  misc_feature: GYAE6OF01E0GS4.13.42.D09.1.454.CMB.1.raw
  modified_base (201)..(201): a, c, t, g, unknown or other
  misc_feature (201)..(201): n is a, c, g, or t
  modified_base (508)..(508): a, c, t, g, unknown or other
  misc_feature (508)..(508): n is a, c, g, or t
tcagtcacgtactacacgaccggtgctcgatttagacacatacgcagggaaaggggagagctgctcagttaggacccagagggaaccatggaaaccccagcgcagcttctcttcctcctgctactctggctcccagataccaccggagaaattgtgttgacgcagtctccaggcaccctgtctttgtctccaggggaaagngccaccctctcctgcagggccagtcagagtgttagcagcagcttagcctggtaccagcagaagcctggccaggctcccaggctcctcatctacgatgtattcgaggaggaccactgacatcccagacaggttcagtggcagtgggtctgggacagacttcactctcaccatcagcagactagactagaagtactttgctactttatttctgtcactagtatggtagtcaccgtactacgtttggaccgtacgggacaagcgtggagagtacgaagcgtaacgtgtcggctgcacctatctgtcttcnttcc

SEQ ID NO: 275708 - DNA, 438 bp, Homo sapiens
  misc_feature: GYAE6OF01BD73N.13.42.D09.1.454.CMB.1.raw
  modified_base (433)..(438): a, c, t, g, unknown or other
  misc_feature (433)..(438): n is a, c, g, or t
tcagtcacgtactacacgaccggtgctcgatttagacacatacgcagggaaagggctggagtggattggccatattaaggacagacctaatggcgcgacagcacactaccttgaatccgtcaaagacagattcatcatctcgagaggtgattccgacaacacggtgtctctccatatgagcagcctgaaaatcgaggacacaggcctatattactgtgcagtgatgggccacgaccacgacttttggagtggtgcgctcgacccctggggcccgggaaccctggtcaccgtctcctcagcctccaccaagggcccatcggtcttccccctggcaccctcctccaagagcacctctgggggcacagcggccctgggctgcctggtcaaggctacttcctagtacgtgactgagcgggctggcaaggcgcatagnnnnnn

SEQ ID NO: 275709 - DNA, 449 bp, Homo sapiens
  misc_feature: GYAE6OF01ALKA0.13.42.D09.1.454.CMB.1.raw
  modified_base (439)..(449): a, c, t, g, unknown or other
  misc_feature (439)..(449): n is a, c, g, or t
tcagtcacgtactacacgaccggtgctcgatttagacacatacgcagggaaaggggctggagtggattggccatattaaggacagacctaatggcgcgacagcacactaccttgaatccgtcaaagacagattcatcatctcgagaggtgattccgacaacacggtgtctctccatatgagcagcctgaaaatcgaggacacaggcctatattactgtgcagtgatgggccagaccacgacttttggagtggtgcgctcgaccctggggcccgggaaccctggtcaccgtctcctcagcctccaccaagggcccatccggtccttccccctggccacccctcctccaagacgcacctctgggggcacacgcggccctgggctgcctggtcaaggactacttcctagtacgtgactgagcgggctggcaaggcgcatagnnnnnnnnnnn

SEQ ID NO: 275710 - DNA, 428 bp, Homo sapiens
  misc_feature: GYAE6OF01C85B2.13.42.D09.1.454.CMB.1.raw
  modified_base (418)..(428): a, c, t, g, unknown or other
  misc_feature (418)..(428): n is a, c, g, or t
tcagtcacgtactacacgaccggtgctcgatttagacacatacgcagggaaaggggctggagtggattggggaaatctatcatagtgggaccacctactacagcccgtccctcaatagtcgcgtcaccatgtcagtggacgagcccaagaaccagttctccctgagcctgacctctgtgaccgccgcggactcggccctatacttctgtgcgagagatcgagatgtgtcatcgcggggcacttttgatatctggggccaagggtcgatggtcatcgtctcttcagcctcacaagggcccatcggtcttccccctggccaccctcctccaagagcacctctggggcacagcggcctgggctgcctggtcaaggactacttcctagtacgtgactgagcgggctggcaaggcgcagtagnnnnnnnnnnn

SEQ ID NO: 275711 - DNA, 545 bp, Homo sapiens
  misc_feature: GYAE6OF01ENPGH.13.42.D09.1.454.CMB.1.raw
  modified_base (513)..(514): a, c, t, g, unknown or other
  misc_feature (513)..(514): n is a, c, g, or t
  modified_base (516)..(516): a, c, t, g, unknown or other
  misc_feature (516)..(516): n is a, c, g, or t
  modified_base (518)..(545): a, c, t, g, unknown or other
  misc_feature (518)..(545): n is a, c, g, or t
tcagtcacgtactacacgaccggtgctcgatttagacacatacgcagggaaagggctggagtggattggccatattaaggacagacctaatggcgcgacagcacactaccttgaatccgtcaaagacagattcatcatctcgagaggtgattccgacaacacggtgtctctccatatgagcagcctgaaaatcgaggacacaggcctatattactgtgcagtgatgggccacgaccacgactttttggagtggtgcgctcgacccgtggggcccggaaccctggtcaccgtctcctcacgcctccaccaacgggccccagtccggtccttcccccgtggccgccctgcctccgaggacgccaccgtcgtcgggggccacgacggccggcccgtgggccttcggcccttgggtaccgaacgggtaccttaccgtttacccgtaggttaccgtcggtaacgttcggaacggtccggggacgttcgggaccgtaaacggggccgactaagtacggnngngnnnnnnnnnnnnnnnnnnnnnnnnnnnn

SEQ ID NO: 275712 - DNA, 555 bp, Homo sapiens
  misc_feature: GYAE6OF01BDQPI.13.42.D09.1.454.CMB.1.raw
  modified_base (200)..(200): a, c, t, g, unknown or other
  misc_feature (200)..(200): n is a, c, g, or t
  modified_base (299)..(299): a, c, t, g, unknown or other
  misc_feature (299)..(299): n is a, c, g, or t
tcagtcacgtactacacgaccggtgctcgatttagacacatacgcagggaaaggggagagctgctcagttaggacccagagggaaccatggaaaccccagcgcagcttctcttcctcctgctactctggctcccagataccaccggagaaattgtgttgacgcagtctccaggcaccctgtctttgtctccaggggaaangccaccctctcctgcagggccagtcagagtgttagcagcagctacttagcctggtaccagcagaaacctggccaggctccaggctcctcatctatggtncatccagcagggccagtggcatcccagacaggttcagtggcaggtgggtctgggacagtacttcactctcaccatcagcagactggacgcctagaagtagttttcgactagttgtattacgtgtcagtctagttatggtagtctctacgtcgggtacgttccggacgtaacgggtaccgaagggtacggtaaacgtacgaaacggtacgtaggtacgggaccgtacggacctaaccgtcgttccgttggttacccg

SEQ ID NO: 275713 - DNA, 476 bp, Homo sapiens
  misc_feature: GYAE6OF01C469A.13.42.D09.1.454.CMB.1.raw
  modified_base (459)..(459): a, c, t, g, unknown or other
  misc_feature (459)..(459): n is a, c, g, or t
  modified_base (465)..(476): a, c, t, g, unknown or other
  misc_feature (465)..(476): n is a, c, g, or t
tcagtcacgtactacacgaccggtgctcgatttagacacatacgcagggaaaggggctggagtggattggccatattaaggacagacctaatggcgcgacagcacactaccttgaatccgtcaaagacagattcatcatctcgagaggtgattccgacaacacggtgtctctccatatgagcagcctagaaaatcgaggacacaggcctatattactgtgcagtgatgggccacgaccagtacttttggagtggtgcgctcgaccccgtggggcccgggaaccctggtccaccgtctcctcacgcctcccaccgaacgggcccagtccggtccttccccctggccacccctcctaccaagcgccacctcggtcgggggccacgacggccggcccgtgggctcgccgtggtacgaaggacctacttcctagtacgtgactgaggcgggctggcgaaggcncatagnnnnnnnnnnnn

SEQ ID NO: 275714 - DNA, 443 bp, Homo sapiens
  misc_feature: GYAE6OF01DA3OC.13.42.D09.1.454.CMB.1.raw
  modified_base (428)..(428): a, c, t, g, unknown or other
  misc_feature (428)..(428): n is a, c, g, or t
  modified_base (434)..(443): a, c, t, g, unknown or other
  misc_feature (434)..(443): n is a, c, g, or t
tcagtcacgtactacacgaccggtgctcgatttagacacatacgcagggaaaggggctggagtggattggccatattaaggacagacctaatggcgcgacagcacactaccttgaatccgtcaaagacagattcatcatctcgagaggtgattccgacaacacggtgtctctccatatgagcagcctgaaaatcgaggacacaggcctatattactgtgcagtgatgggccacgaccacgacttttggagtggtgcgctcgacccctggggcccggaaccctggtcaccgtctcctcagcctccaccaaggcccatcggtcttccccctggccaccctcctccaagacgcacctctgggggcacagcggccctgggctgcctggtcaaggactacttccagtacgtgactgagcgggctggcaaggcncatagnnnnnnnnnn

SEQ ID NO: 275715 - DNA, 521 bp, Homo sapiens
  misc_feature: GYAE6OF01CLANA.13.42.D09.1.454.CMB.1.raw
  modified_base (199)..(199): a, c, t, g, unknown or other
  misc_feature (199)..(199): n is a, c, g, or t
  modified_base (208)..(208): a, c, t, g, unknown or other
  misc_feature (208)..(208): n is a, c, g, or t
  modified_base (404)..(404): a, c, t, g, unknown or other
  misc_feature (404)..(404): n is a, c, g, or t
tcagtcacgtactacacgaccggtgctcgatttagacacatacgcagggaaaggggagagctgctcagttaggacccagagggaaccatggaaaccccagcgcagcttctcttcctcctgctactctggctcccagataccaccggagaaattgtgttgacgcagtctccaggcaccctgtctttgctccaggggaaangccaccctntcctgcagggccagtcagagtgttagcagcagctactagcctggtaccagcagaaacctggccaggcctcccaggcctcctcatctatggtgcatcccagcagggccacgtggcatccccagacaggttcaggtggcaggtgggtctgggacaggaccttcactctcaccatcagcagactggacgcctagaagtnttttgctagtctattactgtcagtctagtattagttacgtggtagtaccgttcggacgaaggacacgacgtaggaagtaagttaaaggacgtggtaggctagacacatctgtcttac

SEQ ID NO: 275716 - DNA, 442 bp, Homo sapiens
  misc_feature: GYAE6OF01CZTD6.13.42.D09.1.454.CMB.1.raw
  modified_base (434)..(442): a, c, t, g, unknown or other
  misc_feature (434)..(442): n is a, c, g, or t
tcagtcacgtactacacgaccggtgctcgatttagacacatacgcagggaaaggggctggagtggattggccatattaaggacagacctaatggcgcgacagcacactaccttgaatccgtcaaagacagattcatcatctcgagaggtgattccgacaacacggtgtctctccatatgagcagcctgaaaatcgaggacacaggcctatattactgtgcagtgatgggccacgaccacgacttttggagtggtgcgctcgacccctggggcccgggaaccctggtcaccgtctcctcagcctccaccagggcccatcggtcttccccctggcaccctcctccaagacgcacctctgggggcacgagcggccctgggctgcctggtcaaggctacttcctagtacgtgactgagcgggctggcaggcgcatagnnnnnnnnn

SEQ ID NO: 275717 - DNA, 453 bp, Homo sapiens
  misc_feature: GYAE6OF01EZ401.13.42.D09.1.454.CMB.1.raw
  modified_base (436)..(453): a, c, t, g, unknown or other
  misc_feature (436)..(453): n is a, c, g, or t
tcagtcacgtactacacgaccggtgctcgatttagacacatacgcagggaaaggggctggagtggattggccatattaaggacagacctaatggcgcgacagcacactaccttgaatccgtcaaagacagattcatcatctcgagaggtgattccgacaacacggtgtctctccatatgagcagcctgaaaatcgaggacacaggcctatattactgtgcagtgatgggccacgaccacgactttttggagtggtgcgctcgacccctggggcccgggaaccctggtcaccgtctcttcagcctccaccaagggcccatcggtcttccccctggcaccctcctccaagagcacctctgggggcacagcggccctgggctgcctggtcaaggactacttcctagtacgtgactgagcgggctggcaaggcgcatagnnnnnnnnnnnnnnnnnn

SEQ ID NO: 275718 - DNA, 461 bp, Homo sapiens
  misc_feature: GYAE6OF01BSWN1.13.42.D09.1.454.CMB.1.raw
  modified_base (451)..(461): a, c, t, g, unknown or other
  misc_feature (451)..(461): n is a, c, g, or t
tcagtcacgtactacacgaccggtgctcgatttagacacatacgcagggaaaggcatacgcagggaaaggggctggagtgggtggccaacataaacacagacggaagtgacccatactatgcggactctgtgaagggccgattcaccatctccagagacaacgccaagaactcactatatttgcaaatggaccgcctgagagacgaggacacggctatgtattactgtgcgagagatgagagtggctacgagttggggccgggaacctggtccaccgtcaactcacgcctccaccaagggcccagtccggtccttccccctggccgccctgcctccgaggacgccacctccgagacgcacgacgccggcccgtgggcctgcccgtggtacaaggacctacgttcctagtacgtgtactggacggccgggctgggcaacgggcgacagtagnnnnnnnnnnn

SEQ ID NO: 275719 - DNA, 404 bp, Homo sapiens
  misc_feature: GYAE6OF01BDLSO.13.42.D09.1.454.CMB.1.raw
  modified_base (396)..(404): a, c, t, g, unknown or other
  misc_feature (396)..(404): n is a, c, g, or t
tcagtcacgtactacacgaccggtgctcgatttagacacatacgcagggaaagggactggagtggattgggcttatcaatgccagtgggggcaccagctacaacccctccctcaagagccgcgtcaccatttcagtagacacgtccaagaaccagctctccctgaagctgagttctgtgaccgccgcagacacggccgtgtattactgtgcgcgacaggtggacgtctggggccaaggggaccacggtcaccgtctcctcagcctccaccaagggcccatcggtcttcccctggcgccctgctccaggagcacctccgagagcacagcggccctgggctgcctggtcaaggactacttcctagtacgtgactgagcgggctggcaaggcgcatagnnnnnnnnn

SEQ ID NO: 275720 - DNA, 541 bp, Homo sapiens
  misc_feature: GYAE6OF01CL4E1.13.42.D09.1.454.CMB.1.raw
  modified_base (201)..(201): a, c, t, g, unknown or other
  misc_feature (201)..(201): n is a, c, g, or t
  modified_base (259)..(259): a, c, t, g, unknown or other
  misc_feature (259)..(259): n is a, c, g, or t
tcagtcacgtactacacgaccggtgctcgatttagacacatacgcagggaaaggggagagctgctcagttaggacccagagggaaccatggaaaccccagcgcagcttctcttcctcctgctactctggctcccagataccaccggagaaattgtgttgacgcagtctccaggcaccctgtctttgtctccgaggggaaangccaccctctcctgcagggccagtcagagtgttagcagcagctactagcctggtaccngcagaacctggccaggctccaggctcctcatctagtggtgcactccagcagggcccatggcatcccagacaggttcagtggcaggtgggtctgggacagtacttcacttctacaccatcagcagactggagtcctagaagttatttgactagttgtattacgtgtacagctagtaagtggtacgtcgtccgtacgtcggtacgttacggaccgtaacggggacctaagggtagtaaacgtacgaaaacggtacgtgtaggctacgacaacctgtctggttcc

SEQ ID NO: 275721 - DNA, 567 bp, Homo sapiens
  misc_feature: GYAE6OF01A4I75.13.42.D09.1.454.CMB.1.raw
  modified_base (200)..(200): a, c, t, g, unknown or other
  misc_feature (200)..(200): n is a, c, g, or t
tcagtcacgtactacacgaccggtgctcgatttagacacatacgcagggaaaggggagagctgctcagttaggacccagagggaaccatggaaaccccagcgcagcttctcttcctcctgctactctggctcccagataccaccggagaaattgtgttgacgcagtctccaggcaccctgtctttgtctccaggggaaanagccaccctctcctgcagggccagtcagagtgttagcagcagctacttagcctggtaccagcagaaacctggccaggcctcccgaggcctcctcatctatggtgcatccagcgacgggccacgtggcactcccagaccaggttcaggtcggcaggtcgggtcgtgggacaggtacttcgactcctacacctatcacgacagacgtgggacgtccgtaggtaagtatttgacgtagttgtattacgtgtacagtctagtagtggtacgtctacgtaccgtcggtaccgtcggaccgaacgggaccgtaaggtagaaacgtacgaaacggtacgtggtacggacgtacgaccactactcgttcgttacc

SEQ ID NO: 275722 - DNA, 532 bp, Homo sapiens
  misc_feature: GYAE6OF01E5V1E.13.42.D09.1.454.CMB.1.raw
  modified_base (290)..(290): a, c, t, g, unknown or other
  misc_feature (290)..(290): n is a, c, g, or t
  modified_base (301)..(301): a, c, t, g, unknown or other
  misc_feature (301)..(301): n is a, c, g, or t
  modified_base (440)..(440): a, c, t, g, unknown or other
  misc_feature (440)..(440): n is a, c, g, or t
tcagtcacgtactacacgaccggtgctcgatttagacacatacgcagggaaaggggagagctgctcagttaggacccagagggaaccatggaaaccccagcgcagcttctcttcctcctgctactctggctcccagataccaccggagaaattgtgttgacgcagtctccaggcaccctgtctttgtctccaggggaaagagccaccctctcctgcagggccagtcagagtgttagcagcagctacttagcctggtaccagcagaaacctggccaggctcccaggctccncatctatggtncatccagcagggccactggcactcccagacaggttcagtggcaggtgggtcgtgggacaggtacttcactctcaccatcagcagacgtggagtccgtagaagtatttgctagttgttattacgtgtacagtctagtagnggtacgtctacaccgttcggaccgttcggaccgaagggaccgaaggtacggaactacgaaacgtacgtagtcggctcgacacatcgtcgttc

SEQ ID NO: 275723 - DNA, 558 bp, Homo sapiens
  misc_feature: GYAE6OF01BRFTF.13.42.D09.1.454.CMB.1.raw
  modified_base (521)..(521): a, c, t, g, unknown or other
  misc_feature (521)..(521): n is a, c, g, or t
  modified_base (523)..(525): a, c, t, g, unknown or other
  misc_feature (523)..(525): n is a, c, g, or t
  modified_base (527)..(527): a, c, t, g, unknown or other
  misc_feature (527)..(527): n is a, c, g, or t
  modified_base (529)..(529): a, c, t, g, unknown or other
  misc_feature (529)..(529): n is a, c, g, or t
  modified_base (533)..(533): a, c, t, g, unknown or other
  misc_feature (533)..(533): n is a, c, g, or t
  modified_base (535)..(558): a, c, t, g, unknown or other
  misc_feature (535)..(558): n is a, c, g, or t
tcagtcacgtactacacgaccggtgctcgatttagacacatacgcagggaaaggggctggagtggattggccatattaaggacagacctaatggcgcgacagcacactaccttgaatccgtcaaagacagattcatcatctcgagaggtgattccgacaacacggtgtctctccatatgagcagcctgaaaatcgaggacacaggcctatattactgtgcagtgatgggccacgaccacgacttttggagtggtgcgctccgaccctggggcccggaccctggtcaccgtctcctcacgcctccaccaagggcccagtccggtccttccccctggccaccctcctccaacgacgccaccgtcgtcgggggccacgacggccggcccgtcggggcctcggacccgttcgggtaccgaacgggtaccttaccgttacccgttaggttaccggtggtaaccgttcggaacgggtcccgggggccgttacggggaccgtaaacgggggccgaccgtagtaacggngnnngngngcgngnnnnnnnnnnnnnnnnnnnnnnnn

SEQ ID NO: 275724 - DNA, 561 bp, Homo sapiens
  misc_feature: GYAE6OF01BNKG9.13.42.D09.1.454.CMB.1.raw
  modified_base (200)..(200): a, c, t, g, unknown or other
  misc_feature (200)..(200): n is a, c, g, or t
tcagtcacgtactacacgaccggtgctcgatttagacacatacgcagggaaaggggagagctgctcagttaggacccagagggaaccatggaaaccccagcgcagcttctcttcctcctgctactctggctcccagataccaccggagaaattgtgttgacgcagtctccaggcaccctgtctttgtctccaggggaaangccaccctctcctgcagggccagtcagagtgttagcagcagctacttagcctggtaccagcaagaaacctggccaggctccgaggctcctcatctagtggtgcatccagcaggccacgtgcatcccagcaggttcagtgctaggtgggtctgggacaggtaccttcgacttccgtacacccgtatcgagcaagacgtggacgcgtagaacgtatttcgctagtagtattactgtcagtctagtagtggtagtccttacgacgtcggtacgttacgaccgtaacgggaccgtaaagggtacgtaaacgtaacgtaaacggtaacgtcggtacggacgtacgactaccgattcgtacgttccg

SEQ ID NO: 275725 - DNA, 555 bp, Homo sapiens
  misc_feature: GYAE6OF01BLSMN.13.42.D09.1.454.CMB.1.raw
  modified_base (201)..(201): a, c, t, g, unknown or other
  misc_feature (201)..(201): n is a, c, g, or t
  modified_base (297)..(297): a, c, t, g, unknown or other
  misc_feature (297)..(297): n is a, c, g, or t
  modified_base (353)..(353): a, c, t, g, unknown or other
  misc_feature (353)..(353): n is a, c, g, or t
  modified_base (374)..(374): a, c, t, g, unknown or other
  misc_feature (374)..(374): n is a, c, g, or t
  modified_base (405)..(405): a, c, t, g, unknown or other
  misc_feature (405)..(405): n is a, c, g, or t
tcagtcacgtactacacgaccggtgctcgatttagacacatacgcagggaaaggggagagctgctcagttaggacccagagggaaccatggaaaccccagcgcagcttctcttcctcctgctactctggctcccagataccaccggagaaattgtgttgacgcagtctccaggcaccctgtctttgtctccaggggaaagngccaccctctcctgcagggccagtcagagtgttagcagcagctacttagcctggtaccagcagaaacctggccaggctccaggctcctcatctagnggtgcatccagcagggccagtggcatcccagcaggttcaggtgcgaggtgggtcgngggacagcttcactctcaccntacgagacagactaggacgccgtagtaagtntttgactagtgttattacgtgtcagtctagtatcggtacgtcctcgaccgtcggtacgttcggaccgaagggaccgtaagggtacggaaacgttacgaaacggtacgtacggtacggtacgtacgaccgtaaccgtactcgtacgttccg

SEQ ID NO: 275726 - DNA, 406 bp, Homo sapiens
  misc_feature: GYAE6OF01ERZAZ.13.42.D09.1.454.CMB.1.raw
  modified_base (311)..(311): a, c, t, g, unknown or other
  misc_feature (311)..(311): n is a, c, g, or t
  modified_base (391)..(391): a, c, t, g, unknown or other
  misc_feature (391)..(391): n is a, c, g, or t
  modified_base (397)..(406): a, c, t, g, unknown or other
  misc_feature (397)..(406): n is a, c, g, or t
tcagtcacgtactacacgaccggtgctcgatttagacacatacgcagggaaagggactggagtggattgggcttatcaatgccagtgggggcaccagctacaacccctccctcaagagccgcgtcaccatttcagtagacacgtccaagaaccagctctccctgaagctgagttctgtgaccgccgcagacacggccgtgtattactgtgcgcgacaggtggacgtctgggggccaaggggaccacggtcaccgtctcctcagcctccaccaagggcccatcggtcttcccctggcgccctgctccaggancacctccgagagcacagcggccctgggctgcctggtcaaggactacttcctagtacgtgactgagcgggctggcaaggcncatagnnnnnnnnnn

SEQ ID NO: 275727 - DNA, 642 bp, Homo sapiens
  misc_feature: GYAE6OF01BFJXH.13.42.D09.1.454.CMB.1.raw
  modified_base (199)..(199): a, c, t, g, unknown or other
  misc_feature (199)..(199): n is a, c, g, or t
  modified_base (297)..(297): a, c, t, g, unknown or other
  misc_feature (297)..(297): n is a, c, g, or t
  modified_base (404)..(404): a, c, t, g, unknown or other
  misc_feature (404)..(404): n is a, c, g, or t
  modified_base (414)..(414): a, c, t, g, unknown or other
  misc_feature (414)..(414): n is a, c, g, or t
  modified_base (426)..(426): a, c, t, g, unknown or other
  misc_feature (426)..(426): n is a, c, g, or t
  modified_base (440)..(440): a, c, t, g, unknown or other
  misc_feature (440)..(440): n is a, c, g, or t
tcagtcacgtactacacgaccggtgctcgatttagacacatacgcagggaaaggggagagctgctcagttaggacccagagggaaccatggaaaccccagcgcagcttctcttcctcctgctactctggctcccagataccaccggagaaattgtgttgacgcagtctccaggcaccctgtcttgtctccaggggaaangccaccctctcctgcaggccagtcagagtgtagcagcagctacttagcctggaccagcaagaacctggccaggcctccgaggcctccgcatctagtgngcatccagcgaggccagtcggctacgtcccagacaggttcagtcggctaggttcggtacgtgggaacaggtaccttcacctctacacctatcagtcagtacgtggancgtagaagtntttagctaggtnttacttacgtgtanacgtcgtaagttacgttagggtacgtccgttaccgttacccggttaccgggttacccgtttaccgggaaccgtaaacgggggtacccgttaaaaggggtaaccgggttaaaccgtaaaccgtaaacccgggttaaacggttcgttaaccgggtaccgttacggtaacccgtaacccgttacgttaccggttcggtttaaccc

SEQ ID NO: 275728 - DNA, 894 bp, Homo sapiens
  misc_feature: GYAE6OF01COQ3V.13.42.D09.1.454.CMB.1.raw
tcagtcacgtactacacgaccggtgctcgatttagacacatacgcagggaaaggggagagctgctcagttaggacccagagggaaccatggaaaccccagcgcagcttctcttcctcctgctactctggctcccagataccaccggagaaattgtgttgacgcagtctccaggcaccctgtctttgtctccgaggggaaagcgcccaccctctcctgcacgggccagtcagagtgttagcagcagctacgttagcctaggtaccagacaagaaaccgtggaccacggcctcccgaggcctcctcactctagtcggtgctactccaggccgacgggccacgtcggaccacgtacccgaaggacgtacgggtttcgaacggttcgggacgtaacgggttcggggttaccgttacggggaaccgtaacggtaccgtttacccgtaacccgtttacccgtacccgtaacccgtacgttacccggaacgggtacccgtaaccggggttaaccggttacgggggaaacccggttaccccggtttaagggttaaaacgggtttacggtttttttaccgggaaccggtttaaacgggttttacggtttaaaccgttttaaccggtttacgggttaaccggtaacgggttaaccgttaaagggtttacgggtttacggggtttaaccgttaccggtttaccccggttaaccccggggttttaacccggggttacccggggtttaaccccggggaaacccgggtaaaccggggtaaacccgggttaaacgggggttaaaccggtaaaaccggtaacccggtaaaaaccgggttaaccggttacgggttaccgggaccgttacggaacccgttaaccgttacgttacccgttacggtttaccccg

SEQ ID NO: 275729 - DNA, 444 bp, Homo sapiens
  misc_feature: GYAE6OF01APO64.13.42.D09.1.454.CMB.1.raw
  modified_base (430)..(444): a, c, t, g, unknown or other
  misc_feature (430)..(444): n is a, c, g, or t
tcagtcacgtactacacgaccggtgctcgatttagacacatacgcagggaaaggaactggagtggattgggcttatcaatgccagtgggggcaccagctacaacccctccctcaagagccgcgtcaccatttcagtagacacgtccaagaaccagctctccctgaagctgagttctgtgaccgccgcagacacggccgtgtattactgtgcgcgacaggtggacgtcgtggggccaagggaccacggtcaccgtctcctcagcctccaccaagggtcccatccggtcttccccctggccgcccctgcctccagggacgccaacctccggagacgcaccgacggccggccccgtggggcctcgcccgtgggtacaacgggaccttaccttcctagtaccgtgactggacgcgggctggcaaggcgcatagnnnnnnnnnnnnnnn

SEQ ID NO: 275730 - DNA, 418 bp, Homo sapiens
  misc_feature: GYAE6OF01CB9J3.13.42.D09.1.454.CMB.1.raw
  modified_base (405)..(405): a, c, t, g, unknown or other
  misc_feature (405)..(405): n is a, c, g, or t
  modified_base (410)..(418): a, c, t, g, unknown or other
  misc_feature (410)..(418): n is a, c, g, or t
tcagtcacgtactacacgaccggtgctcgatttagacacatacgcagggaaaggggctggagtgggtggccaacataaacacagacggaagtgacccatactatgcggactctgtgaagggccgattcaccatctccagagacaacgccaagaactcactatatttgcaaatggaccgcctgagagacgaggacacggctatgtattactgtgcgagagatgagagtggctacgaggttcggggccggggaaccctggtcaccgtcaactcagcctccaccaagggcccatcggtcttccccctggccgccctgctccgaggacgcaccgtccgagagcacagcggccctgggctgcctggtcaaggctacttcctagtacgtgactgagcgggctggcaggcgnatagnnnnnnnnn

SEQ ID NO: 275731 - DNA, 525 bp, Homo sapiens
  misc_feature: GYAE6OF01D7355.13.42.D09.1.454.CMB.1.raw
  modified_base (503)..(525): a, c, t, g, unknown or other
  misc_feature (503)..(525): n is a, c, g, or t
tcagtcacgtactacacgaccggtgctcgatttagacacatacgcagggaaaggggctggagtggattggccatattaaggacagacctaatggcgcgacagcacactaccttgaatccgtcaaagacagattcatcatctcgagaggtgattccgacaacacggtgtctctccatatgagcagcctgaaaatcgaggacacaggcctatattactgtgcagtgatgggcccacgaccacgacttttggagtggtgcgctcgaccccgtggggcccggaaccctggtccaccgtctcctcacgcctccaccgaacgggcccatccggtccttcccccgtggcccacccctcctcccgaagacgccaccgtcgtcgggggccacgacggccggccccgtggggcctcggcccgttgggtaccgaacggaccttaccgtttacccgtacggttaccgtgaccgttggacggccggggctcgggacgaacgggcgacgagtacggnnnnnnnnnnnnnnnnnnnnnnn

SEQ ID NO: 275732 - DNA, 405 bp, Homo sapiens
  misc_feature: GYAE6OF01EA68U.13.42.D09.1.454.CMB.1.raw
  modified_base (321)..(321): a, c, t, g, unknown or other
  misc_feature (321)..(321): n is a, c, g, or t
  modified_base (393)..(405): a, c, t, g, unknown or other
  misc_feature (393)..(405): n is a, c, g, or t
tcagtcacgtactacacgaccggtgctcgatttagacacatacgcagggaaagggactggagtggattgggcttatcaatgccagtgggggcaccagctacaacccctccctcaagagccgcgtcaccatttcagtagacacgtccaagaaccagctctccctgaagctgagttctgtgaccgccgcagacacggccgtgtattactgtgcgcgacaggtggacgtcgtggggccaagggaccacgggtcaccgtctcctcagcctcaccaagggcccatcggtcttcccctggccgccctgctccaggagcacctcgagngcacagcgcctggctgctggtcaaggactacttcctagtacgtgactgagcgggctggcaaggcgcagtagnnnnnnnnnnnnn

SEQ ID NO: 275733 - DNA, 504 bp, Homo sapiens
  misc_feature: GYAE6OF01CN59C.13.42.D09.1.454.CMB.1.raw
  modified_base (343)..(343): a, c, t, g, unknown or other
  misc_feature (343)..(343): n is a, c, g, or t
  modified_base (359)..(359): a, c, t, g, unknown or other
  misc_feature (359)..(359): n is a, c, g, or t
  modified_base (488)..(504): a, c, t, g, unknown or other
  misc_feature (488)..(504): n is a, c, g, or t
tcagtcacgtactacacgaccggtgctcgatttagacacatacgcagggaaaggggctggagtggattggccatattaaggacagacctaatggcgcgacagcacactaccttgaatccgtcaaagacagattcatcatctcgagaggtgattccgacaacacggtgtctctccatatgagcagcctgaaaatcgaggacacaggcctatattactgtgcagtgagtgggccacgaccagacttttggagtggtgcgctcgaccccgtggggcccggaaccctggtccaccgtctcctcacgcctccaccgaacggcccagtccggtcccttccccgtggccncccctcctaccaagcnccaccgtcgtcgggggccacgacggcccggcccgtcgggcctcggccgtcggtaccgaacggtccttaacctttcccgtaggttaccgtgaccttggacggcgggctgggacaagggccgacagtacgnnnnnnnnnnnnnnnnn

SEQ ID NO: 275734 - DNA, 748 bp, Homo sapiens
  misc_feature: GYAE6OF01AZVSL.13.42.D09.1.454.CMB.1.raw
  modified_base (200)..(200): a, c, t, g, unknown or other
  misc_feature (200)..(200): n is a, c, g, or t
tcagtcacgtactacacgaccggtgctcgatttagacacatacgcagggaaaggggagagctgctcagttaggacccagagggaaccatggaaaccccagcgcagcttctcttcctcctgctactctggctcccagataccaccggagaaattgtgttgacgcagtctccaggcaccctgtctttgtctccaggggaaangccaccctctcctgcagggccagtcagagtgttagcagcagctacttagcctggtaccagcagaacctggccaggcctccgaggctcctcatctagtggtcgcatccagcgacgggccacgtggcactccccgagaccgtaggttcgaggtcggacgtaggttcggggtcgtggggactacggtaccttcgaaccttcctaccacctactacgacgaccgaacggtaccgtacgggaacgtacccgttaaggtaaacggtttacgtttttacggaccgttaagggttacgtttaacgtttaccgttggttaccgtaacggtacgtaaggtttaacggttacgggttaacgttcccgttaacccgtaacccggttaccggggttaacccgggtttaccgggtaacccgggtaaaccggggtaaacccggtaaacggggttaaacgggtaaaaccgttaacccgggaaaaaccgggttaaccgttacggggttaccggtacccgttacggtaacccgtaacccgtacgtttcccggttaccgtttacccg

SEQ ID NO: 275735 - DNA, 726 bp, Homo sapiens
  misc_feature: GYAE6OF01BM088.13.42.D09.1.454.CMB.1.raw
  modified_base (199)..(199): a, c, t, g, unknown or other
  misc_feature (199)..(199): n is a, c, g, or t
  modified_base (310)..(310): a, c, t, g, unknown or other
  misc_feature (310)..(310): n is a, c, g, or t
tcagtcacgtactacacgaccggtgctcgatttagacacatacgcagggaaaggggagagctgctcagttaggacccagagggaaccatggaaaccccagcgcagcttctcttcctcctgctactctggctcccagataccaccggagaaattgtgttgacgcagtctccaggcaccctgtctttgtctccgagggaanagccaccctctcctgcagggccagtcagagtgttagcagcagctacttacgcctggtaccagcaacgaaaccgtggaccaggcctcccgaggcctcctcatcgtagtggtncactccgagcgacgggccagtcggacactacccagaccgtaggttcaggtcggacgtaggtcgggttccgtgggaactacggtacttaccgtaccgttaccctcaccgtactaccgacgaccgacggtaccgtagggtaaccgccgttaggtaacgtttacgtttttcggactttagggtttagtttaacgtttccgttaggttacgagtacgttaaggttacgttacgggtacgttacccgttccgttaacccgggttaccggtacccggtttaccgggaacccggtaaacggggtaaacccgtaaacggggtaacgggtaaaacgttaaccggtaaaacccgggttaaccgttacgggtacgggttacgtaccggtaacccgtaacccgttagttccccggttcgtttaacccg

SEQ ID NO: 275736 - DNA, 730 bp, Homo sapiens
  misc_feature: GYAE6OF01AR4XP.13.42.D09.1.454.CMB.1.raw
  modified_base (201)..(201): a, c, t, g, unknown or other
  misc_feature (201)..(201): n is a, c, g, or t
  modified_base (309)..(309): a, c, t, g, unknown or other
  misc_feature (309)..(309): n is a, c, g, or t
tcagtcacgtactacacgaccggtgctcgatttagacacatacgcagggaaaggggagagctgctcagttaggacccagagggaaccatggaaaccccagcgcagcttctcttcctcctgctactctggctcccagataccaccggagaaattgtgttgacgcagtctccaggcaccctgtctttgtctccgaggggaaancgccaccctctcctgcgagggccagtcagagtgttagcagcagctactagcctggaccagcaagaacctggaccaggcctccgaggcctccgtcatcctagtcggtcnctactcccgagccgacgggcccacgtcggacctacgtccccgagaccgtaggttccagggtcggactaagggtgggtccgtagggactacggtaccttccgacttcctacaacctatacgtacgactacggacgtcgggaacgtcgtaacgtaagttacgttttcggacgttaacgggttacgtttaacgtttaccgtacggttacgaaggttaccgttaaggttacggttacgggttacgtacccttaccggtacccggttaccgggttacccgggtttacccgggaaccgggtaaaccggggtaaaccggtaaacgggttaaccggtaaaaccgtaaaccggtaaaacggtaaccggtttacgggtaacggtaccgtaccggtacccgtaccgttaacgttccggttcgtttaaccccg

SEQ ID NO: 275737 - DNA, 560 bp, Homo sapiens
  misc_feature: GYAE6OF01AKMU8.13.42.D09.1.454.CMB.1.raw
  modified_base (200)..(200): a, c, t, g, unknown or other
  misc_feature (200)..(200): n is a, c, g, or t
tcagtcacgtactacacgaccggtgctcgatttagacacatacgcagggaaaggggagagctgctcagttaggacccagagggaaccatggaaaccccagcgcagcttctcttcctcctgctactctggctcccagataccaccggagaaattgtgttgacgcagtctccaggcaccctgtctttgtctccaggggaaangccaccctctcctgcagggccagtcagagtgttagcagcagctacttagcctggtaccagcagaacgcctggcccacgggcccccaggcctcctcattctacgatgtattcgaaggacgaccactgacactcccagacaggttcaggtgcagtgggtctgggacagtctcactctcaccatcagcagactcggaacctgaagtacttagcttactttatttctgtaccacctagttacgtggtacgttcaccgttactacgttttcggacccgtagggacctaggtctggagtacacgaggtacgaacgttgtcggcctaggaccctaacctagttccttagtccttcgtctttccccgg

SEQ ID NO: 275738 - DNA, 790 bp, Homo sapiens
  misc_feature: GYAE6OF01DJFZ9.13.42.D09.1.454.CMB.1.raw
  modified_base (195)..(195): a, c, t, g, unknown or other
  misc_feature (195)..(195): n is a, c, g, or t
  modified_base (765)..(765): a, c, t, g, unknown or other
  misc_feature (765)..(765): n is a, c, g, or t
tcagtcacgtactacacgaccggtgctcgatttagacacatacgcagggaaaggggagagctgctcagttaggacccagagggaaccatggaaaccccagcgcagcttctcttcctcctgctactctggcctccagataccaccggagaaattgtgttgacgcagtctcaggcacctgtctttgctcgagggaanagcccaccctctccgtgcacgggccagtcgagtagttgttagcagcagtcttacgttacgccgttacggtaaccaacggactaaacggaaacccgttcgggacccgtaacgggtcccttaccccggaacgggtccccttaccccgtactaacgtttccgttaacggtttcggggtacggtacctaacgttccccgaaacgggcccggaacgggggtcccctaacggttacgggacctaacccgtaccccgtaacggaaccgttaggggtttaccgaggggttacgggacgtacggggttacggggtccggtaacgggggtaacctaacggggttacctttaccgtaacccgttccgttaacccaaccgtaacgtaccgaacgtaccgtaacggaccggttaacgggacgtaccgtaaagttaacgtttacgttttacgaccggtttaagttactttaacgtttcgtacgttcgaagttacgtagttacgtcggtatccgtaccgtacgtcgggtacggtcggaacgaacggacgtaaggacgtaactaacgaaggtctaggcgttaccgngtaacctgtaactcgttcgttaccg

SEQ ID NO: 275739 - DNA, 567 bp, Homo sapiens
  misc_feature: GYAE6OF01EZLYE.13.42.D09.1.454.CMB.1.raw
  modified_base (198)..(198): a, c, t, g, unknown or other
  misc_feature (198)..(198): n is a, c, g, or t
tcagtcacgtactacacgaccggtgctcgatttagacacatacgcagggaaaggggagagctgctcagttaggacccagagggaaccatggaaaccccagcgcagcttctcttcctcctgctactctggctcccagataccaccggagaaattgtgttgacgcagtctccaggcaccctgtctttgctccaggggaangccaccctctcctgcagggccagtcagagtgttagcagcagctacttagcctggtaccagcagaacctggccaggctccaggctcctcatctatggtgcatccagccagggccacgtggcactcccagacaggttcagtgcagtgggtctgggacagtacttcactctcaccatcagcagacgtggagccgtagaagtatttgctagttgtattacgtgtacagcgtaagtagtggtacgtccttacgtacccgttacgggtacgttccgggaccgtaaacggggtaaccgaaagggtacggaaacgttacgaaaaccggtaacgttacggtaggtactacgggaccaacctacgtccgttcgttaccg

SEQ ID NO: 275740 - DNA, 850 bp, Homo sapiens
  misc_feature: GYAE6OF01DGVPG.13.42.D09.1.454.CMB.1.raw
  modified_base (223)..(223): a, c, t, g, unknown or other
  misc_feature (223)..(223): n is a, c, g, or t
tcagtcacgtactacacgaccggtgctcgatttagacacatacgcagggaaaggggagagctgctcagttaggacccagagggaaccatacggaaaccccagcgcagcttctcttcctcctgctactctggcctcccagactaccgaccggaagtaattgtgttagaccgcacgtcctccgacggcctacccttgttcctttcgtcctaccgaaggggaaacncgccctaccctctccgtcgcgacggcctagtacaggtagtcgttacgcgtagcgacgtaccttacgtcgaccgttacggtaaccacggaccaaacgaacccgtcggacccgaacggtccctcccgaaggtccctacctactaacgttcttacggtcggtcgtacctaacgtcccgaggcccggtacgggaccctacgtacgggaccctaccgtacccgaggtaccgttacggttacgacgggtacgtcgttaggggtccgggtacggtacgggtaacgtaccgtaccgtttacccgacgttaccctaccgaaccgttacgtaccggaaccgaccggttaaccgtaacggttaccggtaaccggttacggtaacgtttcttaaccgtcgtttacctttttaaccgtttcctaccgtaccgtaaccgtttaaggtttacggttacgggttttacccgtaaccgtttacccgtttacgggttaccggtttaacccgggaccgggttaaaccgggaccttaaaccgggtgtaaccggtaaggtacccgtaaggtaaccggtaccgggttaagtccggttaccggtaacgtaccgtacccgtacgtaggtttaccttcccggtacttacccg

SEQ ID NO: 275741 - DNA, 673 bp, Homo sapiens
  misc_feature: GYAE6OF01CI3KU.13.42.D09.1.454.CMB.1.raw
  modified_base (413)..(413): a, c, t, g, unknown or other
  misc_feature (413)..(413): n is a, c, g, or t
  modified_base (533)..(533): a, c, t, g, unknown or other
  misc_feature (533)..(533): n is a, c, g, or t
tcagtcacgtactacacgaccggtgctcgatttagacacatacgcagggaaaggggagagctgctcagttaggacccagagggaaccatggaaaccccagcgcagcttctcttcctcctgctactctggcctcccagactaccaccggagaaattgtgttgacgcagtcctccaggccaccctgtctttgtcgtccgaaggggaaacacgccctacccctctcctgacgacgggacccagtcaggtagtgttacgcaggcagtacttacgtagccgtggaaccagacaagaaacccgtggaccacggtccacccgaggtcctccctacgtatccgtagtggcgccagtccgagccgacggtccacgtcgctacctccgagacgtacggtctaggtcggacgtaggttcgggtntacggggaacacggtaccttactaccgttcctacgtaccgtactaccgacgtacccgaagtacggtacgggacctaccgtagtaagttcgtttgacgttagttaccgttagttactcganacgttgtaagttacgtcggtactcgaccgttaccgtggtaccgtacgggtaaccgaacgggtaacctaaggtacgtaaacgtaccggtaaacggtgtagggtaccgacttaccggaccttagtcttccgtacgttacccg

SEQ ID NO: 275742 - DNA, 808 bp, Homo sapiens
  misc_feature: GYAE6OF01D57FY.13.42.D09.1.454.CMB.1.raw
  modified_base (200)..(200): a, c, t, g, unknown or other
  misc_feature (200)..(200): n is a, c, g, or t
tcagtcacgtactacacgaccggtgctcgatttagacacatacgcaggggaaagggggagagctgctcagttaggacccagagggaaccatggaaacccagcgcagcttctcttcctcctgctactctggctccagactaccaccggagaaattggtgttgacgcagtctccaggcacctgtcttgtctccgaagggaanacgccctacccgtctcctggccgacgggcctagtcgaggtacgttgttaacgccgaagcgtagtaccttaacgttacggacccgttaggtaacccaaggtaccgtaaacggtaaacccgttcggggacccctaagggttccctaacccgaaggtaaccttacccgtactaactttccgttaagtcggggtacaccttactacccggaacggcggtaacccgggcctacggtacggacctaccgtacccggaagtaccgtaaggttcaggttcgggacgtgggttcgggtcgtacgggtacacgttaccgtctaccttaccgtactaacccgtatacgacgccaacggtactacggggtacctacggtaacgtaagtttacgtttagacgttacggttagtttaaacttcggttagtacgtacggtaactacggttaagttacgggtactaccgtttaccgtaccggttacgggttaccggtaccgggtaaaccggtaaacggggtaaccggttaaacggtaaggtaaaaccgttaaaccggaaacggttaacggttacggtacggtacccgttcggaaccctaggttacccttacggttcgttaaccc

SEQ ID NO: 275743 - DNA, 743 bp, Homo sapiens
  misc_feature: GYAE6OF01B5FXF.13.42.D09.1.454.CMB.1.raw
  modified_base (201)..(201): a, c, t, g, unknown or other
  misc_feature (201)..(201): n is a, c, g, or t
  modified_base (307)..(307): a, c, t, g, unknown or other
  misc_feature (307)..(307): n is a, c, g, or t
  modified_base (349)..(349): a, c, t, g, unknown or other
  misc_feature (349)..(349): n is a, c, g, or t
tcagtcacgtactacacgaccggtgctcgatttagacacatacgcagggaaaggggagagctgctcagttaggacccagagggaaccatggaaaccccagcgcagcttctcttcctcctgctactctggctcccagactaccaccggagaattgtgttgacgcagtctccaggccaccctgtctttgtctccgaggggaancgcccaccctctcctgcacgggccagtcagagtgttagcagcagctacttagcctggtaccagcagaaacctggaccaggcctccaggcctcctcatctagtggtncactccgagcacgggccacgtggaccacgtcccgagtaccgnggtttacaggtcggacgtagggtacgggtcgtacggggactacggtaccttaccgtactccctacaccctagtccgaagtcccgaaggtaccgttgggaaccgtaccgtagggtaaacgtttagttttcggacgttacggtttcgtttaacttacggtacggttacaacgggttacgtaacgggttaggttaccggtacgttccccgttaccggttaacccgggttaccggggttaacccgggtttacccgggtaacccgggtaaaccggggtaaaccggtaaacgggggtttaaccggaaaacggttaacccggtaaaaccgggttacccgttagggtacccgggttaacgtaccggtacccgtaaccggttacgttcccgttcgtttacccg

SEQ ID NO: 275744 - DNA, 529 bp, Homo sapiens
  misc_feature: GYAE6OF01A27D5.13.42.D09.1.454.CMB.1.raw
  modified_base (435)..(435): a, c, t, g, unknown or other
  misc_feature (435)..(435): n is a, c, g, or t
  modified_base (512)..(529): a, c, t, g, unknown or other
  misc_feature (512)..(529): n is a, c, g, or t
tcagtcacgtactacacgaccggtgctcgatttagacacatacgcagggaaaggggctggagtggattggccatattaaggacagacctaatggcgcgacagcacactaccttgaatccgtcaaagacagattcatcatctcgagaggtgattccgacaacacggtgtctctccatatgagcgagcctagaaaatcgaggacacgaggcctatattactgtgctagtgagtcggccacgaccacgttacgttttggaggtaggtgtcgtcctaccgaaccccggttccggggacccggtaacccgtcggtaccgtacccgtccgttcccgtctccgccctaccaccggaacggaccctcgtaccggtccccttccccgtggaccctaccccgtaccaccgagtaccgacctccgtcggcgggcacgcgcggtccnggtacgcgtcgcgactaggtcctaccgttactacgtagtacgaccgtggcgacggcgtagaccgaggcgtcgatgannnnnnnnnnnnnnnnnn

SEQ ID NO: 275745 - DNA, 754 bp, Homo sapiens
  misc_feature: GYAE6OF01BJJDJ.13.42.D09.1.454.CMB.1.raw
  modified_base (198)..(198): a, c, t, g, unknown or other
  misc_feature (198)..(198): n is a, c, g, or t
  modified_base (686)..(686): a, c, t, g, unknown or other
  misc_feature (686)..(686): n is a, c, g, or t
  modified_base (694)..(694): a, c, t, g, unknown or other
  misc_feature (694)..(694): n is a, c, g, or t
  modified_base (711)..(711): a, c, t, g, unknown or other
  misc_feature (711)..(711): n is a, c, g, or t
  modified_base (735)..(735): a, c, t, g, unknown or other
  misc_feature (735)..(735): n is a, c, g, or t
tcagtcacgtactacacgaccggtgctcgatttagacacatacgcagggaaagggggagagctgctcagttaggacccagagggaaccatggaaaccccagcgcagcttctcttcctcctgctactctggctcccagataccgacggagaattgtgttgacgcagtctccgaggcatcgtgtctttgctcgagggaancgccacctctctggcagggccagtcagtacttgcaggcagctaacgttactacgccgtaggtaccagctagaacgccgtgggacccgaccggtcccccgaggtcccttacccgaccgtaactaccgtaacggtacgttacgtttaccggttacggaacggggtaccggtaacccaccggttaacggaacctaaccgtaaccccgtaaggtaacccggttagggtttacccgaagggtcggggacctacgggggttacgggttcggaacgggtaccgtaacgttacccgtttacgaccctttaccgtaacccgtaacccgtactaccggaacgtacgtaacccgggaacggttaaccgggtaaacttagggaaaccgtttccgttaagtaccctttaacgtttttacttccgtacgtaccgtaccgtaggttacgttcgggtacggtacctaacggttccttagggttcaccggtacgggacctaaggngtacggancgtaagacgcgttacgnggtaccgcgacgacctctacgttntccgttctccggttacccg

SEQ ID NO: 275746 - DNA, 551 bp, Homo sapiens
  misc_feature: GYAE6OF01CH46G.13.42.D09.1.454.CMB.1.raw
  modified_base (515)..(515): a, c, t, g, unknown or other
  misc_feature (515)..(515): n is a, c, g, or t
  modified_base (518)..(518): a, c, t, g, unknown or other
  misc_feature (518)..(518): n is a, c, g, or t
  modified_base (523)..(551): a, c, t, g, unknown or other
  misc_feature (523)..(551): n is a, c, g, or t
tcagtcacgtactacacgaccggtgctcgatttagacacatacgcagggaaaggggctggagtggattggccatattaaggacagacctaatggcgcgacagcacactaccttgaatccgtcaaagacagattcatcatctcgagaggtgattccgacaacacggtgtctctccatatgagcagcctgaaaatcgaggacacaggcctatattactgtgcagtgatgggccacgaccacgtacttttggagtggtgcgctcgacccgtcggggcccggaacctggtccaccgtcctcctcacgcctccacccgaacggcccacgtccggtcccctccccctcggcccacccctccctccgaacgacgccaccgtcgtcgggggcacgacggccggcccgtgggcctcggccgtggtaccgaacgggtaccttaccgtttacccgtaaggttaccggttcggaacgtacggacgggccgggtaccgttcggacgaaacgggccgacgtaagtacgngancacgnnnnnnnnnnnnnnnnnnnnnnnnnnnnn

SEQ ID NO: 275747 - DNA, 719 bp, Homo sapiens
  misc_feature: GYAE6OF01DCPHF.13.42.D09.1.454.CMB.1.raw
  modified_base (148)..(148): a, c, t, g, unknown or other
  misc_feature (148)..(148): n is a, c, g, or t
  modified_base (200)..(200): a, c, t, g, unknown or other
  misc_feature (200)..(200): n is a, c, g, or t
  modified_base (342)..(342): a, c, t, g, unknown or other
  misc_feature (342)..(342): n is a, c, g, or t
tcagtcacgtactacacgaccggtgctcgatttagacacatacgcagggaaagggggagagctgctcagttaggacccagagggaaccatggaaaccccagcgcagcttctcttcctcctgctactctggctccagataccaccgganaaattgtgttgacgcagtctcaggcaccctgtcttgtctccgaggggtaaancgccctaccctctcctgcgacgggccagtcagtagtcgttagcgtagcagtacctacgtacgtcctaggtaccaacgtcaacggaaacccgtggacccacggtccctacccgaggccctcgtactatcgttagttcgggacnctactacgaacggtcgacggtacctacggtcggactaccgtaaccccgtggtaaccggtacggttcgaagggtacgggtcgtaacgggttcggggtacgtaggggacctaaggttccctagccgttcctacgaccgtatacgacgacggtaacggtacgtacggtacgtacgttaaggtacgttacgttttcgaaccgttagtttaaccgtatttaccgtgacgtacggaacgttggtaagtcggtaacgtccgttaaccggtacccgttacggggccgttaacgggacccggaaacgggtaccggttaaaggacggtaaacctaagaaccggttaacgtggttaccgactcgaactacgtaacttgtaccgttacg

SEQ ID NO: 275748 - DNA, 731 bp, Homo sapiens
  misc_feature: GYAE6OF01AJGO0.13.42.D09.1.454.CMB.1.raw
  modified_base (202)..(202): a, c, t, g, unknown or other
  misc_feature (202)..(202): n is a, c, g, or t
  modified_base (349)..(349): a, c, t, g, unknown or other
  misc_feature (349)..(349): n is a, c, g, or t
tcagtcacgtactacacgaccggtgctcgatttagacacatacgcagggaaaggggagagctgctcagttaggacccagagggaaccatggaaaccccagcgcagcttctcttcctcctgctactctggctcccagataccaccggagaaattgtgttgacgcagtctccaggccaccctgtctttgtctccgaggggaaancgcccaccctctcctgcgacgggccagtcagtagttgttagcagcagtccttacttacgccgttcggtaacccagtaccgaacgtaaacccgtgggacccgaggtccctacccgaggtccccttcctactacttcctaggttcggcncctaccgtccgacgcggaccgggtacctacggtcggaccaacgtcccgaaggtaccggtacggttacgtacgggtcggacgtcgggttcggggtaccggacggggtaactaccgttaccctttacctaaccttcccgacccgaaccttacgtaccgacgaccgacgtaacggcggtaacgtaccgtaggtaacgttgtttacgacgtttagttcgttacttacgtagttcgaacgttaggtaggtttacgtacggttaccgtacctaccggttaccggtacgggtaccggtaacccggacggtaacggtaaccgtaagggaacgtaaaccgtaacgtaacgcggttacgtcggactacgacttaccgtacttgtcgttaccg

SEQ ID NO: 275749 - DNA, 570 bp, Homo sapiens
  misc_feature: GYAE6OF01EJE16.13.42.D09.1.454.CMB.1.raw
  modified_base (113)..(113): a, c, t, g, unknown or other
  misc_feature (113)..(113): n is a, c, g, or t
  modified_base (155)..(155): a, c, t, g, unknown or other
  misc_feature (155)..(155): n is a, c, g, or t
  modified_base (219)..(219): a, c, t, g, unknown or other
  misc_feature (219)..(219): n is a, c, g, or t
  modified_base (292)..(292): a, c, t, g, unknown or other
  misc_feature (292)..(292): n is a, c, g, or t
  modified_base (517)..(517): a, c, t, g, unknown or other
  misc_feature (517)..(517): n is a, c, g, or t
  modified_base (520)..(520): a, c, t, g, unknown or other
  misc_feature (520)..(520): n is a, c, g, or t
  modified_base (522)..(525): a, c, t, g, unknown or other
  misc_feature (522)..(525): n is a, c, g, or t
  modified_base (528)..(529): a, c, t, g, unknown or other
  misc_feature (528)..(529): n is a, c, g, or t
  modified_base (532)..(533): a, c, t, g, unknown or other
  misc_feature (532)..(533): n is a, c, g, or t
  modified_base (536)..(536): a, c, t, g, unknown or other
  misc_feature (536)..(536): n is a, c, g, or t
  modified_base (540)..(570): a, c, t, g, unknown or other
  misc_feature (540)..(570): n is a, c, g, or t
tcagtcacgtactacacgaccggtgctcgatttagacacatacgcagggaaagggactggagtggattgggcttatcaatgccagtgggggcaccagctacaacccctccctnaagagccgcgtcaccattttcagtagacacgtccaagaaccngctctccctagagctgagtttctggtcgacccgcgacagtacgaccggtccgtgttacttacgnggtagccgacgacgagggtcggaccgtcggtaggggacccaaagggtcccacgggtcctacccggttcttccncaacggtccctaccgaaccggacgggccctagttcccggttaccccgttccccgggcccgtcccttcgcctcccggaaggtacaccgtaccgtccggagacgtaccgacgacggtcccggtccgtgggtcctcgtccgtcggtacaacggttacccttacgttcgtaggtacccgtgtacgtagggaccggcgggttaccagggtacgaaggcccaataagcggnacngnnnntanntanngangctnnnnnnnnnnnnnnnnnnnnnnnnnnnnnnn

SEQ ID NO: 275750 - DNA, 774 bp, Homo sapiens
  misc_feature: GYAE6OF01EJYRT.13.42.D09.1.454.CMB.1.raw
  modified_base (207)..(207): a, c, t, g, unknown or other
  misc_feature (207)..(207): n is a, c, g, or t
  modified_base (535)..(535): a, c, t, g, unknown or other
  misc_feature (535)..(535): n is a, c, g, or t
tcagtcacgtactacacgaccggtgctcgatttagacacatacgcagggaaaggggagagctgctcagttaggacccagagggaaccatggaaaccccagcgcagcttctcttcctcctgcctactctgctcccagactaccgaccggagtaaattgtgttgacgtcagtctccaggccaccttgttctttgtctccgaaggggaanacgccctaccctctccgtacgcgacgggcctacgtcgaaggtacgttgttagacagcctagtccttaacttacgcccgttacgggtaaccaacggtaccgaaacggtaaacccgttcgggaccccgtaacggtccctacccgacggtccctaccctactaacgttccgtacgtttgggcgaccgtaccgtaccggacgaccggtaccgggcctaacgtcggtacctaccgtaccccgaagtaccgtacggtttacgaacggttcggacgttacgggttcggtacgttagggactacggtacctttacacgtctaccactactcgaacncgaacggtacgtacgggaccgtacgtaagttaagtttacgtttacgaggttgttttacgtaagtttccgtaggtacctagtacgttaaggttacgttacggtacctccgttaacccgtcggtaccggtcggtaccgacggtaaaccgggtacgtaagggtacgtaaccgtaaggaaaccgttcggtacgtacggttacccgaacgttacccgaacgtttacggttcgttccgttacccg

SEQ ID NO: 275751 - DNA, 728 bp, Homo sapiens
  misc_feature: GYAE6OF01DG2ID.13.42.D09.1.454.CMB.1.raw
tcagtcacgtactacacgaccggtgctcgatttagacacatacgcagggaaaggggagagctgctcagttaggacccagagggaaccataggaaaccccagcgcagcttctcttcctcctgctactctggctccagactaccaccggagaaattgtgttgacgcagtctcgaggcaccctgttcttgtctaccgaaggggaaagacgcccaccctctccgtcggcgacgggccaagtccgaagtaggttcgttaagcgaacgcaggtccttaacctacgtccgtacggaaccagaccgaacgaacgccgtacggacccgaccggaccccgaggtccctccactacgtaccgtaacgtagtagttacgttacgaagggaacggaccacgtacgaactaaccaccgaacgtacgtaggttacagggtcggacgtagggtacggtcggtacggaacgtacgtacttaccgactccgtacaaccgatacgacgacgtaacgacgtaaccggaacgtacgtaagttactttacgacgtttattttacctttcgtaaccggttaccacgttaacggttggtaccggtttacggtaccttaacccggttacttacggttacgggaccggtaacgggttaccaacggttaggacggaaactcgaaaccggtactacggttaacgtggtacggacctacggactaaactcgttactcggttactcctcgttaccccg

SEQ ID NO: 275752 - DNA, 730 bp, Homo sapiens
  misc_feature: GYAE6OF01CDBSC.13.42.D09.1.454.CMB.1.raw
  modified_base (201)..(201): a, c, t, g, unknown or other
  misc_feature (201)..(201): n is a, c, g, or t
  modified_base (300)..(300): a, c, t, g, unknown or other
  misc_feature (300)..(300): n is a, c, g, or t
tcagtcacgtactacacgaccggtgctcgatttagacacatacgcagggaaagggggagagctgctcagttaggacccagagggaaccatcggaaaccccagcgcagcttctcttcctcctgctactctggctcccagataccaccggagaaattgtgttgacgcagtctccaggcaccctgttctttgctccgagggaancgccacctctcctgcgaggccagtcagagtgttaagcagcacgtctacttagcctggtaccagcagaacctcggccacggcctaccgaggcctccgtcntctagtcggtagccagtcccaggtccgacgggaccacgtcggcctacgtaccccgaagacgtaggttacgacgggtcggtacggtaacgggttcggggtaccgtacgggggtaacctacggtaccgtttacccgtaaccttccgtaccctaacccgtaacgtaccgtaacggtaccggaaccggtaacgttacgggggtaaccggtaccgttaacggtaaacgttttacggttttacgtcggttaacgttgttaacgtttaacgttcggtaccgtacgtacggtaggttaacggtcggttaccggtaccgttccgtaccggttacgggtaccggttcgggaaccgggtaacggtaccggtaaacgggtacgaaacggtacgaaaccggtggtacgttcggacgtacgaccgtactacgttcgtcgttccg

SEQ ID NO: 275753 - DNA, 754 bp, Homo sapiens
  misc_feature: GYAE6OF01BTZ9Z.13.42.D09.1.454.CMB.1.raw
  modified_base (236)..(236): a, c, t, g, unknown or other
  misc_feature (236)..(236): n is a, c, g, or t
tcagtcacgtactacacgaccggtgctcgatttagacacatacgcagggaaaggggagagctgctcagttaggacccagagggaaccatggaaaccccagcgcagcttctcttcctcctgctactctggctcccagataccaccggagaaattgtgttgacgcagtctccaggcaccctgttctttgtcctccgaaggggaaagcgcccaccctctcctgcgagggccagtcaggngtgttagcagcagctacgttcgaccgtcggtaaccagaccaacggaacccgtcggacccgacggtccctacccgacggtcctccctctatctagtcggtcgcctactccgaggccgacgggccacggtcggacctacgtaccccgagtaccggtacggttacgagggtcggacgtgggttgggtccggtacgggactacggtaccttacgaccttccgtaccaccgtataccgtacgaccgtaaggtcgtagggtaccgtacggttaaggtaacgtttagtttcggaccgtttaaggtttacgttaactttaccggtgtaccgtaaggttaccgtaaggttaaggttacgggtaacctcccgttaaccggttaccggttaccgggtacccggttacccgggaaccggtaaaccgggtaacggggttaaacggtaacgggtaaaccttaacccgggaaacgggttaccgttagggtccgttaccggtaccgtaccgtacctcgttcgttacgttacccg

SEQ ID NO: 275754 - DNA, 701 bp, Homo sapiens
  misc_feature: GYAE6OF01BGFEQ.13.42.D09.1.454.CMB.1.raw
  modified_base (150)..(150): a, c, t, g, unknown or other
  misc_feature (150)..(150): n is a, c, g, or t
  modified_base (203)..(203): a, c, t, g, unknown or other
  misc_feature (203)..(203): n is a, c, g, or t
  modified_base (216)..(216): a, c, t, g, unknown or other
  misc_feature (216)..(216): n is a, c, g, or t
  modified_base (251)..(251): a, c, t, g, unknown or other
  misc_feature (251)..(251): n is a, c, g, or t
  modified_base (326)..(326): a, c, t, g, unknown or other
  misc_feature (326)..(326): n is a, c, g, or t
  modified_base (380)..(380): a, c, t, g, unknown or other
  misc_feature (380)..(380): n is a, c, g, or t
  modified_base (663)..(663): a, c, t, g, unknown or other
  misc_feature (663)..(663): n is a, c, g, or t
tcagtcacgtactacacgaccggtgctcgatttagacacatacgcagggaaaggggagagctgctcagttaggacccagagggaaccatggaaaccccagcgcagcttctcttcctcctgctactctcggctccagactaccaccggaanaaattgtgttcgacgcagtctccaggccacccttgtcttcgctccgagggaancgccacctctccngcgacggccagtccgaggacgttgttacgcgaacncgacggtactacgttacggcctacggtaccagtacgaacggaaacgtcggaccacggcctccgacggtcctaccncgattcgtacgtggtcacactacgcgtacgacggtccgccgtggacctccgacncggacgtaggttcaggtcgaacggtggtcgggtaacggcggtaactcggtacctaccgtctacgtaccgactcggacacgactacgtagtacgggtaactacgtaacggtacgttacgtttggtaacgttacggttactttacgttcgtaacgtcgactacggtacgttaaggttaccgggtaactccggtacccgttaccggttccggtacccgggttaaccggtacggtaacgggaacccggtaaaggttaaccgaaacgtaaccgtaacggttaaccggngtaccggtacgcgacctaaaggtaccttcgtccgttac

SEQ ID NO: 275755 - DNA, 781 bp, Homo sapiens
  misc_feature: GYAE6OF01CQBAK.13.42.D09.1.454.CMB.1.raw
  modified_base (215)..(215): a, c, t, g, unknown or other
  misc_feature (215)..(215): n is a, c, g, or t
  modified_base (248)..(248): a, c, t, g, unknown or other
  misc_feature (248)..(248): n is a, c, g, or t
  modified_base (353)..(353): a, c, t, g, unknown or other
  misc_feature (353)..(353): n is a, c, g, or t
  modified_base (366)..(366): a, c, t, g, unknown or other
  misc_feature (366)..(366): n is a, c, g, or t
tcagtcacgtactacacgaccggtgctcgatttagacacatacgcagggaaaggggagagctgctcagttaggacccagagggaaccatggaaaccccagcgcagcttctcttcctcctgctactctggctcccagactaccgaaccggagaaattgtgttgaccgcagtcctccgacggcctacccttgttctttgtcctccgaaggggaaacncgcccacccgtctcctgcgacggccagtcaggngttgttagcagcagctacgtagccgtaggtaccagaccaacggtaaacccgcggaccgacgcccgttacccgacggtccttaccctcgacttccgtagtcggtcncctacgtacccgnggaccgaccggcctaacggtcgtaccaccgtccgaagacgtacggttacgacggtcggtacgtggtccggggtagtacgggaacgtaccggttaccctttaccgccgtttaccccgtaaccgaccgtacaccgtaccggtaccggtaacggtaccggtagggtaccgtacggttaaggttaaaacgtttggtttaccgacgtttaaggttaccgtttacgtttaccgtagtaccggtaagtcgttaaacgggttcgtaacggttcccgtacttcccccggtaagggttcccggtacccgtaacgggacccggttaaacgggacccgttaggggttaaaactaaccggttaaacccgtaaacggtccgggttaagtccccgtaagtacccaccgttagcccgttgtacccgttccg

SEQ ID NO: 275756 - DNA, 748 bp, Homo sapiens
  misc_feature: GYAE6OF01CH1U0.13.42.D09.1.454.CMB.1.raw
  modified_base (213)..(213): a, c, t, g, unknown or other
  misc_feature (213)..(213): n is a, c, g, or t
  modified_base (736)..(736): a, c, t, g, unknown or other
  misc_feature (736)..(736): n is a, c, g, or t
tcagtcacgtactacacgaccggtgctcgatttagacacatacgcagggaaagggggagagctgctcagttaggacccagagggaaccatggaaaccccagcgcagcttctcttcctcctgctactctggctcccagataccaccggataaattgtgttgaccgcagtcctccgaggcctaccctgttctttgtcctaccgaagggggaaacncgccctacccttctccgtcgcgacggcctagtcaggtagtgtagcagcagtacttacttacggccttaggaccagacgtaacgaaacccgtcggaccacggccctacccgacggccttaccgtcctactaccttaacggtagttcgttaaccttacggaaggaccggtaacctactacggaacctaccgtacccaagtaaccggttaagggttccgaaggttacggacgttacggggttacgggttacggaaccgggtaccgtaacggtaacccttttcccaccgttacccgttaaccgaccttaacgaccgttacgacaacgggttaccgtacgtaaccgtaacggtacttacgttacgtacctttattttacgtctttacgccttaacgtaggtaggtttcggaacgttcccgtaacctttacgttccggtaggggtaccgtaacgggtaacctggtacgtaggtacacgtcgaaaggcgtacgtaggtacgtcacgtaccacgtactccttagtcttacnccgggttacccc

SEQ ID NO: 275757 - DNA, 153 bp, Homo sapiens
  misc_feature: GYAE6OF02FUU8H.13.42.D09.1.454.CMB.1.raw
  modified_base (153)..(153): a, c, t, g, unknown or other
  misc_feature (153)..(153): n is a, c, g, or t
tcagtcacgtactacacgaccggtgctcgatttagacacatacgcagggaaagggaccaaggtggaaatcaaacgaactgtggctgcaccatctgtcttcatcttcccgccatctgatagtacgtgactgagcgggctggcaaggcgcatagn

SEQ ID NO: 275758 - DNA, 539 bp, Homo sapiens
  misc_feature: GYAE6OF02ILW3O.13.42.D09.1.454.CMB.1.raw
  modified_base (200)..(200): a, c, t, g, unknown or other
  misc_feature (200)..(200): n is a, c, g, or t
  modified_base (289)..(289): a, c, t, g, unknown or other
  misc_feature (289)..(289): n is a, c, g, or t
  modified_base (300)..(300): a, c, t, g, unknown or other
  misc_feature (300)..(300): n is a, c, g, or t
tcagtcacgtactacacgaccggtgctcgatttagacacatacgcagggaaaggggagagctgctcagttaggacccagagggaaccatggaaaccccagcgcagcttctcttcctcctgctactctggctcccagataccaccggagaaattgtgttgacgcagtctccaggcaccctgtctttgctccgaggggaaangccaccctctcctgcagggccagtcagagtgttagcagcagctacttagcctggtaccagcagaaacctggccaggctccaggcctccncatctatggtncatccagcaggccactggcactcccagactaggtcagtgcaggtgggtctgggacagacttcactctacacctatcagcagactggagccgtagaagtatttgacgtagtagtattacgtgtacagtctaagtagtaggtacgactccgacgttccggacgttcgacgaacggacgaacggtaggaacgtaacaacgtaacgtcgtaggtacgtacgaccgaactactacgtagttacg

SEQ ID NO: 275759 - DNA, 155 bp, Homo sapiens
  misc_feature: GYAE6OF02FIGUI.13.42.D09.1.454.CMB.1.raw
  modified_base (153)..(155): a, c, t, g, unknown or other
  misc_feature (153)..(155): n is a, c, g, or t
tcagtcacgtactacacgaccggtgctcgatttagacacatacgcagggaaagggaccaaggtggaaatcaaacgaactgtggctgcaccatctgtcttcatcttcccgccatctgatagtacgtgactgagcgggctggcaaggcgcatagnnn

SEQ ID NO: 275760 - DNA, 552 bp, Homo sapiens
  misc_feature: GYAE6OF02J3A4I.13.42.D09.1.454.CMB.1.raw
  modified_base (199)..(199): a, c, t, g, unknown or other
  misc_feature (199)..(199): n is a, c, g, or t
tcagtcacgtactacacgaccggtgctcgatttagacacatacgcagggaaaggggagagctgctcagttaggacccagagggaaccatggaaaccccagcgcagcttctcttcctcctgctactctggctcccagataccaccggagaaattgtgttgacgcagtctccaggcaccctgtctttgctccaggggaaangccaccctctcctgcagggccagtcagagtgttagcagcagctacttagcctggtaccagcagaacctggccaggctcccaggctcctcatctacgatgtattcaggaggaccactgaccatccccagaccaggttcagtggcaggtgggtctgggacagacttcactctcaccatcagcagactgaacctgaagtactttgctactttattctgtcacctagtatggtacggtctaccgtactacgttttcggaccgtagggtaccaaggtcgttaggagtacttacgaaggtaccgtaaacgtgtacggtcgtacgacgacctacgtaccgtcgttcttacctacttcccg

SEQ ID NO: 275761 - DNA, 545 bp, Homo sapiens
  misc_feature: GYAE6OF02J24ZG.13.42.D09.1.454.CMB.1.raw
  modified_base (300)..(300): a, c, t, g, unknown or other
  misc_feature (300)..(300): n is a, c, g, or t
tcagtcacgtactacacgaccggtgctcgatttagacacatacgcagggaaaggggagagctgctcagttaggacccagagggaaccatggaaaccccagcgcagcttctcttcctcctgctactctggctcccagataccaccggagaaattgtgttgacgcagtctccaggcaccctgtctttgtctccaggggaaagagccaccctctcctgcagggccagtcagagtgttagcagcagctacttagcctggtaccagcagaacctggccaggcctccaggctcctcatctatggtncatccagcagggccactggcatcccagacaggttcagtggcaggtgggtctgggacagacttcgactctcaccatcagcagactgggacgcctagaagtattttagcgtagttagttacttactgtacagtcgtagtagtggtagtctacgtaccgtcggtacgtcggaccgaacggaccgtaggtacggtaaacgtacgaaacgtaacgtgtaggacgttacgaccgtacctacgtctgttacc

SEQ ID NO: 275762 - DNA, 630 bp, Homo sapiens
  misc_feature: GYAE6OF02G4UAH.13.42.D09.1.454.CMB.1.raw
  modified_base (546)..(546): a, c, t, g, unknown or other
  misc_feature (546)..(546): n is a, c, g, or t
  modified_base (554)..(554): a, c, t, g, unknown or other
  misc_feature (554)..(554): n is a, c, g, or t
  modified_base (571)..(571): a, c, t, g, unknown or other
  misc_feature (571)..(571): n is a, c, g, or t
  modified_base (575)..(575): a, c, t, g, unknown or other
  misc_feature (575)..(575): n is a, c, g, or t
  modified_base (628)..(628): a, c, t, g, unknown or other
  misc_feature (628)..(628): n is a, c, g, or t
tcagtcacgtactacacgaccggtgctcgattttagacacatacgctagggtaaagggcgattacggcagggaaacgggcggtcggagtgggtggccaacataaacacagaccggaagtggacccataccttatgcggactctgtcgaagggccgatttcgaccatcgtccagaggacgaacgccaagaactcactatatttgactaaatggaaccgccgtgaggagaacgaggacacggtctatggtactttaccgtggtaggccgagtacgactgacgacgtgggactaacagtttcgggaccgggaaaccctggtctaccgtcaactacagacctccaccaagggcccaagtccggtaccttacccccgtacgggcccgtaccctacgccttccgaggacgcgaccgttccgacgacgccgaaccgtacgggaccggccccgttggggaccttcggccggtacgggtacgaaaccggtcttaccgttcccgtacgtaccgttcgaacctcgacgcgggcctggccaacggccgcgactacgcncgagcacnctagcggcagcgcgccncgcncgcgtgacagtctacgtcgtcgtcgtacgacgcgcgcgcgcgcgacgcgcgancg

SEQ ID NO: 275763 - DNA, 547 bp, Homo sapiens
  misc_feature: GYAE6OF02I98Z7.13.42.D09.1.454.CMB.1.raw
  modified_base (361)..(361): a, c, t, g, unknown or other
  misc_feature (361)..(361): n is a, c, g, or t
tcagtcacgtactacacgaccggtgctcgatttagacacatacgcagggaaaggggagagctgctcagttaggacccagagggaaccatggaaaccccagcgcagcttctcttcctcctgctactctggctcccagataccaccggagaaattgtgttgacgcagtctccaggcaccctgtctttgtctccagggaagagccaccctctcctgcagggccagtcagagtgttagcagcagctacttagcctggtaccagcagaaacctggccaggctcccaggctcctcatctagatgtattcaggacgaccactgacatcccagacaggttcagtggcagtgggtctagggacagacttnactctcaccatcgagcagacgtggacgtctagaagtagtttcgacgtagttgtatttacgtgtcgagtctaagtgttaggtagtctaccgaccgtcggtacgttcggaccgaacggaccgtaaggtaggtaactacgtaacgaacgtagtacggacgtcgacgactacgtactcggttactctacg

SEQ ID NO: 275764 - DNA, 518 bp, Homo sapiens
  misc_feature: GYAE6OF02IEYO9.13.42.D09.1.454.CMB.1.raw
  modified_base (200)..(200): a, c, t, g, unknown or other
  misc_feature (200)..(200): n is a, c, g, or t
  modified_base (354)..(354): a, c, t, g, unknown or other
  misc_feature (354)..(354): n is a, c, g, or t
tcagtcacgtactacacgaccggtgctcgatttagacacatacgcagggaaaggggagagctgctcagttaggacccagagggaaccatggaaaccccagcgcagcttctcttcctcctgctactctggctcccagataccaccggagaaattgtgttgacgcagtctccaggcaccctgtctttgtctccaggggaaanagccaccctctcctgcagggccagtcagagtgttagcagcagctacttagcctggtaccagcagaaacctggccaggctcccaggctcctcatctatggtgcatccagcagggccactggcatccagacaggttcagtgcagtggtctgggacngacttcactctcaccatcagcagactacggaacctgaacgtacttgtactactttatttctgtacactagtagtagtaggtacaccgttactacgttttcgccgtagggaccaagcgtggagagtcgaagacgtacgtggtacgcgtcgcaccatctgtcttcg

SEQ ID NO: 275765 - DNA, 406 bp, Homo sapiens
  misc_feature: GYAE6OF02JBYX9.13.42.D09.1.454.CMB.1.raw
  modified_base (397)..(406): a, c, t, g, unknown or other
  misc_feature (397)..(406): n is a, c, g, or t
tcagtcacgtactacacgaccggtgctcgatttagacacatacgcagggaaagggactggagtggattgggcttatcaatgccagtgggggcaccagctacaaccctccctcaagagccgcgtcaccatttcagtagacacgtccaagaaccagctctccctgaagctgagttctgtgaccgccgcagacacggccgtgtattactgtgcgcgacaggtggacgtctgggggccaaggggaccacggtcaccgtctccctcagcctccaccaagggcccatcggtcttccccctggccgccctgctccaggagcacctccgagagcacagcggccctgggctgcctggtcaaggctacttcctagtacgtgactgagcgggctggcaggcgcatagnnnnnnnnnn

SEQ ID NO: 275766 - DNA, 510 bp, Homo sapiens
  misc_feature: GYAE6OF02F7UTQ.13.42.D09.1.454.CMB.1.raw
  modified_base (476)..(476): a, c, t, g, unknown or other
  misc_feature (476)..(476): n is a, c, g, or t
  modified_base (480)..(510): a, c, t, g, unknown or other
  misc_feature (480)..(510): n is a, c, g, or t
tcagtcacgtactacacgaccggtgctcgatttagacacatacgcagggaaaggggctggagtggattggggaaatctatcatagtgggaccacctactacagcccgtccctcaatagtcgcgtcaccatgtcagtggacgagcccaagaaccagttctccctgagcctgacctctgtgaccgccgcggactcggccctatacttctgtgcgagagatcgagatgtgtcatcggcggggctacttttgatatcgtggggccaagggtcgatggtcatcgtctcttcagcctccaccaagggcccagtccggtccttcccccgtggccgcccctgcctccgaggcgccaccgtccgagacgcacaggccggccctggggcctcggcctgggtacgaaacggtaccttactttcccgtaaggtaccgtgaccttggacggccggggtctgggaccgtaaacgggccgacgaagtaggnacgnnnnnnnnnnnnnnnnnnnnnnnnnnnnnnn

SEQ ID NO: 275767 - DNA, 673 bp, Homo sapiens
  misc_feature: GYAE6OF02GD7MU.13.42.D09.1.454.CMB.1.raw
  modified_base (200)..(200): a, c, t, g, unknown or other
  misc_feature (200)..(200): n is a, c, g, or t
  modified_base (328)..(328): a, c, t, g, unknown or other
  misc_feature (328)..(328): n is a, c, g, or t
tcagtcacgtactacacgaccggtgctcgatttagacacatacgcagggaaaggggagagctgctcagttaggacccagagggaaccatggaaaccccagcgcagcttctcttcctcctgctactctggctcccagataccaccggagaaattgtgttgacgcagtctccaggcaccctgtctttgtctccaggggaaangccaccctctcctgcagggccagtcagagtgttagcagcagctactagcctggtaccagcagaacctggccaggctcccaggctcctcatctatggtcgcatccagcagggccagtgcatcccagacnggttcagtgcagtgggtctgggacagacttcgactctcaccatcacgcacgacgtcggacgtaccgtaggtaaacggttagtttttacggacgttaacggtttcgtttaaacgtttaaccgtttacggttccgtaacgggtaccttaaaggtttaacgttaacgggtttaaaccttaccggtaacccggttaccgggttaaccggtttaccgggtaacccgtaaaccggggtaaccggtaaacgggtacgggtaaaacggtaacggtaaaaccggtaaccggttaacgggttacggtacggttacggacctaaccgtacgttaccgttacgttaccgtttacccg

SEQ ID NO: 275768 - DNA, 628 bp, Homo sapiens
  misc_feature: GYAE6OF02IGREY.13.42.D09.1.454.CMB.1.raw
  modified_base (199)..(199): a, c, t, g, unknown or other
  misc_feature (199)..(199): n is a, c, g, or t
  modified_base (303)..(303): a, c, t, g, unknown or other
  misc_feature (303)..(303): n is a, c, g, or t
tcagtcacgtactacacgaccggtgctcgatttagacacatacgcagggaaaggggagagctgctcagttaggacccagagggaaccatggaaaccccagcgcagcttctcttcctcctgctactctggctcccagataccaccggagaaattgtgttgacgcagtctccaggcaccctgtctttgtctccaggggaanagccaccctctcctgcagggccagtcagagtgttagcagcagctacttagcctggtaccagcagaaacctggccaggcctcccaggcctacctcatctatggtncatccagcgacgggccacgttggcctacgtccccgaagaccgtaggttccaggtcggacgagggttcgggttcgtagggaccagtaccttcacttcctacaccatcagcagacgtcggacgtaccgtagaacgttcgttttacgactaggtttgttaatttacgtagtcaaggtactaaaggttaattaaacgtacgttcgggtacccttaccgtaactagttacgttaacttacggtttacggacccggtacggggtaaacctaaccggtaggtaaccgtacgtaccgacgggtaaccgtaacgttggacgtccgtagtacccg

SEQ ID NO: 275769 - DNA, 592 bp, Homo sapiens
  misc_feature: GYAE6OF02HIKNK.13.42.D09.1.454.CMB.1.raw
  modified_base (200)..(200): a, c, t, g, unknown or other
  misc_feature (200)..(200): n is a, c, g, or t
tcagtcacgtactacacgaccggtgctcgatttagacacatacgcagggaaaggggagagctgctcagttaggacccagagggaaccatggaaaccccagcgcagcttctcttcctcctgctactctggctcccagataccaccggagaaattgtgttgacgcagtctccaggcaccctgtctttgtctccaggggaaangccaccctctcctgcagggccagtcagagtgttagcagcagctacttagcctggtaccagcagaaacctggccacggcccccaggcctcctcatctacgatgtattcgaggacggaccactgacactcccagacaggttcagtggcagtgggtctgggacagacttcactctacacatcagcagtactaggtaacctgaacgtactttacgcttacttttatttctagttactaccgtagttacgtggttacgtaccgtaccgttactacgttttcggaccgtacggggacctaaggcgtggagtacgtacgacggtacggtaacgtggtacgggtctcggacctaaccgtagttccgttacggttcctttactaccgttccgttaccccgg

SEQ ID NO: 275770 - DNA, 548 bp, Homo sapiens
  misc_feature: GYAE6OF02F3IIY.13.42.D09.1.454.CMB.1.raw
  modified_base (200)..(200): a, c, t, g, unknown or other
  misc_feature (200)..(200): n is a, c, g, or t
  modified_base (375)..(375): a, c, t, g, unknown or other
  misc_feature (375)..(375): n is a, c, g, or t
tcagtcacgtactacacgaccggtgctcgatttagacacatacgcagggaaaggggagagctgctcagttaggacccagagggaaccatggaaaccccagcgcagcttctcttcctcctgctactctggctcccagataccaccggagaaattgtgttgacgcagtctccaggcaccctgtctttgtctccaggggaaangccaccctctcctgcagggccagtcagagtgttagcagcagctacttagcctggtaccagcagaacctggccaggctcccaggctcctcatctatggtgcatcccagcagggccacgtggcatcccagacaggttcagtggcaggtgggtctgggacagtacttcactctccacntcagcagacgtggacgcgtgaagtatttgctagtgttattacgtgtcagcagttagtggtagtctcgtaccgtcggtacggttcgaccgaacgggacctaagggtaggtaaacgtacgaaacggtaacgtacggttacggacgtacggacctaaccgacgttacgtagttacc

SEQ ID NO: 275771 - DNA, 604 bp, Homo sapiens
  misc_feature: GYAE6OF02GVQCB.13.42.D09.1.454.CMB.1.raw
tcagtcacgtactacacgaccggtgctcgatttagacacatacgcagggaaaggggagagctgctcagttaggacccagagggaaccatggaaaccccagcgcagcttctcttcctcctgctactctggctcccagataccaccggagaaattgtgttgacgcagtctccaggcaccctgtctttgtctccaggggaaagagccaccctctcctgcagggccagtcagagtgttagcagcagctacttagcctggtaccagcaagaaacctggaccaggctccccaggcctcctcatctatggtgcatccagccgacgggccacgtggctactccccagacaggttcagtcggctaggtgggtctggggacaggtaccttcactctccactactcgacgcgagacgtgggacgcctaggaagttcgtttgacgtagttagttacttacgtgtacagtctaggttagtaggtacgccttacgaccgttcgggtaccgttcgggacccgaacgggtacccgtaagggtaacggtaaacgtaaccgtaaaacggtaacggtaggttacggacgttacggaccgtaacctagttcccgttagttaccg

SEQ ID NO: 275772 - DNA, 411 bp, Homo sapiens
  misc_feature: GYAE6OF02GDAB3.13.42.D09.1.454.CMB.1.raw
  modified_base (305)..(305): a, c, t, g, unknown or other
  misc_feature (305)..(305): n is a, c, g, or t
  modified_base (331)..(331): a, c, t, g, unknown or other
  misc_feature (331)..(331): n is a, c, g, or t
  modified_base (406)..(411): a, c, t, g, unknown or other
  misc_feature (406)..(411): n is a, c, g, or t
tcagtcacgtactacacgaccggtgctcgatttagacacatacgcagggaaggggctggagtgggtggccaacataaacacagacggaagtgacccatactatgcggactctgtgaagggccgattcaccatctccagagacaacgccaagaactcactatatttgcaaatggaccgcctgagagacgaggacacggctatgtattactgtgcgagagatgagagtggctacagttggggccggggaaccctggtcaccgtcaactcagcctccaccaagggcccatcggtcttccccctggccnccctgctccaggagccacctccgagngcacagcggccctgggctgcctggtcaaggactacttcctagtacgtgactgagcgggctggcaaggcgcatagnnnnnn

SEQ ID NO: 275773 - DNA, 507 bp, Homo sapiens
  misc_feature: GYAE6OF02FJL0O.13.42.D09.1.454.CMB.1.raw
  modified_base (479)..(479): a, c, t, g, unknown or other
  misc_feature (479)..(479): n is a, c, g, or t
  modified_base (488)..(488): a, c, t, g, unknown or other
  misc_feature (488)..(488): n is a, c, g, or t
tcagtcacgtactacacgaccggtgctcgatttagacacatacgcagggaaaggggagagctgctcagttaggacccagagggaaccatggaaaccccagcgcagcttctcttcctcctgctactctggctcccagataccaccggagaaattgtgttgacgcagtctccaggcaccctgtctttgtctccaggggaaagagccaccctctcctgcagggccagtcagagtgttagcagcaactacttagcctggtaccagcagaagcctggccaggcccccaggctcctcatctacgatgtattcaggagaccactgacatcccagacaggttcagtggcagtgggtctgggacagacttcactctcaccatcagcagactggaacctgaagtactttgctactttattctgttcacctagtatggtagtcaccgttacacttttggctaggggaccagctggagatacagcgaatgnggctgcacntctgtcttcacttctcccg

SEQ ID NO: 275774 - DNA, 574 bp, Homo sapiens
  misc_feature: GYAE6OF02IWRUS.13.42.D09.1.454.CMB.1.raw
  modified_base (199)..(199): a, c, t, g, unknown or other
  misc_feature (199)..(199): n is a, c, g, or t
  modified_base (282)..(282): a, c, t, g, unknown or other
  misc_feature (282)..(282): n is a, c, g, or t
  modified_base (347)..(347): a, c, t, g, unknown or other
  misc_feature (347)..(347): n is a, c, g, or t
tcagtcacgtactacacgaccggtgctcgatttagacacatacgcagggaaaggggagagctgctcagttaggacccagagggaaccatggaaaccccagcgcagcttctcttcctcctgctactctggctcccagataccaccggagaaattgtgttgacgcagtctcaggcacctgtctttgtctccaggggaaagngccaccctctcctgcagggccagtcagagtgtagcagcagctatagcctggtaccagcagaacctggaccaggctccagctcncatctatgtgcatcagcagggccacgtggacactcccagtacaggttcagtcgctaggtgggtcnggacagtacttcactctccacatcgagcagactggacgccgtagaacgttagtttgacgtagttacgttaattacgtgtaccagtacgtagttagtggtacgccgttacgacccgttacggaccgtttccgggacctaacggggacctaacgggtacggtaaacttaaccgaaaccggtaagtcggttacggacgttacggaccgtaaccgtataccgttcgttacc

SEQ ID NO: 275775 - DNA, 154 bp, Homo sapiens
  misc_feature: GYAE6OF02FYW97.13.42.D09.1.454.CMB.1.raw
  modified_base (132)..(132): a, c, t, g, unknown or other
  misc_feature (132)..(132): n is a, c, g, or t
  modified_base (153)..(154): a, c, t, g, unknown or other
  misc_feature (153)..(154): n is a, c, g, or t
tcagtcacgtactacacgaccggtgctcgatttagacacatacgcagggaaagggaccaaggtggaaatcaaacgaactgtggctgcaccatctgtcttcatcttcccgccatctgatagtacgtgactgancgggctggcaaggcgcatagnn

SEQ ID NO: 275776 - DNA, 544 bp, Homo sapiens
  misc_feature: GYAE6OF02J3QTN.13.42.D09.1.454.CMB.1.raw
  modified_base (170)..(170): a, c, t, g, unknown or other
  misc_feature (170)..(170): n is a, c, g, or t
  modified_base (209)..(209): a, c, t, g, unknown or other
  misc_feature (209)..(209): n is a, c, g, or t
  modified_base (222)..(222): a, c, t, g, unknown or other
  misc_feature (222)..(222): n is a, c, g, or t
  modified_base (262)..(262): a, c, t, g, unknown or other
  misc_feature (262)..(262): n is a, c, g, or t
  modified_base (304)..(304): a, c, t, g, unknown or other
  misc_feature (304)..(304): n is a, c, g, or t
  modified_base (322)..(322): a, c, t, g, unknown or other
  misc_feature (322)..(322): n is a, c, g, or t
  modified_base (443)..(443): a, c, t, g, unknown or other
  misc_feature (443)..(443): n is a, c, g, or t
  modified_base (451)..(451): a, c, t, g, unknown or other
  misc_feature (451)..(451): n is a, c, g, or t
  modified_base (454)..(454): a, c, t, g, unknown or other
  misc_feature (454)..(454): n is a, c, g, or t
  modified_base (458)..(458): a, c, t, g, unknown or other
  misc_feature (458)..(458): n is a, c, g, or t
  modified_base (487)..(487): a, c, t, g, unknown or other
  misc_feature (487)..(487): n is a, c, g, or t
  modified_base (503)..(503): a, c, t, g, unknown or other
  misc_feature (503)..(503): n is a, c, g, or t
  modified_base (509)..(509): a, c, t, g, unknown or other
  misc_feature (509)..(509): n is a, c, g, or t
  modified_base (511)..(511): a, c, t, g, unknown or other
  misc_feature (511)..(511): n is a, c, g, or t
  modified_base (515)..(515): a, c, t, g, unknown or other
  misc_feature (515)..(515): n is a, c, g, or t
  modified_base (536)..(536): a, c, t, g, unknown or other
  misc_feature (536)..(536): n is a, c, g, or t
  modified_base (541)..(542): a, c, t, g, unknown or other
  misc_feature (541)..(542): n is a, c, g, or t
tcagtcacgtactacacgaccggtgctcgatttagacacatacgcagggaagggactggagtggattggcttatcaatgccagtggggcaccagctacaaccctcctcaagagccgcgtcaccatttcagtagacacgtacaagaccagctctcctagaagctgagttcngtcgaccgccgacagtaccacggtccgttagtacttacngtcgcgacgtagnggtcggacgtcgtcgggaccaacggccacggtcaccgtcncctgaccgcctaccgacgacggcctagtccgtcccttcccgngccaccctcacgaacgcnccgtacgtcggtacgggcacgcggccgtccgtcggcttcgccgtagacgacgtcctctacgagtacgtcgacgtggacggcggctacggacgaaggtccacgtagtacgcgcacttgcacncgacgcgncancgcncacgtacgcacgacgacgcgtacgcgacncgacgtactcgcacgngcgcgncncgcncgacgacacagacacgacgtncgtcnncg

SEQ ID NO: 275777 - DNA, 538 bp, Homo sapiens
  misc_feature: GYAE6OF02FIWUV.13.42.D09.1.454.CMB.1.raw
  modified_base (200)..(200): a, c, t, g, unknown or other
  misc_feature (200)..(200): n is a, c, g, or t
  modified_base (300)..(300): a, c, t, g, unknown or other
  misc_feature (300)..(300): n is a, c, g, or t
  modified_base (390)..(390): a, c, t, g, unknown or other
  misc_feature (390)..(390): n is a, c, g, or t
  modified_base (439)..(439): a, c, t, g, unknown or other
  misc_feature (439)..(439): n is a, c, g, or t
tcagtcacgtactacacgaccggtgctcgatttagacacatacgcagggaaaggggagagctgctcagttaggacccagagggaaccatggaaaccccagcgcagcttctcttcctcctgctactctggctcccagataccaccggagaaattgtgttgacgcagtctccaggcaccctgtctttgtctccaggggaaangccaccctctcctgcagggccagtcagagtgttagcagcagctacttagcctggtaccagcagaaacctggccaggctcccaggctcctcatctatggtncatccagcagggccactggcatcccagacaggttcagtggcaggtcgggtctggggacagacttcactctacaccatcagcagactggancctagaagtatttggactagtgtattacgtgtcagtctagtagtagtanctacacgtcgtacgttcgaccgaagggaccaagggtcgaaagtaccgaaacggtaacgttaggtacggactacggacctaaccgtacttcgtagtttcc

SEQ ID NO: 275778 - DNA, 606 bp, Homo sapiens
  misc_feature: GYAE6OF02GP3HV.13.42.D09.1.454.CMB.1.raw
  modified_base (199)..(199): a, c, t, g, unknown or other
  misc_feature (199)..(199): n is a, c, g, or t
  modified_base (299)..(299): a, c, t, g, unknown or other
  misc_feature (299)..(299): n is a, c, g, or t
  modified_base (349)..(349): a, c, t, g, unknown or other
  misc_feature (349)..(349): n is a, c, g, or t
  modified_base (356)..(356): a, c, t, g, unknown or other
  misc_feature (356)..(356): n is a, c, g, or t
  modified_base (367)..(367): a, c, t, g, unknown or other
  misc_feature (367)..(367): n is a, c, g, or t
  modified_base (371)..(371): a, c, t, g, unknown or other
  misc_feature (371)..(371): n is a, c, g, or t
tcagtcacgtactacacgaccggtgctcgatttagacacatacgcagggaaaggggagagctgctcagttaggacccagagggaaccatggaaaccccagcgcagcttctcttcctcctgctactctggctcccagataccaccggagaaattgtgttgacgcagtctccaggcaccctgtctttgctccaggggaaangccaccctctcctgcagggccagtcagagtgttagcagcagctacttagcctggtaccagcagaaacctggccaggctcccaggctcctcatctatggtncatccagcagggccactggcactcccagacaggttcaggtgcaggtgggntgggacngacttcactcncacntcagcagactggagcctaggaacgttattttgacgtaagtttagttatttacgtgtactagtacgtaacgttagttacggtacgtaccgttaccgtaaccggttccgggtaacgttaccgggaaccgaacggggtacccgtaaaggggtacggtaaaacggtaaccgtaaaaccggtaacggttacggtacggtacgttacggacccgtaacctacgttacggttacgttacccg

SEQ ID NO: 275779 - DNA, 696 bp, Homo sapiens
  misc_feature: GYAE6OF02IW70C.13.42.D09.1.454.CMB.1.raw
  modified_base (200)..(200): a, c, t, g, unknown or other
  misc_feature (200)..(200): n is a, c, g, or t
tcagtcacgtactacacgaccggtgctcgatttagacacatacgcagggaaaggggagagctgctcagttaggacccagagggaaccatggaaaccccagcgcagcttctcttcctcctgctactctggctcccagataccaccggagaaattgtgttgacgcagtctccaggcatcgtgtctttgtctccgaggggaangccacctctcctgcaggccagtcagattgcagcagccaactacttagcctggtaccagcagaacgccgtcggccacggccccccaggcctccctcatctacgattcgtattcgaggacggaccacgtacgacactcccaagacctaggttccaggtcggccgaaggttcggggtacttggggaactacggtaacctttacgaccttcctaccaaccctattcgaacgtaccgaacgtaaccgtacggtaaacccttaggaaacgttaccgtttaggtaccctttaacgtttttactttccgttagttaccctaaccgttaggttacgttgggttacggttacctaacccggttaccgttacgtttttcgggaacccgtacggggtaacctaacggtcgtacgggtacgtacgttacgaacggtcggtaaaccgttggtacgggaccgttacggacccgtaccgttacttccgtacgtttaccgttacttaaccccg

SEQ ID NO: 275780 - DNA, 501 bp, Homo sapiens
  misc_feature: GYAE6OF02F610O.13.42.D09.1.454.CMB.1.raw
tcagtcacgtactacacgaccggtgctcgatttagacacatacgcagggaaaggggagagctgctcagttaggacccagagggaaccatggaaaccccagcgcagcttctcttcctcctgctactctggctcccagataccaccggagaaattgtgttgacgcagtctccaggcaccctgtctttgtctccaggggaaagagccaccctctcctgcagggccagtcagagtgttagcagcagctacttagcctggtaccagcagaagcctggccaggcccccaggctcctcatctacgatgtattcaggaggaccactgacatcccagacaggttcagtggcagtgggtctgggacagacttcactctcaccatcagcagactggaacctgaagactttgctactttatttctgtcaccagtatggtagtcaccgtacacttttgcctagggaccaagctagagatcaagcgaactgtggctgcacatctgtcttcattcc

SEQ ID NO: 275781 - DNA, 644 bp, Homo sapiens
  misc_feature: GYAE6OF02J1HU6.13.42.D09.1.454.CMB.1.raw
  modified_base (195)..(195): a, c, t, g, unknown or other
  misc_feature (195)..(195): n is a, c, g, or t
  modified_base (287)..(287): a, c, t, g, unknown or other
  misc_feature (287)..(287): n is a, c, g, or t
  modified_base (310)..(310): a, c, t, g, unknown or other
  misc_feature (310)..(310): n is a, c, g, or t
tcagtcacgtactacacgaccggtgctcgatttagacacatacgcaggaaagggagagctgctcagttaggacccagagggaaccatggaaaccccagcgcagcttctcttcctcctgctactctgctcccagataccaccggagaaattgtgttgacgcagtctccaggcaccctgtctttgtctccagggaangccaccctctcctgcagggccaggtcagacgtgttagcagcagctacttagcctggtaccagcagaacctggaccaggcctccaggcctccnctatcctagcggtgcagtccagnacgggtccacgtggacactccgagacaggttccaggtgaccgtgtgggtactggggaacagtacctttccaccgttcgtccaacccgtataccacggacgacgtacgtcggaagtcccgtaaggaacgtttgtttcgactaggtttaacgttactttccgtagttccgaagtacgtaggttacgttacgggtacgttacctacccgttaccgttccgggtaacgtttacccggaccggtaaaccgggtacgaacgggttacgaaaccggttacgaaaaccggttaccggtagtacgggtactcgtaaccggcctaacggttaccgtcgttaccg

SEQ ID NO: 275782 - DNA, 523 bp, Homo sapiens
  misc_feature: GYAE6OF02IQH1O.13.42.D09.1.454.CMB.1.raw
  modified_base (200)..(200): a, c, t, g, unknown or other
  misc_feature (200)..(200): n is a, c, g, or t
  modified_base (299)..(299): a, c, t, g, unknown or other
  misc_feature (299)..(299): n is a, c, g, or t
  modified_base (440)..(440): a, c, t, g, unknown or other
  misc_feature (440)..(440): n is a, c, g, or t
tcagtcacgtactacacgaccggtgctcgatttagacacatacgcagggaaaggggagagctgctcagttaggacccagagggaaccatggaaaccccagcgcagcttctcttcctcctgctactctggctcccagataccaccggagaaattgtgttgacgcagtctccaggcaccctgtctttgtctccaggggaaangccaccctctcctgcagggccagtcagagtgttagcagcagctactagcctggtaccagcagaaacctggccaggctcccaggctcctcatctatggtncatccagcagggccacgtggcatcccagactaggtcagtggcaggtgggtctgggacagacttcactctcacctatcagacagactggacgcgtagaacgtagtttgctagtgttattactgtcagtcgtagtagtggtanctctacgtcggacgtcgcgaacggacgaaggtacggaactacaacgaacgtaggtcggtactacgaccacgtactcgtgttac

SEQ ID NO: 275783 - DNA, 540 bp, Homo sapiens
  misc_feature: GYAE6OF02I8QCI.13.42.D09.1.454.CMB.1.raw
  modified_base (199)..(199): a, c, t, g, unknown or other
  misc_feature (199)..(199): n is a, c, g, or t
  modified_base (379)..(379): a, c, t, g, unknown or other
  misc_feature (379)..(379): n is a, c, g, or t
  modified_base (390)..(390): a, c, t, g, unknown or other
  misc_feature (390)..(390): n is a, c, g, or t
  modified_base (439)..(439): a, c, t, g, unknown or other
  misc_feature (439)..(439): n is a, c, g, or t
tcagtcacgtactacacgaccggtgctcgatttagacacatacgcagggaaaggggagagctgctcagttaggacccagagggaaccatggaaaccccagcgcagcttctcttcctcctgctactctggctcccagataccaccggagaaattgtgttgacgcagtctccaggcaccctgtcttgtctccaggggaaanagccaccctctcctgcagggccagtcagagtgttagcagcagctacttagcctggtaccagcagaacctggccaggctccaggctcctcatctatggtgcatccagcaggggccacgtggccatcccagacaggttccagtggcaggtgggtctgggacagacttcactctcacatcacncagactggacncctagaagtatttgactagtgttattactgtcagctagttatggtacgntccaccgttcggtacgttcgacccgaagggtaccgaaggtaggaaactaacgaaacgaacgttcgtaggacgtagacccgtaccgacttccgtgttacccg

SEQ ID NO: 275784 - DNA, 474 bp, Homo sapiens
  misc_feature: GYAE6OF02F3TZM.13.42.D09.1.454.CMB.1.raw
  modified_base (441)..(441): a, c, t, g, unknown or other
  misc_feature (441)..(441): n is a, c, g, or t
  modified_base (443)..(446): a, c, t, g, unknown or other
  misc_feature (443)..(446): n is a, c, g, or t
  modified_base (448)..(474): a, c, t, g, unknown or other
  misc_feature (448)..(474): n is a, c, g, or t
tcagtcacgtactacacgaccggtgctcgatttagacacatacgcagggaaaggggctggagtggattggccatattaaggacagacctaatggcgcgacagcacactaccttgaatccgtcaaagacagattcatcatctcgagaggtgattccgacaacacggtgtctctccatatgagcagcctgaaaatcgaggacacaggcctatattactgtgcagtgatgggccacgaccacgacttttggagtggtgcgctcgacccctggggccccggaaccctggtcaccgtctcctcagcctccaccaacgggcccatcggtccttccccctggccaccctcctccaagacgcacctcgtggggcacagcggcctgggctgcctggtcaaggactacttccagtacgtgactgagcgggctggacaaggcgacagtacgncnnnncnnnnnnnnnnnnnnnnnnnnnnnnnnn

SEQ ID NO: 275785 - DNA, 602 bp, Homo sapiens
  misc_feature: GYAE6OF02F3V5K.13.42.D09.1.454.CMB.1.raw
  modified_base (200)..(200): a, c, t, g, unknown or other
  misc_feature (200)..(200): n is a, c, g, or t
  modified_base (303)..(303): a, c, t, g, unknown or other
  misc_feature (303)..(303): n is a, c, g, or t
tcagtcacgtactacacgaccggtgctcgatttagacacatacgcagggaaaggggagagctgctcagttaggacccagagggaaccatggaaaccccagcgcagcttctcttcctcctgctactctggctcccagataccaccggagaaattgtgttgacgcagtctccaggcaccctgtctttgtctccaggggaaanagccaccctctcctgcagggcccagtcagagtgttagcagcagctacttagcctggtaccagcaagaacctggccaggcctcccaggcctctcatctatggtncatccagcacgggccagtggcactcccaggacctaggttccaggtcggacaggttgggtcgtagggacaggtaccttccacttcgtccaaccgtatacgacgtcaacggacgtggacgccgtagtaagttacttttggactaggttgttaacttacgtgtcgagtcgtagttacgtggtacgctaccgtaccgtacggtacgttccggaccgaacgggtaccgtaagggtacgtaaagtaccgtaaacgtaacggtggtaccggtcgtacggacctaccgtacgttccgtacgtttccc

SEQ ID NO: 275786 - DNA, 554 bp, Homo sapiens
  misc_feature: GYAE6OF02GLTGP.13.42.D09.1.454.CMB.1.raw
  modified_base (200)..(200): a, c, t, g, unknown or other
  misc_feature (200)..(200): n is a, c, g, or t
  modified_base (301)..(301): a, c, t, g, unknown or other
  misc_feature (301)..(301): n is a, c, g, or t
tcagtcacgtactacacgaccggtgctcgatttagacacatacgcagggaaaggggagagctgctcagttaggacccagagggaaccatggaaaccccagcgcagcttctcttcctcctgctactctggctcccagataccaccggagaaattgtgttgacgcagtctccaggcaccctgtctttgtctccaggggaaangccaccctctcctgcagggccagtcagagtgttagcagcagctacttagcctggtaccagcagaaacctggccaggctcccgaggctcctcatctatggtncatccagcagggccagtggcactcccagacaggttcaggtgcaggtcgggtctgggacagtacttcactctcaacctatcagcagacgtcggagccgtagaagtagtttagcgtagtcgttattacgtgtacagtacgtagtagtacggtacgctacaccgtcggtacgttacggaccgaacgggtacgaaggtacggtaaacgtacgaacgtaacgtggtacggtacgtacgacctacgtacgtacgtgtac

SEQ ID NO: 275787 - DNA, 416 bp, Homo sapiens
  misc_feature: GYAE6OF02GPGP0.13.42.D09.1.454.CMB.1.raw
  modified_base (305)..(305): a, c, t, g, unknown or other
  misc_feature (305)..(305): n is a, c, g, or t
  modified_base (319)..(319): a, c, t, g, unknown or other
  misc_feature (319)..(319): n is a, c, g, or t
  modified_base (402)..(416): a, c, t, g, unknown or other
  misc_feature (402)..(416): n is a, c, g, or t
tcagtcacgtactacacgaccggtgctcgatttagacacatacgcagggaaaggggctggagtgggtggccaacataaacacagacggaagtgacccatactatgcggactctgtgaagggccgattcaccatctccagagacaacgccaagaactcactatatttgcaaatggaccgcctgagagacgaggacacggctatgtattactgtgcgagagatgagagtggctacaggttggggccggggaaccctggtcaccgtcaactcagcctccaccaaggcccatcggtcttccccctggcnccctgcctccaggngcacctcgagagcacagccgccctgggctgcctggtcaaggctacttctagtcgtgactgagcgggctggcaaggcgcatagnnnnnnnnnnnnnnn

SEQ ID NO: 275788 - DNA, 465 bp, Homo sapiens
  misc_feature: GYAE6OF02IE49E.13.42.D09.1.454.CMB.1.raw
  modified_base (453)..(465): a, c, t, g, unknown or other
  misc_feature (453)..(465): n is a, c, g, or t
tcagtcacgtactacacgaccggtgctcgatttagacacatacgcagggaaaggggctggagtggattggccatattaaggacagacctaatggcgcgacagcacactaccttgaatccgtcaaagacagattcatcatctcgagaggtgattccgacaacacggtgtctctccatatgagcagcctgaaaatcgaggacacaggcctatattactgtgcagtgatggccacgaccacgacttttggagtggtgcgctcgaccccgtggggccccggacccgtggtcaccgtcctcctcacgcctccaccaacgggcccatccggtccttccccctggccaccctcctaccaagacgccacctcgtcggggccacgacgccggcccgtgggctcgcctggtacaacggtactacttctacgtacgtgactgagcggctggcaaggcacatagnnnnnnnnnnnnn

SEQ ID NO: 275789 - DNA, 805 bp, Homo sapiens
  misc_feature: GYAE6OF02HPYYX.13.42.D09.1.454.CMB.1.raw
  modified_base (200)..(200): a, c, t, g, unknown or other
  misc_feature (200)..(200): n is a, c, g, or t
tcagtcacgtactacacgaccggtgctcgatttagacacatacgcagggaaaggggagagctgctcagttaggacccagacggaaccatggaagccccagcgcagcttctcttcctcctgctactctggctccagatactagtggagaaatagtgatgacgcagtctccagccaccctgtctgtgtctcgaggggaaagngccaccctctcctgcacgggccagtcacgacgtacgttagacaacgaacgtagccgtacggtaccagcaaggaaacgtcggaccacggcctacccgacggcctcctacacttccgtagttcggtcgccaaccgttcccgaacccggagggtacccctaacgttacgggtaccttaccccggaacggttaccccgggttacgacgggtcgggtaccgtacgggtttcggggttaccggaacggggtaactaccggtaacctttccaccgtttcccgtaaccgaacccgttacaccgtacggacgtacggtccctggtaacccgtacggttcgtaacgggtaaacgtttcggttttacgtaccgtttaagtttttaaccgttacttcggtaaccgaagttaaccgtaagtttaaacgttaaacgttaaccgggttcccggttaccccgttaacgttaacccgttaagtttacccggtttaaaccgtttacggttttacccgggaaccggaaccggggtaaccctaccgggtaaggtaaccgttaacgtaaccggtacggaaacgtttaccgtcggggtaccgtacggtaccgaccgttaacccttcg

SEQ ID NO: 275790 - DNA, 555 bp, Homo sapiens
  misc_feature: GYAE6OF02IWT3N.13.42.D09.1.454.CMB.1.raw
  modified_base (200)..(200): a, c, t, g, unknown or other
  misc_feature (200)..(200): n is a, c, g, or t
  modified_base (298)..(298): a, c, t, g, unknown or other
  misc_feature (298)..(298): n is a, c, g, or t
tcagtcacgtactacacgaccggtgctcgatttagacacatacgcagggaaaggggagagctgctcagttaggacccagagggaaccatggaaaccccagcgcagcttctcttcctcctgctactctggctcccagataccaccggagaaattgtgttgacgcagtctccaggcaccctgtctttgtctccaggggaaangccaccctctcctgcagggccagtcagagtgtagcagcagctactagcctggtaccagcagaacctggccaggctcccaggcctcctcatctatggtncatccagcgagggccacgtggcactcccagacctaggttcaggtcgcaggtggtctgggactagtacttcactccgtaccacgtatcgagcagacgtacggacgtcgtagtaagtactttgctagttgtattacgtagtcagtctagtagtgtacgtctacgaccgtacggtacgtccggaccgtaacggacgtaaggtacggaaactacgaaacggtaactaggtacgtcgtacgaccgacgtactcgtcgtaccg

SEQ ID NO: 275791 - DNA, 781 bp, Homo sapiens
  misc_feature: GYAE6OF02H6LSO.13.42.D09.1.454.CMB.1.raw
tcagtcacgtactacacgaccggtgctcgatttagacacatacgcagggaaagggggagagctgctcagttaggacccagagggaaccatggaaaccccagcgcagcttctcttcctcctgctactctggctcccagataccaccggagaaattgtgttgacgcagtctccaggcaccctgtctttgtctccaggggaagagccaccctctcctgcacgggccagtcagagtgttagcagcagctacttagcctggtaccagcaacgaaacctggccaggcctccccaggcctcctcactctacgtggtcgacacgtccagcgacgggacccacgtcgggcacgtaccccaaggaaccgacgggttcgaacggtcggcgtaagggttcggggtcggtacgggaacgacgtactttaccgaccttcctacctaacccgtattaccgacgacctaacggtacgtacgggtaacgtcccgttaggtaaacgtttacgtttttacggaccgttaaggtttaggtttaacgtttacctttacgggttacgaaccgttcggttaaaggttaacggtttcggggtaaacgttcccgtttacccggtaacccggtttacccggggtaccgggtttaacccgggaacccgggtaaaaccggggtacccggtaaaagggggtttaaaccgggaaaacgttaaccccggtaaaaacggtaaccggttacgggtacgggtaacccggttcggaacccgtacccgttaacgttcccgtttaccgggttaacccg

SEQ ID NO: 275792 - DNA, 553 bp, Homo sapiens
  misc_feature: GYAE6OF02FGY6Y.13.42.D09.1.454.CMB.1.raw
  modified_base (516)..(516): a, c, t, g, unknown or other
  misc_feature (516)..(516): n is a, c, g, or t
  modified_base (520)..(538): a, c, t, g, unknown or other
  misc_feature (520)..(538): n is a, c, g, or t
  modified_base (540)..(553): a, c, t, g, unknown or other
  misc_feature (540)..(553): n is a, c, g, or t
tcagtcacgtactacacgaccggtgctcgatttagacacatacgcagggaaaggcatacgcagggaaaggggctggagtgggtggccaacataaacacagacggaagtgacccatactatgcggactctgtgaagggccgattcaccatctccagagacaacgccaagaactcactatatttgcaaatggaccaacctgagagacgaggacacggctatgtattactgtgcagagatgagagtggctacgaggttggggcccggggaaccctggtcgaccgtcaacctcaagcctcccaccaacgggccccaagtccggtccttccccccgtggccgcccctggcctacccagggagcccacccgtccggagtacgaccacacggccggccccgtcggggactcggccctgggtaccaaacggggtaccttaacccgtttaccctaggtaccggttgaacccgttggaacggtaccgggggcttacggggaacaaggggcccgacaacgttaggcnacgnnnnnnnnnnnnnnnnnnnannnnnnnnnnnnnn

SEQ ID NO: 275793 - DNA, 554 bp, Homo sapiens
  misc_feature: GYAE6OF02GYR40.13.42.D09.1.454.CMB.1.raw
  modified_base (527)..(554): a, c, t, g, unknown or other
  misc_feature (527)..(554): n is a, c, g, or t
tcagtcacgtactacacgaccggtgctcgatttagacacatacgcagggaaagggggctggagtggattgggggaaatctatcatagtgggaccacctactacagcccgtccctcaatagtcgcgtcaccatgtcagtggacgagcccaagaaccagttctccctgagcctgacctctgtgaccgccgcggactcggccctatacttctgtgcgagagatcgagatgtgtcatcgcggggcacttttgatatcgtggggccaagggtcgagtggtcatcgtctcttcagcctccaccaacgggccccagtccggtcctttccccccgtgggccgtccccgtcgcctccgtacgggacgccacccgtcccggagacgaccacaggccggccccgtggggcctcggcccgtgggtaccgaaacgggtaccttaaccgtttcccgttaacggttaccggttaggaaccgttgggaacggtcccggggcgttaggggccgtaaacggggccgaccgaagtacggcgtcgannnnnnnnnnnnnnnnnnnnnnnnnnnn

SEQ ID NO: 275794 - DNA, 843 bp, Homo sapiens
  misc_feature: GYAE6OF02GVTGJ.13.42.D09.1.454.CMB.1.raw
  modified_base (204)..(204): a, c, t, g, unknown or other
  misc_feature (204)..(204): n is a, c, g, or t
tcagtcacgtactacacgaccggtgctcgatttagacacatacgcagggaaaggggagagctgctcagttaggacccagagggaaccatggaaaccccagcgcagcttctcttcctcctgctactctggctcccagataccaccggagaaattgtgttgacgcagtctccaggccaccctgttctttgcctccgaaggggaaangcccaccctctcctgcagggccagtcagagtgtagcagcagctacttagccttaggtaccagccgaaacgtaaccctcggacctacggccctaccccggaggtcccttccctaccgtaattaccgttagtcgggttacgaccctaccgtacccggacggaccggaccgggtaccctaccgtcgggtaccctaaccgtaccccgaacggtaccgtaaccggggtttcgacgggtccgggtacggtagggtttccgggggtccgtaacgggggtacctaacggttaccctttaccccgtaacttcccgtacccgtaaccgtactaccgaaccggtacggtaaccgtaaccggtacgggtaccgtaaccggttacggtaaagtttacgtttacggtacgttaacggtttaacgtttacgtttaaccggttcgtaaccgtacggtaacgttaaggttacgttaggtaccgttacccgtaccgttacccggttaccgggtaaccggttacccgggtaaccgtaaccggggtaacccggttaaggggtaacggttaaaactacccgggaaacgttaaccgggttaggtaacccgggtcgttaacccgacccgttaaccgttacggtttacttaacccggtttccg

SEQ ID NO: 275795 - DNA, 593 bp, Homo sapiens
  misc_feature: GYAE6OF02JKIDO.13.42.D09.1.454.CMB.1.raw
  modified_base (370)..(370): a, c, t, g, unknown or other
  misc_feature (370)..(370): n is a, c, g, or t
  modified_base (555)..(555): a, c, t, g, unknown or other
  misc_feature (555)..(555): n is a, c, g, or t
  modified_base (558)..(558): a, c, t, g, unknown or other
  misc_feature (558)..(558): n is a, c, g, or t
  modified_base (564)..(566): a, c, t, g, unknown or other
  misc_feature (564)..(566): n is a, c, g, or t
  modified_base (568)..(569): a, c, t, g, unknown or other
  misc_feature (568)..(569): n is a, c, g, or t
  modified_base (571)..(593): a, c, t, g, unknown or other
  misc_feature (571)..(593): n is a, c, g, or t
tcagtcacgtactacacgaccggtgctcgattttagacacatacgcagggaaaggggctggagtggattggccatattaaggacagacctaatggcgcgacagcacactaccttgaatccgtcaaagacagattcatcatctcgagaggtgattccgacaacacggtgtcctctccatatgagcagcctagaaaatcgaggacacaggctatattactgtgacagtgagtcgggaccacgaccacgtacgttttggagtggtgcgcctccgaccccggtcggggaccccggtaccgtcggtcctaccgtcctcccgtcaccgccctacccgacccgaacggcccacgtccggtcccttccccgcggcccncccctccctaccgaacgcgccctaccgtccggtcggggccaacggacggcccggtcccggtcgggtccgtcggtcccgtgggtaccgaacggtaccttaccgttacccgtaaggttccgtacggtaccgtcgggtccggtaccggggtcgtcgggtaccgaacgggccgtaacgtacgtacgcgngtnacgcgnnngnngnnnnnnnnnnnnnnnnnnnnnnn

SEQ ID NO: 275796 - DNA, 828 bp, Homo sapiens
  misc_feature: GYAE6OF02JU41N.13.42.D09.1.454.CMB.1.raw
  modified_base (749)..(749): a, c, t, g, unknown or other
  misc_feature (749)..(749): n is a, c, g, or t
  modified_base (753)..(753): a, c, t, g, unknown or other
  misc_feature (753)..(753): n is a, c, g, or t
  modified_base (814)..(814): a, c, t, g, unknown or other
  misc_feature (814)..(814): n is a, c, g, or t
tcagtcacgtactacacgaccggtgctcgatttagacacatacgcagggaaaggggctggagtggattggccatattaaggacagacctaatggcgcgacagcacactaccttgaactccgtcaaagacagacttcatcatctcgaggtaggtgattccgacaacgacggtgtctctcactatggacgcagcctagaaactcgacggaccacgacggtccctaattattaactggtcgacgtagttgatcgggacccaacgtaaccgacgttacgttttggaggttgtcggcgccgtccggaccccggtccgggggacccccggaacccgtcggtaccgtaccgtccgtaccctcgaaccggtccctaacccggtaacccggaaccgggtacccgtaaccggttcccggttccccctttccccccgggtacccggtaccccgtacccccctttacccttaaacccgaaaccggtacccctacccgttaaccccgggacccgtaacggaaccgaccgtaacccggtaacccggtccggggtaacccgggtcgtaaccggttcccgtaccggggttaccgttaccggtaaacccgggtaccccttttaacggttaacccggtttaccggttaccggtttaaacccgggtacggttaccgggttacggggtccggttaaccggggaaaccggtcccgggaaacgttacgaccgggtaaaccgtcggaccttggttacgcccgtaagtaccgngacncgtcgaggtgtcgtcgcgacgtacgtagtcgtcgtcgtcgtacgtagtaccggtcggtcgngacgtacgtcgtcg

SEQ ID NO: 275797 - DNA, 522 bp, Homo sapiens
  misc_feature: GYAE6OF02ITL28.13.42.D09.1.454.CMB.1.raw
  modified_base (200)..(200): a, c, t, g, unknown or other
  misc_feature (200)..(200): n is a, c, g, or t
  modified_base (348)..(348): a, c, t, g, unknown or other
  misc_feature (348)..(348): n is a, c, g, or t
  modified_base (354)..(354): a, c, t, g, unknown or other
  misc_feature (354)..(354): n is a, c, g, or t
  modified_base (425)..(425): a, c, t, g, unknown or other
  misc_feature (425)..(425): n is a, c, g, or t
  modified_base (433)..(433): a, c, t, g, unknown or other
  misc_feature (433)..(433): n is a, c, g, or t
  modified_base (517)..(517): a, c, t, g, unknown or other
  misc_feature (517)..(517): n is a, c, g, or t
tcagtcacgtactacacgaccggtgctcgatttagacacatacgcagggaaaggggagagctgctcagttaggacccagagggaaccatggaaaccccagcgcagcttctcttcctcctgctactctggctcccagataccaccggagaaattgtgttgacgcagtctccaggcaccctgtctttgtctccaggggaaangccaccctctcctgcagggccagtcagagtgtagcagcagctatagcctggtaccagcagaacctggccaggctcccaggctcctacatctagtggtgcatccagcagggccatggccatcccagacaggttcagtgctaggtggtcngggacngtactcactcaccactatacacgacgagacgtaggacgccgtagaagtactttgacttacttttacttctntacgtacngttagtggtacgtcactatacttcgtttcgacgtacggactagcgtaggagtactacgacgtacgacgtgtcgctgacctactntctcg

SEQ ID NO: 275798 - DNA, 739 bp, Homo sapiens
  misc_feature: GYAE6OF02JRS5A.13.42.D09.1.454.CMB.1.raw
  modified_base (193)..(193): a, c, t, g, unknown or other
  misc_feature (193)..(193): n is a, c, g, or t
  modified_base (245)..(245): a, c, t, g, unknown or other
  misc_feature (245)..(245): n is a, c, g, or t
  modified_base (292)..(292): a, c, t, g, unknown or other
  misc_feature (292)..(292): n is a, c, g, or t
  modified_base (328)..(328): a, c, t, g, unknown or other
  misc_feature (328)..(328): n is a, c, g, or t
  modified_base (408)..(408): a, c, t, g, unknown or other
  misc_feature (408)..(408): n is a, c, g, or t
  modified_base (587)..(587): a, c, t, g, unknown or other
  misc_feature (587)..(587): n is a, c, g, or t
  modified_base (597)..(597): a, c, t, g, unknown or other
  misc_feature (597)..(597): n is a, c, g, or t
tcagtcacgtactacacgaccggtgctcgatttagacacatacgcagggaaaggggagagctgctcagttaggacccagagggaaccatggaaaccccagcgcagcttctcgttcctctgctactctggctccagataccacggagaattgtgttagacgcagtctcgagcacctgtcttcgctcgagggaancgccacctctccgtgacgacgggccagtcgagtagttcgttacgcgacgccnggtacctaacgttcgccgtacggtaccacggcgaacgtaaacccggnggtaccgagttacccgaccgtacggtcctaccggtnacgttctaggttcgtcgctacgtccgacggacggtacggccctagtacggtcctaccgtaccgacgtacgtcggtaccgnggttagcgaggttcgggacgttaggacgtaaccgtccgttactcgttaccgtaccaacccggtataccggaacgtacgtacggtacgtacggacgttaccggtaataaacgggtttcttaacggtaggttacgtttaacgttaacgttccgttaacacggtacggttacttaacgggtntaaccgggtntacccggttacgtacccgttggtaaccggttccggtaacgttaaccgggaccgttaaacggtaacgtaccggttaaaccgacggtaacgtacgggttcgtaaccggttacgacccgttagttaccgtagttcccgttaaccg

SEQ ID NO: 275799 - DNA, 523 bp, Homo sapiens
  misc_feature: GYAE6OF01D1BT3.36.36.D03.1.454.CMB.1.raw
  modified_base (324)..(324): a, c, t, g, unknown or other
  misc_feature (324)..(324): n is a, c, g, or t
tcagtacgctgtctcacgaccggtgctcgatttagctgcgtcacgatctctcttgggggggtctcaggaggcagcgctctcaggacatctccaccatggcctgggctctgctgctcctcaccctcctcactcagggcacagggtcctgggcccagtctgccctgactcagcctgcgtccgtgtctgggtctcctggacagtcgatcaccatctcctgcactggaaccagcagtgactttggtggtaacaatcatgtctcctggtaccaacagtacccaggcaaagccccaaactcatcatttttgacgtcggtagtcggccctnaggaatttcaatcgcttctctggctccaagtctgccaacacggcctccctgaccatctctgggctccagcctgaggacgaggctgattattactgttcctcactattcaagccggtagtacttggtctttcgggcgggtccggacccacgtcgaccgtccgtaggtccagcccgaaggcctcgccccctggtcctaccg

SEQ ID NO: 275800 - DNA, 513 bp, Homo sapiens
  misc_feature: GYAE6OF01CFKN6.36.36.D03.1.454.CMB.1.raw
  modified_base (409)..(409): a, c, t, g, unknown or other
  misc_feature (409)..(409): n is a, c, g, or t
tcagtacgctgtctcacgaccggtgctcgatttagctgcgtcacgatctctcttgggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctcctgcactggaaccagcagtgacgttggtgcttaataattatgtctcctggttccaacagcattcaggcagccgacccgaaactcttaatttatgtacgttctttcgtcggtccctcgtaggggtttctagtcgtcttctccggctcagtctgcaacacggcctccctgaccatctctagactcaggctgagacgngctgactattattgcaagctactatatactgaagtcaattggtatccagtcggtcttggttccggacggtagggacctaaggttcgaccgtctggtctaaccgg

SEQ ID NO: 275801 - DNA, 772 bp, Homo sapiens
  misc_feature: GYAE6OF01DFI0D.36.36.D03.1.454.CMB.1.raw
tcagtacgctgtctcacgaccggtgctcgatttagctgcgtcacgatctctcttgggggccctgggattttcaggtgttttcatttggtgatcaggactgaacagagagaactcaccatggagtttgggctgaactggctttttcttgtggctattttaaaaggtgtccagtgtggaggtgcagctggttgggaggggtcggggggaggtcgttggtaacacggccgggtcggggggtccctaggacgtactccttccgtggtcgacacgtcccttcgtggtactttccttaccgtttacgacctaaccttatccgaccctaagtggaacgtcggttcggggtcccgaccgagggccctacccggaagggggaaacgggtacgtaggggtagggttcggggttcctacacttcctaagtttaggttcggtacgaccggtactttacaactaacacttaccttcgacaacggtaccttccgggtaaggaaccggggtcccgttaccaacctagtcgtaccaagacgaactaacttaccgaaacgaaccaacaacgaagtaacttcgtacgaactaaagtacgaaacacgtacccgtaggaacggacggaccggaaacggaccggaacccgggtccgttacgtttactttcgtggtacgaacgtaaacgttaccgtttaggttacggtttaaccggttagtaggtaggtttaacggggaaacggggggtcgtaacgttacggtacggggaccgtaagggtacgttccggtacgg

SEQ ID NO: 275802 - DNA, 517 bp, Homo sapiens
  misc_feature: GYAE6OF01BM5XE.36.36.D03.1.454.CMB.1.raw
tcagtacgctgtctcacgaccggtgctcgatttagctgcgtcacgatctctcttgggggggtctcaggaggcagcgctctcaggacatctccaccatggcctgggctctgctgctcctcaccctcctcactcagggcacagggtcctgggcccagtctgccctgactcagcctgcgtccgtgtctgggtctcctggacagtcgatcaccatctcctgcactggaaccagcagtgactttggtggtaacaatcatgtctcctggtaccaacagtacccaggcaaacgcccccaaactcatcatttttgacgtcggtagtcggccctcaggaatttctaatcgcttctctggctccaagtctgccaacacggcctcctgaccatctctgggctccagcctgaggacgaggctgattattactgttcctcactattcaagccgagtacgttggcttttcggcgggcgacccacgtcgaccgtcgtcggtcagcccaaggcctcgccccctggtcctaccg

SEQ ID NO: 275803 - DNA, 663 bp, Homo sapiens
  misc_feature: GYAE6OF01B0MFO.36.36.D03.1.454.CMB.1.raw
tcagtacgctgtctcacgaccggtgctcgatttagctgcgtcacgatctctcgttgggggggtctcaggaggcagcgctctcaggacatctccaccatggcctgggctctgctgctcctcaccctcctcactcagggcacagggtcctgggcccagtctgccctgactcagcctgcgtccgtgtctgggtctcctggacagtcgatcacatctcctgcactggaaccagcagtgtactttggtagtaacaatcatgtctcctggtaccaacagtacccaggacaaacgccccaaactcatctattttcgacgtcggtacgtcggcctgagtatttctaatcgtcttctctcggctacctaagtcctacgaccctaaaccgaccggtccccttacccgtacgaaccctacttcccgttccgtcggggtcccttacccgacggtcccgtaggaacgggtaacggaacgggtccgttaggtaacttttacgtttaacgttccgtttaccctacctaaccttacgtttaccgaacggtacccggtaagttaaccgtttcggtccggttttcggggccgggttaccggacccctaccggtcggtacccgttcgtacggtccacggtacccgtaacggccctacccggtcccccgttcggtcctacccg

SEQ ID NO: 275804 - DNA, 775 bp, Homo sapiens
  misc_feature: GYAE6OF01DF5DU.36.36.D03.1.454.CMB.1.raw
tcagtacgctgtctcacgaccggtgctcgatttagctgcgtcacgatctctcgttgggggggtctcaggaggcagcgctctcaggacatctccaccatggcctgggctctgctgctcctcaccctcctcactcagggcacagggtcctgggcccagtctgccctgactcagcctgcgtccgtgtctgggtctcctggacagtcgatcaccatctcctgcactggaaccagcagtgtactttggtagtaactaatctatcgtcctacctacggtacccaaacacggtaacccgacggaccaaaccgtacccccaaactctacttactagtttttacgaccggttcggtaacggtccggtacccttagtaacggtaacttttactaacgttccgtctttcctccgtacggtcctaacccgaacgttccgtacgaccccaaaccgtacccggtcccttacccgtacgaacctacgttccgtcgtcggggtccctaccgacggtccgtaggacgggtacgtacggtacttagttaactttacgtttaacgttcgttaccctaacgtaacgttaaccgttaccggtaaaaccgggttcccggttaacggtttaccggttaccggggtttccccggttttacccgggggacccggggttaccccggtaaacccccgtacccggttaccgggtaaccccgttccggtaaccgggtaccgaacccggtaccccggtaaccggtcccgttaccccggtcccccgttccggtcccttaaccccgg

SEQ ID NO: 275805 - DNA, 678 bp, Homo sapiens
  misc_feature: GYAE6OF01CN07J.36.36.D03.1.454.CMB.1.raw
  modified_base (372)..(372): a, c, t, g, unknown or other
  misc_feature (372)..(372): n is a, c, g, or t
tcagtacgctgtctcacgaccggtgctcgatttagctgcgtcacgatctctcttgggggggtctcaggaggcagcgctctcaggacatctccaccatggcctgggctctgctgctcctcaccctctcactcagggcacagggtcctgggcccagtctgccctgactcagcctgcgtccgtgtctgggtctcctggacagtcgatcaccatctcctgcactggaaccagcagtgactttggtaggtaacaatcatgtctctaggtaccaacagtacccaggacaaacgccccaaactcatctattttgacgttcggtagtcgcctagaggtaatttctaatcgtcttctctggctactaagtctagaccaacnccggccttccctacgacctattcctcgtcgggcccttccgacgtccgtaggacggacgtacggtccgtaggtaacttttaacgttaccgttacgtttaccctacctaacgttactttaccgaaacggttcccgggttaagttaacccggtttcgggttaccgtttttccgggggcccgggtacccgggtaaccccctaacccggtccgggtaaccccggtttcccggttaacgggttacccgaaaccggtaccccgtaaacgggtccctacccgggtcccccccgttacgggtccccttaaccccg

SEQ ID NO: 275806 - DNA, 569 bp, Homo sapiens
  misc_feature: GYAE6OF01D1MWS.36.36.D03.1.454.CMB.1.raw
  modified_base (324)..(324): a, c, t, g, unknown or other
  misc_feature (324)..(324): n is a, c, g, or t
tcagtacgctgtctcacgaccggtgctcgatttagctgcgtcacgatctctcttggggggggtctcaggaggcagcgctctcaggacatctccaccatggcctgggctctgctgctcctcaccctcctcactcagggcacagggtcctgggcccagtctgccctgactcagcctgcgtccgtgtctgggtctcctggacagtcgatcaccatctcctgcactggaaccagcagtgactttggtggtaacaatcatgtctctggtaccaacagtacccaggcaaacgccccaaactcatctatttttgacgtcggtagtcgcctnagtaatttctaatcgcttctctggctccaagtctgaccaacaccggcctccctcgaccatctctcgggctccgagcctgaggacgacggtctagtatttattacttcgttcctactactattacgaacgtccggtagttacgttcggtacgttttccgggccgggtccggaccccgtaccgtcggtacccgttccgtacgggtccacggccccgtaaggcctaccgcccccgtcggtcctacccg

SEQ ID NO: 275807 - DNA, 512 bp, Homo sapiens
  misc_feature: GYAE6OF01ARDGP.36.36.D03.1.454.CMB.1.raw
  modified_base (365)..(365): a, c, t, g, unknown or other
  misc_feature (365)..(365): n is a, c, g, or t
tcagtacgctgtctcacgaccggtgctcgatttagctgcgtcacgatctctcttgggggggtctcaggaggcagcgctctcaggacatctccaccatggcctgggctctgctgctcctcaccctcctcactcagggcacagggtcctgggcccagtctgccctgactcagcctgcgtccgtgtctgggtctcctggacagtcgatcaccatctcctgcactggaaccagcagtgacgttggtgcttataattatgtctcctggttccaacagcattcaggcagcgcccgaaactcttaatttatgaggttctttcgtcggccctcagggtttctagtcgcttctccggctccaagtctggcaacncggccctcctgaccatctctagactccaggctgaggacgagctgactattattgcagctcatatactgaagtcaatggtatccacgtggtctggttcgggcggacgggacctaaggttcgaccgtaccgtaggtccaggtaccccgg

SEQ ID NO: 275808 - DNA, 679 bp, Homo sapiens
  misc_feature: GYAE6OF01D26MH.36.36.D03.1.454.CMB.1.raw
  modified_base (233)..(233): a, c, t, g, unknown or other
  misc_feature (233)..(233): n is a, c, g, or t
  modified_base (330)..(330): a, c, t, g, unknown or other
  misc_feature (330)..(330): n is a, c, g, or t
tcagtacgctgtctcacgaccggtgctcgatttagctgcgtcacgagtctctcgttgggggggtctcaggaggcagcgctctcaggacatctccaccatggcctgggctctgctgctcctcaccctcctcactcgagggcacagggtcctgggcccagtctgccctgactcagcctgcgtccgtgtctgggtctcctggacagtcgatcaccatcctcctagcactggaaccngcagtgtacttggtagtaacatcatgtctcctggtaccaacacgtacccaggacaaacgcccaactcatctattttcgacgttcggtagtcgcctanagtaacttctaatcgtacttctacgtcgcctcaagtctcgtaccaaccgtaccgccttacccgtcgacctacttccgtacgtcggacccttaccgaacggtccgtaggaaccggtacgtacggtcttaggtaactttactttacgttcgttaccctacgtaaccttacgttaccgtaacggttacccggtaagtttaccggtttcggttaccggttttccggggaccgggtcccggtaaaccccgttcccgttaccggggtaaccccttaccgggttaccggtacccgtaaccggtaccccgtaaacggtcccgttacccggtccccccgttcggtcccgttaccccgg

SEQ ID NO: 275809 - DNA, 583 bp, Homo sapiens
  misc_feature: GYAE6OF01BI6OE.36.36.D03.1.454.CMB.1.raw
tcagtacgctgtctcacgaccggtgctcgatttagctgcgtcacgatctctcttgggggggtctcaggaggcagcgctctcaggacatctccaccatggcctgggctctgctgctcctcaccctcctcactcagggcacagggtcctgggcccagtctgccctgactcagcctgcgtccgtgtctgggtctcctggacagtcgatcaccatctcctgcactggaaccagcagtgactttggtaggtaacaatcatgtctctggtaccaacagtacccaggcaacgccccaaatcatcattttgacgtcggtagtcggcctcaggtaattctaatcgcttctctggctccaagtctcgaccaacacggtcctccctacgaccctactccttcgtcggggtcctcccgacgcctggacggaacgacggacgttgtatttagtttaacttcgttcctcgtaactattacaacggtccgtacgttacgttcggtacgttttcgggcgggtccggaccccgtaccgtcgtacccgtccgttaggtaccaggaccccgtacggcctaccgcccccgtcggtcctacccg

SEQ ID NO: 275810 - DNA, 692 bp, Homo sapiens
  misc_feature: GYAE6OF01CUHOH.36.36.D03.1.454.CMB.1.raw
  modified_base (255)..(255): a, c, t, g, unknown or other
  misc_feature (255)..(255): n is a, c, g, or t
tcagtacgctgtctcacgaccggtgctcgatttagctgcgtcacgatctctcgttgggggggtctcaggaggcagcgctctcaggacatctccaccatggcctgggctctgctgctcctcaccctcctcactcagggcacagggtcctgggcccagtctgccctgactcagcctgcgtccgtgtctgggtctcctggacagtcgatcaccatctcctgcactggaaccagcagtgactttggtgtaacaatcatntctctggtaccaacagtacccaggacaaacgaccccaaactcatctattttcgacgtcggtagtcggcctcaggtaatttctaatccgtacttctcgtggtctccaagtctacgaccaacgaccggccctccctagaccctactccgttcgtcggggaccttccgaacgtcccgtaggacgggaccggtagggtcccttaggtacttttaacgtttaacgttcgtttacccgttacctaaccgttaacgttttaccgaaaccgggtacccggttaaggttttaacccgtttgggttacccgtttttccggggcccggggtaccccgggtaacccgtaccccgttacggtaccccggtaccggtttaacgggacccgtaccggacccgtaaccgggtacccgttcccggtaccccccgtccgggttcccttaccccgg

SEQ ID NO: 275811 - DNA, 737 bp, Homo sapiens
  misc_feature: GYAE6OF01CLDG9.36.36.D03.1.454.CMB.1.raw
tcagtacgctgtctcacgaccggtgctcgatttagctgcgtcacgatctctcgttggggggggtctcaggaggcagcgctctcaggacatctccaccatggcctgggctctgctgctcctcaccctcctcactcagggcacagggtcctgggcccagtctgccctgactcagcctgcgtccgtgtctgggtctccgtggacagtcgatcaccatctcctgcactggaaccagctagtgtactttggtagtaacatcattcgtctccgtacggtaccaacacgtaacccaggaccaaacgccccaaatcatctagtttttcgacgttcggtacgtccggaccctagaagttactttactactcgtacttctcgtcgtcctactaagtctacgacctaaccgtacccggtcccttaccgtacgtaacctctccgttacgtccgggtcctaccgtacgtccgtaggacgggacggtaggtacgttaggttaacttttaacgttaccttacgtttaccctactaaccgttaacgttaaccgaaccgggttaccggttaacgtttacggtttcgggtttacccggtttccggggtacccggggtacccggttaaccccgtacccgggttaccggttaaccccggttacggttaacccgggttacccgaacccggtaccccggttaaaccggtccccgttaccccggttaccccccggttccgggttacccctttaaccccgg

SEQ ID NO: 275812 - DNA, 615 bp, Homo sapiens
  misc_feature: GYAE6OF01CVPVU.36.36.D03.1.454.CMB.1.raw
tcagtacgctgtctcacgaccggtgctcgatttagctgcgtcacgatctctcttgggggggtctcaggaggccagcgctctcaggacatctccaccatggcctgggctctgctgctcctcaccctctcactcagggcacagggtcctgggccctagtctgccctgactcagcctgccgtccgtgtctgggtctcctggacagtcgatcgaccatctcctgcactggaaccagcagtgactttgagtaacaatcatgtctctggtaccaacagtacccaggaccaaaacgccccaaactcactctatttttcgacgtcggtagtcgcctacgaggtaatttctaaatcgtcttctctggtctcaagtctgaccaagccggctccctgacctatcctacgtgggcctccagcctaggaacgcggagtctgtaactttacttaacgtcgttacctacaccttacttacgaaacgtccggtaacgttacgttcgggttaccgttttcgggccggtccggtaacccctaccggttcggaaccccggttcggtaacggttccgaacccggacccgtaaaccgggtccttacccggtccccccggtcggttccccgtacccg

SEQ ID NO: 275813 - DNA, 570 bp, Homo sapiens
  misc_feature: GYAE6OF01BLTMB.36.36.D03.1.454.CMB.1.raw
  modified_base (324)..(324): a, c, t, g, unknown or other
  misc_feature (324)..(324): n is a, c, g, or t
tcagtacgctgtctcacgaccggtgctcgatttagctgcgtcacgatctctcttggggggggtctcaggaggcagcgctctcaggacatctccaccatggcctgggctctgctgctcctcaccctcctcactcagggcacagggtcctgggcccagtctgccctgactcagcctgcgtccgtgtctgggtctcctggacagtcgatcaccatctcctgccactggaaccagcagtgactttggtggtaacaatcatgtctcctggtaccaacacgtacccaggcaaacgccccaaactcatcattttgacgtcgtagtcgcctnaggtaattctaatcgcttctctggctccaagtctgccaacgacgcctcctgaccatctctggcctccagtcctggaggacgaggctagatttacttactcgttcctacactacttacgaacgtccggtaagttacgttggtccgttttcgggccggggtaccgtaccccgtacccgtcggtacccggttcccgtacggtcccgacggaccctaacgggcctaccgccccccttcggtccctacccg

SEQ ID NO: 275814 - DNA, 682 bp, Homo sapiens
  misc_feature: GYAE6OF01D3PLI.36.36.D03.1.454.CMB.1.raw
tcagtacgctgtctcacgaccggtgctcgatttagctgcgtcacgatctctcgttggggggggtctcaggaggcagcgctctcaggacatctccaccatggcctgggctctgctgctcctcaccctcctcactcagggcacgagggtcctgggccccagtctcgccctgactcagcctgcgtccgtgtctgggtctcctggacagtcgatcaccatcctcctgcacgtaggaaccagcagtgtacgttggtagttaattaatttgtactccgtaggtaccaacagccgaccggacaactaccgaaccccaaaatccatagtatttagtagtagtacaagtaaacgtccgtaccgttcggtacgggtttctgtactcgtacgtttctccgtcggtcctaccgtaacgtcgtacggaccgaccgtaccggtaccccttcccgtaccgacctacgttccgttaccggtcgggtccctccggacgtccgtagggacgggtaccgtacgggtcttagtaactttaacttacgcggtacacggtacttacgtaattaactaaccgtaagtacgacgtacgacgttaccttccggttacgttaccggttacgggtaacgttaccgggaaacccgtaacggtccgtaacttaccggtaccgttacggtaccgaacccggtaaacccccgg

SEQ ID NO: 275815 - DNA, 576 bp, Homo sapiens
  misc_feature: GYAE6OF01C6OB7.36.36.D03.1.454.CMB.1.raw
  modified_base (196)..(196): a, c, t, g, unknown or other
  misc_feature (196)..(196): n is a, c, g, or t
  modified_base (212)..(212): a, c, t, g, unknown or other
  misc_feature (212)..(212): n is a, c, g, or t
  modified_base (228)..(228): a, c, t, g, unknown or other
  misc_feature (228)..(228): n is a, c, g, or t
  modified_base (241)..(241): a, c, t, g, unknown or other
  misc_feature (241)..(241): n is a, c, g, or t
  modified_base (261)..(261): a, c, t, g, unknown or other
  misc_feature (261)..(261): n is a, c, g, or t
  modified_base (282)..(282): a, c, t, g, unknown or other
  misc_feature (282)..(282): n is a, c, g, or t
  modified_base (327)..(327): a, c, t, g, unknown or other
  misc_feature (327)..(327): n is a, c, g, or t
  modified_base (341)..(341): a, c, t, g, unknown or other
  misc_feature (341)..(341): n is a, c, g, or t
tcagtacgctgtctcacgaccggtgctcgatttagctgcgtcacgatctctcgttgggggggtctcaggaggcagcgctctcaggacatctccaccatggcctgggctctgctgctcctcaccctctcactcagggcacgagggtcctgggcccagtctgccctgactcagcctgccgtccgtgtctgggtctcgnggacagtcgatcaccntctctgcatggaaccngcagtgacgttgntctatatatgtctctgtcangcatcagcagccgaccgaatnttaattatgtagttcttcgccgtcctgagggtttcagtcgcttcnccgctacgagtcgngacaacgcgtcctcctgacctatcctctacgacttccgaggtcgtagaacggacggagtcgtagtaacttatttgtcgacagtccgtactaagtaataccgttagtaagtactaaggtacgttacacccgtaagttcgggtcgttcgggttaccggccggggtaacgggttaaccctaacgggtttcccggtaacccggtacccggtttacggtccgaacccgggttaaccccgg

SEQ ID NO: 275816 - DNA, 592 bp, Homo sapiens
  misc_feature: GYAE6OF01BX8H9.36.36.D03.1.454.CMB.1.raw
  modified_base (229)..(229): a, c, t, g, unknown or other
  misc_feature (229)..(229): n is a, c, g, or t
tcagtacgctgtctcacgaccggtgctcgatttagctgcgtcacgatctctcttggggggggtctcaggaggcagcgctctcaggacatctccaccatggcctgggttctgctgctcctcaccctcctcactcagggcacagggtcctgggcccagtctgccctgactcagcctgcgtccgtgtctgggtctcctggacagtcgatcaccatctcctgcactggaaccngcagtgactttggtggtaacaatcatgtctctggtaccaacacgtacccaggcaaacgcccccaaactcatctattttgacgtcggtagtccggcctcgaggtaatttctaatcgcttctctggctccaagtctcgccaacaccggccctccctcgacctatcctctcgggcctccagcctggacggacgaggctgtatttattacttcgttcctcactattccgaacgtccggtagttacgttgggttccgttttccgggccggggtccgacccgtacccgtcggtacccggttccgtacggttccacggtaccccgaagggtccctcccggtaccccccgtcggtcctacccgtttccccg

SEQ ID NO: 275817 - DNA, 544 bp, Homo sapiens
  misc_feature: GYAE6OF01BH27W.36.36.D03.1.454.CMB.1.raw
  modified_base (326)..(326): a, c, t, g, unknown or other
  misc_feature (326)..(326): n is a, c, g, or t
tcagtacgctgtctcacgaccggtgctcgatttagctgcgtcacgatctctcttgggggggtctcaggaggcagcgctctcaggacatctccaccatggcctgggctctgctgctcctcaccctcctcactcagggcacagggtcctgggcccagtctgccctgactcagcctgcgtccgtgtctgggtctcctggacagtcgatcaccatctcctgcactggaaccagcagtgactttggtggtaacaatcatgtctcctggtaccaacagtacccaggcaaaacgcccccaaaatcatcatttttgacgtcggtagtcggcctnaggaatttctaatcgcttctctgctccaagtctgccaaacaccggccctccctgacctactctcgtcgggcctccacgtccgtgagggacgaggctgtatttatttactgttcctcgactattacaagccgtagttacgttggtcttttcgggcgggccggaccctaccgtcgacccgtccgtggtccagacccgaggcctcgcccccgtgtctaccg

SEQ ID NO: 275818 - DNA, 765 bp, Homo sapiens
  misc_feature: GYAE6OF01AEFL9.36.36.D03.1.454.CMB.1.raw
  modified_base (354)..(354): a, c, t, g, unknown or other
  misc_feature (354)..(354): n is a, c, g, or t
tcagtacgctgtctcacgaccggtgctcgatttagctgcgtcacgatctctcttggggggggtctcaggaggcagcgctctcaggacatctccaccatggcctgggctctgctgctcctcaccctcctcactcagggcacagggtcctgggcccagtctgccctgactcagcctgcgtccgtgtcgtgggtctcctggacagtcgatccaccatctcctgcactcggaaccagctagtcgtactttggtggtaacatcatcgtctcctggtaccaacagtacccaggacaaacgccccaaatcatctattttgacgtcggtacgtcggcctacaggtaactttcgtaatccgtnttctctcggtcctaccgaagtcgtacgcccaaaccgtaccgggtcccttaccccgtacgtaccctactttccgttccggttaccggggtcccttacccgaacggtccccggttaaggaaccggggtaaccggtacgggtaccgttacggtaacttttaacgtttaccgttccgtttacccgttacctaaccgttacgttaccgtaaccggacccgggttaaggtttacccgtttacggggttacccgtttttccgggggacccgggttacccgggtaacccccgtaacccgttcccgggtaaccccggttccccggttaaccgggttcccgtaacccgggaaccccggttaaccggggtaccccgttccccgggttacccccccgttaccgggttcccccttaaccccggg

SEQ ID NO: 275819 - DNA, 635 bp, Homo sapiens
  misc_feature: GYAE6OF01A4QJY.36.36.D03.1.454.CMB.1.raw
  modified_base (324)..(324): a, c, t, g, unknown or other
  misc_feature (324)..(324): n is a, c, g, or t
tcagtacgctgtctcacgaccggtgctcgatttagctgcgtcacgatctctcttggggggggtctcaggaggcagcgctctcaggacatctccaccatggcctgggctctgctgctcctcaccctcctcactcagggcacagggtcctgggcccagtctgccctgactcagcctgcgtccgtgtctgggtctcctggacagtcgatcaccatctcctgcactggaaccagcagtgactttggtggtaacaatcatgtctcctggtaccaacagtacccaggcaaacgccccaaatcatcatttttgacgtcggtagtcggcctnaggtatttctaatcgtcttctctggctccaagtctgccaacacgcctccctgacctatctcgtgggccctccgacgccgtggacggacgaggtcttaggtactttacgttacttcgtttccctctaacctagtttaccgaacggtcccggttaagttaccgtttcgggttacccgttttcggggcccggggtcccgggtaacccctacccgttaccggtaccccgttacccggttaacgggttcccgaaccggtacccccggtaaacgggttcccctaccgggtccccccccgttgggtcccgttaccccg

SEQ ID NO: 275820 - DNA, 707 bp, Homo sapiens
  misc_feature: GYAE6OF01CXPZW.36.36.D03.1.454.CMB.1.raw
  modified_base (223)..(223): a, c, t, g, unknown or other
  misc_feature (223)..(223): n is a, c, g, or t
  modified_base (239)..(239): a, c, t, g, unknown or other
  misc_feature (239)..(239): n is a, c, g, or t
tcagtacgctgtctcacgaccggtgctcgatttagctgcgtcacgatctctcgttggggggggtctcaggaggcagcgctctcaggacatctccaccatggcctgggctctgctgctcctcaccctcctcactcgagggcacgagggtcctgggcccagtctcgccctgactcagcctgcgtccgtgtcgtgggtctccgtggacagtcatccacctatctcngacacgtacggaaccngctagtgtacgtttggtagtaacaatcatcgtcctcgtacgtaaccaacacgtaacccgacggaccaaaacccgaccccctaaactcctattacctttagttttacggaccggtttacggtaccggtccggtacccttagtaaggttaacttttactaacgtcgttccttccgtcgtacggtacctacgtaacgttccgtaccgaaccctaaccgtacccggtcccttacccgtacgaccctactccgtcgtcggtacctcgacgtccgtaggacggtacgacgtacgtagttacttacttacgttcttacctactaactacgtaaccgtacggtaccgttagttcggttcggttccggtttccgggccgggtacccggtacccgtaccggtaccggtacccgtacggtccggtaccgtaccggacccgtaacggtcccgtaccccggtccccgtccggtacctcccg

SEQ ID NO: 275821 - DNA, 650 bp, Homo sapiens
  misc_feature: GYAE6OF01CZHXM.36.36.D03.1.454.CMB.1.raw
  modified_base (285)..(285): a, c, t, g, unknown or other
  misc_feature (285)..(285): n is a, c, g, or t
  modified_base (629)..(629): a, c, t, g, unknown or other
  misc_feature (629)..(629): n is a, c, g, or t
tcagtacgctgtctcacgaccggtgctcgatttagctgcgtcacgatctctcgttggggggggtctcaggaggcagcgctctcaggacatctccaccatggcctgggctctgctgctcctcaccctcctcactcgagggcacgacgggtcctcgggcccagtctcgccctgactcagcctgcgtccgtgtcgtggtctccgtgacagtcgatcaccatctcctgcactcggaaccagcagtgtacgtttggtagtaacaatcatcgtctacgtacggtaaccaanacgtacccgaaggaccaaaaccgccccaaatctactcttattttcgacgttcggtacgtccgtacctagaggttaactttctaactcgtacttctcgtcggtcctactaagtcctacgaccctaaacgcccgtccctaccgtacgtaacctacgttccgtccggtacggccctaccggacgtccgtaggaccgggacggtacggtcttacgtacttttacgttacgttcgttacctactacttacgtacggtaacgtacggttattacggttcggttcgtttccggggaccggacccgtaccgaccgtccgtaccgtcgtacgccaccggaccgtacggtcccnccggtccccgtgtccctaccg

SEQ ID NO: 275822 - DNA, 657 bp, Homo sapiens
  misc_feature: GYAE6OF01BIQHP.36.36.D03.1.454.CMB.1.raw
tcagtacgctgtctcacgaccggtgctcgatttagctgcgtcacgatctctcttggggggggtctcaggaggcagcgctctcaggacatctccaccatggcctgggctctgctgctcctcaccctcctcactcagggcacagggtcctgggcccagtctgccctgactcagcctgcgtccgtgtctgggtctcctggacagtcatcaccatcctcctgcactggaaccagcagtgactttggtggtaacaatcatgtctcctggtaccaacagtacccaggacaaacgcccccaaactcatctatttttgacgtcggtagtcgcctcacggtaatttctaatcgtcttctctgctccaagtctgaccaaccacggccctaccctcgaccacttctacgtcgggcctccacgccgtgaggacgaggtctaggtactttaatttaccgtcgtttccctctaaccgttacttaccgtaaacggtcccgggttaagttaccgtttacgggttaccgtttttccggggccggggtacccggtaaccccgtaacccgttcgggtaacccccggttacccggttaacggggtcccgtaaccggaaccccgtaaacgggtccccgttacccgggtccccccccgttagggttccccttaacccgg

SEQ ID NO: 275823 - DNA, 650 bp, Homo sapiens
  misc_feature: GYAE6OF01D7HSY.36.36.D03.1.454.CMB.1.raw
  modified_base (230)..(230): a, c, t, g, unknown or other
  misc_feature (230)..(230): n is a, c, g, or t
tcagtacgctgtctcacgaccggtgctcgatttagctgcgtcacgatctctcgttggggggggtctcaggaggcagcgctctcaggacatctccaccatggcctgggctctgctgctcctcaccctctcactcagggcacagggtcctgggcccagtctgccctgactcagcctgcgtccgtgtctgggtctcgtggacagccgatcaccatctcctgccactggaaccngcagtgtacgtttggtaggtaacatcatgtctcctaggtaccaacacgtacccaggaccaaaccgaccccaaactcattactatttttgacgttcggtagtccggcctacgaggtatttctaatcgtcttctctcggtactaccagtctcgaccaacgaccgtccctcctacgacctatccgtcgtcggtcctccgacgtcgtacggacggtacgaggtcttagtatttaactttactcgttacctactaactacgttaccgaaggtccggttagttaccgttcgggttccggtttccggggccgggtacccggtaacccgtacccggtccggtacccggttacccggtacgggtacccaacggtaccccggtaacgggtcccgttaccccggtcccccccgttcggtcccttaccccgg

SEQ ID NO: 275824 - DNA, 629 bp, Homo sapiens
  misc_feature: GYAE6OF01ANW5P.36.36.D03.1.454.CMB.1.raw
  modified_base (405)..(405): a, c, t, g, unknown or other
  misc_feature (405)..(405): n is a, c, g, or t
tcagtacgctgtctcacgaccggtgctcgatttagctgcgtcacgatctctcgttggggggggtctcaggaggcagcgctctcaggacatctccaccatggcctgggctctgctgctcctcaccctcctcactcagggcacagggtcctgggcccagtctcgccctgactcagcctgcgtccgtgtctgggtctccgtggactagtcgatccactactcctctgcctacgtacgaaccagctagtgtagtttggagtaacaatctatcgtcctccgtaggtaaccaactacgtacccgacgaccaaaccgacccctaaatcattcttattttcggacgttcggtacgtcccgtcctacgaacgttactttactacgtccgtacttctcgtcgtcctactacgtcncgtaccacgtccgtaccctccgtagacctatccgtcgtcggtcctaccgtcgtacctacgggacgacggtagtactagttaacttacgttacgttcgtacctctacgtactacgtacggtacgttaacgttcgtcgttaccggttcgggaccggtccgacccttcgtccggtacgtaccggtcgccgacgacccgacgtcccgtaccgtcccgtcgtcctcccg

SEQ ID NO: 275825 - DNA, 709 bp, Homo sapiens
  misc_feature: GYAE6OF01BD28G.36.36.D03.1.454.CMB.1.raw
  modified_base (217)..(217): a, c, t, g, unknown or other
  misc_feature (217)..(217): n is a, c, g, or t
  modified_base (501)..(501): a, c, t, g, unknown or other
  misc_feature (501)..(501): n is a, c, g, or t
tcagtacgctgtctcacgaccggtgctcgatttagctgcgtcacgatctctcgttgggggggggtctcaggaggcagcgctctcaggacatctccaccatggcctgggctctgctgctcctcaccctcctcactcagggcacgagggtcctgggcccaggtctgccctgactcagcctgcgtcgtgtcgtgggtctccgtggacagtcgatcaaccntcctctgcacgtcggaaccagcagtgtacgtttgggtacgtaaacaatcattcgtactaccgttaggtaacccaacgtaaccgtacccgaagggaccaaaacccgtacccccaaaactctaacttcttagttttcgaccggttcggtacggtccgtacctagtacggtaactttactaacttccgtcttactcgtcgtctacagtcctacgacctaacgccgtccctaccgtacgacctactcgtacggtcggccctaccgacgtaccgaggaacgggtacggnggtaccgttagttactttaacgtttacgttccgttaccctctaaccttcgttaccggaacggtccggtttaaggttacggttcggttcccggtttacggggcccgggtacccgtaccccgtaccgtaccggtaccccgttacggaccgggtcctaacccggacccgtaacggccctaccccggtcccccgttaggtcccttaccccgg

SEQ ID NO: 275826 - DNA, 722 bp, Homo sapiens
  misc_feature: GYAE6OF01DMI7Q.36.36.D03.1.454.CMB.1.raw
tcagtacgctgtctcacgaccggtgctcgatttagctgcgtcacgatctctcgttggggggggtctcaggaggcagcgctctcaggacatctccaccatggcctgggctctgctgctcctcacccctcctcactcagggcacagggtcctgggcccagtctgccctgactcagcctgcgtccgtgtctgggtctccgtggacagtcgatcaccatctcctgcactaggaaccagcagtagtaacgttttggtaggtaacaatcagtcgtactcctaggtaaccaactacgtacccgaaggacaaaccgaccccaaatcatctattttggaacgttcggtacgtccggacctacgtaaggtaactttacgtaatccgtcttctcgtcggactaccaagtctacgaccaacgccggaccttccacgtacctattccgtacgtggccctaccaacgtccgtagaacgggacgtacggtactacgtattttaacttaccgttcgtttacctaacctaaccgttaacgtttaaccggaacgggttaccgggttaacgtttaccggttttcgggttaaccggtttttcccgggggaccggggtaccccggtaccccgtaaccggttcccggtaaaccccgtttcccggtaaacggtacccgtaaccggaacccccgtaacggggtccccttccccgggtacccccccgtttcggtcccgttaaccccg

SEQ ID NO: 275827 - DNA, 590 bp, Homo sapiens
  misc_feature: GYAE6OF01BMXVZ.36.36.D03.1.454.CMB.1.raw
  modified_base (230)..(230): a, c, t, g, unknown or other
  misc_feature (230)..(230): n is a, c, g, or t
  modified_base (271)..(271): a, c, t, g, unknown or other
  misc_feature (271)..(271): n is a, c, g, or t
tcagtacgctgtctcacgaccggtgctcgatttagctgcgtcacgatctctcttggggggggtctcaggaggcagcgctctcaggacatctccaccatggcctgggctctgctgctcctcaccctcctcactcagggcacagggtcctgggcccagtctgccctgactcagcctgcgtccgtgtctgggtctcctggacagtcgatcaccatcctcctgcactggaaccngcagtgacgttggtgcttataattatgtctctgttccaacngcattcaggcagcgaccccgaaactcttaatttatgtaggttcttcgtcggccctcgtagggtttctagtcgtcttctccggctccaagtctggcacacggcctcctgaccatctctagactccgaggtctggacggacggaggcttaggacttagttagttcgactagtcctacagttactacgttagtaagtctaaagtggttaactccgtaacgttcggtccgttggttaccggggtcgggaacgggtaacccgtaaacgggtttcggaaccccggtttaccggttaacgggttaccgaaccgggtaaacccccgg

SEQ ID NO: 275828 - DNA, 694 bp, Homo sapiens
  misc_feature: GYAE6OF01D5MOA.36.36.D03.1.454.CMB.1.raw
tcagtacgctgtctcacgaccggtgctcgatttagctgcgtcacgatctctcttggggggggtctcaggaggcagcgctctcaggacatctccaccatggcctgggctctgctgctcctcaccctcctcactcagggcacagggtcctgggcccagtctgccctgactcagcctgcgtccgtgtcgtcgggtctccgtggactagtcgatcacctattcctcctgccacgtggaaccagcagtgtacgttggtagtaacaatcatgtctctagaccaacgacgtacccaggaccaaaccgacccaaactctatctattttgacgttcgtacgtcggcctcgagtatttacatcgtcttctcgtcggctacgtatcctgaccctaacgacccgtccttacccgacgtacctactccgtcgtcggtactccgacgtccgtaggaacggtacggtacggtcgtagttaacttttacgttaccgtttcgttacccttactaaccgttaacgttaccgaaacgggttcccggttaacggtttaccgtttccgggttccggtttcccggggaccgggtaccccggtaacccccgtaccggtaccggtaccccggttaccggttaccggtaccgtaccccggaccccggtaaaccgggtccccttacccgggcccccccgtttggtccccgttaaccccgg

SEQ ID NO: 275829 - DNA, 547 bp, Homo sapiens
  misc_feature: GYAE6OF01ALB4S.36.36.D03.1.454.CMB.1.raw
  modified_base (242)..(242): a, c, t, g, unknown or other
  misc_feature (242)..(242): n is a, c, g, or t
tcagtacgctgtctcacgaccggtgctcgatttagctgcgtcacgatctctcttgggggggtctcaggaggcagcgctctcaggacatctccaccatggcctgggctctgctgctcctcaccctcctcactcagggcacagggtcctgggcccagtctgccctgactcagcctgcgtccgtgtctgggtctcctggacagtcgatcaccatctcctgcactggaaccagcagtgactttggnggtaacaatcatgtctcctggtaccaacagtacccaggcaaacgccccaaactcatcatttttgacgtcggtagtcggccctcaggtatttctaatcgtcttctctggctccaagtctgccaacacggcctccctgaccatcctctgggcctccgagccgtgagggacgaggctgtattattactgttcctcacacttacaagtccggtagtacgttggtccgttttcggcgggtccggacccgaccgtcgacccgttccgtacggtcacgacccgtaacggcctaccgccccctggtcctaccg

SEQ ID NO: 275830 - DNA, 661 bp, Homo sapiens
  misc_feature: GYAE6OF01BN4S3.36.36.D03.1.454.CMB.1.raw
tcagtacgctgtctcacgaccggtgctcgatttagctgcgtcacgatctctcgttggggggggtctcaggaggcagcgctctcaggacatctccaccatggcctgggctctgctgctcctcaccctcctcactcagggcacgagggtcctgggcccagtctgccctgactcagcctgcgtccgtgtctgggtctcctggacagtcgatcaccatctcctgccactggaaccagcagtgtacgtttggtaggtaacaatcattgtctcctggtaccaacacgtacccaggaccaaacgccccaaatcatctatttttcgacgttcggtacgtccggacctgaggtaatttcaagtctcttctgtcggctacagtcacgccaaacgcccggtcctccctacgacctacttacgtcgtcgggccctaccgacgtccgtaggacgggtacgaggtccgtagtaactttacttaccgttcgttccctactaacctacgttacgaacggtccggttaacggttccgtttacgggttaccggttttccggggccgggtacccggtaaccccgtaccgtaccggtaccccggttaccggttaccggtccgaacccggtaccccgtaacgggtccccttaccccggtccccgttccgggtcctaccccgg

SEQ ID NO: 275831 - DNA, 631 bp, Homo sapiens
  misc_feature: GYAE6OF01DOM3B.36.36.D03.1.454.CMB.1.raw
  modified_base (374)..(374): a, c, t, g, unknown or other
  misc_feature (374)..(374): n is a, c, g, or t
tcagtacgctgtctcacgaccggtgctcgatttagctgcgtcacgatctctcgttggggggggtctcaggaggcagcgctctcaggacatctccaccatggcctgggctctgctgctcctcaccctcctcactcagggcacagggtcctgggcccagtctgccctgactcagcctgcgtccgtgtctgggtctccgtggacagtcgatcaccatctcctgcactggaaccagcagtgactttggtaggtaacaatcatgtctctggtaccaacacgtacccaggaccaaacgcccccaaatcatctattttgacgtcggtagtcggcctgaggtaatttctaatcgtcttctctggctaccaagtctgccaacnccggcctcctgaccatcctcgtcgggcctccgagtcctggacggacgaggctagtactttattacttcgtttccctactacctagtttaccgaagtcccgggttaagttaccgtttgggttccgtttttaccggggccggggtacccggtaccccgtacccggttcggtaaccccggttaccgttaacgggtacccgaccggaacccccgtaacgggacccgttcccggacccccccgttcgggttccctaaccccg

SEQ ID NO: 275832 - DNA, 791 bp, Homo sapiens
  misc_feature: GYAE6OF01AZO1N.36.36.D03.1.454.CMB.1.raw
tcagtacgctgtctcacgaccggtgctcgatttagctgcgtcacgatctctcgttggggggggtctcaggaggcagcgctctcaggacatctccaccatggcctgggctctgctgctcctcaccctcctcactcagggcacgtagggtcctgggcccagtctcgcctgactcagcctgcgtccgtgtctgggtctccgtggacagtcgatccacctatcctcctgacctacgtcggaaccagctagtcggtactttggtcggtaactaatctatcgtccttccgtaggtaccaacacgtacccgaggaccaaacgccccaaagtcactcttacttttacgacgttcggtacgtcggcctagaaggtatttcctaatccgtcttctacgtcggtcctacgtaagtcctacgggaccctaaccgacccggtcctacccgtacgaccttacgtcgtaccgttcgggtaccctacgtacggtccgtacggaacgggccgtaacggtccgttaacgtacgttttaaacttttaccggtacggttttacccctacgtaacccgttaacgttacccgggtaaaccgggttaccccgggttaacgtttaacccggggttttaccggtttccccggggttttcggggaacccccggggtttaacccgggtaccccccgttaacgttccccgggtaaacccggttttcccggtaaacggtccccggtaaaccgtacccccgggtaacgtacccccggttcccccgggtttaacccccgtcgggttaaccccttaccccggg

SEQ ID NO: 275833 - DNA, 631 bp, Homo sapiens
  misc_feature: GYAE6OF01BHI3F.36.36.D03.1.454.CMB.1.raw
  modified_base (333)..(333): a, c, t, g, unknown or other
  misc_feature (333)..(333): n is a, c, g, or t
  modified_base (369)..(369): a, c, t, g, unknown or other
  misc_feature (369)..(369): n is a, c, g, or t
tcagtacgctgtctcacgaccggtgctcgatttagctgcgtcacgatctctcttggggggggtctcaggaggcagcgctctcaggacatctccaccatggcctggctctgctgctcctcaccctcctcactcagggcacagggtcctgggcccagtctgccctgactcagcctgcgtccgtgtctgggtctcctggacagtcatcaccatctcctgcacgtggaaccagcagttgtacgtttggtaggtaaacaatcatgtctcctggtaaccaacacgtacccaggaccaaacgaccccaaactcatctattttgacgtcgtagtcgcctanaggtattactaagtctcttctcgtcgctccgaatcncgaccaacgaccggtcctccctagacctatccgtcgtcggcctccgacgtccgtagacgggacgtaggtacttcggtaatttcgtttacctgttccctactactaacttacgtaacggtccggttacgttaccgttgggttaccgtttccggggccgggtacccggtaaccccgtaccgttaccggtacccggtcgttaccgggtccgaacccggaccccgtaacgggtcccgtacccgccccccgttcggtccttaccccg

SEQ ID NO: 275834 - DNA, 835 bp, Homo sapiens
  misc_feature: GYAE6OF01DTFUU.36.36.D03.1.454.CMB.1.raw
  modified_base (201)..(201): a, c, t, g, unknown or other
  misc_feature (201)..(201): n is a, c, g, or t
  modified_base (234)..(234): a, c, t, g, unknown or other
  misc_feature (234)..(234): n is a, c, g, or t
tcagtacgctgtctcacgaccggtgctcgatttagctgcgtcacgatcgtctcttggggggggtctcaggaggcagcgctctcaggacatctccaccatggcctgggctctgctgctcctcaccctcctcactcagggcacgagggtcctgggcccagtctggcctgacacagcctgcctcgtgtctgagactcgtggacngtcgatcaccatcctcctgccactacggaaccngcagtcgacgtttggtgtacttaataatttatcgttccttccgttgggtttaccccaacgtacggtacctaagtttaccgaacggggtacctaacgggtccccggtaaccccccggttaaaactttaccgtttttaaaagttttttacggttacgggttaaccgggttttcccgttttttacccgggtacccggggttacccccgtttacgggtttaacggggggttttttacccttaacggggtttcccgttacccgtttttacccggtaccccgggtacctttacccggaaaacggtttcccgtacggggtaccctaaacccggtacccgggtccccttacccccgttacggtaaccctacgtttacctaccgttaacgtacccttaccggaacgggtccgtagggacgggtaaccgtacgggtacttacggtaactttagtttaacgttcggacctagtccttacgtaattacttacgtagtaacgttactaaggttcgtacctaccgtaacgtcgggttcgttacgggttcggacggggtaaccggtaaccgttacggttaccggaacccgtttccggtaaggtcccgtaacccggg

SEQ ID NO: 275835 - DNA, 654 bp, Homo sapiens
  misc_feature: GYAE6OF01EOPTN.36.36.D03.1.454.CMB.1.raw
tcagtacgctgtctcacgaccggtgctcgatttagctgcgtcacgatctctcgttgggggggggtctcaggaggcagcgctctcaggacatctccaccatggcctgggctctgctgctcctcaccctcctcactcagggcacagggtcctgggcccagtctgccctgactcagcctgcgtccgtgtctgggtctcctggaccagtcgatcaccatctcctgcactggaaccagcagtgtactttggtaggtaacaatcatgtctcctaggtaccaacacgtacccaggaccaaacgaccccaaactcactctagtttttcgacgtcggtagtcggccctacgagtaatttctaatcgtcttcgtactggctccaagtcctcgaccaacgaccggtccctccctcgacctactctcgtgggccctacgcgtcgtacggacggacgagtccgtagtatttacttacgttcgtttccctactaactacttaccgaacggtaccgggttaacgttacgtttcgggttccgttttccggggccggggtacccggtaccccgtacccgtcggtacccggttacccggtaacgggttacccgaaccggtaccccgtaacgggtcccttacccgggtccccccgttcggtcccgttaccccg

SEQ ID NO: 275836 - DNA, 589 bp, Homo sapiens
  misc_feature: GYAE6OF01ATQII.36.36.D03.1.454.CMB.1.raw
  modified_base (230)..(230): a, c, t, g, unknown or other
  misc_feature (230)..(230): n is a, c, g, or t
  modified_base (466)..(466): a, c, t, g, unknown or other
  misc_feature (466)..(466): n is a, c, g, or t
  modified_base (538)..(538): a, c, t, g, unknown or other
  misc_feature (538)..(538): n is a, c, g, or t
  modified_base (554)..(554): a, c, t, g, unknown or other
  misc_feature (554)..(554): n is a, c, g, or t
tcagtacgctgtctcacgaccggtgctcgatttagctgcgtcacgatctctcttgggggggtctcaggaggcagcgctctcaggacatctccaccatggcctgggctctgctgctcctcaccctcctcactcagggcaccgagggtcctgggcccagtctggcctgacacagcctgcctccgtgtctgagactcctggacagtcgatcaccatctcctgcactggaaccngcagtgtacgttggtgtacttataattatcgttccttccgtcggttaccaactagctattcgaggcacgtcccgacccgtaaacttcgttaatttagtaggtacgttcgtttccgtccggtccttcgtacgggtttctaggtccgtcttccgtccggctacctagtcgtaggacctaccgtccgtccctccgtacgacctctcctctacgtacctcgacgtcgtacgagggaccgngtaccgtacgtacttagttcgttacgctaacgtctactatacgttactagtactactaagttcgtactccgngttgtcgtggtccggnggtacgtacgtagttacgaccgtcgtaggctacgg

SEQ ID NO: 275837 - DNA, 604 bp, Homo sapiens
  misc_feature: GYAE6OF01A9FU6.36.36.D03.1.454.CMB.1.raw
  modified_base (230)..(230): a, c, t, g, unknown or other
  misc_feature (230)..(230): n is a, c, g, or t
tcagtacgctgtctcacgaccggtgctcgatttagctgcgtcacgatctctcttggggggggtctcaggaggcagcgctctcaggacatctccaccatggcctgggctctgctgctcctcaccctcctcactcagggcacagggtcctgggcccagtctgccctgactcagcctgcgtccgtgtctgggtctcctggacagtcgatcaccatcctcctgcactggaaccngcagtgtacgtttggtaggtaaactaatcatgtctcctaggtaccaacacgtacccaaggaccaaacgacccccaaactcatctatttttgacgttcggtagtccggcctcgaggtaatttctaatcgtcttctctcggtctaccaagttcacgaccaacgccggtccctccctagaccctactcctctacgacctaccgaggctaggacggacgaggctagtacttattatgcagtctacattatacgtagtaagtacaagttggtaactaccgtacgttcggtcgttgggttaccgggtcgggaacgggtaacccgtaaagggtttaccggacccggtttacccgtaacggtccgtaaccgggtaaccccgg

SEQ ID NO: 275838 - DNA, 525 bp, Homo sapiens
  misc_feature: GYAE6OF01B2FVO.36.36.D03.1.454.CMB.1.raw
  modified_base (231)..(231): a, c, t, g, unknown or other
  misc_feature (231)..(231): n is a, c, g, or t
  modified_base (275)..(275): a, c, t, g, unknown or other
  misc_feature (275)..(275): n is a, c, g, or t
  modified_base (307)..(307): a, c, t, g, unknown or other
  misc_feature (307)..(307): n is a, c, g, or t
  modified_base (341)..(341): a, c, t, g, unknown or other
  misc_feature (341)..(341): n is a, c, g, or t
  modified_base (360)..(360): a, c, t, g, unknown or other
  misc_feature (360)..(360): n is a, c, g, or t
  modified_base (373)..(373): a, c, t, g, unknown or other
  misc_feature (373)..(373): n is a, c, g, or t
  modified_base (379)..(379): a, c, t, g, unknown or other
  misc_feature (379)..(379): n is a, c, g, or t
  modified_base (407)..(407): a, c, t, g, unknown or other
  misc_feature (407)..(407): n is a, c, g, or t
  modified_base (415)..(415): a, c, t, g, unknown or other
  misc_feature (415)..(415): n is a, c, g, or t
  modified_base (441)..(441): a, c, t, g, unknown or other
  misc_feature (441)..(441): n is a, c, g, or t
tcagtacgctgtctcacgaccggtgctcgatttagctgcgtcacgatctctcttggggggggtctcaggaggcagcgctctcaggacatctccaccatggcctgggctctgctgctcatcaccctcctcactcagggcacagggtcctgggcccagtctgccctgactcagcctgcgtccgtgtcgtgggtctcctggacagtcgatcaccatcctcctgcactggaaccngcagtgtactttggtaggtaacatcatgtctcctggttccaacngcattcaggcacgcgaccccgaatcttaattntgtagttcttcgtcgcctcgtagggttctagtcncttcgtccgctcctagtcngacacacgcctcngtaccntcctatacgctcagctgagtcgagctanacttattntgcagctactattatacaggtactanagtacgtactacgtagtcggtgttacggtcgggacgggtacggtaccgtaacggttcgaacccggttccgtggtacgaacccgg

SEQ ID NO: 275839 - DNA, 754 bp, Homo sapiens
  misc_feature: GYAE6OF01A7Y4I.36.36.D03.1.454.CMB.1.raw
tcagtacgctgtctcacgaccggtgctcgatttagctgcgtcacgatctctcttggggggggtctcaggaggcagcgctctcaggacatctccaccatggcctgggctctgctgctcctcaccctcctcactcagggcacagggtcctgggcccagtctgccctgactcagcctgcgtccgtgtctgggtctcctggacagtcgatcaccatcctcctgcacgtggaaccagcagtgtacgtttggtaggtaacaatctatcgtcctccgtacggtaaccaacgtacgtaacccgaggaccaaaaccgacccccaaaactctatcttatttttcgacggttcggtacgtccggccctacgtaaggtaactttactaactcgtctttcgtcgtcgtccttacctaacgttcctacgacccaaccgtaccgggtccccttaccctcgaaccctacttccgtacgtcgggtccctaccgacgtacccgtagggacgggtaaccggtacggtccgttagttaacgttttaactttaccgttccgttttaccctaaccgtaaccttacgtttaccgtaaccgggttaccggttaacggtttaccggtttacgggttcccggttttaccgggggccccgggtacccgggtaaccccgttaccggttaccggttaccccgttacccggtacgggtacccgtaaccggtaccccgtaaccgggttccctaccccggtccccccggttccggttccctacccg

SEQ ID NO: 275840 - DNA, 602 bp, Homo sapiens
  misc_feature: GYAE6OF01BWDXN.36.36.D03.1.454.CMB.1.raw
  modified_base (227)..(227): a, c, t, g, unknown or other
  misc_feature (227)..(227): n is a, c, g, or t
tcagtacgctgtctcacgaccggtgctcgatttagctgcgtcacgatctctcttgggggggtctcaggaggcagcgctctcaggacatctccaccatggcctgggctctgctgctcctcaccctctcactcagggcacagggtcctgggcccagtctgccctgactcagcctgcgtccgtgtctgggtctcctggacagtcgatcaccatctcctgcactggaaccngcagtgactttggtaggtaacatcatcgtctcctgtaccaacacgtaccaggaccaacgccccaaactcatctattttcgacgtcggtagtcgcctcgtagtacttctaatcgtacttctcgtggtctacctaacgtctcgaccacaccggtcctccctgacctactcgtcgtcgggtcctaccgacgtccgtaggacgggacggaggtcctagttaacttactttacttcgttcctacacttacgttacgaacggccggttacgttacgttcgggtaccgttttcgggaccgggtcccgacccgtaccgtacgtacccgtacgtacggtccacgtacccggacgtcccgtacccgccccgttccgtcctacccg

SEQ ID NO: 275841 - DNA, 664 bp, Homo sapiens
  misc_feature: GYAE6OF01ASSSX.36.36.D03.1.454.CMB.1.raw
tcagtacgctgtctcacgaccggtgctcgatttagctgcgtcacgatctctcttggggggggtctcaggaggcagcgctctcaggacatctccaccatggcctgggctctgctgctcctcaccctcctcactcagggcacagggtcctgggcccagtctgccctgactcagcctgcgtccgtgtctgggtctcctggacagtcgatcaccatctcctgcactggaaccagcagtgactttggaggtaacatcatgtctcctggtaccaacagtacccaggcaaacgcccccaaactcatctatttttcgacgtcggtagtccggcctcgaggtaatttctaatcgtcttctctaggctcaagtctgacccaacaccggccctcccgtcgacctattcctcgtcgggtccctccgacgtcccgtaggacgggacgtagggctagtatttacttacgttcgttccctacgtaacttacttaccgtaacgtcccgggtaagtttaccgtttacggttccggttttccggggcccggggtacccgggtaaccccctaccggtcccggtaccccggttacccggttaaccgggttccgaccccgggtaccccgtaaaccgggtccccttaccccgggcccccccggttaccgggtcccctttaccccgg

SEQ ID NO: 275842 - DNA, 707 bp, Homo sapiens
  misc_feature: GYAE6OF01CAQ38.36.36.D03.1.454.CMB.1.raw
  modified_base (204)..(204): a, c, t, g, unknown or other
  misc_feature (204)..(204): n is a, c, g, or t
tcagtacgctgtctcacgaccggtgctcgatttagctgcgtcacgatctctcgttggggggggtctcaggaggcagcgctctcaggacatctccaccatggcctgggctctgctgctcctcaccctcctcactcagggcacgacgggtcctgggcccagtcctcgccctgactcagcctgcgtcgtgtctgggtctcgtggacngtcatcaccatcctcctgccacgtacggaaccagcgagttgtacgtttggtacgtaaacaatacatcgtctaccgtacggtaacccaacgtaccgtacccgacggaaccaaaccgaccccaaatccaattcttagttttcgacgttcggtacgtccgacctagtaagttaacttctaactcgtacttcctgtcgcctacgtagtctaccgacctaaccgccgtaccctcccgacgtaccctacgttccgtcgtccgggtacctcccgtaacggtccgtaggaacgggtacgggtacgtacgttacgttaactttacgtttactttccgttaccctaacctaacgttaacgttaccggaacggtccggttacgtttacgggttacgttccggtttccggggacccgggtcccggtaacccgtccgtccggtaccccggttaccgtacggcccgtaaccgacccgtacggtccccgtacccggtcccccggttcgcccttacccg

SEQ ID NO: 275843 - DNA, 641 bp, Homo sapiens
  misc_feature: GYAE6OF01BL39I.36.36.D03.1.454.CMB.1.raw
  modified_base (217)..(217): a, c, t, g, unknown or other
  misc_feature (217)..(217): n is a, c, g, or t
tcagtacgctgtctcacgaccggtgctcgatttagctgcgtcacgatctctcgttggggggggtctcaggaggcagcgctctcaggacatctccaccatggcctgggctctgctgctcctcaccctcctcactcagggcacagggtcctgggcccagtctgccctgactcagcctgcgtccgtgtcgtgggtctcctggacagtcgatcacatctcngcactgaaccagcagtgacttggtagtaacaatcatgtctcgtacgtaccaacacgtacccagaccaaccgaccccaaacgtcatctattttcgacgtcggtagtccgcctacgaggtaactttctaatccgtcttcgtcgtcggcctaccgtaagttcacgaccaacgtacccggtccctcccgtacgtacctacttaccgtcgtcggaccctccgacggtacctacggaacggacggtaacggtcgttaacgtacgtttactttacgtctttccctactactaacttcgtaacggtcggttacgttacgttacggttcggtttccggggcccggtacccgacccgtaccgccggttacccgtccgtaccggacccgacggaccccgtacggtcctacccgtcccccgttccggtcctacccg

SEQ ID NO: 275844 - DNA, 871 bp, Homo sapiens
  misc_feature: GYAE6OF01CIEPT.36.36.D03.1.454.CMB.1.raw
tcagtacgctgtctcacgaccggtgctcgatttagctgcgtcacgatctctcttggggggggtctcaggaggcagcgctctcaggacatctccaccatggcctgggctctgctgctcctcaccctcctcactcagggcacagggtcctgggcccagtctgccctgactcagcctgcgtccgtgtctggtctcctggacagtcgatcaccatcctcctgccacgtcggaaccagctagtgtacgttttgggtaggttaaacaatcaagttcgtccttcccgtacggtaacccaacgtacgtaccccgaagggaccaaaaccgaccccccaaaacgtccattactaattttttcggaccggttcggtaacggtcccggtaccctacgaaggtaactttctaaacgtcgtacttcctcgtcggtcctaccgtaacgtccgtacgacccaaacccgtacccgggtccccttaccccgtacgtaaccctaaccgttcccgttaccggttccggggacccttaccccggaacggtccccgttaggggaaccggggtaacccgggtacgggtacccttacggtttaacgttttaacgtttaacccgtttaccgtttaccccttaccttaaccgttaaccgtttaacccggtaaaccgggtaccccgggtttaacggtttacccggttttcggggtttacccgggtttttacccgggggcccgggggttacccccggtaaccccccggttaacccggttacccgggtaacccccggttcccggtttaaaccgggtcccgtaaaccccggtacccccggtaaaccgggttccccgtacccccggttcccccccggttccgggttaccccttaacccccgg

SEQ ID NO: 275845 - DNA, 757 bp, Homo sapiens
  misc_feature: GYAE6OF01B6DQS.36.36.D03.1.454.CMB.1.raw
tcagtacgctgtctcacgaccggtgctcgatttagctgcgtcacgatctctcgttggggggggtctcaggaggcagcgctctcaggacatctccaccatggcctgggctctgctgctcctcaccctcctcactcagggcacagggtcctgggcccagtctgccctgactcagcctgcgtccgtgtctgggtctcgtggacagtcgatcaccatcctcctgcactggaaccagcagtgtactttggtaggtaacatcagttcgtcctccgtacggtaaccaacgacgtacccaggaccaaaaccgccccctaaaactctactacttacgtttttacggaaccggttcgggtaacggtcccgggtaccccttacgtaaacggttaaccttttacgttaaacgttccgttaccctttcgttaccgttcggtacccttaccgtaaacgttccgtacgaacccccgtaaaccgtaccccggtacccttaccccgtacgtaccctacgttccgttccggtaccgggtccctacccgacgtccggtagggacgggaaccggtaggtccgttagtacgtttacgtttaccttaccgtttccctaactacttacgttaccgaaacggtccggtaacgtttacggttcggttccgtttccggggcccgggtaccggtaccccgtaccgtccggtaacccgttccggtaaccggtccaaccgacccgtaacggtccctacccggtcccccgttccggttccgtacccg

SEQ ID NO: 275846 - DNA, 674 bp, Homo sapiens
  misc_feature: GYAE6OF01DLGK2.36.36.D03.1.454.CMB.1.raw
tcagtacgctgtctcacgaccggtgctcgatttagctgcgtcacgagtctcgtcgttgggggggtctcaggaggcagcgctctcaggacatctccaccatggcctgggctctgctgctcctcaccctcctcactcgtagggcacgtacgggttcctaggggccctaggtcctggtccctgactcgagcctgcgtcgtgtcgtggggtctccgtggacagtcgagtccacctatcctcctcgctacgtacggaaccagcctaggtgtacgtttggtacgtaactatactacttcgtctccgtacggtaaccaacgtacgtacccgaggaccaaacgcccctaaatcgacttcgttagttttcggacggttcggacgtcgacctgtaggtacttacgtaatctcttctacgtacgtctacctaagtctacgaaccgtaacgtaccggtcccttacctacgtaaccctacgttccgtacgtcgggacccttaccgaacgtccgtaggaacggtacggtacgtctacgttactttaactacgttcgtaccgtactactacgttacgaacggtcggtacttacgttcggtacgtttcggacggtcccgtaccgtaccgtcggaacccgttcgtaacggcctacgacccggtaggtccctcggtccccgtgtcctacccg

SEQ ID NO: 275847 - DNA, 632 bp, Homo sapiens
  misc_feature: GYAE6OF01AKQGN.36.36.D03.1.454.CMB.1.raw
  modified_base (190)..(190): a, c, t, g, unknown or other
  misc_feature (190)..(190): n is a, c, g, or t
  modified_base (336)..(336): a, c, t, g, unknown or other
  misc_feature (336)..(336): n is a, c, g, or t
  modified_base (614)..(614): a, c, t, g, unknown or other
  misc_feature (614)..(614): n is a, c, g, or t
tcagtacgctgtctcacgaccggtgctcgatttagctgcgtcacgatctctcgttggggggggtctcaggaggcagcgctctcaggacatctcccaccatggcctgggctctgctgctcctcaccctcctcacgtcagggcacgagggtcctgggcccagtctgccctagactcagcctggccgttccgngtctgggtctcctaggacagtccgatccacctattcctccgtgacctacgtggaaaccaggcctaggtcgtacgtttggtaggtaaacatcatcgtctcctacggtaaccaacacgtacccaggaccaaaccgaccccaaacctcnctactatttttcgacgttcggtaacgtccggtcctacgtacggtaactttactaactcgtcttcgtctcggcctactaagtctcggaccaacgccgtccctacctacgacctactccgtacgtcgggcctaccgtacgtccgtaggacggtaacggcgtacgtagtacttcttacgtcgttcctactactactacgaacgtccgtacgttacgttacggtcgttccggcggtacccggcctaccgtcgtaccgtccgtacgaccacgaccgtcggtcncccgcccgtcgtctcccg

SEQ ID NO: 275848 - DNA, 740 bp, Homo sapiens
  misc_feature: GYAE6OF01AZLMR.36.36.D03.1.454.CMB.1.raw
tcagtacgctgtctcacgaccggtgctcgatttagctgcgtcacgatctctcgttggggggggtctcaggaggcagcgctctcaggacatctccaccatggcctgggctctgctgctcctcaccctctcactcgagggcacgacgggtcctcgggcccagtctcgccctgactcacgcctgccgtcgtgtcgtgggtctccgtggactacgtcgatccacctactcctcctgacacgtacggaaccagctaggtgtacgtttggtacggtaaactaatctatcgtctaccgtacgtaccaacgtacgtaacccgaaggacctaaaacccgacccctaaacgtctacttacttacgttttttacggaccggttacgggttaccgtccggtaccgtacgtaacggttaactttacctaacgtcctacgttactcgtcggtacctacgtacgtctaccgaccgtaaccgccggtcctaccgtacgtacctacgtacctcggtaccggtacccgtaccgacgtaccgtacggaacgggtaacggtcggtacgttaacgttaacgtttacgtttaccgttacgttaccctaaccgtaacgttaacgttacgtaaccggtacccggttaagttaccggttacggttccggtttaccgggaccgggtacccgtacccgtacgtaccggaccgttacggtacgtaccgaccgaccgtaacgtcccgcccgtcccgtcgtccgtacccg

SEQ ID NO: 275849 - DNA, 821 bp, Homo sapiens
  misc_feature: GYAE6OF01ANRV2.36.36.D03.1.454.CMB.1.raw
tcagtacgctgtctcacgaccggtgctcgatttagctgcgtcacgatctctcgttggggggggtctcaggaggcagcgctctcaggacatctccaccatggcctgggctctgctgctcctcaccctcctcactcagggcacgagggtcctgggcccagtctgccctggctcagcctgcctcgtgtcgtgggtctccgtggacagtcgactccacctactctcctgcctacgtacggaaccagcctaggtcggtaacggtttggtagttttaattaaagttttcgtccgttaccgtaggttaacctaacgacggtaccgacccggggactaactaccggaaccccctaaaaatcctaagttagtaaagttttagtacgggtaacggttacctaactccgtaacgttcccggtacccttcgggttaacgggttttaccttaaacgttcgttacctttccgttcgtacgtactaaccttacccgtaacggttccggtacggtaacccgtaacccgtacccggtacccccttacccgtaccggtaaccttaacgtcccggtttcggtccgggggtacccttacccgggtaacgggtcggttaacgggtaacggggtaaccggtaaaccggttaacgttttaacgtttttacgtttaccggttacggttaaccttaacggtttaacctaaacttaaccgtaaacccgtaaaacccgactaacccgtaaacctacttaccgttaccgtaccgttacgggtaccgggaagggtaccggaacgtacgtacgtacggtaccctaccgtagacccgtacggcccgtaccgg

SEQ ID NO: 275850 - DNA, 693 bp, Homo sapiens
  misc_feature: GYAE6OF01AFY40.36.36.D03.1.454.CMB.1.raw
tcagtacgctgtctcacgaccggtgctcgatttagctgcgtcacgatctctcgttggggggggtctcaggaggcagcgctctcaggacatctccaccatggcctgggctctgctgctcctcaccctcctcactcagggcacgagggtcctgggcccagtctgccctgactcagcctgcgtcgtgtctggtctccgtggacagtcgatcacatctctgcactggaaccagcagtgtacttggtagtaacatcatcgtctcctacggtaaccaacacgtacccgaaggaccaaaaccgaccccctaaaactctacttacttaagtttttacgaacggttcggtaagtccggccctagtacggttaactttactaacgtccgtcttctcgtcggctaccaagtcctagacccaacaccggtcctaccgtcgaccactcgtacgtcgggtacctccgacgtcgtggaacgggcggtacgtcgtacgtactttacgttaccgttcgttacctaccgtaactaacttcgtaaccggtacggtaacgttacgttaccgggttccggtttaccgggccgggtaccccggtaccccgtacccggttccggtacccggttaccggtaaccgggtacccgtaacccgggaaccccgtaaccggaaccccctaaaccccgtaccgttcccgtaaccttaccccgg

SEQ ID NO: 275851 - DNA, 938 bp, Homo sapiens
  misc_feature: GYAE6OF01EMR37.36.36.D03.1.454.CMB.1.raw
tcagtacgctgtctcacgaccggtgctcgatttagctgcgtcacgatctctcttgggggccctgggattttcaggtgtttttcatttggtgatcaggactgaacagagagaactcaccatggagtttgggctgactggtctttttcttgtggacttattttaaaggtgtccagtgtgaggtgcagctggttgggagggtcgggggggaggtcgttcgggtacgacggtccggttcgggggggtccctggacgtaccttcctccctggtgacacgtccttcgtggtactttccttacctttacgcctaccttatcgacctagtgacgtcggtcggggtcccgaccgacggtccgtaccggaagggggtaacggggacggtggggtagggttcgggtcctacgtacttccgtagtttacggtcggtaccgtaacggttaccttacaacttacgtacttaccttcggaccgaacgtacccgttaccgggtacgggaaccggggtcccgttaaccacccgtacgttacgtacccgaaggaacgtaaccgtaaccttaacccgaaaacgtaaccaacctaacgtaacgttaaccgtacttaacgaaacctaaacgtaaccgaaaccgtaccggtaccgtaacgggaacggaccgggaacccgggtaaccggtaaccccgggacccgggttacccggttttaaccgtttaccgtttttaccggacggttaccgggtaaaccggttaaaccggttttacccggtttttaaacgggtttaaccggggttttttaaacccgggttaagggtttaacggggtttaaaccggggggttaaaccggggggtaaaccggggggggttaacccgggttaacccgggttaaccgggggttaccgggggtaacccgggtaaacggggttaacccgttccccggggttaaccggg

SEQ ID NO: 275852 - DNA, 711 bp, Homo sapiens
  misc_feature: GYAE6OF01DHA1I.36.36.D03.1.454.CMB.1.raw
  modified_base (201)..(201): a, c, t, g, unknown or other
  misc_feature (201)..(201): n is a, c, g, or t
tcagtacgctgtctcacgaccggtgctcgatttagctgcgtcacgatctctcgttggggggggtctcaggaggcagcgctctcaggacatctccaccatggcctgggctctgctgctcctcaccctcctcactcgaggcacgacgggtccgtcgggcccagtctcgcctgactcacgcctgcgtcgtgtcgtggtctccgnggacagtcactcactctctctagcacgtacggaaccagcgtagtacgtacgtttaggtaacgtaacaatctagttcgtcctcgtacgtaaccaaacgtaccgaacccgaggaaccaaaaccgaccccctaaaatctaactttacgtttacgttttacggacggttacggtaccggtcccggtacctacgtaaggttaacctttactaacgtccgtacttcgtcgtcgtacctacgtaacgtctaccgacctaaccgtcccgtcctaccgtacaccgtactccgtacggtcggtacctaccgtacgacggtaggtaccggaggtacgtacgttaacgtaatttaccgttacttccgttacctactaaccgttactaccgggtaacggtccggttagttaccgttcgggttaccggttcgggccgacccgtaccgtaccggtacgacccgttaccgtcggtaccgaccgtaccggtacgtcccgtacccgtccccgttagcccgttacccgg

SEQ ID NO: 275853 - DNA, 890 bp, Homo sapiens
  misc_feature: GYAE6OF01A52NZ.36.36.D03.1.454.CMB.1.raw
  modified_base (237)..(237): a, c, t, g, unknown or other
  misc_feature (237)..(237): n is a, c, g, or t
tcagtacgctgtctcacgaccggtgctcgatttagctgcgtcacgatctctcgttgggggggtcgtcaggaggcagcgctctcaggacatctccaccatggcctgggctctgctgctcctcaccctcctcactcagggcacagggtcctgggcccagtctcgccctgactcagcctgcgtccgtgtctgggtctccgtggacagtcgatcaccatctcctagcacgtggaaccaggnacggttgtacgttttggtacggtaaacctaatcctaatcgttccttcccgtaggtaacctaaaccaacggttaaccccaagggaccaaaaaccggaccccctaaaactaccaacttactattttttacggacgtacgggttacggttccggacccttcgtaacggtaacttttacgtaaacttccgtcttacttcgtcggtccgtacctaacggttccttaggacccctaaaacgcccgggtacccttacccgtacgtacccgaactttccgtcggttcccggggtcctacccgtacgtacccgttagggacgggaacccggtacgggaccgttacgttaacgttttaaccgtttaccgtttaccggttttccccttaacttaaccccgttaagtttaacccgggttaaaccggggtacccggtaacgggtttttaaaccccgtttcgggggtttaccgtttttttaaccccggggggccggggggtacccccggttaaaacccccggttaccccgggttacccgggttaacccccgggtttccccgtttaaacggggttccccgaaacccgggttacccccggtaaaaccggggttcccccgttaccccgggtaaccccccccgtttccggggttaccctttaaccccccgg

SEQ ID NO: 275854 - DNA, 588 bp, Homo sapiens
  misc_feature: GYAE6OF01CGKZW.36.36.D03.1.454.CMB.1.raw
  modified_base (120)..(120): a, c, t, g, unknown or other
  misc_feature (120)..(120): n is a, c, g, or t
  modified_base (276)..(276): a, c, t, g, unknown or other
  misc_feature (276)..(276): n is a, c, g, or t
  modified_base (573)..(573): a, c, t, g, unknown or other
  misc_feature (573)..(573): n is a, c, g, or t
tcagtacgctgtctcacgaccggtgctcgatttagctgcgtcacgatctctcttggggggggtctcaggaggcagcgctctcaggacatctccaccatggcctgggctctgctgctcctnaccctctcactcagggcacagggtcctgggcccagtctgccctgactcagcctgcgtcgtgtctgggtctctggacagtcgatcacatctctgcacgtggaaccagcagtgtacgtttggtaggtaacaatcattcgtctccgtcggtaacctaanacgtaacccgaggaccaaaacgccccaaatcactctattttcgacgttcggtacgtcggcctagagtacttctaatcgacttctcgtcgctacaacgtctagaccaacgaccgtccctaccgtcgaacctacgttccgtcgtcgggacctccgacgtccgtggaacggtacgcggtctagtatttactcgttcgtcctacgaccttagtacgacgtccggtacttggttaccggtccgtttcgggaccggtccgtacccacggttcgacccgttcgtacgtcaccgtccgagtcccncgtccctcgcctccg

SEQ ID NO: 275855 - DNA, 755 bp, Homo sapiens
  misc_feature: GYAE6OF01CIRP0.36.36.D03.1.454.CMB.1.raw
  modified_base (200)..(200): a, c, t, g, unknown or other
  misc_feature (200)..(200): n is a, c, g, or t
  modified_base (205)..(205): a, c, t, g, unknown or other
  misc_feature (205)..(205): n is a, c, g, or t
  modified_base (239)..(239): a, c, t, g, unknown or other
  misc_feature (239)..(239): n is a, c, g, or t
  modified_base (367)..(367): a, c, t, g, unknown or other
  misc_feature (367)..(367): n is a, c, g, or t
  modified_base (585)..(585): a, c, t, g, unknown or other
  misc_feature (585)..(585): n is a, c, g, or t
tcagtacgctgtctcacgaccggtgctcgatttagctgcgtcacgatctctcgttgggggggggtctcaggaggcagcgctctcaggacatctccaccatggcctgggctctgctgctcctcaccctcctcactcgagggcacgagggtcctgggcccagtctcgccctgactcagcctgcgtccgtgtcgtggtctcgnggacngtcgatccactatcctcctgctacgtacggaccncgcgtagtcgttacggtttaggaacgtaaactagtactcgttcggtaccctttaccggtaaccggtaaccctaacggtaaccgtaacccggaaccggaaaccaaaacccccgtaacccccaaaacttnaacttttacgtttacggttttacggaaccggtttccgggaccgttcccggtactacggtaaacggtttaacctttactaacgtccgttcccttcggtcgtaccggtaccttaacgaacgtccgtaaccaacccgaacccgtccgtccctaccgtactaacctcgttcctacggtcgacccgtccgacggtcggaggaccgggagtcgtacgtacgttntttaacgttccgttctaccctataacgacgttaaccggaggttaccggttaagttccgggttacgttaccggggtccggcccgggttacccaccccgttacggtacccgggttaccaacggtccgaccgaccgtcgtaacccgtcctacccgtccccgtagtccctaccg

SEQ ID NO: 275856 - DNA, 674 bp, Homo sapiens
  misc_feature: GYAE6OF01CGIZI.36.36.D03.1.454.CMB.1.raw
  modified_base (202)..(202): a, c, t, g, unknown or other
  misc_feature (202)..(202): n is a, c, g, or t
  modified_base (219)..(219): a, c, t, g, unknown or other
  misc_feature (219)..(219): n is a, c, g, or t
  modified_base (364)..(364): a, c, t, g, unknown or other
  misc_feature (364)..(364): n is a, c, g, or t
tcagtacgctgtctcacgaccggtgctcgatttagctgcgtcacgatctctcgttggggggggtctcagggaggcagcgctctcaggacatctccaccatggcctgggctctgctgctcctcaccctcctcactcagggcacgagggtcctgggcccaggtctgccctgactcagctgcgtcgtgtctgggtctcgtggacngtcgatcacatcctctncactggacctagctagtgtacgttaggtaggtaactaatctagttcgtcctccgtacggtaacctaacacgtaacccgagaccaaaccgacccctaaactctactctagttttcgacgttcggtacgtcgccgtacaggtacttntaactcgtcttctcgtacgtctacaaggtcctcgacctaacgaccggtcctacccgtcgacctgttaccgtcgttacggctaccgaccggtccgtagggaccgggtacggacggttacgttacggttaaactttgtaccgttttaccgttaccttcgtaactacgttaccgtaaacggtcccgtaggttacggttcggttccgggttacgggccgggaccgtacccggtccgttaccggtaccgtccggttacggccgtaaccggtacccgtacgggcccttacccggtccccgtccgttcctaccccgg

SEQ ID NO: 275857 - DNA, 683 bp, Homo sapiens
  misc_feature: GYAE6OF01CU3CM.36.36.D03.1.454.CMB.1.raw
  modified_base (231)..(231): a, c, t, g, unknown or other
  misc_feature (231)..(231): n is a, c, g, or t
  modified_base (237)..(237): a, c, t, g, unknown or other
  misc_feature (237)..(237): n is a, c, g, or t
  modified_base (285)..(285): a, c, t, g, unknown or other
  misc_feature (285)..(285): n is a, c, g, or t
  modified_base (508)..(508): a, c, t, g, unknown or other
  misc_feature (508)..(508): n is a, c, g, or t
  modified_base (560)..(560): a, c, t, g, unknown or other
  misc_feature (560)..(560): n is a, c, g, or t
tcagtacgctgtctcacgaccggtgctcgatttagctgcgtcacgatctctcgttggggggggtctcaggaggcagcgctctcaggacatctccaccatggcctgggctctgctgctcctcaccctctcactcgagggcacgagggtcctcgggcccaggtctcggccctgacctcacgtcctggtccgtccgtggtccgttgggtcctccgtggacaggtcatccacctntctccngaccacgtacggacctagctaggtcgtacgtttggtagtaacatactntacgtctaccgtacggtaaccaacgaaccgtaccgaacggacctaaaccgacccctaaactacctattacttacgtttacgacggttcggtacgtccggtaccctactacggttactttacgtaactccgttcttccgtcggtacgttcaccgtaattccgacgaccgtaaccgaccggtaccctacccgtacgtacctactccggtcgtccggtcgtaccgngtaccgtagacggtacggatacggtatacgtttacttacgtcttacccgtanaccgtactacggtaaccgtcggttacgttaccgttcgggttacgttccggccggaaccgtacccgtacgtcggtaccgtcgtcgacgccgtaccggactccgtacccgtccgtacgtcctacg

SEQ ID NO: 275858 - DNA, 653 bp, Homo sapiens
  misc_feature: GYAE6OF01EYYXU.36.36.D03.1.454.CMB.1.raw
tcagtacgctgtctcacgaccggtgctcgatttagctgcgtcacgatctctcgttgggggggggtctcagggaggcagcgctctcaggacatctccaccatggcctgggctctgctgctcctcaccctcctcactcagggcacagggtcctgggcccagtctgccctgactcagcctgcgtccgtgtctgggtctcgtggacagtcgatcacctatcctctgcacgtggaaccagctagtcgtacggttggtgtacttattaattatcgttcctccgttcggttaccaacagtctattcgaggcacggcccgtaccccgtaaacttacttttaaatttagtggttacggtttccgtttccgggtcccggtcccgttaggtacgggttttactacggtccgttccgttccgtcccggtccttaccgtaacgttcgtacggaccctaccgtacccggtccctccctcgtaaccctactaccgtactacgtaccgtaccgtacgcgtaggacgggtacggaggtactacgtaacttagttacgtgactagtccttacgtagttaactacgttagaagtacgtaagtcggtactccgtacgtggtcgtcgggtcgggcggtacgactaaggtccgtacgtctacggtccaggacccg

SEQ ID NO: 275859 - DNA, 691 bp, Homo sapiens
  misc_feature: GYAE6OF01D9ZOV.36.36.D03.1.454.CMB.1.raw
tcagtacgctgtctcacgaccggtgctcgatttagctgcgtcacgatctctcgttggggggggtctcaggaggcagcgctctcaggacatctccaccatggcctgggctctgctgctcctcacccctcctcactcagggcacagggtcctgggcccagtctgccctgactcagcctgcgtccgtgtctgggtctcctggacagtcgatcaccatctcctgacacgtggaaccagcagtgtacgtttggtaggtaacaatcattcgtctcctaggtaaccaacacgtacccaggaccaaaccgaccccaaatctatctagtttttcgacgttcggtacgtccgcctagaacggtactttcgaactcgtcttcgtcgtcggtacctacctacgtcacgacccaaccgtacccggtccctcccgtacgaccctacttccgtacgtcgggtccctaccgacgtccgaggacggacggacggtctagttacttttaacgttaccgttcgtttccctaacgtactaacgttaccgaacggttccggttaagttacggttcgggtttccgtttccgggggacccgggtacccgtaaccccgtaccggtaccgggtacccggttaccggttacgggtacccgacggtaaccccggtcggtaccccttccccgggttccccccgttgggtcccctacccg

SEQ ID NO: 275860 - DNA, 833 bp, Homo sapiens
  misc_feature: GYAE6OF01EN468.36.36.D03.1.454.CMB.1.raw
  modified_base (243)..(243): a, c, t, g, unknown or other
  misc_feature (243)..(243): n is a, c, g, or t
  modified_base (719)..(719): a, c, t, g, unknown or other
  misc_feature (719)..(719): n is a, c, g, or t
tcagtacgctgtctcacgaccggtgctcgatttagctgcgtcacgatctctcgttggggggggtctcaggaggcagcgctctcaggacatctccaccatggcctgggctctgctgctcctcaccctctcactcgagggcacgagggtcctcgggcccagtctggcctgacacacgcctgcctcgtgtctgacgactccgtggactaggtcatcacctattcctctagcctacgtacggaaccnggactagtcggtaacggtttgggtactactttaagtaatttacgtcgttaccgttccgttacggttaccaaaacgtcggtacctaagtttaccgaacgggtacccgtaaccggacccccgtaaaccccgtaaaattttccgttttaaaagtttagtacggttacggttttccttcccgggtacccggtccgttacgggttacgggtttaccgtacggttccgttccgtttccgtcccgggtaccttaaccggtaacggttcctacggggtaaccctaaaccgggaaccccggttcccttacccggtaaccgtaaccgttaacgttcccttaacggttaaacgtacccgttaccggaggtaccgttaagggaaccgggtacggaacggtccgttaacgttaacgtttaacgtcgttacgacgttacggaccttacgtaaacttacgttaacgtaacgtaacgttactaaacgggttnttaacccgtactacggttcggtaaggttacggttaaccgggaccggggttaaacgtaccgggttaaaccgtaccggttaacccgggttacctagggaacccccgttaaaccggg

SEQ ID NO: 275861 - DNA, 851 bp, Homo sapiens
  misc_feature: GYAE6OF01EPOQX.36.36.D03.1.454.CMB.1.raw
tcagtacgctgtctcacgaccggtgctcgatttagctgcgtcacgatctctcgttggggggggtctcaggaggcagcgctctcaggacatctccacatggcctgggctctgctgctcctcaccctcctcacgtcgacgggcacgacgggtcctcgggcccagtctcgccctgactcacgctgcgtcgtcgtcgtcgggtctcgtggacagtcgactcacctattcctccgtgacctacgtacgggaacccagtaccgtaggttcggtaacgttttagggtaacggtaaaacctaaacgttcgtaacgttcgttcctacccgttaacgggtaaacccaaacggtaccgtaacccgaggaccaaaaccgtaccccaaactctactactttacgtttttacggacgttacggtacgtcccgtccgtacggtacgttaacgtttctaacgttcgtacctttcgtacgtcggtaccttaccgtagtttaccgtaccggaaccctaacccggtcccggtaccccgtttaccgtaacgaaccccgtttactccgggtttaccgggtaccggtacccttacccggacggtaccgtaaggggaaccggggaccggtaacggtaccgtttaaggtaacttttttaaacgtttccgttacccgttttaccaacccgttaagttaacccgttaccgggtaacggggtaccgtttaacggtttaccggtttcgggtttcccggttacgggggcccgggttacccgtacccctacgggttaccgtaacccggttcggtaaccggtacccgaacgggtaccccttacgggcccgttaccccgggccccgttcgtaccgttaccccg

SEQ ID NO: 275862 - DNA, 682 bp, Homo sapiens
  misc_feature: GYAE6OF01AM6QB.36.36.D03.1.454.CMB.1.raw
  modified_base (173)..(173): a, c, t, g, unknown or other
  misc_feature (173)..(173): n is a, c, g, or t
  modified_base (327)..(327): a, c, t, g, unknown or other
  misc_feature (327)..(327): n is a, c, g, or t
tcagtacgctgtctcacgaccggtgctcgatttagctgcgtcacgatctctcgttgggggggggtctcaggaggcagcgctctcaggacatctccaccatggcctgggctctgctgctcctcaccctcctcactcagggcacagggtcctgggacccagtctgccctgactcngcctgcgtccgtgtctgggtcctccgtggacagtcgactcaccatcctcctgccacgtacggaaccagctagtgtacgtttggacggtaacaatcattcgtcctccgtacggaccaacgacgtacccgaagaccaaaccgacccccaaactacncttacttagttttgacggtcggtacgtccggacccttagtaaggttaactttactaattccgtccttctcgtcggccttaccgagtcctacgacccaacgcccgtccctcccacgacctctccgtcgtacgggccctaccgcgtcccgtaggacgggacggtaggtctagttaacctttacgtttacttcgttacctactaactactacggaacggttccgggtatttaccggttcggttaccggtttccggggcccgggtaccccggtaccaaccccggttcggtaccccgttacggtacggtaccgaccggacccgtacggtcccaccccggtcccccgtcgtcccggttccc

SEQ ID NO: 275863 - DNA, 698 bp, Homo sapiens
  misc_feature: GYAE6OF01AHFZD.36.36.D03.1.454.CMB.1.raw
  modified_base (598)..(598): a, c, t, g, unknown or other
  misc_feature (598)..(598): n is a, c, g, or t
tcagtacgctgtctcacgaccggtgctcgatttagctgcgtcacgatctctcttgggggccctgggattttcaggtgttttcatttggtgatcaggactgaacagagagaactcaccatggagtttgggctgaactggtctttttcttgtggcttattttaaaaggtgtccagtgtgaggtgcagcgtggttgggagggtcggggggaggtccgttgggtacgaggtcccggtcggggggtccctggacgtacctctccgtgtcgcacgcctcgtggtactttcctccgtttacgcctacctatcgacctagtcgacggtccgttcggggtcccgaccggacggtcccgtaccgggaagggggaacggggtacggttggggtacgggttcgggttacctacgtacgttcctagtttacggtcggtaccgtacggtcttacacttacacttacgtccgacacgtaccgttcggacggacggtccgtcactagtcgacagaacgactaacgtacaagaccatatacgtatctagacaagtaccgaacgcgtcgaggacgcccggaacggaccgaccgtacccggtcgtactttacgtcgngtaccgagtaccgttgtttacgtacggttacgtgtaggggtacggtaggggtaccgggacgtacggtacgggacgggacctaggtacgtcccgggttacg

SEQ ID NO: 275864 - DNA, 641 bp, Homo sapiens
  misc_feature: GYAE6OF01BLYI0.36.36.D03.1.454.CMB.1.raw
  modified_base (175)..(175): a, c, t, g, unknown or other
  misc_feature (175)..(175): n is a, c, g, or t
  modified_base (257)..(257): a, c, t, g, unknown or other
  misc_feature (257)..(257): n is a, c, g, or t
  modified_base (279)..(279): a, c, t, g, unknown or other
  misc_feature (279)..(279): n is a, c, g, or t
tcagtacgctgtctcacgaccggtgctcgatttagctgcgtcacgatctctcgttggggggggtctcaggaggcagcgctctcaggacatctccaccatggcctgggctctgctgctcctcaccctcctcactcagggcacgtacgggtcctcgggccagtctcgccctgactcncgcctgccgtcgtgtcgtggtctcgtggacagtcactcacctatcctctgcacgtcgaccagctagtgtacgttggtagaanatcatcgtctcgtacgaaccanacgtacccgagaccaaaccaccccaatcactacttagtttcggacgtcggtatccgccgtactaggtactttactacgttcgtacttctcggtcgtacctacgtaagtctaaccgtaccaaaccgtccggtccctaccgtaccgactacgtcgttacgtcgggtaccttcccgacgtaccgtaggaccggacggtcgtacttagttactttacgttacttccggtactaccgtacttactacggtaaccgtcgggtaaccgtttgtccggttccggttacgggccggtacccgtaacccgtcggtaacgtccgtaccgtagccgaaaccgccgacgtcccgaccctcccgtagtccgtaccg

SEQ ID NO: 275865 - DNA, 796 bp, Homo sapiens
  misc_feature: GYAE6OF01D1DPU.36.36.D03.1.454.CMB.1.raw
  modified_base (115)..(115): a, c, t, g, unknown or other
  misc_feature (115)..(115): n is a, c, g, or t
  modified_base (220)..(220): a, c, t, g, unknown or other
  misc_feature (220)..(220): n is a, c, g, or t
tcagtacgctgtctcacgaccggtgctcgatttagctgcgtcacgatctctcgttggggggggtctcaggaggcagcgctctcaggacatcctccacatggcctgggctctgctnctcctcaccctcctcactcgagggcacgacgggtccgtcgggcccagtctcgcctgactcagcctgtcgttccgtgtcgtgggtcctccgtaggactagtccganccgaacctacttcctcctcggacctacgtacggaaaccaggctagttcgttacgtttgggtaacgtaaactacttcgaacttcgtccgtccggttaacgtaaccaaaccggtacgtaacccgaaggaaccaaacccgaccccctaaatcttaacttctttagtttttcgacggtcggtaacgtccgacctaggtaagtaactttctaacgtcctacttcgtcgtcggtaccctaactacggtcctaacgacccaaccggtcccgtaccctttaccgacgaccctctccggtccgtcggtccctaccgaacggtccgtacgggaacgtcggtaccggtctttacgttaactttacgttaccgtttccgttacctaacttacgttacgttaaccgtaaccgggttacggtttacggtttaccggtttcgggtttaccgggtttacccgggtaccggtaccccggtacccgtacccggtacccggtacccggttaccggttaaccggtacccgacccggtaaacccggtacccggttccccgttaccccggtcccccggtttaaccgccctttaccccg

SEQ ID NO: 275866 - DNA, 792 bp, Homo sapiens
  misc_feature: GYAE6OF01C50YV.36.36.D03.1.454.CMB.1.raw
tcagtacgctgtctcacgaccggtgctcgatttagctgcgtcacgatctctcgttggggggggtctcaggaggcagcgctctcaggacatctccaaccatggcctgggctctgctgctcctccaccctcctccactcgagggcacgacgggtccgtcgggcccagtctcgccctgacctcacgcctggccgttccggtcgttcggttcgggtccttccgtacggacgtagtcgacttccaacctcttcctccgtcaccgtacgtacggaaccagcgtagttgttacgtttgggtaagtaaccattactagttcgtccttcgtaccgtaaccaaccgaccgtaaccgaacggaccaaaccgacccctaactcgtacttcttttacgtttgtaaccggtcggttaccgtccgtaccgtacgtaacgttactttacgtaactcgttacttccgttacgtcgtacctacgtacgtctaccgacctaaccgtacccggtccctaccgtaccgtaccttccgttcgttaccgcggtcccgtaccgaccgtacggtacggaacgggtacgtacggtcgtttaattacggtttactttaccgtttacccgttctaaccttaacttaccggttaacgtaacggttccggttaacgtttaccggtttcggtttaccgggttcccgggaccgggtaccccggtcccgttacgggcccgttacccgttaaccggaccggttaccgtacccggaccgtacccggttacccgttcccccggttacccgtccgttcccttaccccgg

SEQ ID NO: 275867 - DNA, 704 bp, Homo sapiens
  misc_feature: GYAE6OF01EH7Y8.36.36.D03.1.454.CMB.1.raw
  modified_base (172)..(172): a, c, t, g, unknown or other
  misc_feature (172)..(172): n is a, c, g, or t
  modified_base (328)..(328): a, c, t, g, unknown or other
  misc_feature (328)..(328): n is a, c, g, or t
tcagtacgctgtctcacgaccggtgctcgatttagctgcgtcacgatctctcgttgggggggggtctcaggaggcagcgctctcaggacatctccacatggcctgggctctgctgctcctcaccctcctcactcagggcacgagggtcctgggcccagtctcgccctgactnagcctgcgtccgtgtcgtgggtcctccgtgggacagtcgatcactatcctctgaccacgtcggaaccagtcagttgtacgtttggtagtaaacaatcgtatgttcctccgtagtaaccaaacacgttaacccgaggacctaaaaccgcccccaaanccgtatcgttattttcgacgtcggtacgtcggtaccctatacggtaactttctaaacgtcgtccttacgtcctcgggacctccgtaaagtcctacggaccctaaaccgacccgggtaccccttcccgtaccgtaaccctaactttcccgtcgttccggggtaccccttaccggaccgtaccgttacggaacgggaacgtacggtctacgtaatttaaccgttcttcgtttcctaaccgtactagtttaccgaacggtccggttaacgtcgttcgttacggttttccggcgggtacccggaccctacggtccgtaaccggtcgtacgccgtaccgaccgtaacgggtcctaccccggtcccgttcgtacccgtcccg

SEQ ID NO: 275868 - DNA, 718 bp, Homo sapiens
  misc_feature: GYAE6OF01DUVM2.36.36.D03.1.454.CMB.1.raw
tcagtacgctgtctcacgaccggtgctcgatttagctgcgtcacgatctctcgttggggggggtctcaggaggcagcgctctcaggacatctccaccatggcctgggctctgctgctcctcaccctcctctactcgagggcacgacgggttccgtcgggcccagtctcgccctgacctcacgcctgccgtcgtgtcgtcgggtctccgtggacgacgtcgactacaccacgtcctcgtcgaccgtacgtacggaaccagacgtagttcggtacgtttaggtaagtaaactaatctagttcctactaccgtacgtaaaccaacgtaccgaaccgaacggaacctaaaccgacccctaaatctaagttacctttagtttttacggacggttacggtccggtccgtaacctcgtaagttactttacgtaagttccgtacttccgtcgtcggtaccttactaacggtcctaccgtaaccaacccggtccgtaccctaccgtcgtaacctcgttcgtaccgtcggtacccgtcgacggtcgacggacggtacggtacgtactaagttactttacgttactggaactcgtacttaacgtattaaccgttacgtaagttaactacggtaacgttagtacccgttacgtaggttcggttcgtaccggggtacgggacggtaacggtacttacggtcccttacggtacgtacgcgtaccggtaaccg

SEQ ID NO: 275869 - DNA, 860 bp, Homo sapiens
  misc_feature: GYAE6OF01DVQJ5.36.36.D03.1.454.CMB.1.raw
tcagtacgctgtctcacgaccggtgctcgatttagctgcgtcacgatctctcttgggggccctgggattttcaggtgttttcatttggtgatcaggactgaacagagacgaactcaccatggtagttggctgaactggtcttttctgtggtacttatttaaaaggtgtcctagtggtgaggtgcagtctggttgggaggtcggggggtagtcgttggtacgtacggccggtcgggggtccctaggacgtaccgttccgtccgtgtcgcgtacgtcccgttgtcggtactttccttccttacgcctaaccttagtaccgacctagtacgtacggtccggttcgggtacccgtaccgtacggtccgtaccgggaacggggtaacgggtacggtggggtaggggttcggtacccttacgtaaccgttaccgtaaggtttacgggttccgtaacccggaccggttaacgttacctaagtaccttacgtttaccgttacggtaacccgtaccggttacccttacccgggttaacggggaacccgggttaccccggtttaacgaacccgttaggttaccggtacccgtaaacgggtaccgtaaaccgttaaacgttaacccgaaacccgaaacgtaacccggaacttaacgtaacgttaccgtaaccgggaacttaaacggtacaaacccgtacgtaaccgtagaacgggacgaccgggaacgtacccgtacggtacccgttcgttaacgttcgtacggtgtaaccggtacttacggttacgttacggttaagtcgttaacgggtggttaaccggggacgggtacgtaccgttacggacgggaacctagggtaccctcgggtaccg

SEQ ID NO: 275870 - DNA, 852 bp, Homo sapiens
  misc_feature: GYAE6OF01DXOGN.36.36.D03.1.454.CMB.1.raw
tcagtacgctgtctcacgaccggtgctcgatttagctgcgtcacgatctctcgttggggggggtctcaggaggcagcgctctcaggacatctccaccatggcctgggctctgctgctcctcacccctcctcactcagggcacgagggtcctgggcccaggtctgccctgactcagcctgcgttccgtgtcgtgggtctccgtggacagtcgatccacctactcctcctggacctacgtacgggaacccagcgtagtcggtacgttttgggtaacggttaaacaaattctaagttcgtccgttaccgtacgggtaaacccaaaccgtaaccggtaaccccaagggaacccaaaacccggaccccctaaaaacgttctaactttacgttttaacgtttttacggtaaccggttccgggtttaacgtcccggtacccctacggtaaggttaaacttttcctaacttccggttactttaccgtcgtacggtacccttaccgtaacgttccgtaccgacccgaaaccgtaccccgtacccgttcccgtacggtaaccctacgttccgtccgtcggtccgtccgacggtccgtacggacgggtacggtcggtacgttagtaacttttacttaccgtttccgttacctactaccgttaacgttccggtaacgggttacccgggttaacgtttccggtttaccgggtttcccgggtttacccgggggccgggtacccccgggtaaccccgttaccggttaaccgggtaacccccgggtttcggtaccggtacccggtaacccgtaccccgggtaaccggttcccttaccccggttcccccgttcgggtccccttacccgg

SEQ ID NO: 275871 - DNA, 695 bp, Homo sapiens
  misc_feature: GYAE6OF01EZYY7.36.36.D03.1.454.CMB.1.raw
  modified_base (199)..(199): a, c, t, g, unknown or other
  misc_feature (199)..(199): n is a, c, g, or t
  modified_base (239)..(239): a, c, t, g, unknown or other
  misc_feature (239)..(239): n is a, c, g, or t
  modified_base (241)..(241): a, c, t, g, unknown or other
  misc_feature (241)..(241): n is a, c, g, or t
tcagtacgctgtctcacgaccggtgctcgatttagctgcgtcacgatctctcgttgggggggggtctcaggaggcagcgctctcaggacatctccaccatggcctgggctctgctgctcctcaccctcctcactcgagggcacagggtcctgggcccagtctgccctgactcagcctgcgtccgtgtctgggtctccgnggacagtcgatccacctatcctcctgccacgtcggaaccngntagtgtacggttggtagttataactttgtcctccgtaggtaaccaacgacgccaaccgaggcacgtaccgaccccaaactcaattgtatttatggtacggtacaagtaacgtccggtcccgtggtacggggtttctaggtacttccgtctttactcgtcggtcctaccgaacggtcggtacggccgtaccgtcccggtccctcccgtacgtaccctacgtcctcggtcggcctccgacgtccgtagggtacgggacgtcggtacttagtaactttacgtacgtcgtaacgtacggtcctaacgttaactaacgtaaccgtaacggtacgacctaacggtacctaccgttccggtttcccggttaccggtaaccggggtaaaccggttaccgggtaaaccgttaccggtaccgttacggttacccgttacggtacccggaacccgtaaccccggg

SEQ ID NO: 275872 - DNA, 864 bp, Homo sapiens
  misc_feature: GYAE6OF01E1YYV.36.36.D03.1.454.CMB.1.raw
tcagtacgctgtctcacgaccggtgctcgatttagctgcgtcacgatctctcttgggggggggtctcaggaggcagcgctctcaggacatctccaccatggcctgggctctgctgctcctcaccctcctcactcagggcacgagggtcctgggcccagtctggcctgacacacgcctgcctccgtgtctgagacctccgtggacagtcgactccacctatcctcctcgacctacgtacggaaccacgcgtaggttcggtacggtttgggtactacttttaagttaaatttagtccgtttaccgttacccgtttacgggttaccccaaaacgtacggtacttaacgtttccggaacgggtcccaaccgggtacccccggaaacccccgtttaaaaccgttttaactttttaaaacgttttaggttacgggttaacgggtttttcccgttttacccgggaccccgggttaccccgtttagggtttaaccggggggttttactacggttcccggttacctttcccggtcccggtacctaccgttaaggtcccgtacggacctaaacccggcccgttacccgtcccgtaccgtaccctacgttccttacgtaaaccgtacccgtaccgacgggtccgtacgggacgggtacggtacgtacgtacgttaacgtttatttacggtcacgtacgtaccgttacgtaacttacgtaagtacggtaagtaccgttaaacggttacggttacctacccggtacggtcggtttcggttacccggggttaacgggaccggggtaaccggggttaaacccgttaacggggttccggttaacccccggtttaggtacccggggtacgtaaaccccggg

SEQ ID NO: 275873 - DNA, 985 bp, Homo sapiens
  misc_feature: GYAE6OF01B778I.36.36.D03.1.454.CMB.1.raw
  modified_base (236)..(236): a, c, t, g, unknown or other
  misc_feature (236)..(236): n is a, c, g, or t
  modified_base (267)..(267): a, c, t, g, unknown or other
  misc_feature (267)..(267): n is a, c, g, or t
tcagtacgctgtctcacgaccggtgctcgatttagctgcgtcacgatctctcgttggggggggtctcaggaggcagcgctctcaggacatctccaccatggcctgggctctgctgctcctccacccctcctcactcgaggccacgacgggtcctcgggcccagtccgtcggcctacgacacacgtcctcgcctccgtgtcgtgacgacctcgtacggacagtacgactaccacccngttccctccgtacgccaacgtacggaaaccngacctaggtacggtacggtttggttcgttaactttaagttaactttacgttccgttccgtttaccgttacggttaacccaaaccggtacgtaccgtttaacgtcggaacggtaaccgaacccggtaacccggttaaacccccggttaaactttttaacgtttaaaccgttttacggttaagggttttaccgggtttaccccggtttacccgggttccccggtttccccgggtttaaacggttttaccgggggtttttaccttacccggggttccccgtttcccgggtttaccccgggttaccccgggttacctttaaacccgggttaaccgttcccggttaaccgggaccccgtaaccccgggtaacccccggttcccccgttaccccgttaacgaacccccgttttcgttaacccccgtttaacgttaaccccggtaaccggtttacccgaaccgggttaccggtaaaccggggtaaccgggtaaccgggacgttaaccgtttaacggttaacgtttaacgttttccgtaacgtcccgtaaatttcccgtaagttaacctttacgtaaccggtaacgtacgttaattaacgttacgtacccgttaccggttacgtccgggttttgacccgggttacggggttaaccgggtacccggtaacgtttaacccggttaccggttacccggttaacgggttaccgcccggttaaaccccggg

SEQ ID NO: 275874 - DNA, 755 bp, Homo sapiens
  misc_feature: GYAE6OF01DR1S9.36.36.D03.1.454.CMB.1.raw
  modified_base (244)..(244): a, c, t, g, unknown or other
  misc_feature (244)..(244): n is a, c, g, or t
  modified_base (725)..(725): a, c, t, g, unknown or other
  misc_feature (725)..(725): n is a, c, g, or t
tcagtacgctgtctcacgaccggtgctcgatttagctgcgtcacgatctctcttgggggggtctcaggaggcagcgctctcaggacatctccacatggcctgggctctgctcgctcctcaccctctcactcagggcacgacgggttcctcgggccctagtcctcgccctgactcacgcctgccgtcgtgtctcgggtctcgtggactagtcgactccactactcctcctgccacgtacggaccngctagtcgttacgtttggtaacgtaacaatcgtattcgttccgtaccgtacggtaaccaacgtaccgtaaccgaacggtacccaaaccgccccctaaaatcctacttacttacgttttacgacggtttcggtacgtcccggacctagtagttactttcaacgtcgtctcgtacgtcgacctacgtactcgtacaccgaaccgtccgtcccttacctacgtaaccctcgtcccgttggccggttccctacgtacggtccgtacgggaacggtaaccgtcggtacgttaacggttaacttttccgttaaccgtttccgtttacccgtaacttaacgttaaccgttacggtaaccgggttaccgtttaacggtttcggtttccggttaaccggtttccggggcccggtaccccgacccgttaccggtacccggttaaccggtccgttacggtaccccgacggtaacccggtacggttacccccncccgggttacccctaggttcccttccccgg

SEQ ID NO: 275875 - DNA, 738 bp, Homo sapiens
  misc_feature: GYAE6OF01BMGHI.36.36.D03.1.454.CMB.1.raw
  modified_base (141)..(141): a, c, t, g, unknown or other
  misc_feature (141)..(141): n is a, c, g, or t
  modified_base (528)..(528): a, c, t, g, unknown or other
  misc_feature (528)..(528): n is a, c, g, or t
tcagtacgctgtctcacgaccggtgctcgatttagctgcgtcacgatctctcgttggggggggtctcaggaggcagcgctctcaggacatctccacatggcctgggctctgctgctcctcaccctctcactcgaggcacgnggtccgtcgggcccagtctcgccctgacctcacgtcctggccgttccgtgtcgtcgggtctccgtggacagtcgactcacctatcctcctgaccacgtacgggaaccagacgtaggtcgttacggtttagggtaacgtaaactaagtctacgtcgttcttaccgtaggaaccctaacgaccgtaacccgaacggtaaccaaaacccgaccctaaactctacgtttacttagtttttcggacgttacgggtacgtccggtacctagtaacgttaactttactaattcgtactttccgtacgtcgtacctaccgtaacgtctaccggaaccctacgtaccccgttcctaccgaccgtaacctacttccggtacgttcggccttaaccgngtacccgaggaccggtacgtacggtcttagtaacttttcttacgttacgttaccactaacgtaactacggtaaccggtacggttacgtttcgttccgggttagggtcccggggaccggtacccgaaaccccttgggtcccggttaccggagttaccggtacgccgacccggttacgcccgacccggtaccccgtcggttacccttacccg

SEQ ID NO: 275876 - DNA, 544 bp, Homo sapiens
  misc_feature: GYAE6OF02IBUXW.36.36.D03.1.454.CMB.1.raw
  modified_base (422)..(422): a, c, t, g, unknown or other
  misc_feature (422)..(422): n is a, c, g, or t
tcagtacgctgtctcacgaccggtgctcgatttagctgcgtcacgatctctcttgggggccctgggattttcaggtgttttcatttggtgatcaggactgaacagagagaactcaccatggagtttgggctgaactggctttttcttgtggctattttaaaaggtgtccagtgtgaggtgcagctgttggagtcgggggaggcttggtacaggcctggggggtccctgagactctcctgtgcagcctctggattctcctttagcacctatgccatgagctgggtccgccaggctcccgagggaacgggactggagtgggtctcatccattagtggtcacggacttcatacatacttcgcagactccgtgaacgggccgttcaccatgtccagagacaattccaaagaacaacacagtatacngacaaatagaacagcctagagagcgagacacgcgtctacttctgtgcgaagcctttagtgttaccggttatgagttacggaagggggcggacgtacggtggggaccagggtactccgtacgg

SEQ ID NO: 275877 - DNA, 576 bp, Homo sapiens
  misc_feature: GYAE6OF02HSIR5.36.36.D03.1.454.CMB.1.raw
tcagtacgctgtctcacgaccggtgctcgatttagctgcgtcacgatctctcttggggggggtctcaggaggcagcgctctcaggacatctccaccatggcctgggctctgctgctcctcaccctcctcactcagggcacgagggtcctgggcccagtctgccctgactcagcctgcgtccgtgtctgggtctcctggacagtcgatcaccatctcctgcactggaaccagcagtgactttggtggtaacaatcatgtctctggtaccaacagtacccaggacaaacgcccccaaatcatctatttttgacgttcggtagtcggccctgaggtaatttctaatcgtcttctctggctccaagtctgaccaacaccggccctccctagacctatctcgtcgggctccgagcctggacggacggaggtctaggtactttattactcgtttcctactactacgttacgaacggtccggtaagttacgttggtccgttttcgggccggtccggacccgtaccgtcgtacccgtccgtacggtccacgccctaacggcctccggtcccctcggtcctaccg

SEQ ID NO: 275878 - DNA, 559 bp, Homo sapiens
  misc_feature: GYAE6OF02JA873.36.36.D03.1.454.CMB.1.raw
  modified_base (367)..(367): a, c, t, g, unknown or other
  misc_feature (367)..(367): n is a, c, g, or t
tcagtacgctgtctcacgaccggtgctcgatttagctgcgtcacgatctctcttggggggggtctcaggaggcagcgctctcaggacatctccaccatggcctgggctctgctgctcctcaccctcctcactcagggcacagggtcctgggcccagtctgccctgactcagcctgcgtccgtgtctgggtctcctggacagtcgatcaccatctcctgcactggaaccagcagtgactttggtggtaacaatcatgtctcctggtaccaacagtacccaggcaaacgcccccaaactcatcatttttgacgtcggtagtcggccctcaggaatttctaatcgcttctctggctcaagtctgccaacnccggcctccctgacccatcctcgtcgggcctccgagcctgacggacgaggctgtattattactgttcctcactattcaacgtccggtagttacgttggtcgttttcgggcgggtccggacccgtaccgtcggtacccgtccgtacggtccacgcccgaacggtccgtccggcccccgttcggtccctacccg

SEQ ID NO: 275879 - DNA, 513 bp, Homo sapiens
  misc_feature: GYAE6OF02INWOG.36.36.D03.1.454.CMB.1.raw
tcagtacgctgtctcacgaccggtgctcgatttagctgcgtcacgatctctcttgggggggtctcaggaggcagcgctctcaggacatctccaccatggcctgggctctgctgctcctcaccctcctcactcagggcacagggtcctgggcccagtctgccctgactcagcctgcgtccgtgtctgggtctcctggacagtcgatcaccatctcctgcactggaaccagcagtgactttggtggtaacaatcatgtctcctggtaccaacagtacccaggcaaagcccccaaactcatcatttttgacgtcggtagtcggccctcaggatttctaatcgcttctctggctccaagtctgccaacaccggcctccctgacccatcctctagaccttccaggctggaggacgaggctgactattatgcagctcatatactgaaagtcaaattggtacttccactcggcttggttcggcggagggaccagttcgaccgtcgtaggtccaggacccg

SEQ ID NO: 275880 - DNA, 567 bp, Homo sapiens
  misc_feature: GYAE6OF02GVLIK.36.36.D03.1.454.CMB.1.raw
  modified_base (324)..(324): a, c, t, g, unknown or other
  misc_feature (324)..(324): n is a, c, g, or t
  modified_base (366)..(366): a, c, t, g, unknown or other
  misc_feature (366)..(366): n is a, c, g, or t
  modified_base (375)..(375): a, c, t, g, unknown or other
  misc_feature (375)..(375): n is a, c, g, or t
tcagtacgctgtctcacgaccggtgctcgatttagctgcgtcacgatctctcttggggggggtctcaggaggcagcgctctcaggacatctccaccatggcctgggctctgctgctcctcaccctcctcactcagggcacagggtcctgggcccagtctgccctgactcagcctgcgtccgtgtctgggtctcctggacagtcgatcaccatctcctgcactggaaccagcagtgactttggtaggtaacaatcatgtctctggtaccaacagtacccagcaaacgccccaaactcatctattttgacgtcggtagtcgcctanaggtaatttctaatcgcttctctgctacagtctcgaccaacnccgcctccncgacctactctcgtcgggctccgacgcctggacggacgacggtctagtattacttacttcgttcctactactacttacaacggtcgtacgttacgttggtccgttttcgggcggtaccggaccctaccggtcgtacccgtccgtacggtaccacggtcccgaacggccgttccgccccgtcggtcctacccg

SEQ ID NO: 275881 - DNA, 587 bp, Homo sapiens
  misc_feature: GYAE6OF02IM0GB.36.36.D03.1.454.CMB.1.raw
  modified_base (362)..(362): a, c, t, g, unknown or other
  misc_feature (362)..(362): n is a, c, g, or t
tcagtacgctgtctcacgaccggtgctcgatttagctgcgtcacgatctctcttggggggggtctcaggaggcagcgctctcaggacatctccaccatggcctgggctctgctgctcctcaccctcctcactcagggcacagggtcctgggcccagtctgccctgactcagcctgcgtccgtgtctgggtctcctggacagtcgatcaccatctcctgccactggaaccagcagtgactttggtggtaacaatcatgtctcctggtaccaacagtacccaggcaaacgcccccaaactcatctattttgacgtcggtagtcggcctcaggtaatttctaatcgtcttctctgctcaagtctnccaacacgcctcctcgaccatctctcggctccacgcctgacggacgaggctgtactttattactcgttacctctaactactttcgaaacgtccggtaacgttacggtttcggtcgtttttcgggaccgggtccggaaccctaccgttcggtacccggttaccgttacgggttaccgaacggtacccgaacggtcccgttccggcccccgttccggtccctacccg

SEQ ID NO: 275882 - DNA, 524 bp, Homo sapiens
  misc_feature: GYAE6OF02I58HD.36.36.D03.1.454.CMB.1.raw
  modified_base (326)..(326): a, c, t, g, unknown or other
  misc_feature (326)..(326): n is a, c, g, or t
  modified_base (468)..(468): a, c, t, g, unknown or other
  misc_feature (468)..(468): n is a, c, g, or t
tcagtacgctgtctcacgaccggtgctcgatttagctgcgtcacgatctctcttgggaggggtctcaggaggcagcgctctcaggacatctccaccatggcctgggctctgctgctcctcaccctcctcactcagggcacagggtcctgggcccagtctgccctgactcagcctgcgtccgtgtctgggtctcctggacagtcgatcaccatctcctgcactggaaccagcagtgactttggtggtaacaatcatgtctcctggtaccaacacgtacccaggcaaacgccccaaactcatctattttgacgtcggtagtcggcctnaggtaatttctaatcgtcttctctggctccaagtctgccacacgcctcctcgaccatcctctcgggctccgacgcctgacggacgacgctagtatttatacttgttcctcactatcaagccgtagtacgttgtcttttcggnggtccgaccgtctcgaccgtcgtagtccacgccaaggcctacggtcccctacggtc

SEQ ID NO: 275883 - DNA, 531 bp, Homo sapiens
  misc_feature: GYAE6OF02ICGJ2.36.36.D03.1.454.CMB.1.raw
  modified_base (228)..(228): a, c, t, g, unknown or other
  misc_feature (228)..(228): n is a, c, g, or t
tcagtacgctgtctcacgaccggtgctcgatttagctgcgtcacgatctctcttgggggggtctcaggaggcagcgctctcaggacatctccaccatggcctgggctctgctgctcctcaccctcctcactcagggcacagggtcctgggcccagtctgccctgactcagcctgcgtccgtgtctgggtctcctggacagtcgatcaccatctcctgcactggaaccngcagtgactttggtggtaacaatcatgtctcctggtaccaacagtacccaggcaaacgcccccaaactcatcatttttgacgtcggtagtcggcctcaggtaatttctaatcgcttctctgctcagtctgccaacacggcctccctgaccatctctcggctccagcctgaggacgaggctgattatactgttcctcactattcaagccgtagtcttggcttttcgggcgggtccggacccaccgtcgtacccgttccgtacggtccacgtcccgaaggtcctccggccccctcggtcctaccg

SEQ ID NO: 275884 - DNA, 596 bp, Homo sapiens
  misc_feature: GYAE6OF02HT62U.36.36.D03.1.454.CMB.1.raw
  modified_base (229)..(229): a, c, t, g, unknown or other
  misc_feature (229)..(229): n is a, c, g, or t
  modified_base (244)..(244): a, c, t, g, unknown or other
  misc_feature (244)..(244): n is a, c, g, or t
  modified_base (271)..(271): a, c, t, g, unknown or other
  misc_feature (271)..(271): n is a, c, g, or t
  modified_base (502)..(502): a, c, t, g, unknown or other
  misc_feature (502)..(502): n is a, c, g, or t
tcagtacgctgtctcacgaccggtgctcgatttagctgcgtcacgatctctcttggggggggtctcaggaggcagcgctctcaggacatctccaccatggcctgggctctgctgctcctcaccctcctcactcagggcacagggtcctgggcccagtctgccctgactcagcctgcgtccgtgtctgggtctcctggacagtcgatcaccatctcctgcactggaaccngcagtgtactttggngtcttaatattatgtctctgttccaanagcattcgaggcacgccgacccgtaactctttaatttagtgtagttctttcgcggtcccgtgtacgggtttctacgtcgtctttccgtccggtctacctaagtctggacctaaccgaccggtccctcctagaccctattcgtacctaacgtacctaccgaggtctacgggagacgtaggtctagtaactttatagttcgcgtagtctacgattaacgtacgtagtaacgtntaaagtgtaactcgtacgttggacttcggtacggggacggaacgggtacctaaggtttccggacccgtttaccgtagggtccaacggtacccgg

SEQ ID NO: 275885 - DNA, 541 bp, Homo sapiens
  misc_feature: GYAE6OF02I5ZV4.36.36.D03.1.454.CMB.1.raw
  modified_base (535)..(541): a, c, t, g, unknown or other
  misc_feature (535)..(541): n is a, c, g, or t
tcagtacgctgtctcacgaccggtgctcgatttagctgcgtcacgactctcctgtgcagcctctggattctcctttagcacctatgccatgagctgggtccgccaggctccagggaagggactggagtgggtctcatccattagtggtcacggacttcatacatacttcgcagactccgtgaagggccggttcaccatgtccagagacaattccaagaacacacagtatctgcaaatgaacagcctgagagccgaggacacggccgtctatttctgtgcgaaagcctttagtgttaccggttatgagttcggaaagggggcgactacgtggggccagggaatccgtggtcaccgtctcctcagcctccaccaagggcccagtccggtccttccccgtggccgccctgctccagggacgccacctccgagacgccacgacgccggccctgggcctcggccctgggtaccaagggtacctaccgttccgacgacgacgtcgtactgaggcgggcgtggaccgaagggccgcagtagnnnnnnn

SEQ ID NO: 275886 - DNA, 577 bp, Homo sapiens
  misc_feature: GYAE6OF02IY6EQ.36.36.D03.1.454.CMB.1.raw
  modified_base (429)..(429): a, c, t, g, unknown or other
  misc_feature (429)..(429): n is a, c, g, or t
tcagtacgctgtctcacgaccggtgctcgatttagctgcgtcacgatctctcttggggggggtctcaggaggcagcgctctcaggacatctccaccatggcctgggctctgctgctcctcaccctcctcactcagggcacagggtcctgggcccagtctgccctgactcagcctgcgtccgtgtctgggtctcctggacagtcgatcaccatcctcctgcactggaaccagcagtgactttggtaggtaacaatcatgtctcctaggtaccaacacgtacccaggaccaaacgacccccaaaatcatactatttttcgacgtcggtagtccggtccctacgaaggtaacttctaactcgtcttctcgtgctaccaagtctcgaccaacgccggccctacccgactactctcgtcggctccgacgtccgngaggacgaggctagtattacttactgtcctcactattacaagccgtagttactttcggtcgtttccgggcgggtacccggaccctaccgtcggacccgtcctacggtccacgcccgtaacggcctccgccccgtcgtctaccgttccg

SEQ ID NO: 275887 - DNA, 526 bp, Homo sapiens
  misc_feature: GYAE6OF02GC0ZT.36.36.D03.1.454.CMB.1.raw
tcagtacgctgtctcacgaccggtgctcgatttagctgcgtcacgatctctcttgggggggtctcaggaggcagcgctctcaggacatctccaccatggcctgggctctgctgctcctcaccctcctcactcagggcacagggtcctgggcccagtctgccctgactcagcctgcgtccgtgtctgggtctcctggacagtcgatcaccatctcctgcactggaaccagcagtgactttggtggtaacaatcatgtctcctggtaccaacagtacccaggcaaacgcccccaaactcatcatttttgacgtcggtagtcggccctcaggtatttctaatcgcttctctggctccaagtctgccaacaccggcctccctgacccatctctcgggctccgacgcctgaggacgagctgattattactgttcctcactattcaagccggtatcgttggtctttcggcggtcggaccaccgtcgaccgtccgtaggtccagcccgaggcctcgccccgtcggtcctaccg

SEQ ID NO: 275888 - DNA, 560 bp, Homo sapiens
  misc_feature: GYAE6OF02H6V9N.36.36.D03.1.454.CMB.1.raw
tcagtacgctgtctcacgaccggtgctcgatttagctgcgtcacgatctctcttggggggggtctcaggaggcagcgctctcaggacatctccaccatggcctgggctctgctgctcctcaccctcctcactcagggcacagggtcctgggcccagtctgccctgactcagcctgcgtccgtgtctgggtctcctggacagtcgatcaccatctcctgcactggaaccagcagtgactttggtggtaacaatcatgtctctggtaccaacagtaccaggacaaagcccccaaactcatcatttttgacgtcggtagtcggccctcaggaattttctaatcgtcttctctggcctccaaagtctgacccaacgtaccggccctccctcgaccactctctcgggcctccagctggaacggacgaggctagtatttactacttcgttcctcactacttacaacgtccgtagtacgttggtccgttttcgggcgggtaccgacccgtaccgtcggaccgttccgtacggtcacgccgaaggccgtcgccccgttcggtctaccg

SEQ ID NO: 275889 - DNA, 575 bp, Homo sapiens
  misc_feature: GYAE6OF02FYP9L.36.36.D03.1.454.CMB.1.raw
tcagtacgctgtctcacgaccggtgctcgatttagctgcgtcacgatctctcttgggggccctgggattttcaggtgttttcatttggtgatcaggactgaacagagagaactcaccatggagtttgggctgaactggctttttcttgtggctattttaaaaggtgtccagtgtgaggtgcagctgttggagtcggggggaggcttggtacagcctggggggtccctgagactctcctgtgcagcctctggattctcctttagcacctatgccatgagctgggtccgccaggctccgagggaagggctggagtgggtctcatccattagtggtcacggtacttcatacatacttcgcagactccgtagaacgggcccgttcaccatcgtaccagagacaattccaaagaacacacagtatctagacaaatgaacagcctagagacgaccgaggaccaccggccgtactatttctgtcgacgtaacgtccgtttagtcgttaccggttagtaggtaggttacgggaaagggggtcggtacggttacggtcggggaccgagggtacgtccgtacggg

SEQ ID NO: 275890 - DNA, 1009 bp, Homo sapiens
  misc_feature: GYAE6OF02ITO7H.36.36.D03.1.454.CMB.1.raw
tcagtacgctgtctcacgaccggtgctcgattttagctgcgtcacgaagtacgtctcgttgggggggtcgtcaggaggcagtacgcgtactcgaggacaactctccaaccatggcctcgggccttcgtaggccgttgcctccttcacccctcgtcaacttccaaggacacaggtcctggccctagtcctaagccctagactccagccgtgcgtccggtagtccgtcggttactaccgttggactaggtcgaagtccacctatcccttacctagccacgtcgggaacctaggtcctaggttacgttacgttttacggtacggttaaacggaacgtaccggtaaaccgttcggttacctaccccgttacggttaacccctaaaccgtaaccggttaacccccgtaaccgggaacccgtaaaaaccggggaccccccctaaaaacgttcccggttaacctttacccccgttaaggtttttttaccggaaccccggtttaccgggttaaccgttcccgggaccccggtttaccggtaaccgggggttttaccctttaaacggttaccggtaccgttttacccgttaccgttaacggtcccggtaacccgtttacccggtaaacgtttccgtaccgggtaccgtaaacccggtaaccgggtacccctttaccccgttaccggaacccctttaacgttaccgttacccggtttaccgggtaccgttacccgggacggggtccgtttacggggaaacggggtaaaccgggtaacgggttaaccgtttaaacttttaccggttttacctacggtacccgttaaggtttacctaaacttaaccgtaaacctaaacccgtaaacggaacctaaaaccctacgtttaaccctcgggtacctttacgggttttaccgggaaccggggtaaccgggaaaccgaacgggttaccgtaccggtaaacccgttaccgttaaacggttaccgaaccggaaccccgtaacgggtccccgtaccccgg

SEQ ID NO: 275891 - DNA, 510 bp, Homo sapiens
  misc_feature: GYAE6OF02IZEY9.36.36.D03.1.454.CMB.1.raw
  modified_base (304)..(304): a, c, t, g, unknown or other
  misc_feature (304)..(304): n is a, c, g, or t
  modified_base (310)..(310): a, c, t, g, unknown or other
  misc_feature (310)..(310): n is a, c, g, or t
  modified_base (331)..(331): a, c, t, g, unknown or other
  misc_feature (331)..(331): n is a, c, g, or t
  modified_base (360)..(360): a, c, t, g, unknown or other
  misc_feature (360)..(360): n is a, c, g, or t
tcagtacgctgtctcacgaccggtgctcgatttagctgcgtcacgatctctcttggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccagcagtgaagttggtagttataactttgtctctggtaccaacagcaccaggcagacgccccaaatcaatgatttangaggtnagaatcgcctcgagggtttcngatcgcttctctggctcagtctggcgacncggcctccctgaccatctctgggctccgacgcctggaggacgaggctaggatttattactgacagtctactataactaacaagtagcagcacttcgtcgtacttacggaacgtcgggtaacaacggtcctacgtggtcctaggcaaccgg

SEQ ID NO: 275892 - DNA, 712 bp, Homo sapiens
  misc_feature: GYAE6OF02JBQKA.36.36.D03.1.454.CMB.1.raw
tcagtacgctgtctcacgaccggtgctcgatttagctgcgtcacgatctctcttgggggggtctcaggaggcagcgctctcaggacatctccaccatggcctgggctctgctgctcctcaccctcctcactcagggcacagggtcctgggcccagtctgccctgactcagcctgcgtccgtgtctgggtctctggacagtcgatcaccatctcctgcactggaaccagcagtgacgttggtgcttataattatgtctcctggttccaacagcattcaggcacgccgaccccgtaaacttctttaatttatggtaggttctttccggtcggtccctcgtacgggtttctacggttcgtcgtttccgtcccggtctaccgtaagttccgttacggaccaaccgtacccgggtcccttaccccgtagtaaccctaacttccctacgttaacgacccttccgacgggtaccttacgggaacgggtaccggtaacgggttccttacgggtaaacccttttaagttttacgttacggtaccgtaacggtacccttacgtaacgtttacgtaaccgttaggttaaacgttcgtaaaacgtttcgggttaacctccgtaaccgtgggtaaccgtttcggttaccggggaccgggtaacgggtacccgttaaacggtttcggtaacccgttaccgtacgggtaccgtaccgtaaccccggg

SEQ ID NO: 275893 - DNA, 647 bp, Homo sapiens
  misc_feature: GYAE6OF02HVYA3.36.36.D03.1.454.CMB.1.raw
  modified_base (233)..(233): a, c, t, g, unknown or other
  misc_feature (233)..(233): n is a, c, g, or t
tcagtacgctgtctcacgaccggtgctcgatttagctgcgtcacgatctctcttggggggggtctcaggaggcagcgctctcaggacatctccaccatggcctgggctctgctgctcctcacactcctcactcagggcacagggtcctgggcccagtctgccctgactcagcctgcgtccgtgtctgggtctccgtggacagtcgatccaccatcctcctgcactcggaaccngcagtgtactttggtgtaacaatcatgtctcgtgtaccaacacgtacccaggacaaacgaccccaaatcatctattttgacgtcggtacgtccgcctcgagtaactttctaatcgtcttctctcggtcctaccaagtctacgacccaacgaccggtccctcccgtcgaaccctacgttccttcgtacggtcctacccgacgtccgttaggaacggtaaccggaggtacgttagtaatttacttaccgttcgtttaccctactaactacgtttaccgaaacggttcccggtaagtttacgtttcggttaccgtttttccggggccgggtacccggtacccgaccgttaccggacccggttaccgtacggtccaccggtacccgaacggtccctccggtacccccgtcggtacccg

SEQ ID NO: 275894 - DNA, 745 bp, Homo sapiens
  misc_feature: GYAE6OF02H74TP.36.36.D03.1.454.CMB.1.raw
tcagtacgctgtctcacgaccggtgctcgatttagctgcgtcacgatctctcttggggccctgggattttcaggtgttttcatttggtgatcaggactgacagagagaactcaccatggagtttgggctgaactggcttttctgtggctatttaaaaggtgtccagtgtgaggtgcagctgtggagtcgggggagcttggtacagccgtgggggtcctgagactctcctgtgcacgcctctggattcctcctttacgcctaccgtattcgccatgacgcgtcgggtcccgccgtaaggctccgaaggggaacgggtacgtcggagtggggtctcgagtccagtttacgtggtcgacggtaccttaccgtaagtactacgttaccttcggaccgtagtaccgttaccggtacggaacggggtcccgtttacgaacccctagttcggttacccaagaacggaacctaaactttacccgaaacgtaaaccaacgtaacctaagtaacgtactacgtacaaacgttagaaacctacgccttacggaaggtacggccgtaacggaccgtaacccgggtccgttacgttaacgttttcgttacggtacgtaaggtaaaccgttcccgttttagttaccggtttaaccgggttacgttacggtaacggggtttaaccgggtaaacgggggggaccgttaacggttaccgggtacgggggtacccgtaaggggtaccgtttacggtacccggg

SEQ ID NO: 275895 - DNA, 603 bp, Homo sapiens
  misc_feature: GYAE6OF02I5Y8C.36.36.D03.1.454.CMB.1.raw
  modified_base (229)..(229): a, c, t, g, unknown or other
  misc_feature (229)..(229): n is a, c, g, or t
tcagtacgctgtctcacgaccggtgctcgatttagctgcgtcacgatctatcttggggggggtctcaggaggcagcgctctcaggacatctccaccatggcctgggctctgctgctcctcaccctcctcactcagggcacagggtcctgggcccagtctgccctgactcagcctgcgtccgtgtctgggtctcctggacagtcgatcaccatctcctgcactggaaccngcagtgactttggtggtaacaatcatgtctcctggtaccaacacgtacccaggaccaaacgcccccaaactcatactattttgacgttcggtagtccggcctcaggtaatttctaatcgtcttctctcggctccaagtctacgccaacgccgtccctcctcgacctactctcgtcgggtcctccgacgccgtggacggacggaggtcttaggtaacttacttacgttcgtttccctacctactattaccgaaacggtaccggtaacgttacgttcggtccgttttccgggccgggtaccggacccgtaccgtcggtacccgttccgtacggtccacggacccgtacggcctcccgtccccgtcggtcctacccg

SEQ ID NO: 275896 - DNA, 634 bp, Homo sapiens
  misc_feature: GYAE6OF02H231D.36.36.D03.1.454.CMB.1.raw
  modified_base (291)..(291): a, c, t, g, unknown or other
  misc_feature (291)..(291): n is a, c, g, or t
  modified_base (354)..(354): a, c, t, g, unknown or other
  misc_feature (354)..(354): n is a, c, g, or t
tcagtacgctgtctcacgaccggtgctcgatttagctgcgtcacgatctctcttgggggccctgggattttcaggtgttttcatttggtgatcaggactgaacagagagaactcaccatggagtttgggctgaactggtctttttcttgtggcttaattttaaaaggtgtccagtgtgaggtgcagctgttggaggtcgggggagcttggtacagccgtggggggtccctgagactctcctgtgcagcctcgtggattctcctttagcacctatgccatgagctgggtccncaggctccgagggaacggactggaggtgggtcctcactcctagttagtcggtcacggtacttnaatacattaccttcgactacgaccttcgtaggaacgggtcccggttacaccctagtcgtccaagtacgaccaatttaccaaagaaccacaactacgtactcgtcgacaaatcgaacacgcctagacgacggccggaacggacaccggccgttactactttcgtgtacgtacgaacgttacctttaggtcgtttaaccggttagtacggtacggttacgggaaacgggggtccgtaacgttaccggtacggggacccgtaagggtacgttccgttaccggg

SEQ ID NO: 275897 - DNA, 652 bp, Homo sapiens
  misc_feature: GYAE6OF02IPKX6.36.36.D03.1.454.CMB.1.raw
tcagtacgctgtctcacgaccggtgctcgatttagctgcgtcacgatctctcttggggggggtctcaggaggcagcgctctcaggacatctccaccatggcctgggctctgctgctcctcaccctctcactcagggcacagggtcctgggcccagtctgccctgactcagcctgcgtccgtgtctgggtctcctggacagtcgatccaccatctcctgcactggaaccagcagtgtacgtttggtggtaaacaatcatgtctccgtggtaccaacacgtaccaggaccaaacgccccaaactcatctattttcgacgttcggtagtcggcctgagtatttactaatcgtcttctctcgctccgaagtctcgaccaacgaccggcctcctcgacctactcctacgtcgggcctccgacgtccgtacggaacggaccggtacggcttacgttaactttacgtttacttcggtttaccctactaacttacgttacgaaacggtccggttaacgtttacgtttcggttaccggtttttccggggaccgggttacccggacccgttaccggtacggtaaccccggttaccggttacggtaccgtaaccggtacccgaacgggtcccgtacccggccccccgttacggtccctacccg

SEQ ID NO: 275898 - DNA, 583 bp, Homo sapiens
  misc_feature: GYAE6OF02G2CUV.36.36.D03.1.454.CMB.1.raw
  modified_base (464)..(464): a, c, t, g, unknown or other
  misc_feature (464)..(464): n is a, c, g, or t
tcagtacgctgtctcacgaccggtgctcgatttagctgcgtcacgatctctcttggggggggtctcaggaggcagcgctctcaggacatctccaccatggcctgggctctgctgctcctcaccctcctcactcagggcacagggtcctgggcccagtctgccctgactcagcctgcgtccgtgtctgggtctcctggacagtcgatcaccatctcctgcactggaacccagcagtgtacgtttggtagtaacaatcatgtctctaggtaccaacacgtacccaggacaaaccgaccccaaactcatctattttcgacgtcggtagtccgcctagaggtaatttcaatcgtctctctgctcaagtctcgaccacgacgccctcctacgacctactctccgtcgggcctccgacgtccgtaggacggtacggacggtacttagtatttagttatgacgtatacctntaattactactacgtaagtactaagttcgtactaccgtacgttaggtcgttacggttacgggacggaacgggtaccgtaacggttccgaccggttcgtaacggttaccacggtaacccg

SEQ ID NO: 275899 - DNA, 661 bp, Homo sapiens
  misc_feature: GYAE6OF02IK2KV.36.36.D03.1.454.CMB.1.raw
tcagtacgctgtctcacgaccggtgctcgatttagctgcgtcacgatctctcttggggggggtctcaggaggcagcgctctcaggacatctccaccatggcctgggctctgctgctcctcaccctcctcactcagggcacagggtcctgggcccagtctgccctgactcagcctgcgtccgtgtctgggtctcctggacagtcgatcaccatctcctgcactggaaccagcagtgactttggtggtaacaatcatgtctctggtaccaacagtacccaggacaaacgcccccaaatcatctattttgacgtcggtagtccggccctgaggtaatttctaatcgtcttctctcggctaccgaagtctgaccaacacgggccctccctagacctacttcctcgtcggggtctccgacgtccctaggacggacggaaggtccgtagttaacgtttaacttaccgttcggtttacctaccgtaactacgtttaccgaacggtacccggtaagttaccgtttcggttaccgtttttaccggggccggggtacccggtaaccccgtaccggttaccggtaaccccggttccgttaaccgggtacccgtaaccggtaccccggtaacgggtccccgtccggtaccccccgttcggtacccttacccgg

SEQ ID NO: 275900 - DNA, 695 bp, Homo sapiens
  misc_feature: GYAE6OF02GBA82.36.36.D03.1.454.CMB.1.raw
  modified_base (230)..(230): a, c, t, g, unknown or other
  misc_feature (230)..(230): n is a, c, g, or t
  modified_base (252)..(252): a, c, t, g, unknown or other
  misc_feature (252)..(252): n is a, c, g, or t
tcagtacgctgtctcacgaccggtgctcgatttagctgcgtcacgatctctcttggggggggtctcaggaggcagcgctctcaggacatctccaccatggcctgggctctgctgctcctcaccctcctcactcagggcacagggtcctgggcccagtctgccctgactcagcctgcgtccgtgtctgggtctcctggacagtcgaatcaccatctcctgcactggaaccngcagtgacttgtggtaacaatnatgtctctggtaccacagtaccaggcaaacgccccaaactcaatctatttttagacgtacggttagtaccggtccctacaggtaactttcgtaaactcgtacttctactggtcttaccgaaagtctcgaccaaacgtaccggacctccctcggaacctacttctccgtgggccttaccgaacgtccctaggtacggacggtaacggtccgttacggtattaacgtttaacctttcggtttacccttacctaacgttaacgttttaccgaaaccggtacccgggttaagtttaaccgttcgggttaccgttttttacccggggacgggttaccccgggaacccctaacccggttacggtaacccggttacccgttaaccgggttccctaacggccccgaaacgggtccgttacccggccccccggttcggtaccgttaaccccg

SEQ ID NO: 275901 - DNA, 682 bp, Homo sapiens
  misc_feature: GYAE6OF02IK4TT.36.36.D03.1.454.CMB.1.raw
  modified_base (298)..(298): a, c, t, g, unknown or other
  misc_feature (298)..(298): n is a, c, g, or t
  modified_base (330)..(330): a, c, t, g, unknown or other
  misc_feature (330)..(330): n is a, c, g, or t
  modified_base (343)..(343): a, c, t, g, unknown or other
  misc_feature (343)..(343): n is a, c, g, or t
tcagtacgctgtctcacgaccggtgctcgatttagctgcgtcacgatctctcttgggggccctgggattttcaggtgttttcatttggtgatcaggactgaacagagagaactcaccatggagtttgggctgaactggtctttttcttgtggctattttaaaaggtgtccagtgtgaggtgcagctgttggaggtcggggggaggcttggtacaggccgtggggggtcctgagactctcctgtgcagcctcgtggtacttctcctttagctacctatcgccagtgagcgtcgggtccnccaggcctccgagggaaggactggagtggtcncgactcagttagnggtcacggcttcatacgattacttcgacagtccgtacggtggaaacggggtcccgttacaaccgtacgttgacccgaagacgaacgtaacttaccaaaaggaaccaacgacgtaagtaactcgtagaactaaatacggaaacacgaccgtagagaaccggaccggaacggaaccgtaccgggcccgtttacgttacgttttaccgtcggtacgtaaccggtaaagttcccgtttagttacggttttacccggttaagtacggttacggttaacggggaaacgggggtacgtaaccggttacgggtaccgggaccggtaagggtacgtcccggttacggg

SEQ ID NO: 275902 - DNA, 634 bp, Homo sapiens
  misc_feature: GYAE6OF02I0NQ7.36.36.D03.1.454.CMB.1.raw
  modified_base (279)..(279): a, c, t, g, unknown or other
  misc_feature (279)..(279): n is a, c, g, or t
  modified_base (322)..(322): a, c, t, g, unknown or other
  misc_feature (322)..(322): n is a, c, g, or t
  modified_base (329)..(329): a, c, t, g, unknown or other
  misc_feature (329)..(329): n is a, c, g, or t
  modified_base (360)..(360): a, c, t, g, unknown or other
  misc_feature (360)..(360): n is a, c, g, or t
  modified_base (437)..(437): a, c, t, g, unknown or other
  misc_feature (437)..(437): n is a, c, g, or t
tcagtacgctgtctcacgaccggtgctcgatttagctgcgtcacgatctctcttggggggggtctcaggaggcagcgctctcaggacatctccaccatggcctgggctctgctgctcctcaccctctcactcaggcacagggtcctgggcccagtctgccctgactcagcctgcctcgtgtctggtcctcctggaccagtcatccaccatcctccagacactacggaaccagtcagtgtacgttggtacttataactttcgtctaccttaggaaccaanacgcaacccgaggacacggacaccccaaatccatagtatttanagagtanaagaaacgttcgaccgttcggtagggtttcnggtatccgtcttcgtaccgtagtcctaacgtagtcgtacggccgtaaccgtccgtaccccgtccctacgttaacccncgtactttcccggagggtccttaccgaccggcccgttggaaacgtcgacgtcttaacggaatttagtaccgtgaaccgtcgtactactaacgtacgtaaactacgaactcgtaccactaccgttccttacggttaccgtaggtaaccttacgggaaccgtaggtacctaggtccgttaccttacgggacctacccgg

SEQ ID NO: 275903 - DNA, 586 bp, Homo sapiens
  misc_feature: GYAE6OF02HLMP7.36.36.D03.1.454.CMB.1.raw
  modified_base (431)..(431): a, c, t, g, unknown or other
  misc_feature (431)..(431): n is a, c, g, or t
  modified_base (447)..(447): a, c, t, g, unknown or other
  misc_feature (447)..(447): n is a, c, g, or t
tcagtacgctgtctcacgaccggtgctcgatttagctgcgtcacgatctctcttggggggggtctcaggaggcagcgctctcaggacatctccaccatggcctgggctctgctgctcctcaccctcctcactcagggcacagggtcctgggcccagtctgccctgactcagcctgcgtccgtgtctgggtctcctggacagtcgatcaccatctcctgcactggaccagcagtgactttggtggtaacaatcatgtctcctggtaccaacagtaccaggacaaacgccccaaactcatctattttgacgtcggtagtcggccctgaggtaatttctaatcgcttctctggctcaagtctcgaccaacacggcctaccctgaccctatcctctcgggcctccgacgcccgtaggacggacggaggtctagtnttacttactcgttccnctactatacaagccggtagttcgttggtccgttttcgggcgggtccgacccgtaccgttcgaccggttaccgtacggttaccaccggaccccggtaagggtccccgttacggaccccccggtttcggtacccttacccg

SEQ ID NO: 275904 - DNA, 596 bp, Homo sapiens
  misc_feature: GYAE6OF02ID0E4.36.36.D03.1.454.CMB.1.raw
  modified_base (330)..(330): a, c, t, g, unknown or other
  misc_feature (330)..(330): n is a, c, g, or t
  modified_base (368)..(368): a, c, t, g, unknown or other
  misc_feature (368)..(368): n is a, c, g, or t
tcagtacgctgtctcacgaccggtgctcgatttagctgcgtcacgatctctcttggggggggtctcaggaggcagcgctctcaggacatctccaccatggcctgggctctgctgctcctcaccctcctcactcagggcacagggtcctgggcccagtctgccctgactcagcctgcgtccgtgtctgggtctcctggacagtcgatcaccatctcctgcactggaaccagcagtgactttggtaggtaacaatcatgtctcctggtaccaacacgtacccaggcaaacgcccccaaactcatctattttgacgtcggtagtccggccctnaggtaatttctaatcgcttctctgctcagtctgccacncgtcctcctgacctatctcgtcgggcctccgacgtccgtaggacggacggaggtctagtatttacgttaccttcgttccctactacctacttacgaacggtaccgggtacgtttaccgttcgggtaccgttttcggggccgggtccggtacccctaccgtccggtacccgttccgtaggtccgtacgacccgtaaggtcccgtccgacccccgttcggtacctacccg

SEQ ID NO: 275905 - DNA, 708 bp, Homo sapiens
  misc_feature: GYAE6OF02HGBXL.36.36.D03.1.454.CMB.1.raw
tcagtacgctgtctcacgaccggtgctcgatttagctgcgtcacgatctctcttgggggggtctcaggaggcagcgctctcaggacatctccaccatggcctgggctctgctgctcctcaccctcctcactcagggcacagggtcctgggcccagtctgccctgactcagcctgcgtccgtgtctgggtctcctggacagtcgatcaccatctctgcactggaaccagcagtgacttggtggtaacaatcatgtctcctggtaccaacacgtacccaggacaaacgaccccaaactcatctattttagacgtcggtagtcggcctcgaggtaatttctaatcgtcttctctggctctaagtctcgaccaacgaccggcctaccctgaccctactcgtccgtcgggccttccgacgtccgttacggacgggaccggtagggtcctaggtaactttaacgttaccttacggtttaccttaccaaccgttacgtttaaccgaaacggtcccggttaaaggttaccggttttacggttcccgtttttaccggggaccggggtaccccgggtaaccccgtacccgggttaccggtaaccccgggtttaccggttaaaccgggtttcccgaaaccgggttacccccggtaaacggggttccccttaaccccggggtccccccccggtttaccgggttacccggttaaccccccg

SEQ ID NO: 275906 - DNA, 595 bp, Homo sapiens
  misc_feature: GYAE6OF02IWBVV.36.36.D03.1.454.CMB.1.raw
  modified_base (376)..(376): a, c, t, g, unknown or other
  misc_feature (376)..(376): n is a, c, g, or t
  modified_base (405)..(405): a, c, t, g, unknown or other
  misc_feature (405)..(405): n is a, c, g, or t
  modified_base (466)..(466): a, c, t, g, unknown or other
  misc_feature (466)..(466): n is a, c, g, or t
tcagtacgctgtctcacgaccggtgctcgatttagctgcgtcacgatctctcttggggggggtctcaggaggcagcgctctcaggacatctccaccatggcctgggctctgctgctcctcaccctcctcactcagggcacagggtcctgggcccagtctgccctgactcagcctgcgtccgtgtcgtgggtctccgtggacagtcgatcaccatcctcctgccacgtacggaaccagcagtgtacgtttggtaggtaacaatcatgtctccgtgtaaccaacacgtacccagaccaaacgaccccaaatcatagtatttagtagacggtcactacacgtccgccctacggtacgggttactaagtcgtcttctctnctactcagtcgtgacacaccgcctaccgnaccacttctcggtcggcctaccgagtccgtaggacggtacgagttacttaatttacttcgngtacgtattacgtaataactaaccaacgaactaaccgaactactcgtacgtacgttaacggtaccggagggaaccggtaacaacggtctaccggttaccgttaacccgaacgtaccgaccggtaacccg

SEQ ID NO: 275907 - DNA, 670 bp, Homo sapiens
  misc_feature: GYAE6OF02J1W35.36.36.D03.1.454.CMB.1.raw
  modified_base (195)..(195): a, c, t, g, unknown or other
  misc_feature (195)..(195): n is a, c, g, or t
  modified_base (203)..(203): a, c, t, g, unknown or other
  misc_feature (203)..(203): n is a, c, g, or t
  modified_base (213)..(213): a, c, t, g, unknown or other
  misc_feature (213)..(213): n is a, c, g, or t
  modified_base (216)..(216): a, c, t, g, unknown or other
  misc_feature (216)..(216): n is a, c, g, or t
  modified_base (232)..(232): a, c, t, g, unknown or other
  misc_feature (232)..(232): n is a, c, g, or t
  modified_base (246)..(246): a, c, t, g, unknown or other
  misc_feature (246)..(246): n is a, c, g, or t
  modified_base (273)..(273): a, c, t, g, unknown or other
  misc_feature (273)..(273): n is a, c, g, or t
  modified_base (282)..(282): a, c, t, g, unknown or other
  misc_feature (282)..(282): n is a, c, g, or t
  modified_base (344)..(344): a, c, t, g, unknown or other
  misc_feature (344)..(344): n is a, c, g, or t
  modified_base (369)..(369): a, c, t, g, unknown or other
  misc_feature (369)..(369): n is a, c, g, or t
tcagtacgctgtctcacgaccggtgctcgatttagctgcgtcacgagtctctcttgggggggtcgtcaggaggcagcgctctcaggacatctccaccatggcctgggctctgctgctcctcgaccctcctcactcagggcacagggtcctgggcccagtctgaccctgactcagcctgcgtccgtgtctgggtcncctggacngtcgatcacntcncctagcacgtgaaccngcattgactttggngtaacaatcactgtctctggtacaacncgtacccgnggacaaaacgcccccaaaactccattctacgtttttagaaccggtcggttagccgtcccgtntaggtaatttctaatccggctttcncttggcctacctaaggtccttgaccctaaccgacgtccccgtcctacgacccacttcctccgtacgggtcctcccgtacgtccgtacggacggtaaccgcggtacgtccggtaattacgttaccgttccgtttaccgttccaacgttactttaccgaaaggtacccggtaacgttacgtttacgggtcgtttttaccgggggaccggttccgggacccctaccggtccggttacccggtcgttaaccggtccgtagacccggtaaccggtccgtccgtcccccgggtacgtttcggacccc

SEQ ID NO: 275908 - DNA, 630 bp, Homo sapiens
  misc_feature: GYAE6OF02GKWT0.36.36.D03.1.454.CMB.1.raw
  modified_base (343)..(343): a, c, t, g, unknown or other
  misc_feature (343)..(343): n is a, c, g, or t
tcagtacgctgtctcacgaccggtgctcgatttagctgcgtcacgatctctcttggggggggtctcaggaggcagcgctctcaggacatctccaccatggcctgggctctgctgctcctcaccctcctcactcagggcacagggtcctgggcccagtctgccctgactcagcctgcgtccgtgtctgggtctccgtggacagtcgatcaccatctcctgcactggaaccagcagtgacgtttggtagtaaacaatcatgtcctccgtaggtaccaactacgtacccgaggaccaaaaccgcccccaaactcatctaattttcgacgtcggtacgtcggccctnaggtatttctaatcgtcttctcgtgactcaagtctcgaccaacgaccggtccctaccgtcgacctactcgtcgtcgggcctccgacgtccgtaggacggacgacggtacttagtatttacgttacttcgtttcctactactacgttaccaacggtccgtaagttccgttcggttccgttttcgggaccgggtacccgtacccgtaccgttaccggacccgttaccgtacggtaccaaccggtacccgacggtaccccgttcccggtccccgttccgtcccttacccg

SEQ ID NO: 275909 - DNA, 703 bp, Homo sapiens
  misc_feature: GYAE6OF02FI1P8.36.36.D03.1.454.CMB.1.raw
  modified_base (328)..(328): a, c, t, g, unknown or other
  misc_feature (328)..(328): n is a, c, g, or t
tcagtacgctgtctcacgaccggtgctcgatttagctgcgtcacgatctctcttggggggggtctcaggaggcagcgctctcaggacatctccaccatggcctgggctctgctgctcctcaccctcctcactcagggcacagggtcctgggcccagtctgccctgactcagcctgcgtccgtgtctgggtctcctggacagtcgatcaccatcctcctgcactggaaccagcagtgactttggtggtaacaatcatgtctctggtaccacagtacccaggcaaacgccccaaactcatctatttttgacgtcggtacgtccggccctnacggtaatttctaatcgtcttactctcggctccgaagtcctcgaccaaccgtcggcccttccctcgaacccattcctcgtcgggccctaccgacggtccttcggaggaccggtacggcttaggtaacctttagtttaaccttcggttttaccctacgtaaccttagttacccgaaacgggttacccgggtaaggtttaaaccgtttcgggttcccgtttttaccggggccgggggttacccggacccccgtaacccggttccggtaaccccgggttcccggttaaccgggttaccgaacccgggtacccccggtaaacgggtccccggttacccggtacccccccggtttaccgggttaccccttaacccccggg

SEQ ID NO: 275910 - DNA, 565 bp, Homo sapiens
  misc_feature: GYAE6OF02JERQL.36.36.D03.1.454.CMB.1.raw
  modified_base (277)..(277): a, c, t, g, unknown or other
  misc_feature (277)..(277): n is a, c, g, or t
  modified_base (549)..(549): a, c, t, g, unknown or other
  misc_feature (549)..(549): n is a, c, g, or t
  modified_base (558)..(559): a, c, t, g, unknown or other
  misc_feature (558)..(559): n is a, c, g, or t
  modified_base (561)..(565): a, c, t, g, unknown or other
  misc_feature (561)..(565): n is a, c, g, or t
tcagtacgctgtctcacgaccggtgctcgatttagctgcgtcacgactctcctgtgcagcctctggattctcctttagcacctatgccatgagctggggtccgccaggctccgagggaagggactggagtgggtctcagtccattagtggtcacggacttcatacatacttcgcagactccgtgaagggccgttcaccatgtccagagacaattccaagaacacacagtatctgcaaatgaacagcctgagagccgaggacacggccgtctatttcngtgcgaaagcctttagtgttaccggttatgagttcggaaagggggcgactacgtgggccagggactccgtggtcaccgtctctcagcctcacaggcccatcggtctccccgtgccgtccctgcctccgaggacgccaccgtccgagacgccacgacggccggcccgtggggcctacggtcccgtgggtaccgaagggtaccttaccgttaccgacgtacgacggtccgtaactcggacggccgggcgttcgggaaccgaacgggcccgttanaagtacggnngnnnnn

SEQ ID NO: 275911 - DNA, 767 bp, Homo sapiens
  misc_feature: GYAE6OF02FG53G.36.36.D03.1.454.CMB.1.raw
  modified_base (185)..(185): a, c, t, g, unknown or other
  misc_feature (185)..(185): n is a, c, g, or t
tcagtacgctgtctcacgaccggtgctcgatttagctgcgtcacgatctctcttgggggggtctcaggaggcagcgctctcaggacatctccaccatggcctgggctctgctgctcctcaccctcctcactcaggcacagggtcctgggcccagtctgccctgacctcagcctgcgtccgtgtcngggtctccgtggacagtcgatcaccatctcctgcactaggaacccagcagtgactttggagtaacaatcattcggtactccgtaggtaacccaacgactaccccgaaggaccaaaccgaccccctaaaactcacttacgttactttttacggacgttacggttacgtccggtacccctacgaacggttaacttttaccgtaaagtccggttctttaccgttcgtacggtaccttaccgaaacggttcccttacgacccgtaaacccgtacccgggtccccttaccccgttacggaaccctaacctttcccgttccggttaccggggtcccttacccggtaaccggtcccgtacggtaaccgggaccggtacggtaccgttacgtaactttaactttaccgtttacggttacccttaccaacttacgtttaaccgaaacgggtaccggttaagttaaccgtttacgggttaccgttttaccggggccggtacccgtacccgtaccgtaccggtacccgtaccgtaacggtaccgtaccgacccgtaacggtcccgtaccgtcccccgtacggtcctaacccgg

SEQ ID NO: 275912 - DNA, 578 bp, Homo sapiens
  misc_feature: GYAE6OF02I254N.36.36.D03.1.454.CMB.1.raw
  modified_base (328)..(328): a, c, t, g, unknown or other
  misc_feature (328)..(328): n is a, c, g, or t
tcagtacgctgtctcacgaccggtgctcgatttagctgcgtcacgatctctcttgggggggggtctcaggaggcagcgctctcaggacatctccaccatggcctgggctctgctgctcctcaccctcctcactcagggcacagggtcctgggcccagtctgccctgactcagcctgcgtcgtgtctgggtctctggacagtcgatcaccatctcctgcactggaaccagcagtgactttggtggtaacaatcatgtctcctggtaccaacagtacccaggaccaaacgcccccaaactcatctattttgacgtcggtacgtcgccctnaggtaatttctaatcgtcttctctggctcaagtctggacgacaccggccctcccgtagacctattcctcgtcgggcctccgacgtccgtggacgggaccggagtccgttagtactttattacgcggcacggtctactaagttactaacgaagtacgcacgactaccttctccggttacgttaccggaacgttacggggaacctaaggtccgtacttcggttaccgtaggtccacggacccgtaaacccgg

SEQ ID NO: 275913 - DNA, 598 bp, Homo sapiens
  misc_feature: GYAE6OF02JDMGK.36.36.D03.1.454.CMB.1.raw
  modified_base (229)..(229): a, c, t, g, unknown or other
  misc_feature (229)..(229): n is a, c, g, or t
tcagtacgctgtctcacgaccggtgctcgatttagctgcgtcacgatctctcttggggggggtctcaggaggcagcgctctcaggacatctccaccatggcctgggctctgctgctcctcaccctcctcactcagggcacagggtcctgggcccagtctgccctgactcagcctgcgtccgtgtctgggtctcctggacagtcgatcaccatctcctgcactggaaccngcagtgactttggtgtaacaatcatgtctcctggtaccaacacgtacccaggacaaacgcccccaaactcactctatttttgacgtcggtagtccggccctcaggtaatttctaatcgtcttctcgtggctccaagtctcgccaacgaccggtcctccctgaccctatctcgtcgggctccgacgtccgtgacggacgtaggtctagtacttactttacctcgtttcctactactacgttaccgaacggtccggtacgttacgttcggttcgttttccgggccgggtccgacccgtaccgtcggtacccgtccgtacggtccgacgtacccgaacggtcccgtaccggcccccgttcggtccctacccg

SEQ ID NO: 275914 - DNA, 642 bp, Homo sapiens
  misc_feature: GYAE6OF02GKZUZ.36.36.D03.1.454.CMB.1.raw
tcagtacgctgtctcacgaccggtgctcgatttagctgcgtcacgatctctcttggggggggtctcaggaggcagcgctctcaggacatctccaccatggcctgggctctgctgctcctcaccctcctcactcagggcacagggtcctgggcccagtctgccctgactcagcctgcgtcgtgtctggtctctggacagtcgatcaccatctcctgcacgtcggaaccagcagttgtacgtttgggtaggtaaacaatcattgtcctccgtggtaccaacgacgtacccaggaccaaacgacccccaaactcactctattttgacgttcggtacgtccgtccctacgagtaactttactaactcgtcttccttcgtcggtacctacctaacgttctacgaccctaaccgacccggtcccttcccgtacgtaaccctcttcctcgttccggggtacctcccgtacggcccgtacggacggacgtacggtcttagtactttacttacttccgttcctacacttattacgaacggtccggtagttcgttggttccgtttcgggaccggtccgtaccctaccgtcgtaccgttccgtacggtaccgacgaccgtacggtccctccggtaccccgtcgtcccgtaccg

SEQ ID NO: 275915 - DNA, 622 bp, Homo sapiens
  misc_feature: GYAE6OF02H5FK6.36.36.D03.1.454.CMB.1.raw
  modified_base (227)..(227): a, c, t, g, unknown or other
  misc_feature (227)..(227): n is a, c, g, or t
  modified_base (310)..(310): a, c, t, g, unknown or other
  misc_feature (310)..(310): n is a, c, g, or t
tcagtacgctgtctcacgaccggtgctcgatttagctgcgtcacgatctctcttggggggggtctcaggaggcagcgctctcaggacatctccaccatggcctggctctgctgctcctcaccctcctcactcagggcacagggtcctgggcccagtctggcctgacacagcctgcctccgtgtctgagactcctggacagtcgatcaccatctctgcactggaaccngcagtgacgttggtgcttaataattatgttctcctggttaccaacagctattcaggcagccgacccgaaattctttaattagngtacgttcctttcggtccgtcctacggtaggggtttctagtcgtcttccgtccggctccgaagtcgtaggaccaacgtccggtcctacctacgaccctattcctactacgtacctcccgaaggtcgtacggaacgggtcgaggtctagtactattacgttcgacgtacgtcctactaacttacgttaacgtggtaaactacgtaaagttcggtacttacccgtaggtcggtacctttacggggtccgggtaacggtaacgggtaccgtaacggtttccggtaaccccggtcgttaaccgggcgtaacccggg

SEQ ID NO: 275916 - DNA, 781 bp, Homo sapiens
  misc_feature: GYAE6OF02HB79S.36.36.D03.1.454.CMB.1.raw
tcagtacgctgtctcacgaccggtgctcgatttagctgcgtcacgatctctcttgggggccctgggattttcaggtgttttcatttggtgatcaggactgaacagagagaactcaccatggagtttgggctgaactggctttttcttgtggctattttaaaaggtgtccagtgtgaggtgcagctggttgggaggtcggggggaggcgttggtacaggccgtggggggtccctgagactctcctgtgcagcctctggtattctccttagccacctatcgcctatggacgcgtcgggtcccgccgaggccgtaccggaggggaacggggacgtggggtagggttcggggtcctacgacttccgtaagtttaggtcggttaccgaccgggttaaccttacgaacttacctaagtttacccgttaccgacgtaccggtaccgttacccggtacgggtaaaccgggggttccccggtttaccaacccgtaacggttccggtaccgtaacggtaacgtaacccgttaaaaccgtttaccaaaaacggtaaaaccaacccgtaaacgtaacgttaactacgttacgaaactaaaacgttcggaaactacgtaccgtaagacgacggacccggaaggacccgtaccggtaccgttcgttactttcgaggtacgtaacggtaacttccgtttaggttccggtttaaccgggttacgttcggtaacgggttacggggaaacggggtccgtacggtacgggtacgggacggtaagggtacctccggtacgg

SEQ ID NO: 275917 - DNA, 558 bp, Homo sapiens
  misc_feature: GYAE6OF02G6GYV.36.36.D03.1.454.CMB.1.raw
  modified_base (167)..(167): a, c, t, g, unknown or other
  misc_feature (167)..(167): n is a, c, g, or t
  modified_base (212)..(212): a, c, t, g, unknown or other
  misc_feature (212)..(212): n is a, c, g, or t
  modified_base (330)..(330): a, c, t, g, unknown or other
  misc_feature (330)..(330): n is a, c, g, or t
tcagtacgctgtctcacgaccggtgctcgatttagctgcgtcacgatctctcttgggggggtctcaggaggcagcgctctcaggacatctccaccatggcctgggctctgctgctcctcaccctctcactcagggcacagggtcctgggcccagtctgccctgactnagcctgcgtccgtgtctgggtctcctggacagtcgatcaccatcncctgcactggaaccagcagtgacttttgaggtaacaatcatgtctcctggtaccaacacgtacccaggaccaaacgacccccaaactccatcatttttgacgttcggtagtccgcctnaggtaatttctaatctcttctctgctcaagtctcgaccaacaccggcctccctgacctatctctagcctccgaggctgacgacgaggctgtacttattatcgctagctcgtatataccgtagaacgtctaaagttcggtatcctaacgtgggtccttgggttccgggaccggtaacgggtacccgtaaggttccggtaacccgttacgtacggtcctacggtaccccg

SEQ ID NO: 275918 - DNA, 821 bp, Homo sapiens
  misc_feature: GYAE6OF02FJ78G.36.36.D03.1.454.CMB.1.raw
  modified_base (232)..(232): a, c, t, g, unknown or other
  misc_feature (232)..(232): n is a, c, g, or t
tcagtacgctgtctcacgaccggtgctcgatttagctgcgtcacgagtctctcgttggggggggtctcaggaggcagcgctctcaggacatctccaccatggcctgggctctgctgctcctcaccctctcactcgagggcacagggtcctgggcccagtcctcgccctgactcagcctgcgtcgtgtctgggtctccgtggacagtcatcaccatctcgtgcactggaaccngcaggtcgtacttggtgtaactagtcattcgtctaccgtcgtaaccaacacgtacccgaaggacaaaccgaccccctaaactcaactcttaactttttacgaccggttcggttacggtccggtaccccttaggaacggttaacttttaccgtaaacgttcccgtacctttccgtccgttcgggtaccctaccgtaaacgttccgttacggaaccccgtaaaccgtacccgggttaccccttaccccgggttcgaacccgtacgtttacccgtccgtttaccggggtcccttacccgaccgggtacccttacgggaaaccggggtacggaacggtccgttaggtaaccttttaagtttaacccgtttccggttttaccctacggtaccgtttaccgttaaccgaacgggtttcccgttaaacgggttttaccgtttcgggttaccggtttttcccgggggaccgggtacccggtaccccgtaccgggttaccggtaccccggtttaccggttaaccgggttaccgtaacccggtacccggtaacgggtccgtaccccgggtaccccccggttacggttacccttacccgg

SEQ ID NO: 275919 - DNA, 848 bp, Homo sapiens
  misc_feature: GYAE6OF02F9DY3.36.36.D03.1.454.CMB.1.raw
  modified_base (229)..(229): a, c, t, g, unknown or other
  misc_feature (229)..(229): n is a, c, g, or t
tcagtacgctgtctcacgaccggtgctcgatttagctgcgtcacgatctctcttggggggggtctcaggaggcagcgctctcaggacatctccaccatggcctgggctctgctgctcctcaccctctcactcagggcacagggtcctgggcccagtctgccctgactcagcctgcgtccgtgtctgggtctcctggacagtcgatcaccatctcctgcactcggaaccngcagtgtactttggtaggtaaacaaatctaagttcgttccttccgttacgggttaacccaaacctaacggttaaccccaagggaccaaaaccggcccccaaaactccaacttcctaatttttggaaccggttcggtaacggtccggtccccttacaggtaacttttctaaactcggttcttctcgtcggtacttcctaaagtcctacgacccaaacgtacccgggtcccttcccgtacggtaaccctaacgtttcccgttccgttccgggggtaccttacccgtaaaccggtcccgttacggggtaaaccggggacgggtaaaccgggtccgtttaacgggttaacttttaaacgttttaaccgtttccggttttaccccgttacctaaccgtttaacgttttaaccgtaaaaccgggtcccgggtttaaaccgtttaacccgttttaacgggttcccgggttttttaccgggggaccccggggttacccgggtaaacccccggttacccgttaaccgggtaaccccggttacccggttaacgggtacccgtaacggtaccccgtaaacgggtcccgttaccccggtccccccgtttacgggtacccctttaaccccgg

SEQ ID NO: 275920 - DNA, 612 bp, Homo sapiens
  misc_feature: GYAE6OF02IO763.36.36.D03.1.454.CMB.1.raw
tcagtacgctgtctcacgaccggtgctcgatttagctgcgtcacgatctctcttggggggggtctcaggaggcagcgctctcaggacatctccaccatggcctgggctctgctgctctcaccctcctcactcagggcacagggtcctgggcccagtctgccctgactcagcctgcgtcgtgtctgggtctcctggacagtcgatccacatctcctgccacgtcggaaccagcagtgtacgtttggtagtaacaatcatgtctcctggtaccaacacgtaccaggaccaaaccgaccccaaactctatacttattttacgacggtcggtacgtcgtcctacaagtactttctaagtctcttctcgtcggtctacaagtcgtagactaaccgaccggtcctccgtacgacctacgtctacgtacaccgttccgacggtcgtagggacggacggagtctacgttacttatttacgtgactacgtacttacgtaattactacgtaagtacgtactaaacgtgtacctccgtagttacggtcgttacgggtccgggagggaacggtaacgttacggttccggtaaccgttccggtaacggtcccgtaacgtacccgg

SEQ ID NO: 275921 - DNA, 688 bp, Homo sapiens
  misc_feature: GYAE6OF02HTEKE.36.36.D03.1.454.CMB.1.raw
  modified_base (281)..(281): a, c, t, g, unknown or other
  misc_feature (281)..(281): n is a, c, g, or t
  modified_base (307)..(307): a, c, t, g, unknown or other
  misc_feature (307)..(307): n is a, c, g, or t
  modified_base (355)..(355): a, c, t, g, unknown or other
  misc_feature (355)..(355): n is a, c, g, or t
tcagtacgctgtctcacgaccggtgctcgatttagctgcgtcacgatctctcgttggggggggtctcaggaggcagcgctctcaggacatctccaccatggcctgggctctgctgctcctcaccctcctcactcgagggcacagggtcctgggccctagtctgccctgactcagcctgcgtccgtgtcgtgggtctccgtggacagtcgatcgaccatcctcctgccacgtggaaccagcctagtgtactttggtggtaaacaatcatgtctctgaccaanacgtaccagacaaacgaccccaaacncatctattttgacgtcgtagtcgcctagagtattctatcgtcttactntcggtactaccgtaagtctcgaccaacgtaccgggtccctacccgtacgtaaccctaacttccgttccgtcggggtccctacccgtaacgtcccgtaacgggaacggtaaccggacgggtacgtacgttaatttaacgttaccgttcgtttacccgtctaaaccgttacgtacgtaaacggtaccggtaagttaccgttacggttccggttttccggggaccgggtaccggtaaccccgtaccggtaccggtacccggtaccgttaccggtaccgaccggaccccggtaacggtcccgtacccggtccccggttaccggtacccgtaacccgg

SEQ ID NO: 275922 - DNA, 753 bp, Homo sapiens
  misc_feature: GYAE6OF02GYA02.36.36.D03.1.454.CMB.1.raw
tcagtacgctgtctcacgaccggtgctcgatttagctgcgtcacgatctctcttgggggggtctcaggaggcagcgctctcaggacatctccaccatggcctgggctctgctgctcctcaccctctcactcagggcacagggtcctgggcccagtctgccctgactcagcctgcgtccgtgtctgggtctcctggacagtcgatcaccatctcctgcactcggaaccaggcagtgtactttggtagtaacatcatcgtctcgtggtaccaacacgtacccaggacaaacgccccaaatccatactatttttcgacgttcggtacgtcggccctagacggtaatttctaacttcgactttcctacgtcggtcctcctaaacgttctacggacccaaccgtacccgggtccctcccgtacgaccctacgtcctccgtcgggccctaccgacggtcccgtacgggaacgggtaccggtacgggacctttaggtaaacgttttaacgtttacccgtttacggtttaccctacgttaacccttaacgtttacccgtaaaccgggtaccggtttaacgttaaccggttttcgggtttacccgtttttaccgggggaccgggttacccgggaccccccgttaaccggttacccggtaacccccggttccggtttaaaccggtcccgtaacccgggtaccccgttaaaccgggtccccgtttaccccggtccccccgtttaccgggtacccttacccccgg

SEQ ID NO: 275923 - DNA, 856 bp, Homo sapiens
  misc_feature: GYAE6OF02HQWVE.36.36.D03.1.454.CMB.1.raw
tcagtacgctgtctcacgaccggtgctcgatttagctgcgtcacgatctctcgttggggggggtctcaggaggcagcgctctcaggacatctccaaccatggcctgggctctgctgctcctcaccctcctcactcgagggcacgagggtcctgggcccagtctgaccctgactcagcctgcgtccgtgtcgtggtcctcgtggacagtcgatcaccatcctctgcacgtggaaccagcagttgtaccgtttggtacggtaaactaatctacttgttccgtaccgtaggtaacctaacgaccgtaacccggagaccgtaacgaacccgaaccccctaaaacgtcgtaattagttaattttacgaggtaacgggtaccgtaaaaggtaaccgttacccgggtaccccgttagggtttaacggggggttttccttagggttaaccgttcgtttaacccgttttcggttccggttacgggtacccttaacccggtaaacggttccgtaccggggtaacccgaaccgtaccccgggttacccctttaccccggttaaccggtaaccctaccgtttcccggttacggtcccggggtccttacccggaacgtccggttaacgggaacgggacccgggtacggtacgttacttaaccgtttaacgttacgtcggtaccgtacggtcctaacttaacgttaaccgttaaacgaaacgttacgttaccgacggtacctttaacccgttccggtttaaccccggtacggttttaacccgggaaacccgggtttaacgggaacccgttaaaccggggttacccttaaccgggtttacccggtttaaccggtaacccggtaaaccccgg

SEQ ID NO: 275924 - DNA, 625 bp, Homo sapiens
  misc_feature: GYAE6OF02G65GJ.36.36.D03.1.454.CMB.1.raw
  modified_base (624)..(624): a, c, t, g, unknown or other
  misc_feature (624)..(624): n is a, c, g, or t
tcagtacgctgtctcacgaccggtgctcgatttagctgcgtcacgactctcctgtgcagcctctggattctcctttagcacctatgccatgagctgggtccgccaggctccagggaagggactggagtgggtctcatccattagtggtcacggacttcatacatacttcgcagactccgtgaagggccggttcaccatgtccagagacaattccaagaaccacacagtatctgacaaatgaacagcctgagagccgaggacacggccgtctatttctgtgcgaagtcctttaggtgttaccggttatggaggttacggaaaggggggcgacgtacgtggggaccgagggaactccgtggtccaccgtctcctcacgtccctcaccgaacgggcccctaagttcccggtccctttcccccgtgggcccgtcccgtgcccttcccgaggacgcctacccgtccggagcgaccaccgacggcccggcccgtggggccctcgggcccgtgggtaccgaaccgggtaacctttacccgttaccgacgtaaccgcgtaccggtactacgggacggtccggggaccggttcgggaccgtaaccgggcgacgtaagtacgcagctcgagtgng

SEQ ID NO: 275925 - DNA, 567 bp, Homo sapiens
  misc_feature: GYAE6OF02F1MHA.36.36.D03.1.454.CMB.1.raw
  modified_base (379)..(379): a, c, t, g, unknown or other
  misc_feature (379)..(379): n is a, c, g, or t
tcagtacgctgtctcacgaccggtgctcgatttagctgcgtcacgatctctcttggggggggtctcaggaggcagcgctctcaggacatctccaccatggcctgggctctgctgctcctcaccctcctcactcagggcacagggtcctgggcccagtctgccctgactcagcctgcgtccgtgtctgggtctcctggacagtcgatcaccatctcctgcactggaaccagcaaggtgtacgtttggtaggtaaacaatcatcgtctcctggtaaccaacacgtacccaggacaaacgaccccaaactcatctattttcgacgtcggtagtccggcctacgagtacttctaatcgtcttctctgctacagtctgccaacnccgcctcctacgaccactctcgtcggcctccacgtccgtggacggacggaggtctagtatttagttatcgatgtacctatattatacttagtaacgtactaagttacgtactccgtcgtcggtcgttcggttcgggacgggtacggtaaccgtacggttcgtaccgtacgtacggtacacgtacccgg

SEQ ID NO: 275926 - DNA, 691 bp, Homo sapiens
  misc_feature: GYAE6OF02JI5T0.36.36.D03.1.454.CMB.1.raw
tcagtacgctgtctcacgaccggtgctcgatttagctgcgtcacgatctctcttgggggggtctcaggaggcagcgctctcaggacatctccaccatggcctgggctctgctgctcctcaccctcctcactcagggcacagggtcctgggcccagtctgccctgactcagcctgcgtccgtgtctgggtctcctggacagtcgatcaccatctcctgcactggaaccagcagtgactttggtggtaacatcatgtctcctggtaccaacagtacccaggacaaacgccccaaatccatctatttttcgacgtcggtagtccggtccctcaaggtatttctaatcgtcttctcgttcggaccttccaaagtctacggtacccaaaccgacggtccctccttacgaccctactctacgtcgggcctaccgagccgttacggacggtacgacgtccgtagtaactttaactttacctcgtttaccctactaacctacttttaacgaacggtcccgggtaaacgttttaacccgtttcgggttcccgtttttaccgggggacccggggttacccgggtacccccgtaacccgttccgggtaaccccgttacccggttaacggttaccccgaaccggtacccccgtaagggtcccccgttcccggtcccccccgtttacgggtccccttaacccgg

SEQ ID NO: 275927 - DNA, 848 bp, Homo sapiens
  misc_feature: GYAE6OF02G78OO.36.36.D03.1.454.CMB.1.raw
tcagtacgctgtctcacgaccggtgctcgatttagctgcgtcacgatctctcttgggggccctgggattttcaggtgttttcatttggtgatcaggactgaacagagagaactcaccatggagtttgggctgaactggtcttttcttgtggcttattttaaaggtgtccagtgtgaggtgcagctgttggaggtcggggggaggtcgttggtacaggtccgtcgggggtccctgacgactctcctgtcgcacgcctctggtacttcctcctttacgcctacctagtcgccatcggagtcgttcgggtacccgccgacggtcctaccggaggggaagggccgtgggaggttcggggtctcgacgttcctaagtttacggtcggtaccgaaccggttacctttaccgtaacttaacctaactttaccttaccgaacgaacgtaccgttccggtaacggggaaaccggggttcccggtttaccaacccgtacgttaccgttaccgaacggtaacgtaacctaaaccgtttaacccaaaacgaaaccctaaaccaacgtaacgttaacttcgtacgtaaactaaacgttaacgaacgaccgtaccgtacgggaacggtaccggaaccggtaacgggaacccgtacccgggtaccgtttaccgtttaagtttaacgtccggttacggaaaccgttaacggtttacccgttttaacggttaaccgggtttttaaccggttaaggttacgggttaaacggggttaacgggggtaaaccgggggggtaccggtaaccggtttaccgggggtaccggggtaaccgggttaacgggtaccgttaccggtttacccggg

SEQ ID NO: 275928 - DNA, 632 bp, Homo sapiens
  misc_feature: GYAE6OF02J0P0V.36.36.D03.1.454.CMB.1.raw
  modified_base (203)..(203): a, c, t, g, unknown or other
  misc_feature (203)..(203): n is a, c, g, or t
  modified_base (220)..(220): a, c, t, g, unknown or other
  misc_feature (220)..(220): n is a, c, g, or t
tcagtacgctgtctcacgaccggtgctcgatttagctgcgtcacgatctctcgttgggggggtcgtcaggaggcagcgctctcaggacatctccaccatggcctggctctgctgctcctcaccctcctcactcgagggcacagggtcctgggcccaggtctcgccctgactcagcctgcgtccgtgtctggtctccgtggacngtcgatcaccatctccngacacgtaggaacctagcctaagtcgtacgtttggtaggtaactaatctatcgtctactcggtaaccaacacgtacccaggactaaacgaccccaaatcgactactacttttcgacgttacggtacgtccggtccttacgaacggtaacttttactaacgtcgtccttcctctcggtacctacccgtaagttccacggaccctaacgaccggtccctaccctacgacctactcctcggtacgtccgtcgcgtccgtggaacgggacggtagtcgttagtacttattacgttcgttcctacacgttactacgaacgtcggtacgttacgtggtgtttccgggacggccgtaaccgtcgcgtacccgttctaacggtcctacgcccgagtccgtcccgaccctttcgcgttacc

SEQ ID NO: 275929 - DNA, 820 bp, Homo sapiens
  misc_feature: GYAE6OF02GGC68.36.36.D03.1.454.CMB.1.raw
tcagtacgctgtctcacgaccggtgctcgatttagctgcgtcacgagtctctcttggggggggtctcaggaggcagcgctctcaggacatctccaccatggcctgggctctgctgctcctcaccctcctcactcagggcacagggtcctgggcccagtctgccctgactcagcctgcgtccgtgtctgggtctccgtggacagtcgactcacctattcctcctgctactcggaaccagcaggtgacgttggtagttattaactttgtctccgtggtaccaacacgcacccaggcagacgacccccaaatcaatgtaatttacgagtagtacgaagtaaacgtccggtaccctacggtacggggtttcctagtacgttcggtacctttccgtacgttacgggtccttaccgtaagttccgtaccgggaacctaaaccggtcccggtacccttaccccgtacgtaacccctacgttacccgttaaccgttaaccgaacccgtacccggtaacgggtaccgttacgggaaccggtaaccgggtaacggtccgtttaacgggtaaccttttaaggtttaacgttaccgggtccgtaaaacgttccttaaccgttaacgtttaaacgtttaaccggttaacgtaaaccggtttaacgttaaacggtttacgggttaaccctttaacccggtacggtttaccggggttacccggtttacggggttacccccgggggtaacggggtaaccccgggggttaacccgttaaaccgggttttaccccggggtaaccccggttttacccgggtaccgggttaacccccggg

SEQ ID NO: 275930 - DNA, 607 bp, Homo sapiens
  misc_feature: GYAE6OF02IKJ5C.36.36.D03.1.454.CMB.1.raw
  modified_base (201)..(201): a, c, t, g, unknown or other
  misc_feature (201)..(201): n is a, c, g, or t
tcagtacgctgtctcacgaccggtgctcgatttagctgcgtcacgatctctcttggggggggtctcaggaggcagcgctctcaggacatctccaccatggcctgggctctgctgctcctcaccctcctcactcagggcacagggttcctgggcccagtctgccctgactcagcctgcgtccgtgtctgggtctcctggacngtcgatcacctatcctcctgcacgtggaaccagcagtgtacttttggaggtaacaatcatgtcctctaggtaccaacacgtacccaggacaaaccgaccccaaactcactcttattttcgacgttcggtgttccgcctagtagtaactttctaatcgtcttctcgtgtctacgtacgttctacgaccaacgccggtccctcctacgacctactcctcgtggtcctcgacgtccgtaggacggacgcggtctagtactttacttacgttcttccgactacttacttacgacgtacgggtattacgttcggttccggtttcgggacggtacccgaccgtaccgtcgtacccgttcgtacggccgtacgacccgtaacggtccgtcccgtaccccgtcggtccctaccg

SEQ ID NO: 275931 - DNA, 634 bp, Homo sapiens
  misc_feature: GYAE6OF02HIDZF.36.36.D03.1.454.CMB.1.raw
  modified_base (216)..(216): a, c, t, g, unknown or other
  misc_feature (216)..(216): n is a, c, g, or t
tcagtacgctgtctcacgaccggtgctcgatttagctgcgtcacgatctctcgttggggggggtctcaggaggcagcgctctcaggacatctccaccatggcctgggctctgctgctcctcaccctcctcactcagggcacagggtcctgggcccagtctgccctgactcagcctgcgtcgtgtctgggtctcgtgacagtcgatcaccatcctcngccactcggaaccagctagtgtactttggtaggtaaacaatcaatcgtcctccgtaggtaccaacgacgtaccaaggacaaaccgcccccaaactcaatctattttcgacgtcggtagtcgaccctgagtaattctaatcgtcttctcgtcggtctacaagtctacgaccaacgaccgtcctacctacgacctactcctcgtcggcctaccgacgtccgtacggacggacggtacggtctacgtaactttacgttacttcgttacctactactactaccgaacggtccggtaacgttcgttcggttccgtttcggggccgggtacccgacccgttaccggtcggtaccccgttacgtaccggtaccgaccggaccgtaaccggtccgtcccggtcccccggttcggtacccttacccg

SEQ ID NO: 275932 - DNA, 712 bp, Homo sapiens
  misc_feature: GYAE6OF02HPTSU.36.36.D03.1.454.CMB.1.raw
  modified_base (204)..(204): a, c, t, g, unknown or other
  misc_feature (204)..(204): n is a, c, g, or t
  modified_base (222)..(222): a, c, t, g, unknown or other
  misc_feature (222)..(222): n is a, c, g, or t
tcagtacgctgtctcacgaccggtgctcgatttagctgcgtcacgatctctcttgggggggggtctcaggaggcagcgctctcaggacatctccaccatggcctgggctctgctgctcctcaccctcctcactcagggcacgagggtcctgggcccagtctcgccctgactcagcctgcgtccgtgtcgtgggtctcgtggacngtcgatcaccatcctctncactacggaaccagctagtgtacgtttggtaggtaaacatcatcgtcctcgtacgtaaccaacacgtaacccgaggaccaaaccgacccccaaactcactcttagttttcgacggtcggtacgtccggtccctagtaaggtaactttactaacgtctaccttcgtcgtacggtcctaccgtaagtcctaccgacccgaaaccgtacccggtcccttacccgtacgaccctacttccgtcggtcgggtccctaccgacggtcccgtagggacgggaccggtaggtccttaaggttaactttacgtttaccgttcgttaccctactaacctacgttaccgaacggtaccggtactttaccggttcggttaccgtttccggggaccgggtacccgtacccgtaccggtccggtcccgttaccgtacggtacccgtaaccggtacccgtacccggtccgttaccccgggtcccccttacggtaccttaccccgg

SEQ ID NO: 275933 - DNA, 665 bp, Homo sapiens
  misc_feature: GYAE6OF02HZ7HH.36.36.D03.1.454.CMB.1.raw
tcagtacgctgtctcacgaccggtgctcgatttagctgcgtcacgatctctcttggggggggtctcaggaggcagcgctctcaggacatctccaccatggcctgggctctgctgctcctcaccctcctcactcagggcacacgggtcctgggcccagtctcgccctgactcagcctgcgtccgtgtcgtggtctctggacagtcgatcaccatctcctgctacgtaggaaccagcagtcgtatttggtagtaacatcgtatcgtctccgtacgtaaccaactacgtacccgaagaccaaaccgaccccaaatcaacttactagtttttcggacgttaccggtacgttccggaccctacgtaaggttactttactaactcgtactttcctcgtcgtacctaccgattccgtacgacccaaaccgccggtccctccgtaccgaacctctacgtcggtcgcctaccgacgctacggacggtacgacggtctacgttaagtttacttacgtcgttctacctaactacgttagaccggtaccgttacggttaccgttacggttccgtttccgggaccggtacccgtacccgtaccgtccgttacccgtccgtacgtacccgaccgacccgacggtccccgtacccggtacccccgttccgtccctacccg

SEQ ID NO: 275934 - DNA, 656 bp, Homo sapiens
  misc_feature: GYAE6OF02IWIBV.36.36.D03.1.454.CMB.1.raw
  modified_base (461)..(461): a, c, t, g, unknown or other
  misc_feature (461)..(461): n is a, c, g, or t
  modified_base (521)..(521): a, c, t, g, unknown or other
  misc_feature (521)..(521): n is a, c, g, or t
tcagtacgctgtctcacgaccggtgctcgatttagctgcgtcacgagtctctcttgggggggtctcaggaggccagcgctctcaggacatctccaaccatggcctgggctctgctgctcctcaccctcctcactcagggcacagggtcctgggcccagtcctgccctgactcagcctgcgtcgtggtctgggtctcctggacagtcgatcaccatcctcctgcctactcggaaccagcagttcgtacgtttggttacggtaaactaatccaacttgttacctccctagggtaaccaaccgacgtaacccgacggaccgaaaacgacccccgaaactcacttacttatttttagaccgttacggtaccgtaccggtcctgaaggtactttactaatcgttacttccttgtacgtctacctaagtctcgaccaactccggtcctccgtagaccatacctctanacctaccgagtactgaacggacggtacgtcgtagtacttattacgtcgactagtaccttnacgttaaactacgtagtaaacttactaacgttagtactcccgaagttcggtactttcggttacgggaccggtaggttaacccgtaacggtttaccggtaaccggttaccgttaacgggtccgaccggtaacccgg

SEQ ID NO: 275935 - DNA, 747 bp, Homo sapiens
  misc_feature: GYAE6OF02JUO1Z.36.36.D03.1.454.CMB.1.raw
tcagtacgctgtctcacgaccggtgctcgatttagctgcgtcacgatctctcgttggggggggtctcaggaggcagcgctctcaggacatctccaccatggcctgggctctgctgctcctcaccctcctcactcgaggcacgagggtccctgggccctagtctcgcccgtgacctcgacgcctgcggtccgtgtcgtcggtctccgtggacagtcgatccacctactcctccgtgaccacgttacggaacccaggacgtacggttcggttacgtttaggggtaacggttaaactaacgtactaacgttcggttcctaccgttaccggtaacccaaactacccggtaacccgaacgaacccgaaacctacccccaaactaccgtacttacgttacgtttacggtacggttaccggtacggtcccgaccgttacgaggttaactttactacgtcgttctctcgtcgcttacacgtctcgaaccaccgccgtaccctccgtacctactcctcgtccgtacggtcctaccgtagccgtaggaccggtacggtaggtccgtagttacgttacgttaccttcgtccgtacgtaaccttacgtaacgtaccgggtccggtaactttaccggttcggttacggtttaccggggccggtaccgtaccccgtccggtacccggtaccggttacgtacccggtaccgaccgttaacccgacggtccccgtacggtacccccggtaggtccctacccgg

SEQ ID NO: 275936 - DNA, 658 bp, Homo sapiens
  misc_feature: GYAE6OF02FHOA7.36.36.D03.1.454.CMB.1.raw
  modified_base (333)..(333): a, c, t, g, unknown or other
  misc_feature (333)..(333): n is a, c, g, or t
tcagtacgctgtctcacgaccggtgctcgatttagctgcgtcacgatctctcttggggggggtctcaggaggcagcgctctcaggacatctccaccatggcctgggctctgctgctcctcaccctcctcactcagggcacagggtcctgggcccagtctgccctgactcagcctgcgtccgtgtctgggtctcctggacagtcgatcaccatcctcctgcactggaacccagcagtgactttggtggtaacaatcattgtctcctggtaccaacagtacccaggcaaacgcccccaaactcatctatttttgacgttcggtagtcggcccctnaggtaatttctaatcgcttctctggctcaagtctgccaacgaccggccctccctcgaccacttcctacgtcgggcctcccgacgtccgtaggacgggaccggaggtccgtaggttactttaagtttaccttcgtttccctacgtacctactttaccgaaacggtcccgggtaagttaccgtttgggtcccgttttttaccggggccgggtacccggtaccccgtacccgttcggtaaccccggttacccgttaacggttcccgaaccggtaccccggtaacgggtcccgttcccggtcccccccggttcggttacccttaccccg

SEQ ID NO: 275937 - DNA, 649 bp, Homo sapiens
  misc_feature: GYAE6OF02F95G3.36.36.D03.1.454.CMB.1.raw
  modified_base (296)..(296): a, c, t, g, unknown or other
  misc_feature (296)..(296): n is a, c, g, or t
tcagtacgctgtctcacgaccggtgctcgatttagctgcgtcacgatctctcttggggggggtctcaggaggcagcgctctcaggacatctccaccatggcctgggctctgctgctcctcacccctcctcactcagggcacagggtcctgggcccagtctgccctgactcagcctgcgtccgtgtctgggtctccgtggacagtcgatcaccatctcctgcactggaaccagcagtgtactttggtagtaacatcatgtctcctgtaccaacagtacccaggacaacgaccccaancatctattttcgacgttcggtacgtcgcctacgaggtaactttctaacgtcgtcttactcgtacggtcctacctaagtcctacgaccctaacgacccgtccctcccgtacgacctacgttcctacgtcggcctccgacggtcctggacggacggtaggtcttagtactttaacgttcttccgttccttaccaacttacttaccgaacggtaccggtagttacgttcggttccgttttccgggacccgggtccgtaacccgtaccggtccgtaacccggttaccggtaaccgtaccgtaaccgacccggtaacggtcccgtacccggtcccccgttaccggtaccttaccccgg

SEQ ID NO: 275938 - DNA, 682 bp, Homo sapiens
  misc_feature: GYAE6OF02IU5EG.36.36.D03.1.454.CMB.1.raw
  modified_base (401)..(401): a, c, t, g, unknown or other
  misc_feature (401)..(401): n is a, c, g, or t
  modified_base (516)..(516): a, c, t, g, unknown or other
  misc_feature (516)..(516): n is a, c, g, or t
tcagtacgctgtctcacgaccggtgctcgatttagctgcgtcacgatctctcttgggggcccgtgggattttctaggtgtttttctatttggtgatcaggactgaacagagagaactcaccatggagtttgggctgaactggtctttttcttgtggtctaattttaaaaggttgtccagtgtgaggtgcagctgttggaggtcgggggggaggtcgttggtacgacggccgtcggggggtccctgagactctcctgtgcacgcctcgtggtattccttccgtttacgctacctagtcgccatgagtcggttcgggtcccgccgacggcgtaccgaaggggaaggggacgtgggtaggtcgggtctacgtactcctagtttacggtggtcgacggtaccttnatacatcctagcagtaccgtcgtaggaacgggtcccgttacaccctcgtcctaccgagaacgtaactaacctttaccaaacgacgaccgacgtacgttcgtaatttcgacctaanacgtaacgaacacgtccgagacgacgaccggacggaccaccggactattaacgttattacgttcgacgtaaccgtacttttccgttttacgacgtttaggttacctttaaccgtacccgttaggtaccaccgtacggtaccgggaccggtacgggtaccctaccgg

SEQ ID NO: 275939 - DNA, 619 bp, Homo sapiens
  misc_feature: GYAE6OF02G64P8.36.36.D03.1.454.CMB.1.raw
  modified_base (326)..(326): a, c, t, g, unknown or other
  misc_feature (326)..(326): n is a, c, g, or t
tcagtacgctgtctcacgaccggtgctcgatttagctgcgtcacgatctctcttgggggggggtctcaggaggcagcgctctcaggacatctccaccatggcctgggctctgctgctcctcaccctcctcactcagggcacagggtcctgggcccagtctgccctgactcagcctgcgtccgtgtctgggtctcctggacagtcgatcaccatctcctgcactggaaccagcagtgactttggtggtaaacaatcatgtctcctggtaccaacagtacccaggcaaacgccccaaatcatctattttgacgtcgtagtcggccctnaggtatttctaatcgcttctctggctcaagtctgaccaacgaccggtccctccctgacctactctcgtgggctccgagcctagacggacgaggtctagatttaattacttcgttcctacactattaccgaaggcccggtaagttaccgtttgggtccgtttttccggggaccggggtaccggtaaccccgtacccggttacggtaccccggttaccggttaacgggttccgaaccggtaccccgtaaacgggtcccgttacccggaccccccgtttacgggtaccctaacccg

SEQ ID NO: 275940 - DNA, 710 bp, Homo sapiens
  misc_feature: GYAE6OF02HJLGL.36.36.D03.1.454.CMB.1.raw
  modified_base (455)..(455): a, c, t, g, unknown or other
  misc_feature (455)..(455): n is a, c, g, or t
tcagtacgctgtctcacgaccggtgctcgatttagctgcgtcacgatctctcgttggggggggtctcaggaggcagcgctctcaggacatcctccaccatggcctgggctctgctgctcctcaccctcctaactcagggcacagggtcctgggcccagtctgccctgactcagcctgcgtccgtgtctggtctcctggacagtcgatacaccatctcctgcactacggaaccagactagtcgtacgtttaggtacgtaaacaatctaattcgtcctaccgtacggtaccaaacgacgtaacccaggaaccaaaccgaccccctaaaagtaccattacttacgttttacgaccgttacgggtacgtccggtccctagtaaggttaactttacaaacttcgtcctttacgtcgttacggctaccaaggtcacgacccaacgtaccgtcctaccctanaccgtactcgttacgtcgggtacctacccgacgtaccgtaggaaccggacggtacggtacgtacgttaatttacgttaaccttccggttcccttacgacgtactaccgtaacgtaccggtagttaccgttacggttccggtttaccggccgggtacccggacccgtaaccgttcgtaacccggttacgtaccggtaccgaccgtacccgtaaccggtccgtacccgtcccccgtacgtacccttaccgtaccccg

SEQ ID NO: 275941 - DNA, 681 bp, Homo sapiens
  misc_feature: GYAE6OF02FX7Q1.36.36.D03.1.454.CMB.1.raw
tcagtacgctgtctcacgaccggtgctcgatttagctgcgtcacgatctctcttggggggggtctcaggaggcagcgctctcaggacatctccaccatggcctgggctctgctgctcctcacactcctcactcagggcacagggtcctgggcccagtctgccctgactcagcctgcgtccgtgtctgggtctcctggacagtcgatcaccatctcctgcacgtggaacccaggcagtgacgtttggtggtaaacaatcatgtctcctggtaccaacacgtacccaggacaaacgacccccaaactcatactattttagacgtcggtacgtccggccctagaaggtaatttctaactcgtctttctcgtcggtctaccgtaagtcctcggacccaaacccgtacccggtaccccttacccccgtaggtaaccccctagttacccctacggttaccggggtaccttcccggaaccgtcccgtacggacgggaaccgacgggtctagtacgtttaatttacctcgtttccctactacctacttacgaacggtaccggtagttaacgttcgggtacgtttttccgggccgggtacccggtacccgtaccggtcgtaccccggttccgtacggtacgtaaccggacccggtacggtccgtacccggtcccccgttaggttaccccg

SEQ ID NO: 275942 - DNA, 722 bp, Homo sapiens
  misc_feature: GYAE6OF02I86XA.36.36.D03.1.454.CMB.1.raw
tcagtacgctgtctcacgaccggtgctcgatttagctgcgtcacgatcgtctcgttggggggggtctcaggaggcagcgctctcaggacatctccaccatggcctgggctctgctgctcctcaccctctcactcgagggcacgacgggtcctcgggacccagtctcgccctgacctcacgcctgccgtcgtgtctgggtcctcgtggacagtcgactaccacctacttcctacctcgactaccgtacggaaccagcgtaacgtcgttacgtttgggtacggtaacaactcgtactcggttctccgtaggtaaccaacgtaccgtaaccgacggaaccgaaccgtacccccaaataccacttaccttagtttcgacggtacggtacgtccggtcctagtacgtacttacgtaactcgtcttctacgtcggtacctacgtaacgtctaccgtacccgaaccgtccggtccctaccgtacgtaacctcgtcgtccgtcgtacctccgcgtaccgtacggacgacgacggtactaggttaacttacttcctcgttacctacgacttacgtaccgtacggtaccgtagttacgtttcggtacccggtttacgggacccgggaccccgttaccgtacccggttaccggttaccgtccggttaacggacccgaccgttacccgggtaccgtcccggtaccccggtccccgtttaccggccttaccccgg

SEQ ID NO: 275943 - DNA, 744 bp, Homo sapiens
  misc_feature: GYAE6OF02IILZE.36.36.D03.1.454.CMB.1.raw
  modified_base (238)..(238): a, c, t, g, unknown or other
  misc_feature (238)..(238): n is a, c, g, or t
  modified_base (405)..(405): a, c, t, g, unknown or other
  misc_feature (405)..(405): n is a, c, g, or t
  modified_base (411)..(411): a, c, t, g, unknown or other
  misc_feature (411)..(411): n is a, c, g, or t
tcagtacgctgtctcacgaccggtgctcgatttagctgcgtcacgatctctcgttggggggggtctcaggaggcagcgctctcaggacatctccaccatggcctgggctctgctgctcctcaccctcctcactcagggcacgagggtcctgggcccagtctcgccctgactcagcctgcgtccgtgtctgggtctctggacagtcgatccacctatcctctgacctacgtacgaaccnacgtaggtcgttaggtttcggtaacggtaactatctattcgttccttaccgtacggtaaaccaacgaccgtaccgacggtaaccaacccgacccctaaatctacttcttagtttacgacggttcgtacgtccggacctaggtaacgtactttactagtccgtcttcncggtcncctacgacgtcaccgacccaaccggtcccgtcccttaccgtacgtacctcgttacccgttcgggccgtaccgtccgtacctcgggttacggacgggtaacgttacggttctaaggtttaacctttacgtcccggtttacttaccgtaaccttaacgtacgttaacccggagggttaccgtttaacgttaaccgggttggttttcccgggttacgggcccggggtacccttaccccggtcggttaacccggttacccggttaccggtaaccggaccgtaccggtacccgtacggtcccgttccccccgggttacccgtcgttacccgttacccg

SEQ ID NO: 275944 - DNA, 664 bp, Homo sapiens
  misc_feature: GYAE6OF02JTCRR.36.36.D03.1.454.CMB.1.raw
  modified_base (488)..(488): a, c, t, g, unknown or other
  misc_feature (488)..(488): n is a, c, g, or t
tcagtacgctgtctcacgaccggtgctcgatttagctgcgtcacgatctctcgttgggggggtcgtcaggaggcagcgctctcaggacatctccaccatggcctgggctctgctgctcctcaccctctcactcgagggcacgtagggtccgtcgggcccagtctcggccctgactcagcctgcggtccgtgtcgtggtcctccgtaggaccaggtcgataccaccagtcctcctgccacgtacggaaccagcctaggtcgtacggttgtacgtcttaatacttatcggtactccgttcggttaccacgacgtctagttcgagtacgacgaccggaacccgtaaattacgtttaaactttagtcggttaacggtttcgtttcggtacccgtcccgttacgttacgggtttactacgtcgtccgttccgccggtactaccgtagttcgtacggtacccgaaccgtccggtcccttcccgtacaacccgtnttacctacgaccgtacccgcgtaacggtcggtaacggacgggtaacgcggtacgtaccgtacttagtttccgtgcgtacgtctacgtaatacggtactaggtatactaagtcgacttcgacgtggtacgtcgtacgggacgtacgagttacgtcgacgtacgtaggcacggtaccg

SEQ ID NO: 275945 - DNA, 679 bp, Homo sapiens
  misc_feature: GYAE6OF02IVNDR.36.36.D03.1.454.CMB.1.raw
  modified_base (386)..(386): a, c, t, g, unknown or other
  misc_feature (386)..(386): n is a, c, g, or t
tcagtacgctgtctcacgaccggtgctcgatttagctgcgtcacgatctctcttggggggggtctcaggaggcagcgctctcaggacatctccaccatggcctgggctctgctgctcctcaccctcctcactcagggcacagggtcctgggcccagtctgccctgactcagcctgcgtccgtgtcgtgggtctccgtggacagtcgatccacctatcctcctgccacgtacggaaccagcagtcgtacgtttggtaggtaacaatcatgtcctccgtggtaaccaacacgtaacccgaggaccaaaccgaccccaaactcatctattttgacgtcggtacgtcgcctacgaggtaattctaacgtctcttctcgtgtctacagtcncgaccaacgaccgtcctccgtacgaccctatcctcgtcggtcctaccgacgtccgtacggacggacggtggcgttacgttaacttattaccgtacgttcccgtactacttagttaccgaacggtccgggttaacgttacggtttcggtttaccggtttccggggaccgggtaccccggtacccgtaccggttaccggtaaccccggttaccgttaaccgggtaccgaacccgggtacccggtaaccgggtcccgttaccccgggaccccccggttaccggtcccgttaccccg

SEQ ID NO: 275946 - DNA, 802 bp, Homo sapiens
  misc_feature: GYAE6OF02FMBU0.36.36.D03.1.454.CMB.1.raw
tcagtacgctgtctcacgaccggtgctcgatttagctgcgtcacgatctctcttgggggggggtctcaggaggcagcgctctcaggacatctccaccatggcctgggctctgctgctcctcaccctcctcactcagggcacgagggtccgtgggcccagtctcgccctgactcagcctgcgtccgtgtcgtggtctcctggacagtcgatccaccacttcctcctgcaccgtacggaaccagcagttacgttacgtttgggtacgtaaacaacttctaagttcgttccttcccgttacggtaaacccaaaccgtacgtaacccgaaggaccaaaaccgaaccccccgtaaaactctaactttactttagtttttacggaccgggtttacggtaccggttacccggtccccgtagtaaggttaacttttacgtaacgttccgttacctttcgttaccttcggtaccttaccgtaacgtccgtaccgaacccgaacccgtacccgggtccccttacccgtaacaacccgttacttccgttacccggtcgggtacccttaccggacccggtaccgtacgggtaaacgggacggtacgggtacctttaaggttaacttttaacgtttaccgtttccgtttacccgacttacgttacgttaacgaccgggttacggttaacgtttacgtttggttacccggttccgggacccggggttcccacccgtaccggttacgacccggttacgtaccgtaccgaaccgccggtacggtccccgtacccgggtcccctcggtaccttacccgg

SEQ ID NO: 275947 - DNA, 802 bp, Homo sapiens
  misc_feature: GYAE6OF02JKJGW.36.36.D03.1.454.CMB.1.raw
tcagtacgctgtctcacgaccggtgctcgatttagctgcgtcacgatctctcttggggggggtcgtcaggaggcagcgctctcaggacatctcaccatggcctgggctctgctgctcctcaccctcctcactcagggcacagggtcctgggcccagtctgccctgactcagcctgcgtccgtgtcgtgggtcctcctggacagtcgatcaccattcctcctagccacgtaggaaccagctagtgtacgtttgggtaggtaacaatcatcgtctccgtacggtaccaacaacgtacccaggaccaaaccgaccccctaatcctacgtcttacttttcgaccggttacggtacggtccggccccttacgtaacggttaactttaccgtaactccggttacctttcctcggttcggtactaccggtaactccgttacgacccgaaccgtaacccggtcccttccccgtacgaacccttaaccgttccgttaccgtcggggtacccgttacccgacggttaccgtcggtaacggggaccggtacgggtaccgttaggttaacttttaacgtttaccttccggttttacctacccgttaaccttacgttacgaaaaccgggttcccgggttaaacgttccgtttacgggttaccgttttacccgggggacccggggtaccccgggtaaccccgtacccggtttcccggtaacccggttacccggttaaccgggtacctaaccgggtaccccgaacgggtttcccgtccccgggttccccccggttaccgggtccgtttaacccccgg

SEQ ID NO: 275948 - DNA, 964 bp, Homo sapiens
  misc_feature: GYAE6OF02GDVJV.36.36.D03.1.454.CMB.1.raw
tcagtacgctgtctcacgaccggtgctcgatttagctgcgtcacgatctctcgttgggggggggtctcagggaggcagcgctctcaggacatctccaccatggcctgggctctgctgctcctcaccctctcactcagggcacagggtcctgggcccagtctcgccctgacctcagcctgccgtcgtgtcgtcgggtctccgtggactagtcgactcacctatcctcctgcactacggaaccagacgtaggttcgtaccgttttaggtaacgggtaaactaacgttactaacgttcgttaccgttacccggttacggtaaaaccccaaaccgtaaacccggttaaccccgtaacgggtaaccccgaaaaacccccgaacccccccgtaaaaaccttacctaaccttaacgttttaacttttttaaccgggaccgggtttccggggttaacggttccccgggtaccccgtttacggtaaacgggtttaaaccttttaccgttaaacgtttcccggtttaccgtttaccgttcccggttacgggttcccttaacccgtaaacggtttccgtaaccggtaaccccgtaaaccgttacccggtaccccgttacccccgtaaccggtaccctaaccgtttccgtttaccgggtaccgggttacccttacccggaaccgttcccggtaacgggtaaccgggtaaaccggtacggtaccgttaacggtttaaacttttaaccgtttacgttttaccggtaacccttactaaaccgttactttaaaccgggtaacccggtaccgggttaaacgttttcgtacggggtttaccggtttcccgggggaccgggtacccgtaaccccgtacgggttacccggtaaccggttaccggttaccggtacccgtaaccgggtaacccgaccgggttaccgccccggttaaccccgggtttaccgttaccgttacccccgg

SEQ ID NO: 275949 - DNA, 686 bp, Homo sapiens
  misc_feature: GYAE6OF02JO06A.36.36.D03.1.454.CMB.1.raw
tcagtacgctgtctcacgaccggtgctcgatttagctgcgtcacgatctctcttggggggggtcgtcaggaggcagcgctctcaggacatctcaccatggcctgggctctgctgctcctcaccctcctcactcagggcacagggtcctgggcccagtctgccctgactcagcctgccgtccgtgtctgggtctcctggacagtcgatcacatctctagcactggaaccagctagtgactttggtaggtaacatctatgtctctagtaccaacgtagtacccgaggaccaaaccgccccaaactcacttcgtatttttcgacgttccgggtaacgtccgggtaccctagacggttaactttacttaaagttccggttacctttcgttaccgtggtaccctaccgtaacgttcctcggtacccaaaccgtaccggtcccttaccctcgacctacttctcgtcggtacctccgtacgtccgtagacgggacgtaacggtctaggtaactttagttacttcgttcctacgtactacgttacgtaacggtacgggtacgttacgttcgggttcgttttaccgggccgggtcccggtaaccccgtccgttacccggtaccgtaccggtacggtacccgtacggtacccgtacgggtacccgttccggtcccccgttacggtcccttacccgg

SEQ ID NO: 275950 - DNA, 820 bp, Homo sapiens
  misc_feature: GYAE6OF02H632A.36.36.D03.1.454.CMB.1.raw
tcagtacgctgtctcacgaccggtgctcgatttagctgcgtcacgatctctcgttggggggggtctcaggaggcagcgctctcaggacatctccaccatggcctgggctctgctgctcctcaccctcctcactcgagggcacgagggtccgtgggcccagtcctcgccctgactcagcctgcgtccgtgtcgttcgggtctcgtggacagtcgatcaacctacgttcctcctgccacgtacggaacagacgtaggttacgttacgttttggggtaacgttaaaccaacgttctacgttcgtccttacccgtacggtaaaccctaaacgtaaccgtaacccgacggaaaccaaaacccgtcccccaaaatctaacttacttagttttcggacgttcggtacgtcccgtcctacgtaagttaactttactaacgttctccttcgtcgttacgtccgtaaccgtaagttccgaccgtacccgaaaccggtcccgtacccttcccgtacgacccgtaccttcgttccgtccgggtaccctccgtaccggtcccgtagggaacggaaccgggtacggtacttaggttaacttttaactttaccgttaccgtttacccgtacctaaccgttacgttaaccggaaccggtaccggtttaacgtttaccggtttcgggttacccggttttcccgggggacccgggttaccccggaccccgttaccggttacccgggtaccccgttaccggtacccggttaccgacccggtacccggtaccggtaccccgttccccggtacccccggtttacccgtaccgttacccccg

SEQ ID NO: 275951 - DNA, 863 bp, Homo sapiens
  misc_feature: GYAE6OF02HS84N.36.36.D03.1.454.CMB.1.raw
tcagtacgctgtctcacgaccggtgctcgatttagctgcgtcacgatctctcttgggggccctgggattttcaggtgttttcatttggtgatcaggactgaacagagagaactcaccatggagtttgggctgaactggtctttttcgttgtggtctattttaaaaggtgtccagtgtgaggtgcagctggttggagggtcgggggggagtcgttggacacggccggtggggggtcccctggacgacctccgtccgtggtcgcacgtcctcgtaggtacttctcctttagccaccttatcgacctagtgacggcgttcgggtcccgaccgacggtccgtaccgggaacggggtaacggggtaccggttagggtacgggttcggggttcctacgtactacccgtaaggtttaacggtggtaccgtaccgggtacctttacgaacttaccgtaataacgttccgactaacggtaccctttaccgggtacggtaaccgggggttccccgtacctaaccgtacgttcggtaaccgaaggtaaccgtaaacttaacccttaaaccggaaaacgtaaaccaaccgtaaccgtaagttaacttaccgtacgtaaactaaaccggttacgaaaccgtaaccggtcctaaggaacggtaacccggaacgggtaaccgtaacccgggtacccggttaccgttactttaacggtttcgtaacggtaccgtaaacggttaacgttaccgtttacggtttacggttttaaccgggtagtttaccgggttaagggttaaccgggggggttaacgggaaccgggtacggttaaccggggagggtaacccggttaacgggtacgttcccggttaaccggg

SEQ ID NO: 275952 - DNA, 800 bp, Homo sapiens
  misc_feature: GYAE6OF02IDHZS.36.36.D03.1.454.CMB.1.raw
  modified_base (225)..(225): a, c, t, g, unknown or other
  misc_feature (225)..(225): n is a, c, g, or t
tcagtacgctgtctcacgaccggtgctcgatttagctgcgtcacgatctctcgttggggggggtctcaggaggcagcgctctcaggacatctccaccatggcctgggctctgctgctcctcaccctcctcactcagggcacagggtcctcgggcccagtctcgccctgactcagcctgccgtccgtgtctgggtctcctggaccagtcgatcacctatccttccngccacgtacggaacccagccgagttcgtaccgttttgggtaggtaaacctaatctaattcgtcttccgtacggtaacccaacacgttaacccaggaaccaaaccggacccccctaaaactctacttactagtttttacggacgttacgggttacgtccggtcccctacgaaggttaactttactaacttccgtacctttctccgttcggtaccttaccgtaacgtccttccgaacctaaccgtacccgggtcccttcccgtacgtaacctactccgttccgtacggtccgtaccctacggttcccgtagggtaacggaccgggtaacggtccttacgttaactttaacgtttaccgttccgttttaccctaccgttaaccttacgttaaccgtaaaccggttacccgggttaaaccgttcggtttaacgggttcccggttttaccgggggtccccgggacccgtaaccccgtaccgttacccggtaaccccgtttccgtaaccggttaccgaacccggtccccgaacggtccccgttaccccgtcccccggtttcccggtaccctttaaccccgg

SEQ ID NO: 275953 - DNA, 778 bp, Homo sapiens
  misc_feature: GYAE6OF02GJLRU.36.36.D03.1.454.CMB.1.raw
  modified_base (213)..(213): a, c, t, g, unknown or other
  misc_feature (213)..(213): n is a, c, g, or t
tcagtacgctgtctcacgaccggtgctcgatttagctgcgtcacgatctctcttggggggggtctcaggaggcagcgctctcaggacatctccaccatggcctgggctctgctgctcctcaccctcctcactcagggcacgagggtcctgggcccagtctggcctgacacagcctgcctcgtgtctgagactccgtggacagtcgatcaaccntctcctgcactaggaaccagctagtgacggttggtgtacttaataatttagtcgttccttcgttacggttaccaacgacggtactagttaccgacggaccaacggcccgtaacccccgtaaaactttaccgttttaaattttagtcggttaacggtttccgttttacccgggtccgggtaccccgtttacggttaacggggttttacctaacggttccgttcccgtttccccggtccggttcccttaccggttaaaccgttccgtaccgggtaaccctaaaacccgggtcccgggtccccttccccggttaaccgtacccttacttcccgttaaccgtaacgtaccgtcccgtagggtacccgtaggaaccgggtacggacggttccgtaggttaaccttagtttacggtcgtcgtacggtccttagaacgttacgttacgtaacgtaaacgttacgtaagttacggtacttaccgtacggttacggttccggttcgggtaccggtacgggtaacggtaccgttaggttaccggtacccgtaccggtacggtaccgtaacccggg

SEQ ID NO: 275954 - DNA, 780 bp, Homo sapiens
  misc_feature: GYAE6OF02ID1Z8.36.36.D03.1.454.CMB.1.raw
tcagtacgctgtctcacgaccggtgctcgatttagctgcgtcacgatctctcgttgggggggggtctcagggaggcagcgctctcaggacatctccaccatggcctgggctctgctgctcctcaccctcctcactcgagggcacgacgggtccgtcgggcccagtctcgccctgacctcacgcctgcgtcgtgtcgtcgggtctcgtggacagtcgatccacctactccggtcctgccacgtacggaaccagcaggttcgtacgtttaggtacggtaaactaatcagtcgtcctccgtacggtaaccaacgtacgtaccgacggaccaaaaccgaccccctaaactctacttacttagttttacgacggttcggtacgtccggtaccctagtaacggtaactttctaactccgttacttccgtcgtacggtacctaaccgtacgtcctacggaaccccaaccggtacccggtcccctaccgtaccgtaccctacttccgtacggtcggtcctccgaccgtccgtaagggacgggacggtacggtacgttagttaacttttacgttaccgttacgttccctactaaaccgttcgttaaccggaaccggttaccgggttaacgtttaccggtttcgggtttcccgggttttaccggggacccggggttaccccggtaaccccggttacggtacccggtaacccggttccggtaaccgggttaccgacccggtacccggtacggtccccgtacccggtcccccggttacgtacccttacccgg

SEQ ID NO: 275955 - DNA, 807 bp, Homo sapiens
  misc_feature: GYAE6OF02IZJET.36.36.D03.1.454.CMB.1.raw
tcagtacgctgtctcacgaccggtgctcgatttagctgcgtcacgatctctcgttggggggggtctcaggaggcagcgctctcaggacatctccaccatggcctgggctctgctgctcctcaccctcctcactcgaggcacgtgggtcctcgggcccagtctcgccctgactcgacgcctgccgtccgtgtcgtcgggtcctccgtaggactagtcgactaccacctatcctcgtcgacacgtacggaacacgctaggtgttacgttaggtagtaaacatactagttcgtcctaccgtacggtaacctaacgaaccgtaccgaacggaaccaaacccgacccctaaaacgtctacttacgttacgttttacgaaccggttccggtaggtcccggtaccgttacgtaaacgttactttacgtaacgttccgtacgttcgtacgtcgtacgtacgaacgttccaccgaccgtaaaccgtcccggtaccctcgtaccgtaaccttaccgttccgttaccgggtcggtaccctaccgacgggtcccgttaagggacccggaaacgggttcgtaacgttacgttaactttaccggttactttacgggttccctaacgttaccgttagtaaccgggtacccgttaacgggttactttacggttcgggtttaaccgggtttcccgggggaacccggtacccggaacccgttaccggtcccggtacccggtttcgaacggttccccgtaaccggtaaccggtttccccggaaccggttcccccccggtaccccggtttacgtacccgttaccccg

SEQ ID NO: 275956 - DNA, 822 bp, Homo sapiens
  misc_feature: GYAE6OF02HPYJG.36.36.D03.1.454.CMB.1.raw
  modified_base (243)..(243): a, c, t, g, unknown or other
  misc_feature (243)..(243): n is a, c, g, or t
tcagtacgctgtctcacgaccggtgctcgatttagctgcgtcacgatctctcttggggggggtctcaggaggcagcgctctcaggacatctccaccatggcctgggctctgctgctcctcaccctcctcactcagggcacgacgggtcctgggcccagtctgccctgactcacgcctgccgtccgtgtcgtcgggtctcctggacagtcgatcaccagttctacctgaccacgtacggaaccngcctaggtcgtacgtttagggtacggttaaaacgtaatctaagttcgttaccgttacccgttacggtaaccctaaacgtaaccgttaacccgacggtaacccaaaaccgaccccccgtaaaactcctaacttactttaactttttacgggaccggttaccgggttacgtccggtaccccgttacgaacggttaaactttacgtaaaccttcggttacttccgttcgtacggtacctaaccgtaacgttccgtacgacccgtaaccgtaccggtccccgttacctccgtaaccctacgtttacccgtccggtccggtaccctaccgtaccggtaccgtacgggaacgggtaccggtacgttacgtacggttaacgtttaacttaccgtaccggttttaacccaccgttaactacggttaccgaaaccgggtccgggtttaacgttaccgggtttaacggttcccggtttaccgggacccggggtaccccgtacccgttacccggtccggtacccgttacgtaccggtaccgaccgtaccggtaacggtcccgttcccgccccgttacggtccttacccgg

SEQ ID NO: 275957 - DNA, 716 bp, Homo sapiens
  misc_feature: GYAE6OF02JQBMD.36.36.D03.1.454.CMB.1.raw
  modified_base (181)..(181): a, c, t, g, unknown or other
  misc_feature (181)..(181): n is a, c, g, or t
  modified_base (505)..(505): a, c, t, g, unknown or other
  misc_feature (505)..(505): n is a, c, g, or t
  modified_base (522)..(522): a, c, t, g, unknown or other
  misc_feature (522)..(522): n is a, c, g, or t
  modified_base (530)..(530): a, c, t, g, unknown or other
  misc_feature (530)..(530): n is a, c, g, or t
  modified_base (553)..(553): a, c, t, g, unknown or other
  misc_feature (553)..(553): n is a, c, g, or t
tcagtacgctgtctcacgaccggtgctcgatttagctgcgtcacgatctctcttgggggccctgggattttcaggtgttttcatttggtgatcaggactgaacagagagaactcaccatggagttgggctgaactggtcttttctgtggtctattttaaaaggtgtccagtgtgaggtgcngctgttggaggtcgggggagcttggtacagtccgtgggggtccctgagctctctgtgcacgcctctggtacttctactttagctaccttatcgaccataggacgtccgtcggggttaccccgactcgggtcctacccggaaggggtaacgggtccgtaggggaacgggttcgggtacctaccgtacttaccgtagtttacgggtcggtcccgtaacggtcttacctataccgtaacttccgttcgactaacggtacctttcgggtacggacgggttccgtacccgtacacgttacggtaccacggacgtactaactaccgaaanaactacaactagtactnacggtaanaacgtacacgacgtacgtagganaccggacggacgaccgtacggtaccttacgtctttacgtacggtcgtaaccaacggtttaccgttacgttaacggttaccgttacgtaggttaccggggttaaggggaacgggtccgtaaccggttcgggacccgggttcgtaacgggtacctcgggtaaccg

SEQ ID NO: 275958 - DNA, 786 bp, Homo sapiens
  misc_feature: GYAE6OF02HQU13.36.36.D03.1.454.CMB.1.raw
  modified_base (228)..(228): a, c, t, g, unknown or other
  misc_feature (228)..(228): n is a, c, g, or t
  modified_base (360)..(360): a, c, t, g, unknown or other
  misc_feature (360)..(360): n is a, c, g, or t
tcagtacgctgtctcacgaccggtgctcgatttagctgcgtcacgatctctcgttgggggggggtctcaggaggcagcgctctcaggacatctccaccatggcctggctctgctgctcctcacccctcctcactcgagggcacgagggtcctcgggcccagtctcgccctgactcacgccgtgccgttccgtgtcgtcgggtcctaccgtggacagtcgataccaccnctctcctgacctacgtacggaaccagctaggtcggttacgtttgggaaggtaaaccagtctaacgtgttcctccgtaaggtaaccaaacgtaccggtaacccgaggtaacccaaaaccggacccccctaaanaccgttataaccgtttacgtttttacggaccgtcgggttacgtccggtacccgtagaacgttacttaccgtactcgtcttccgtgtacggtcctaacgtggttacctcgaaacccgacgtacccgtccccgtacctaacgtcctaacgttccgtacggtccgggtacttccgtaccgcgttacgggacggtaacggtacggttactaagttaacttaaccgtttacgtaccgttacttacccgtaacttacgtaccggtaacgtaccggtttacgtttccggttacgggttccggtttaccggggtcccggtacccggtaacccggttccgtaccggttaccccggttacggtaccggtacccggacccggtaccggtaaccggtcccggttaccccggtcccccggttcgttaccccggttcccg

SEQ ID NO: 275959 - DNA, 797 bp, Homo sapiens
  misc_feature: GYAE6OF02HOMTQ.36.36.D03.1.454.CMB.1.raw
tcagtacgctgtctcacgaccggtgctcgatttagctgcgtcacgatctctcttgggggggggtctcaggaggcagcgctctcaggacatctccaccatggcctgggctctgctgctcctcaccctcctcactcgagggcacgaggtccgtcgggaccagtctcgcctagactcgagcctggcgtcgtgtcgtcgggtcctccgtaggacgacgtcgacttcaacctacttctccgtgacctacgtacggaaccgacgcgtaaggttcgaaccttttggggtacggttaaactaagtacctagttcggttccttacccgtagggtaaccctaaacgaccgttaaccgaacggaccaaaccggaacccctaaacgtctaacttacttaacgtttttcggaccggttagggtaccggtccgggtcctacggtaagttactttacggacttacggtccttacgtccggtcgtctaccgtaacgtcgttacgaccacgtaccgtccctaccgtactaccgtacttcggtactcgggtacctaccggaccgtcggtacggaacgggacggtaacggtacgtacgttaacgtttaacgtttactaccgggttttactacccggttaactaccggttaaaccgtaaccgggtcggtttaacgttacgggtttaccggttaccggggttacgggaccgggtcccggaacccgttaccgggaccgtaacccggttccggtacgggttaacccgccggtaaccgacgggttcccgtaacccggtccccggttacgtacccgttaccg

SEQ ID NO: 275960 - DNA, 684 bp, Homo sapiens
  misc_feature: GYAE6OF02GGIOF.36.36.D03.1.454.CMB.1.raw
tcagtacgctgtctcacgaccggtgctcgatttagctgcgtcacgatctctcgttggggggggtctcaggaggcagcgctctcaggacatctccaccatggcctgggctctgctgctcctcaccctcctcactcagggcacgagggtcctgggcccagtctgccctgactcagcctgcgtcgtgtcgtggtctcgtggacagtcgactccacctatcctctgccacgtcggaaccagactagttcgtacgtttaggtacgtaacaactctagttcgtccgtccgtacgtaacctaaccgtaaccgtaacccgaacggaaccaaacccgaaccccctaaacgtactacgttactttacgttttacggaccggttacggtacggtccgtaccgtacgtaacgttaactttactacgtccgttccttccgtaccgtacctacgtacgtcgtacgaccaccgtcccgtccctaccgactacctactctacgtactaccgtacgacgtacgaggacggacgtacgtctagttaacttattcgtacgacgtacgtctactaactagtacgtacgtaacgtcgtaacgttacgtactacgtacgtcggtcggttacgggtaccgggtaacgggtaccgttacgtacgttaccggtaccgttaccgtacggtacgtaccgtacccggtacgg

SEQ ID NO: 275961 - DNA, 807 bp, Homo sapiens
  misc_feature: GYAE6OF02I6XJJ.36.36.D03.1.454.CMB.1.raw
  modified_base (708)..(708): a, c, t, g, unknown or other
  misc_feature (708)..(708): n is a, c, g, or t
tcagtacgctgtctcacgaccggtgctcgatttagctgcgtcacgatctctcttgggggggggtctcaggaggcagcgctctcaggacatctccaccatggcctgggctctgctgctcctcaccctctcactcagggcacgagggtccgtcgggcccagtctcgccctgactcacgtcctgtccgttccgtttcgtgggtcctccgtaggactcgtcgatccaaccacttcctcctcgacctaccgtacggaacccagccgaggttcgtacggtttcggtagtacttttaaattaatttacgttcgttccttccgttacggttaacccaacgtacggtcttaacgttcgaacgggtctaacggaccccgaacccggttaaaactttacgttaaatttcgtacgggtttacggttttcccgttttccgggccccggtaccgtttacggggttacggggttttaccaccgggttccgttcctttcccgggttcccggtaccttaaccgtaacggtttccgaccggtaaccgaaacccggtcccggtacccccttacggtacctacccggtaacttcccggttaacctaaccgggtacccttaccggaacgggtccgttaacgggaacccgggtacgtacgggttaactaccggttaaactttagttacggtacgacgtacgtctaacgttatacgttacaggtaacgttnacggtagttcaccggtgacggtttctacggggtcgggaaccggtacggtacttaccggttaggacccgtcgtttaacgggaccctaccgcccgttacgg

SEQ ID NO: 275962 - DNA, 695 bp, Homo sapiens
  misc_feature: GYAE6OF02I3I95.36.36.D03.1.454.CMB.1.raw
  modified_base (238)..(238): a, c, t, g, unknown or other
  misc_feature (238)..(238): n is a, c, g, or t
  modified_base (293)..(293): a, c, t, g, unknown or other
  misc_feature (293)..(293): n is a, c, g, or t
  modified_base (504)..(504): a, c, t, g, unknown or other
  misc_feature (504)..(504): n is a, c, g, or t
tcagtacgctgtctcacgaccggtgctcgatttagctgcgtcacgatctctcttggggggggtctcaggaggcagcgctctcaggacatctccaccatggcctgggctctgctgctcctcaccctctcactcagggcacgagggtcctgggcccagtctcgccctgactcagcctgcgtccgtgtcgtcggtctccgtggacagtacgactcactactctcctgacaacgtagaaccngacagtcgtacgtttggtaacgtaacatctagtcgttccgtacctagtaaccaanaacgtacccgagaaccgaaaccacccctaaatctactcttacgttttcgacgttcgtacgtccgacctgtaacgttacttactaatcgtacttcctagtcgtactacgtaacgttccgtacgaaccctaaaccggtcccgtccttacccgtacgaacctcttccggtcgtaccgggtcctacgaccggtccgtaacgggaacggtaacggngtacgttacgttaacttttcgttaacgtcctttaccgacttaactacgtttaacggaaccggttaccgggtatttaccgggtttcggttaccgggtttccggaccgggtaccgtacccgtaccggtcgtaaccgtccgaacggtacaacccgacgtacggtaccctccggtaccccttcgtacctacccgg

SEQ ID NO: 275963 - DNA, 610 bp, Homo sapiens
  misc_feature: GYAE6OF02FJFY5.36.36.D03.1.454.CMB.1.raw
  modified_base (272)..(272): a, c, t, g, unknown or other
  misc_feature (272)..(272): n is a, c, g, or t
tcagtacgctgtctcacgaccggtgctcgatttagctgcgtcacgatctctcttggggggggtctcaggaggcagcgctctcaggacatctccaccatggcctgggctctgctgctcctcaccctcctcactcagggcacagggtcctgggcccagtctgccctgactcagcctgcgtccgtgtctgggtctcctggacagtcgatccacctatcctcctgcactggaaccagcagtgtacttggtagtaacatcatgtctcctagtaccanactacccaggcaaacgccccaactcatctagttttcgacgtcggtagtccggcctgagtacttactatcgcttctctgtctcagtctcgaccaacgaccggtccctcccgtacgtacccacgttcctcgtcgggtaccttccgagtaccctaggaacggtacggagccttaggtaacttttacgttacctttccggttacctaccgtaactacttacgaacggtaccgtacgttacttcgggtctttcggggaccggtccggaccctacggtacgtcccgtacgtacggtaccgtacgacccgtacggtccttacccgccccgttacggtcctacccg

SEQ ID NO: 275964 - DNA, 718 bp, Homo sapiens
  misc_feature: GYAE6OF02GJPGY.36.36.D03.1.454.CMB.1.raw
  modified_base (253)..(253): a, c, t, g, unknown or other
  misc_feature (253)..(253): n is a, c, g, or t
tcagtacgctgtctcacgaccggtgctcgatttagctgcgtcacgatctctcttgggggccctgggattttcaggtgttttcatttggtgatcaggactgaacagagagaactcaccatggagtttgggctgaactggctttttcttgtggctattttaaaaggtgtccagtgtgaggtgcagctgttggagtcggggggaggcttggtacaggccgtggggggtccctagagactctcctgtgcagcctcgnggtacttcgttcctttagcacctatcgcctatcgagcgtcgggtcccgccaaggcctacccgaaggggaacgggacgtagggagttcggggtcctacaacgtccgtaagttaggttcgggtccaaccgggtacttccaagttaccaattaccttcgacacgacgttaccgtaggaacgggtccgttacaccgatgtaccagacgaactaactacaaagaacacacagtacactagaacaaagtacaaacgacgacctagagtacggaccgtaacggacgaccggtccgttaacttagtttacctaggtacgaacggaaacgttaccgttttagggttaccgtttaaccgggtttaagtaacggttaacggggttaacggggtaaaaccgggggggtaccggttaaccggtaaccggggtttacgggggaacccgggaagggttaacccgttcccggttaaccggg

SEQ ID NO: 275965 - DNA, 673 bp, Homo sapiens
  misc_feature: GYAE6OF02HI0JZ.36.36.D03.1.454.CMB.1.raw
  modified_base (660)..(660): a, c, t, g, unknown or other
  misc_feature (660)..(660): n is a, c, g, or t
tcagtacgctgtctcacgaccggtgctcgatttagctgcgtcacgatctctcgttggggggggtctcaggaggcagcgctctcaggacatctccaccatggcctgggctctgctgctcctcacactcctcactcgagggcacgtacgggtcctcgggcccagttctcgccctgactcagcctgcgtcgtgtcgtggtctcgtggacagtcgatcacctatcctaccgtgacctacgtacggaaccagctaagtgtacgtttggacggtaacaatcatcgtcgtcgtacgtaccaactacgtacccgaggaccaaccgaccccaactctacttacttatttacggacggttcggtacgtccggtcctaggtacggtaactttcgaacgtctacttcgtctcggtcctaccgtagtctacgaccaacgtcggtccctccgtcgacctactcggtcgtcggacctacgtcgtcgacggaggtaccgagtccgtagtacttacgttccttcgttacctacgtactacgtccgtaaggtccggtaagttcgtcggttacccgggttcgggacccggtacccgtaacccgtccggtaccggttacccggtaacggtaccgaccgtacccggtaccggaaccggttcccgtccccggttaccccggnggtttaacccccg

SEQ ID NO: 275966 - DNA, 644 bp, Homo sapiens
  misc_feature: GYAE6OF02G1JQN.36.36.D03.1.454.CMB.1.raw
  modified_base (230)..(230): a, c, t, g, unknown or other
  misc_feature (230)..(230): n is a, c, g, or t
  modified_base (388)..(388): a, c, t, g, unknown or other
  misc_feature (388)..(388): n is a, c, g, or t
tcagtacgctgtctcacgaccggtgctcgatttagctgcgtcacgatctctcttggggggggtctcaggaggcagcgctctcaggacatctccaccatggcctgggctctgctgctcctcaccctcctcactcgacgggcacgacgggtcctcgggcccaggtctgccctagacctcagcctgcgtccgtgtcgtcggtctccgtggcagtcgatccaccactccttccncgcctacgtcggaaccagcgagttgtacgtttggtagtaaccaatctagtctctccgtacgaacctacgacgtaccacggaaccaaaccgacccctaactctactcttagtttcgcgttacggtacgtccggtcctacgagtacctttactatccgtnttcctcgtcgtcctacgtacgtcgtcaccgtacgtacccgtccctacctcgtacctactcgtcgtcggcctccgacgtccgaggtacggtacgacggtctaggtactttacgtcttctcctcgtactctaccggacggtacgttacgttcgttcggtccggttcggcccggtaccgacccgtcgtcggtaccgttaccggtacgtaccgaccgtaccgtacggtcccgtacccggtcccgtccgttaccgtacccc

SEQ ID NO: 275967 - DNA, 802 bp, Homo sapiens
  misc_feature: GYAE6OF02GSF25.36.36.D03.1.454.CMB.1.raw
tcagtacgctgtctcacgaccggtgctcgatttagctgcgtcacgatcgtctcttggggggggtctcaggaggcagcgctctcaggacatctccaccatggcctgggctctgctgctcctcaccctctcactcgagggcacgacgggtcctcgggcccagtctcgccctgactccacgcctgcgtcgtgtctgggtctccgtggactagtcgactcacctatccgtcctcgcctacgtacggaaacctacgtacgtaggttcggtaacgttttgggtaacggtaaacctaacgtaccgtaagttccgttaccgttcccgttaacgggtaacccaaacgtaccggttaacccgaagggaacccgtaaaacccggtaccccctaaaaccgttaccgtacgttaccgtttaacgtttttcgggaacccggttaacggttacgggtcccggtaccccttaacggtaacggttaaactttaccgttaaacgtccgttacctttcgtaccgtcggtacctaccgtaaacgttctaccgaccaaccgtccgccctacgacgtacctacgttccgtacggtccggacttccgacgttccgtacgggaccgtacggttacggtccgttacgtaaccgtttacgttaccgtttccgtaacctacgtaccgttacctacgaccggttacggtacgttaccggttcggtacggtttaccggggccggtaccgtacctaccggtcggttaaccgttccggtacgtaccgaccgtaccggtacgtccgtccccggtacccttccggacttaccccg

SEQ ID NO: 275968 - DNA, 849 bp, Homo sapiens
  misc_feature: GYAE6OF02JCIA9.36.36.D03.1.454.CMB.1.raw
  modified_base (260)..(260): a, c, t, g, unknown or other
  misc_feature (260)..(260): n is a, c, g, or t
tcagtacgctgtctcacgaccggtgctcgatttagctgcgtcacgatctctcgttggggggggtctcaggaggcagcgctctcaggacatctccaccatcggccgtgggctctgctgctcctcacccctctcactcgacggcacgacgggtccgtcggggccccagtccgtcggcccctggactcgacgcctcggccgtccggttgtccgttgggtcctccgtggactaggtccgactcctaacccacgttcctcccgtntccgacgtacggaaacctacgccgtaggtacggttacgtttgggtacggtaactaactacgtcgtcgttaccgtacccgttaccgggtaaacccaaccggtaaccggtaaccccggaacgaacccgaaaccccgacccccgttaaacgttcctaactttacgtttaaccgtttttacggaccggttccggttaaccgggtcccgtaccccgtacgtaaggttaacgtttactaaccgttcccttaccgttccgtacgtcgtaccctaccgtagtcccgacgtacaccggtcccgtccctacctacgtacctacttcgtaccgtcggtaccctccgacgtcgtaggaccgggtacggttaacgccttagttaaccttacgttccgttctcctactacgtaccgttacgaacgggttaccggttaacggttttccgtacggtttcccgggtttcccggggaaccccggaccggttaacccggcccgttaaccgggttacccgttaccgtacggggttacccgtacccggtaaccgtcccgggtaccccggtttccccctaaccccggttcgggttacccccttaacccggg

SEQ ID NO: 275969 - DNA, 693 bp, Homo sapiens
  misc_feature: GYAE6OF01CKN2W.33.67.G01.1.454.CMB.1.raw
tcagtacacacactcacgaccggtgctcgatttagagtatacatattgggtttggggggtagctcaggaagcagagcctggagcatctccactatggcctgggctccactacttctcaccctcctcgctcactgcacaggttcttgggcctaactttatgctgactcacgccccactctgtgtcggagtcgtccggggaagacggtaaccattctttcgccacccacaacagtggacaactattcgccagtctaatttttgtgctaggtcggtaccagcacggccggcccgggctaccgttccccccaactattgtgtattctagtggaagataatacgaaacgccgttcggtcgggtccctgtacgttccggttctcgtggcctacactcgacactccctcctaccaccttccgtcctccccttccccacctaccctactttccgttaccgtacggtaacgtacggaaacgtacgtagggaacgggacggacggtctacgtaaccttaaccttcgtacgtactagttcttaagtcgtaacgtaccggtccggtacggttacgttaggttcgggttacggttccgggttaccggggagggtaggtaaccgtacgtaacgtccggttaccggtacccggttccgtacgggtaccaacccggacccgtaccggtcccgttccccggtacccccgg

SEQ ID NO: 275970 - DNA, 600 bp, Homo sapiens
  misc_feature: GYAE6OF01CWNNF.33.67.G01.1.454.CMB.1.raw
  modified_base (224)..(224): a, c, t, g, unknown or other
  misc_feature (224)..(224): n is a, c, g, or t
  modified_base (247)..(247): a, c, t, g, unknown or other
  misc_feature (247)..(247): n is a, c, g, or t
  modified_base (392)..(392): a, c, t, g, unknown or other
  misc_feature (392)..(392): n is a, c, g, or t
tcagtacacacactcacgaccggtgctcgatttagagtatacatattgggtttggggggtagctcaggaagcagagcctggagcatctccactatggcctgggctccactacttctcaccctcctcgctcactgcacaggttcttggcctaactttatgctgactcagccccactctgtgtcggagtcgtccgggaagacggtaaccatctttgcaccacaacngtgcaacatgccagcaattttgngcagtggacagcagcgcccggcacgtcccccacattgtgatctatgaggaataatcaaagaccgtctggggtccctgatcggttctctggctcatcgacagcctcctccaactctcgccctccctcacctatctctggactgaanctgaagaccgaggctagactactactagtctaagttaccttatcgtaagttacgcccggtcgggttcctaaggttcggttcgggttaccgtttccgggggacgggtaacggggaaccccgaaaggtccttaccggtaacccgggttacccttaaggggtcccaacggaccccgaaacgggtccgtacccggccccccgtttaccgggg

SEQ ID NO: 275971 - DNA, 513 bp, Homo sapiens
  misc_feature: GYAE6OF02G3B8I.33.67.G01.1.454.CMB.1.raw
  modified_base (455)..(455): a, c, t, g, unknown or other
  misc_feature (455)..(455): n is a, c, g, or t
tcagtacacacactcacgaccggtgctcgatttagagtatacatattgggtttgggggagctctggggagtctgcaccatggcttggaccccactcctcttcctcaccctcctcctccactgcacagggtctctctcccagcttgtgctgactcaatcgccctctgcctctgcctccctgggagcctcggtcaagctcatctgcactctgagcagtgggcacagcaactacgccatcgcatggcatcagcagcagccagagaagggccctcggtacttgatgaaggttaacagtgatggcagccacaccgaagggggacggatcccgtgattcgttttcagggtccagctcgtgggctggacgcgctacctcaccatctccacgcctcagtctgaggatgaggctgactattactgtcagaccgtgggctacgttggttatggttgggtttcggngggacggtacgaaggtcgtcgaccgtcgtaggtcacgcccgaggcctcgccccgtcgg

SEQ ID NO: 275972 - DNA, 679 bp, Homo sapiens
  misc_feature: GYAE6OF02GV5SR.33.67.G01.1.454.CMB.1.raw
  modified_base (253)..(253): a, c, t, g, unknown or other
  misc_feature (253)..(253): n is a, c, g, or t
  modified_base (265)..(265): a, c, t, g, unknown or other
  misc_feature (265)..(265): n is a, c, g, or t
  modified_base (377)..(377): a, c, t, g, unknown or other
  misc_feature (377)..(377): n is a, c, g, or t
  modified_base (414)..(414): a, c, t, g, unknown or other
  misc_feature (414)..(414): n is a, c, g, or t
tcagtacacacactcacgaccggtgctcgatttagagtatacatattgggtttggggggtagctcaggaagcagagcctggagcatctccactatggcctgggctccactacttctcaccctcctcgctcactgcacaggttcttgggccaactttatgctgactcacgccccactctgtgtcggagtcgtccggggaagacggtaaccattctttgcacccacaacagtggcaacattgccagctaatttgngcagtggtaccngcacgcgcccgggcacgttcccccactattgtgatctatcgaggataatacgaaacgtccggtcgtcggggtccctgacgttccggttctccgtcggtcctccagtccgacncgtccttccctaccacttctccgccctaccctcaccncttcctcgtggactagaacgtacgtggaacgggacgacggtccttacgtaaccttacctacgttacgtactaacgtctttaacgtagtacgtaccgggtcccggtaccgggtttacacggttcggtttccgggtaccgtttccgggggacggggtaaccgggaacccgtaacgggtcccgttaaccggtaccccgggttaccgtacggtcccgaaccggtaccccggtaacgggtcccgttacccccggaccccccgttaccggg

SEQ ID NO: 275973 - DNA, 651 bp, Homo sapiens
  misc_feature: GYAE6OF02IE0TO.33.67.G01.1.454.CMB.1.raw
  modified_base (237)..(237): a, c, t, g, unknown or other
  misc_feature (237)..(237): n is a, c, g, or t
  modified_base (265)..(265): a, c, t, g, unknown or other
  misc_feature (265)..(265): n is a, c, g, or t
  modified_base (281)..(281): a, c, t, g, unknown or other
  misc_feature (281)..(281): n is a, c, g, or t
  modified_base (294)..(294): a, c, t, g, unknown or other
  misc_feature (294)..(294): n is a, c, g, or t
  modified_base (333)..(333): a, c, t, g, unknown or other
  misc_feature (333)..(333): n is a, c, g, or t
  modified_base (409)..(409): a, c, t, g, unknown or other
  misc_feature (409)..(409): n is a, c, g, or t
  modified_base (429)..(429): a, c, t, g, unknown or other
  misc_feature (429)..(429): n is a, c, g, or t
tcagtacacacactcacgaccggtgctcgatttagagtatacatattggggtttgggggggtagctcaggaagcagagcctggagcatctccactagtcggccgtcgggctccactacttctccaccctcctcgcctcactcgcacgtacggtttccgttcgggacctaacttttatcgtctcgactcgacgccctctcgtgtcggtcggacgtcgtaccggggaagtacggtaacnttcttcgaccaccacacagtgacaactntcgcagactagtttgngcgtagtcgtacngcacggccggccggactaccgttacccccactattggtntactctagtggaagtaataactacgaacggtccgtcggtcgggtcctgtcgttcggttctcgtcgtctcactcacnctcctcctacctactcctcnccctcctccactctctacgtagacgtacgacgacgaggacggacggtacgcgttacgtactactacgtacgtctagtttacgttacgtacgtacgacggtcggtcgtacgtgttcggtcgggttccggtaccggggacgggaccggtacggtacgtaccggtaccggtacccgttacgtacggcgaccggaccgtaccggtcccgtccccggtcccgtccgg

SEQ ID NO: 275974 - DNA, 635 bp, Homo sapiens
  misc_feature: GYAE6OF02GMSKW.33.67.G01.1.454.CMB.1.raw
  modified_base (313)..(313): a, c, t, g, unknown or other
  misc_feature (313)..(313): n is a, c, g, or t
  modified_base (330)..(330): a, c, t, g, unknown or other
  misc_feature (330)..(330): n is a, c, g, or t
tcagtacacacactcacgaccggtgctcgatttagagtatacatattggggtttggggggtagctcaggaagcagagcctggagcatctccactatggcctgggctccactacttctccaccctcctcgctcactgcactacggttcttcgggcctaactttatgctcgactcacgcccactctgtgtcggacgtcgtcgggaagacggtaacattctttgccaccacaacgacgtggacaactattcgccagctaattttgtgcagtcggtaccagcacggccggccggctaccgttcccccactacttgtnactctatgaggaataanacaaacgtaccgtcgtcggggtcctgtcgtcgttctcgtcgctcatcgacacgcctacctaccaactcgtccgtccctccctacacctacttcctcgtacggtactaacggaacgtacggtaggaacgggacggacgtctacgtaaccttactacgttgtactagttacttagtagtaacgtccggtccggtacggttctaggttcggttcgttccggtcgggacgggaacggtaccgaacggtcgtaccggtacccggtacgttacggacgacgaaccggacggtcccgtcccgtccccgttcg

SEQ ID NO: 275975 - DNA, 619 bp, Homo sapiens
  misc_feature: GYAE6OF02GQKGA.33.67.G01.1.454.CMB.1.raw
  modified_base (252)..(252): a, c, t, g, unknown or other
  misc_feature (252)..(252): n is a, c, g, or t
  modified_base (293)..(293): a, c, t, g, unknown or other
  misc_feature (293)..(293): n is a, c, g, or t
  modified_base (398)..(398): a, c, t, g, unknown or other
  misc_feature (398)..(398): n is a, c, g, or t
tcagtacacacactcacgaccggtgctcgatttagagtatacatattgggtttggggggtagctcaggaagcagagcctggagcatctccactatggcctgggctccactacttctcaccctcctcgctcactgcacaggttcttgggccaactttatgctgactcagccccactctgtgtcggagtctccggggaagacggtaaccatcttttgccaccacaacagtggcaacattcgccagcaattttgngcagtggtaccagcagccgccggcacgttcccccacattgngactctatgaggataatcaaagtccgtcgtcggggtcctgtatcggttctcgtgctcatcgacagcctcctaccaactctcgtcccctccctacacctattcctntcggactaggaaacgcgtaggaacgggtaccgaggtccttcgtaaccttaccttacgtcgtacctaggttcctttaagcgtaacgtcgtccggtacgttcagttcgggtcggttccgttccggggacgggaacggtaaccgacggtccgttaccggccccgtttaccggtaaggttccgaccggtacccgtacgggccttaccccggtcccccgtaccggg

SEQ ID NO: 275976 - DNA, 610 bp, Homo sapiens
  misc_feature: GYAE6OF02GXZA9.33.67.G01.1.454.CMB.1.raw
tcagtacacacactcacgaccggtgctcgatttagagtatacatattgggtttggggggtagctcaggaagcagagcctggagcatctccactatggcctgggctccactacttctcaccctcctcgctcactgcacaggttcttgggccaactttatgctgactcacgccccactctgtgtcggagtcgtccggggaagacggtaaccatcttttgcaccacaacagtggcaacattgccagctaattttgtgcagtggtaccagcagccgcccgggcacgttcccccacattgtgatctatgaggataatacaaagccgtcgtcggggtccctggtattccggttctctcggtctccatccgacacgtcctccctccaactctcgccctccctcacccactcctcgtcggtactaggaacgtacgtaggaacgggacggaggtcgtcgtaaccttactacgttcgtactagttacttagtacgtacgtaccgccggtccgttgtagttcgttcgggttcgttcgggacgggtacgggaccgaaggtccgtacggtacccgtccgttacggaccgacggcccgtaacgggcctccccggtccccgtcgg

SEQ ID NO: 275977 - DNA, 600 bp, Homo sapiens
  misc_feature: GYAE6OF02IDLDE.33.67.G01.1.454.CMB.1.raw
  modified_base (252)..(252): a, c, t, g, unknown or other
  misc_feature (252)..(252): n is a, c, g, or t
  modified_base (277)..(277): a, c, t, g, unknown or other
  misc_feature (277)..(277): n is a, c, g, or t
  modified_base (361)..(361): a, c, t, g, unknown or other
  misc_feature (361)..(361): n is a, c, g, or t
  modified_base (407)..(407): a, c, t, g, unknown or other
  misc_feature (407)..(407): n is a, c, g, or t
tcagtacacacactcacgaccggtgctcgatttagagtatacatattgggtttgggggtagctcaggaagcagagcctggagcatctccactatggcctgggctccactacttctcaccctcctcgctcactgcacaggttcttgggccaacttttatgctgactcagccccactctgtgtcggagtcgtcggggaagacggtaaccatcttttgcacccacaacagtggcaacattgccagcaatttttgngcagtcggtacagcagcgaccgggnagttcccccaccattcgtgatctatggaggatatacaagaccgttgtggggtccctgactggttctcgtcggcctcactcgacngctcctccaactctcgtccctcctacaccatctcgtcgactcgaancgtaggacgtagacggcttaggacctagtacctgtcagttcttaagttgaacttcgccggtcgttacgtacgtggtttcgtcgtttccggggacggtacggggtaacccaagggtccgttcggtaacccgttaccgttacgggtaccctaccggaacccgtaaggggtcccttccggccccccgtttaacggg

SEQ ID NO: 275978 - DNA, 596 bp, Homo sapiens
  misc_feature: GYAE6OF02HET4W.33.67.G01.1.454.CMB.1.raw
  modified_base (223)..(223): a, c, t, g, unknown or other
  misc_feature (223)..(223): n is a, c, g, or t
  modified_base (227)..(227): a, c, t, g, unknown or other
  misc_feature (227)..(227): n is a, c, g, or t
  modified_base (236)..(236): a, c, t, g, unknown or other
  misc_feature (236)..(236): n is a, c, g, or t
  modified_base (371)..(371): a, c, t, g, unknown or other
  misc_feature (371)..(371): n is a, c, g, or t
  modified_base (385)..(385): a, c, t, g, unknown or other
  misc_feature (385)..(385): n is a, c, g, or t
tcagtacacacactcacgaccggtgctcgatttagagtatacatattgggtttggggggtagctcaggaagcagagcctggagcatctccactatggcctgggctccactacttctcaccctcctcgctcactgcacaggttcttgggccaactttatgctgactcagccccactctgtgtcggagtcgtccggggaagacggtaaccattctttgcacccanaacngtggcaacnttgccagctaattttgtgcagtggaccagcagccgcccgggcacgttccccccactattgtgatctagtaggaggaataacgtacaaacgaccgtcgtcgggggtccctggattcggttctctgcctcatcgacngcctccaccactcncgccctccctcacctatctcgtagtctacgagtaccaggtacggacgtaggcgttacgacttactactggttactaggttacttagtagataccgggccgtcggtcaggttcgttgttccgttacggggcggacgggaacccgagtccgtacggtacccgttcgtaggttacccacggtaccggacgtcccgttacccggcccccttccgg

SEQ ID NO: 275979 - DNA, 723 bp, Homo sapiens
  misc_feature: GYAE6OF02JGFTH.33.67.G01.1.454.CMB.1.raw
  modified_base (213)..(213): a, c, t, g, unknown or other
  misc_feature (213)..(213): n is a, c, g, or t
  modified_base (233)..(233): a, c, t, g, unknown or other
  misc_feature (233)..(233): n is a, c, g, or t
  modified_base (262)..(262): a, c, t, g, unknown or other
  misc_feature (262)..(262): n is a, c, g, or t
  modified_base (318)..(318): a, c, t, g, unknown or other
  misc_feature (318)..(318): n is a, c, g, or t
tcagtacacacactcacgaccggtgctcgatttagagtatacatattgggtttggggggtagctcaggaagcagagcctggagcatctccactatggctgggctccactacttctcaccctcctcgctcactgcacaggttcttgggcctaactttatcgtctgactcgacgccccactctgtcgtcggagtcgccggggaagacggtaactnttcgtttgccacctacaacngtcggacactattcgccagcttattttgngctaggtcgtacacgcacgccggcccggctaccgttccccccagtacgttacggtntacgtacttacgtggaacggtaataaaccgtaacgaaaccggtaccccggtcggttacccgggggttaccttacggtcggttaccggtttacctcggtacggtcccgtacgtcgtaccgaacgcgttccctaccgtaacctaactccgtcccggtccccttacccgtccctaacccgtacttccgttacgtacggcgtaaacggtacgcggtaacgacggtacggacggtacttacgaccctttacgcgttacgtacgtcgttaacttagtacggtctacgggtccctagggtaccttcggttcgtacgggtttcgaccgggtcggaacggtccggtacggccgttacggtccctaggtaccgtcggacgacccggtacgtcccggtacccgtcccgttaaccgg

SEQ ID NO: 275980 - DNA, 680 bp, Homo sapiens
  misc_feature: GYAE6OF02IYCAY.33.67.G01.1.454.CMB.1.raw
  modified_base (208)..(208): a, c, t, g, unknown or other
  misc_feature (208)..(208): n is a, c, g, or t
  modified_base (220)..(220): a, c, t, g, unknown or other
  misc_feature (220)..(220): n is a, c, g, or t
tcagtacacacactcacgaccggtgctcgatttagagtatacatattgggtttgggggtagctcaggaagcagagcctggagcatctccactatggcctgggctccactacttctcaccctcctcgctcactgcacaggttcttgggccaactttatcgctgactcagccccactctgtcgtcggagtcgtcgggaagacggtaaccntctttgcaccanaacagtgcaacattcgccagctaattttgtgcaggtcggtaccagcagccgcccgggctaccgttccccccaacctattgtagacttccgtattggacggtataactacgaaaacgcccgttacgtcggggtacccctggtacgttccggttcctcgttcggtcctccgagtccggactacgccttaccctacctaacttccgtccgtcccctccctaccacctacttacctccgtaggaaccttacggaaacgtaccgttaacgggaccgggaaaccgacgggccttaacgtaaccctttaccgttaacgttccgtacgtacgtttaccttaagttcgtattaaccgggccgttcggtactagttcggtcggttacgttcgggacggacggaccgaagtcgtaccgtaccggtaccgtacggctaacgggcccaacggtccgtccccgtccccgtaccg

SEQ ID NO: 275981 - DNA, 694 bp, Homo sapiens
  misc_feature: GYAE6OF01E3F4R.45.14.B03.1.454.CMB.1.raw
tcagacgcgatcgacacgaccggtgctcgatttagtgtgagtagtttgggtttgaggtgaagaagcctggggcctcagtgaaggtctcctgcaaggcttctggatacaccttcaccggctactatatacactgggtgcgacaggcccctggacaagggcttgagtggatgggatggatcaaccctaacaatggtggcacaaactatgcacagaagtttcagggcagggtcaccatgaccagggacacgtccatcagcacagcctacatggagctgagcgaggctgagatctgacgacacggccgtgtattactgtgcgagaggcaggaattacgattttggagtggtattcggacgtagtggacgtcgtggggccaagggaccacgggtcaccgtctcctcgtacgcctaccaccgaacgggcccaacgtccggtcccttccccccgtgggacccctacccgttacccctacccgaacggacgtaccgtaacccgttccggtcgggggggaccctaaccggaaccgggtcccgggtacccccggtcgggggcccgttacgggtaccccgttacggggtacccgtaaacggggtaaccctttaccccggttttacccctacccgggtaaaccgttccccgggtacccgggttttaccctcgggggttaaaccgggcccggggggttaccccgggg

SEQ ID NO: 275982 - DNA, 737 bp, Homo sapiens
  misc_feature: GYAE6OF01DXXF1.45.14.B03.1.454.CMB.1.raw
tcagacgcgatcgacacgaccggtgctcgatttagtgtgagtagtttgggtttgaggtgaagaagcctggggcctcagtgaaggtctcctgcaaggcttctggatacaccttcaccggctactatatacactgggtgcgacaggcccctggacaagggcttgagtggatgggatggatcaaccctaacaatggtggcacaaactatgcacagaagtttcagggcagggtcaccatgaccagggacacgtccatcagcacagcctacatggagctgagcaggctgagtatcgtagacgacgacggccgtgtattactgtgacgaggaggacaaggtaattacggttagttttaggtagttaggtttattacgggtacggtagtcgggtacgttcggtcggggaccgaaacggggtacccgtacgggtaccgtacccgttccgtccccgtacgtaccggtacccctacccgaacccggtaaccggggtacccctaccgttcccgggttaccccgtttcccccccgtcgggtaccccctaccccccgttaccccgttaacccgaaccgtacggtaccccgtaccccggttccgggtaccggggggaccctaaccggaccggtcccgggtaccccggtcgggccgtacggtcccggttacgggtaccgtaaacgggtacccgttaccgtttccccgtacgtacgtccggtccgttacgtcgggtacggtcgggtacccggg

SEQ ID NO: 275983 - DNA, 726 bp, Homo sapiens
  misc_feature: GYAE6OF01CKT15.45.14.B03.1.454.CMB.1.raw
  modified_base (592)..(592): a, c, t, g, unknown or other
  misc_feature (592)..(592): n is a, c, g, or t
  modified_base (683)..(683): a, c, t, g, unknown or other
  misc_feature (683)..(683): n is a, c, g, or t
  modified_base (695)..(695): a, c, t, g, unknown or other
  misc_feature (695)..(695): n is a, c, g, or t
tcagacgcgatcgacacgaccggtgctcgatttagtgtgagtagtttaggggtttagggggagagcaatcacccagcaacccacatcctgtcctctagagaatcccctagagagctccgttccctccacccatggacgtggacctggaggatcctcgttcttggtcggcagactagccgacagggacgcccacctcccgaggtgccagcgtggtcgctacgtcgtggggctggaggtagaagacgcgtgggcctacgagtagaaggtctccgtgacgaggtcttcgtaggtaactacctaccgttaccgacccggtacgtacgtatacgtacgtacgtgggtcgaccgacgtaccggtcccccgtaggaaccgtaaggggtcgtaggacggtagggtacgtcgggtaacgttcggaacgtaacccgtaaacccgtaacgaaacgttccgggtagaacctaacgtaaaccgtacgacggaacctaaacggtaagtttaacgtacggacgggtacgaacgggttacccaacgtacggttacggaaccggtaacgggaccctaacgtacccgaagtcccgaacgtaccacgtacnccgtaacgagtacggcgactaggaccgtcgtacgggcctaaggtacctacgtccgtaaccgcgaaacggtccggtacgtagtacggttcgnggaccggtacgnggtacggagtaacgtacgttgtaggttacgg

SEQ ID NO: 275984 - DNA, 798 bp, Homo sapiens
  misc_feature: GYAE6OF01AHFCO.45.14.B03.1.454.CMB.1.raw
  modified_base (736)..(736): a, c, t, g, unknown or other
  misc_feature (736)..(736): n is a, c, g, or t
tcagacgcgatcgacacgaccggtgctcgatttagtgtgagtagtttggatttgggggagcatcacccagcaaccacatctgtcctctagagaactcccctgagagcttccgttcctcaccatcggactgaccgtggaggatcctcttactggtgcagcagccactaggacgcccactccgaggtcacgagtccgtggtacgactacgtcggtgggctagggaggtggaaacgacgtcccgggtgggtccctagtacggtacggtaccggttcctccggtagacggtaacggtctttcgacgtactaccctaccgttccgaccggtactacgtactaccacgtcgttacggtccgaccgaccggtccgcccggtaaggacgtacggtccgttaggtaggtagaacggtcgggtaacgtacggtaacccttaaccgtaaaacccgttaacggtagggttacgggtaccggaaacccgtaaaaaccgtttaacggtacttaacgggaccgtaaaccggttaaacggtttaccggtttaaacggacccggggttacgggtaacccgggtcctaaaccgtcggtaaccgaacgggtaaccggtacctaacgggtaacctacggtaccgaccgacgtaccgtaaccgtacaacggttacgcgtaagccggtaacgtaccgaggcgtagtacgacgttaccggtacgacggacgacccgtacggtacgttacgtttaaccgnggttacggcccggtaaggtagaccggttacaaacggggtttacttggttaacggtttacggg

SEQ ID NO: 275985 - DNA, 735 bp, Homo sapiens
  misc_feature: GYAE6OF01ES6KE.45.14.B03.1.454.CMB.1.raw
tcagacgcgatcgacacgaccggtgctcgatttagtgtgagtagtttgggtttgaggtgaagaagcctgggggcctcagtgaaggtctcctgcaaggcttctggatacaccttcaccggctactatatacactgggtgcgacaggcccctggacaagggcttggagtggatgggatggatccaaccctaacaatggtggcaacaaactatgacaacgtagaagttttcgaggggacgaggggtccaaccagtcgaaccgagggaccaccgtccatccacgccaacacgaccctaacgagtcggagtctaggagcggacggcgtagacgactcgtacgaccgaccggaccggtcgttagttacgttaccgtggtacgacggaggtacggacgtaaggttaagttaacgtttaggtttttacgggtagttacggtttacggttcggtaacgggttaggtcgggtacggtcggtacggggaccgaacgggtaccgcgggtaccgtaccgttccgtccgtacgcgtaccctacccgaaccgaccggccctccgtcccggttaccccttcccgtcggcccctcccgtaccctaccgaacgaccgtcctacccggtcgggttaccgggcctacggccggcccggtccggtcggtcgtaccggtccgttacggtaaccgaagttacccgttcttacccggcgtacggttcccgtacgttccggaacggtgggtcccgggcgg

SEQ ID NO: 275986 - DNA, 518 bp, Homo sapiens
  misc_feature: GYAE6OF02GJYH7.45.14.B03.1.454.CMB.1.raw
tcagacgcgatcgacacgaccggtgctcgatttagtgtgagtagtttgggtttgaggtgaagaagcctggggcctcagtgaaggtctcctgcaaggcttctggatacaccttcaccggctactatatacactgggtgcgacaggcccctggacaagggcttgagtggatgggatggatcaaccctaacaatggtggcacaaactatgcacagaagtttcagggcagggtcaccatgaccagggacacgtccatcagcacagcctacatggagctgagcaggctgagatctgacgacacggccgtgtattactgtgcgagaggcaggattacgattttggagtggttattcggacggtatggacgtctggggccaagggaccacggtcaccgtctcctcagcctccaccaaggcccatcggtctcccctggccaccctcctccaagacgccacctctggggcacgagcggccctgggctgcctggcaaggctactccgtcgatcgcgtctgagcggtcg

SEQ ID NO: 275987 - DNA, 591 bp, Homo sapiens
  misc_feature: GYAE6OF02I7C8T.45.14.B03.1.454.CMB.1.raw
tcagacgcgatcgacacgaccggtgctcgatttagtgtgagtagtttgggtttgaggtgaagaagcctggggcctcagtgaaggtctcctgcaaggcttctggatacaccttcaccggctactatatacactgggtgcgacaggcccctggacaagggcttgagtggatgggatggatcaaccctaacaatggtggcacaaactatgcacagaagtttcagggcagggtcaccatgaccagggacacgtccatcagcacagcctacatggagctgagcaggctgagatctgacgacacggccgtgtattactgtgcgagaggcaggaattacgtattttggagtggttattcggtacggtatggacgtctggggccaagggaccacgggtcaccgtctcctcacgcctccaccgaacgggcccacgtccggtccttcccccgtcggcccaccctccctcccgaacgacgaccacccgtccgtcgggggccaccgacggcccggtcccgtggggcctcgcccgtcgggtccaacgggtaccttaccgttcccgtcggtacgttccggccgtccgtcggacggcgggtaccgg

SEQ ID NO: 275988 - DNA, 801 bp, Homo sapiens
  misc_feature: GYAE6OF02GJ93J.45.14.B03.1.454.CMB.1.raw
  modified_base (306)..(306): a, c, t, g, unknown or other
  misc_feature (306)..(306): n is a, c, g, or t
  modified_base (325)..(325): a, c, t, g, unknown or other
  misc_feature (325)..(325): n is a, c, g, or t
  modified_base (359)..(359): a, c, t, g, unknown or other
  misc_feature (359)..(359): n is a, c, g, or t
tcagacgcgatcgacacgaccggtgctcgatttagtgtgagtagtttagggtttagggggtgaagaagcctaggggacctcagttcgaaggtctacctagccaagggcttctggatacaccttcaccggctactagtatacgactgggtgtcgactaggcccgtggacaagggcttgagtggatgggactggactcgaaccgtacaagtggtgggcacaaactatggcacagaagttacaagggcaggggtccaccgagtaggtaccacgggacacgtaccgatcaggcgacacgcctacatgganctgacgtcgagcgtgaggncgtagacggaccgacggaccgtaggtacttacgnggtggacgaggaggacacggtaattaccgtagttttcggtaggttaggttacgttacgggaacgtagtcggaacgtcggtaggggtaccgaaggggacccaagggtacgacccgtactacccgttacgaaccggccctaacccgaccgaaacgggccccaacgttacccgggtacccgtttacccccgtacggtaccccgtaaccccgtcccgttacccgaaacgggtaccgaccgtaacccgttcccggttaggggggaccctaaccggtaccgggtacccggggtacccgttaaccgggggcccgttaccgggtcccggtttaccgggttacccgtaaacggggtaaccttaacccggttacccgttaacgtaacccggttaccggttaccggttaccggtttacgggtaacgggtttcccgggtacgttaacccggggg

SEQ ID NO: 275989 - DNA, 667 bp, Homo sapiens
  misc_feature: GYAE6OF02IWGMH.45.14.B03.1.454.CMB.1.raw
tcagacgcgatcgacacgaccggtgctcgatttagtgtgagtagtttgggtttgaggtgaagaagcctggggcctcagtgaaggtctcctgcaaggcttctggatacaccttcaccggctactatatacactgggtgcgacaggcccctggacaagggcttgagtggatgggatggatcaaccctaacaatggtggcacaaactatgcacagaagtttcaggcagggtcaccatgaccaggacacgtccatcagcacagcctacatggagctgagcaggctgagatctagacgacacggccgtgtatactgtgcgagaggcaggaattacgattttggagtggttattcggacggtatggacgtgtgggaccaagggaccgtacggtcgaaccgtcgtcctcgtacgccctccaaccgaacgggtccccaacgttccggtcccgtttacccccgtcgggtaccctaccccgttacccgtacccgtaaacggaccgtaccctacccgtaccgttcggggggaccaaccggtaaccggccggtccccggacggggtaccgtccggtcccgttacgggtaccggtaaaccgggtaccttaacccgtttcccgtaccggtaaccggttcccggtacccggttaccgtaccggtacgggtccgggtcccggg

SEQ ID NO: 275990 - DNA, 532 bp, Homo sapiens
  misc_feature: GYAE6OF02GL8K7.45.14.B03.1.454.CMB.1.raw
  modified_base (360)..(360): a, c, t, g, unknown or other
  misc_feature (360)..(360): n is a, c, g, or t
  modified_base (373)..(373): a, c, t, g, unknown or other
  misc_feature (373)..(373): n is a, c, g, or t
  modified_base (408)..(408): a, c, t, g, unknown or other
  misc_feature (408)..(408): n is a, c, g, or t
  modified_base (442)..(442): a, c, t, g, unknown or other
  misc_feature (442)..(442): n is a, c, g, or t
  modified_base (446)..(446): a, c, t, g, unknown or other
  misc_feature (446)..(446): n is a, c, g, or t
  modified_base (456)..(456): a, c, t, g, unknown or other
  misc_feature (456)..(456): n is a, c, g, or t
  modified_base (460)..(460): a, c, t, g, unknown or other
  misc_feature (460)..(460): n is a, c, g, or t
tcagacgcgatcgacacgaccggtgctcgatttagtgtgagtagtttgggtttgaggtgaagaagcctggggcctcagtgaaggtctcctgcaaggcttctggatacaccttcaccggctactatatacactgggtgcgccaggcccccggacaagggcttgagtggatgggatggatcaacgctggcactggttacacagaatattcacagaaattccaggacagagtcaccatttctagggacatattcgcgaacacagcctacatggacctgagcagtttgagatctgacgacacggctgtctattactgtgcgagagacgggggggaggatagttgcactaaatgattatactgtntgcctatgggttnagctcgtgggccagggaccctggtcaccgtctccnacgcctcaccagggcccagtccgtccttccccgngccncctgcctcgngacnccaccgcgagcgcacgcggccggtccgtgggcctcgccgttcggacgtaacggtccttaccgttccgagtcg

SEQ ID NO: 275991 - DNA, 647 bp, Homo sapiens
  misc_feature: GYAE6OF02IQD9B.45.14.B03.1.454.CMB.1.raw
  modified_base (192)..(192): a, c, t, g, unknown or other
  misc_feature (192)..(192): n is a, c, g, or t
  modified_base (253)..(253): a, c, t, g, unknown or other
  misc_feature (253)..(253): n is a, c, g, or t
  modified_base (271)..(271): a, c, t, g, unknown or other
  misc_feature (271)..(271): n is a, c, g, or t
  modified_base (287)..(287): a, c, t, g, unknown or other
  misc_feature (287)..(287): n is a, c, g, or t
  modified_base (317)..(317): a, c, t, g, unknown or other
  misc_feature (317)..(317): n is a, c, g, or t
  modified_base (441)..(441): a, c, t, g, unknown or other
  misc_feature (441)..(441): n is a, c, g, or t
  modified_base (608)..(608): a, c, t, g, unknown or other
  misc_feature (608)..(608): n is a, c, g, or t
  modified_base (616)..(616): a, c, t, g, unknown or other
  misc_feature (616)..(616): n is a, c, g, or t
tcagacgcgatcgacacgaccggtgctcgatttagtgtgagtagtttgggtttgaggtgaagaagcctggggcctcagtgaaggtctcctgcaaggcttctggatacaccttcaccggctactatatacactgggtgcgacacggcccctggacaagggtcttgagtggatggggatggactcaaccctaanagtggcggacaactaaactagtgcacagagttcgaggctaggcacagtcgacgaggtaacncgtcacgtcacgctaacncgctaacgagtcggancgtcgacggcgtacggctagagtctaccgngacgcgacggtccgtataactgtcgtcgacgagacggtcgaaggttaaactgttaacggttgagggttgtttaagggtaccgaggttacgtagggcttccgggagggtacgaacgggtaccggngttaacccgtcggtctcttaacggctccggacctaacgcgggcctacggtctcccgtaccgtcgacccacgtccgactaacggccctcgaaccgtcggggaccggtcgaaccgtccgggaccggtccgtacgggtcgaccggtcgacggtaccggatccgttaaccncggttacnggtacccgtgtaccgacggtcggccggtacg

SEQ ID NO: 275992 - DNA, 474 bp, Homo sapiens
  misc_feature: GYAE6OF01BXKWT.44.85.H08.1.454.CMB.1.raw
  modified_base (197)..(197): a, c, t, g, unknown or other
  misc_feature (197)..(197): n is a, c, g, or t
tcagacagtatatacacgaccggtgctcgatttagtatcactcagtcgcgggggcagaagtctctctcagtcaggacacagcatggacatgagggtccctgctcagctcctgggactcctgctgctctggctcccagataccagatgtgacatccagatgacccagtctccatcctccctgtctgcatctgtggganacagagtcaccatcacttgccgggcgagtcagggcattagcaattatttagcctggtatcagcagaaaccagggaaagctcctaagctcctgatctatgaaacatccattttgcaatcagggtcccatctcggttcagcgcagtgatcgtgggacagattcactctcacgtcagcagcctgcagcctgaagtatgttgactaacttattactgtacaaagtacaacagtcgaccctagacctacttcggccctggaccaagtgatatacaaagctag

SEQ ID NO: 275993 - DNA, 554 bp, Homo sapiens
  misc_feature: GYAE6OF01AZ71R.44.85.H08.1.454.CMB.1.raw
  modified_base (275)..(275): a, c, t, g, unknown or other
  misc_feature (275)..(275): n is a, c, g, or t
  modified_base (464)..(464): a, c, t, g, unknown or other
  misc_feature (464)..(464): n is a, c, g, or t
  modified_base (518)..(518): a, c, t, g, unknown or other
  misc_feature (518)..(518): n is a, c, g, or t
tcagacagtatatacacgaccggtgctcgatttagtatcactcagtcgcgggggcagaagtctctctcagtcaggacacagcatggacatgagggtccctgctcagctcctgggactcctgctgctctggctcccaggttcgagatgtgacatcgagatgaccaagtctccttccttcctgtcttcttctgttggaggcagcgtcaccatcacttgccgggcgagtcaggttcgttttcggtgtctgttgccttggtttcaaacgaaaagggggngacggccctaaggtcctcgtctctcgtagaaaccagactggaaggtagacgtcccgtcgaggttcagtgccagtccgagggtggtgggccggagtccactcctcacctattacgcgtacctggccggcctaggaacgtattctgactaactttatttctgtcagctagtatcatacgtcgtccccgttntacgtttggccgtaaggggaccaaggtctaggaactacaaacgtactggcgtcngcacctattcgtagtccttacacttccgttcccgac

SEQ ID NO: 275994 - DNA, 640 bp, Homo sapiens
  misc_feature: GYAE6OF01DGRCV.44.85.H08.1.454.CMB.1.raw
tcagacagtatatacacgaccggtgctcgatttagtatcactcagtcgcgggggctgtgggctcagaagcagagttctggggtgtctccaccatggcctggacccctctctggctcactctcctcactctttgcataggttctgtggtttcttctgagctgactcaggaccctgctgtgtctgtggccttgggacagacagtcaggatcacatgaccaaggagacagcctacaagaagctattatgacaagctggtaccagcagaagccaggacaggcccctgtacttgtcatctatgaactaaaaaccaaccggccctacgaagggactacccgagaccgtattctcgtggcctccagcctacgaaggaaacacagtcctttccttagacccatcacgtcggggctcgaacgggtacggaagtagtaggacggctagtaaccttagtttaccgtacgttaaccgtaccccggggaactaaaccgtagggtacggttaaacccgtaggtttacggggttcggttacggggaccgggtaacggggaccaacggtcgtacggtaaccccgttacggtaacgggtacccgaacggaccccgtaacgggccgttcccggaccccccgttcgggtccctacccgg

SEQ ID NO: 275995 - DNA, 521 bp, Homo sapiens
  misc_feature: GYAE6OF01CTGUR.44.85.H08.1.454.CMB.1.raw
  modified_base (303)..(303): a, c, t, g, unknown or other
  misc_feature (303)..(303): n is a, c, g, or t
  modified_base (340)..(340): a, c, t, g, unknown or other
  misc_feature (340)..(340): n is a, c, g, or t
  modified_base (429)..(429): a, c, t, g, unknown or other
  misc_feature (429)..(429): n is a, c, g, or t
tcagacagtatatacacgaccggtgctcgatttagtatcactcagtcgcgggggggagaggagcccagcactagaagtcggcggtgtttccattcggtgatcagcactgaacacagaggactcaccatggagtttgggctgagctgggttttcctcgttgctcttttaagaggtgtccagtgtcaggtgcagctgggtggagtcgtggggggaggcgtggtccagccgtggggaggtccctgagactctcctgtgcagcgtctggattccaccttcagtacctatggcatgcacgtgggtccncaggctccgaggcaaggggctggagtgggtgcattanagtggtatgatggaaagtaataaatctatgacagactcgtgaacgggctattcacctatctccagacgaacaattccaaagtaacacgntgtatctagacaaatgaacacgctgacgacgcgaggacacggctagtgtacgttactggtcgacgagactatattgtacgtctaccgtaccg

SEQ ID NO: 275996 - DNA, 520 bp, Homo sapiens
  misc_feature: GYAE6OF01AX8CZ.44.85.H08.1.454.CMB.1.raw
  modified_base (295)..(295): a, c, t, g, unknown or other
  misc_feature (295)..(295): n is a, c, g, or t
  modified_base (474)..(474): a, c, t, g, unknown or other
  misc_feature (474)..(474): n is a, c, g, or t
tcagacagtatatacacgaccggtgctcgatttagtatcactcagtcgcggggggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccagcctgggagtccctgagactctcctgtgcagcgtctggattcaccttcagtacctatggcatgcacgtgggtccncaggctccgaggcaagggctggagtgggtgcattatagtggtatgatggaaataataaatactatgcagactcgtagaacgggccattcaccatctacagagactaatccaagacacgctgtatctagacaaatcgaacagcctagacgagccgaggacacggctagtacgtattacgnggtgacgtaggtaacctagttagttagtaacgtacctaccgtaccg

SEQ ID NO: 275997 - DNA, 522 bp, Homo sapiens
  misc_feature: GYAE6OF01BNVA7.44.85.H08.1.454.CMB.1.raw
  modified_base (406)..(406): a, c, t, g, unknown or other
  misc_feature (406)..(406): n is a, c, g, or t
tcagacagtatatacacgaccggtgctcgatttagtatcactcagtcgcgggggggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggaggcgtggtccagcctgggaggtccctgagactctcctgtgcagcgtctggattcaccttcagtacctatggcatgcacgtgggtccgccaggcctccgaggcgaaggggctgggagtgggtggctattatatggtatgataggaataataaatactatgcagactcggtagacgggccgattcaccatctcaganacaattccaagacacgctgtatctgacaatagaacagcctagagacgcgaaggacacggctggtagtacttagtggtcgacgaggactattacgttagtacgtacctaccgtaccg

SEQ ID NO: 275998 - DNA, 580 bp, Homo sapiens
  misc_feature: GYAE6OF01AGN7M.44.85.H08.1.454.CMB.1.raw
  modified_base (419)..(419): a, c, t, g, unknown or other
  misc_feature (419)..(419): n is a, c, g, or t
tcagacagtatatacacgaccggtgctcgatttagtatcactcagtcgcgggggctgtgggctcagaagcagagttctggggtgtctccaccatggcctggacccctctctggctcactctcctcactctttgcataggttctgtggtttcttctgagctgactcaggaccctgctgtgtctgtggccttgggacagacagtcaggatcacatgccaaggagacagcctcagaagctattatgcaagctggtaccagcagaagccaggacaggcccctgtacttgtcatctatagaactaaaaacaccggccctcgacgggtccctgaccgtattctctggcctccaagtctggccacctcacgtccctccctcggccatccacgtcgggcctcccgaggctagaagacgtggagggtntatttacttactcgacctagttcctatcgactacgctacgccttcgagggttgggttgggtcggttccggggacgggtacggggtacccgaaggtccgttacgggtaccccgttccggtcggggttacccacgggccccgtaagggcccgttacccccggg

SEQ ID NO: 275999 - DNA, 605 bp, Homo sapiens
  misc_feature: GYAE6OF01BIGI6.44.85.H08.1.454.CMB.1.raw
  modified_base (303)..(303): a, c, t, g, unknown or other
  misc_feature (303)..(303): n is a, c, g, or t
tcagacagtatatacacgaccggtgctcgatttagtatcactcagtcgcgggggggagaggagcccagcactagaagtcggcggtgtttccattcggtgatcagcactgaacacagaggactcaccatggagtttgggctgagcttgggttttcctcgttgcttcttttaagaggtgtccagtgtcaggtgcagctgggtggagtcgtgggggagcgtggccagcctaggaggtccctgagactctcctgtgcagcgtctggattcaccttcagtacctatcggcagtgcacgttcgggtccnccgaggtcctccgaggccgaaggggctgggaggttgggtggactaacttagtagtggtatggaactagggaaaatttaaataaacgtactagtacgacgaggtaaccttccgggtaggaacgggtaccgtattccaacctacttccaccgaagaacgaactaacgttaccgaaacgtaacacgtctagtaatcagtaacaactagaaccacgactaggagacgacgacggaccgacggtctaggtcgtaacttacggtggtgacggtagacttaagtagtttagtacgtaacctccgtaacg

SEQ ID NO: 276000 - DNA, 571 bp, Homo sapiens
  misc_feature: GYAE6OF01EKRJN.44.85.H08.1.454.CMB.1.raw
  modified_base (295)..(295): a, c, t, g, unknown or other
  misc_feature (295)..(295): n is a, c, g, or t
tcagacagtatatacacgaccggtgctcgatttagtatcactcagtcgcgggggggagaggagcccagcactagaagtcggcggtgtttccattcggtgatcagcactgaacacagaggactcaccatggagtttgggctgagcgtggttttcctcgttagctctttaagaggtgtcagtgtcaggtgcagctggtggagtcgtgggggagcgtggtccagcctgggagtccctgagactctcctgtgcagcgtctggattcaccttcagtacctatggcatgcacgtgggtccnccaggcctccgaggcaaggggctgggagtgggtgctacttatagtggtatggatagggaaataaataaagtctaagtgacaagtaccttccggtagaacgggccgtattccacctactactccaagacgaactaattaccaaagaacacgctagtatctagacaaatacgaacagtacctagacgagaccggaaggacgacggctggtacgttaactttacgtaggtcggacggaaggtacgtaagttaattagtaacgttacctacccgtacccg

SEQ ID NO: 276001 - DNA, 727 bp, Homo sapiens
  misc_feature: GYAE6OF01DHXQM.44.85.H08.1.454.CMB.1.raw
tcagacagtatatacacgaccggtgctcgatttagtatcactcagtcgcgggggcagaagtctctctcagtcaggacacagcatggacatgagggtccctgctcagcctccgtggactcctgctgctctggctccagtataccagatgtgacatccagatcgacccagtcctccactccctcctgtctgctatcgtggtggatacagacgtccaccatcctacgttggccgggtcgagtcgaggctagttagtacttaatttatttacgtccgtaggtaactcgaacggaccgaaacggaaaaccggaagggtaaacgtacctaccgtaacgtacccttaccgtagtactactaacgtaactaaactacttacgttattttacgacgtaacgtaccggtaccggttccctagttccgtacggtcgacggacggtacgtaggtgtacgtcggtacggtaacgtagttactttacacttcgttaccaaccggttacgacgtaccgacgtacccgtagacccgtacgtaccgttagaagttcgttacgttacgttaacttaacgtttacttaaaccgtaacgtttaaactaacgtttaaaccgtaacgttaccgtaccccgtaacccttaccgttaaacccggtttacccggtttaccccggaccccggtttaccgggaacctaaccgggttaagtaacggtaacgttaacgtaaccgtaacggtaaccg

SEQ ID NO: 276002 - DNA, 682 bp, Homo sapiens
  misc_feature: GYAE6OF01DV8AS.44.85.H08.1.454.CMB.1.raw
  modified_base (295)..(295): a, c, t, g, unknown or other
  misc_feature (295)..(295): n is a, c, g, or t
tcagacagtatatacacgaccggtgctcgatttagtatcactcagtcgcggggggagaggagcccagcactagaagtcggcggtgtttccattcggtgatcagcactgaacacagaggactcaccatggagtttgggctgagctgggttttcctcgttgcttcttttaagaggtgtccagtgtcaggtgcagctggtggagtcgtgggggagcgtggtccagcctgggagtcctgagactctcctgtgcagcgtctggattcaccttcagtacctatggcatgcacgtgggtccncaggcctccgaggcaagggggctagggaggtgggtggctacgtttaagtagttggtaatggaatagggtaaaagttaaacttaaaagtactaagtcgactaaaggtaccttccgggtaggaaacggggtccgtaatttaccgaaccctaagtcccttacccgaagtaacgaaacctaaacgtttaacccaaaggtaaacccaacggtaccttagtaacttactacggaacctaaaagttcggaaacacggtacccgtaggaacgaacggacccggaacggaaccgtacgggtaccttaggttacgttaacgtttacgtcggttacggaccggtaaagggtaacctaaagttagtttaggttaacgttaacccgtaaccgtaacccgg

SEQ ID NO: 276003 - DNA, 687 bp, Homo sapiens
  misc_feature: GYAE6OF01C2480.44.85.H08.1.454.CMB.1.raw
tcagacagtatatacacgaccggtgctcgatttagtatcactcagtcgcgggggggagaggagcccagcactagaagtcggcggtgtttccattcggtgatcagcactgaacacagaggactcaccatggagtttgggctgagctgggttttcctcgttgctcttttaagaggtgtccagtgtcaggtgcagctgggtggagtcgtggggggagcgtggtccagcctggggagtccctgagactctcctgtgcagcgtctggattcaccttcagtacctatggcatgcacgtcgggtcccgcgaggcctccgaggcgaaggggctgggaggtgggtgctacgttatagtggtaatggtagtagggtaaagttaaattaaaacgtacttaagtggacaaacggtaccgttacccgggtaggtaacggggacccgtaacttacccgaacccgtacttccgtaacccgaaggtaacgtaaacctaacgttacccgaaacgtaaaccgaccgtacttacgttaactccgttagaactaaagtacgaaaccgtacgtaccgtaggacggaacggaccggaaggacccgaacgggtcgttagggttacgttacgtttaccgttaggttacggacggtaaaggtaacgttaagttaacgttaggttaaacgttacccgttaacccgtaacccgg

SEQ ID NO: 276004 - DNA, 583 bp, Homo sapiens
  misc_feature: GYAE6OF01CTJV7.44.85.H08.1.454.CMB.1.raw
  modified_base (278)..(278): a, c, t, g, unknown or other
  misc_feature (278)..(278): n is a, c, g, or t
  modified_base (287)..(287): a, c, t, g, unknown or other
  misc_feature (287)..(287): n is a, c, g, or t
  modified_base (309)..(309): a, c, t, g, unknown or other
  misc_feature (309)..(309): n is a, c, g, or t
  modified_base (458)..(458): a, c, t, g, unknown or other
  misc_feature (458)..(458): n is a, c, g, or t
  modified_base (464)..(464): a, c, t, g, unknown or other
  misc_feature (464)..(464): n is a, c, g, or t
tcagacagtatatacacgaccggtgctcgatttagtatcactcagtcgcgggggggagaggagcccagcactagaagtcggcggtgtttccattcggtgatcagcactgaacacagaggactcaccatggagtttgggctgagcttgggttttcctcgttgctcttttaagaggtgtccagtgtcaggtgcagctggtggagtcgtgggggaggcgtggtccaggccgtggggacggtccctgagacttctcctgtgcagcgtctggattccaccttnacgtacctntggcatgcacgtcggggtcccnccgaggcctccgaaggccgaaggggctagggaggttgggtgctagttagtagtggtatgagtaggtaaagtaattaaatactatcgacaaggtcttcggagaacgggcctatccacctatcctacgagacaacattaccaaagacacgntagtanctagactaaagtcgaacgcgtacgtagagacgcggaacgaccgacggtcgttgtagtttacgtacgttagggcgacgggtagtactagttacgttaggtaactacccgtacccgtacgg

SEQ ID NO: 276005 - DNA, 614 bp, Homo sapiens
  misc_feature: GYAE6OF01D9PSY.44.85.H08.1.454.CMB.1.raw
  modified_base (340)..(340): a, c, t, g, unknown or other
  misc_feature (340)..(340): n is a, c, g, or t
  modified_base (348)..(348): a, c, t, g, unknown or other
  misc_feature (348)..(348): n is a, c, g, or t
tcagacagtatatacacgaccggtgctcgatttagtatcactcagtcgcggggggggagaggagcccagcactagaagtcggcggtgtttccattcggtgatcagcactgaacacagaggactcaccatggagtttgggctgagctgggttttcctcgttgctctttttaagaggtgtccagtgtcaggtgcagctgggtggagtcgtggggggagcgtggtccagccgtgggaggtccctgagacctctcctgtgcagtcgtctggacttccaccttcagtacctatggcatgctacgtgggtcccgcaggcctcgaggcgaaggggctgggagtgggngctattanagtggatgataggaaagttaaataaatctatgacaagtaccgtcggtaggacgggccgtacttccaacctatccctacgagaacgaactaactaccgaaagaactacgtacttgtactcgtagaactaaagttacgaaacgacgtaccgtaggaacgtacggacccgggaacggaaccgtacggtcgttaggtagttaacgtttacgtggttacgacggaggtaactaagtttacgttaggttaaaccgttcctacccgtaaccgg

SEQ ID NO: 276006 - DNA, 953 bp, Homo sapiens
  misc_feature: GYAE6OF01CXBDD.44.85.H08.1.454.CMB.1.raw
  modified_base (914)..(914): a, c, t, g, unknown or other
  misc_feature (914)..(914): n is a, c, g, or t
tcagacagtatatacacgaccggtgctcgatttagtatcactcagtcgcggggagctctgggagaggagcccagcactagaagtcggcggtgtttccgattcggtgatcagcactgaacacaggaggactcaccagtgggtagtttgggcttggacgtcgttcggggtttttccctcggtttggtcctttacgtttttaaaggacgggtttcgtacccgtaggttcggtaccgtacgggttcgaccgtaggtccgttaggggtacgggtacggtttccgggtagggggggacgtccgggttcgggttacccgagggtcccggtggggtaccggttccccgtaggaccggtaccgttcctccggtggtcgccgtaacggtccggtcgtagggtacctttccgaaccgtttcaacggttacccgtaggtcggtacctaaggtttccggacgtacccgggtttcggggtacccctacccggtaacgggtcctttaccccgggaaaggggtaccgggtaaacggggggtcccttaggggggaacgggttcggggtaccgttacgttaacgtttaaggtacggtaggtttacgacggttaacggtaagggttaaaacttaacgttaaaacgtacggttagtacggaacccgttaacggtaacccggtttaacgggttaaccgggtaaaccgggttaccccgttaaaccgtttaacccgtacccgtaaacggtttccccgaacgtaaccgggtaactaaacccgttaaaccgtaaccgtaaacgtaccgttacgttaacgttacgtaacttaccgtagtaaaccgtaagttaccggaaactttccccgaggtaacggaaccggttacgggacccgtaagggtacccgtaaacgggttctaggtttaccgacgtttaccgngggtaaccgtgtaagtaccttaggttaccgttaaacggg

SEQ ID NO: 276007 - DNA, 792 bp, Homo sapiens
  misc_feature: GYAE6OF01A669B.44.85.H08.1.454.CMB.1.raw
  modified_base (227)..(227): a, c, t, g, unknown or other
  misc_feature (227)..(227): n is a, c, g, or t
  modified_base (243)..(243): a, c, t, g, unknown or other
  misc_feature (243)..(243): n is a, c, g, or t
tcagacagtatatacacgaccggtgctcgatttagtatcactcaggtcgggcggggcagaagtctctctcagtcgaggacacagcatggacatgagggtccctgctcagctcctgggactcctgctgctcgtggctcccagactaccagatgtgacatccagatgacccagtcctccatcctcctgtctgcatctgtagggacagagtccacatcacttgccggganaagtcaggcataaacngtcgcttggcctggtatcaagacaacgaaaccgagggaaactcctagaactccgtagactctatgagtcgtaccttaccgtaaggttttaggaaacgttcgggtaacgttcccctaaagttaccgtaaagggtttccgaacggtaccggggtaccgtaacgggttcgggtaacgttaccggtacgggggtaaccttaaggttaacgtttttacccaaccgttcccggttacccgtaaccccggttaccgaacgggaccgtaaccggtcccgttaacggtaccgtaaccggtacccgtacggtaaacgttattacgggtttaacgtaacgtttaaaccgtttaacgtttaaccgtttaagggttaaaccgttaaaaaggtttaaccgttaaaccggttaacgggttacccggtaacccccgttaacgtaaacccgttacccggttttacccggggtaccccgttaacgggggtaacccctaaccgggtaggttaaccgggtaacttaaccgtaccggtaaaccggtacccggttaaaccgtttcccgggg

SEQ ID NO: 276008 - DNA, 826 bp, Homo sapiens
  misc_feature: GYAE6OF01AFGEU.44.85.H08.1.454.CMB.1.raw
tcagacagtatatacacgaccggtgctcgatttagtatcactcagtcggcgggggggagaggagcccagcactagaagtcggcggtgtttccattcggtgatcagcactgaacacagaggactcaccagtggagtttgggctgagtcgttgggttttcctcgttgcttacgttttaaggaggtgtccaggtgtcgaggtgcaggtcgtgggtggaggtcggtggggggaggtccggttggtccaggtccgtaggggaccggtccctggacgtccttcgtccgtggtcgccgtaggtccgttcgtaggtactttaccctacccgtttacgaacgttacccgttagtcgggtaccaagttcggaccctaccggttccgggggtaccccgacccgacggtcctaccggacggggtaccggaaaggggggtccgttagggggacgggttggggtacggaccttaacgtttagttaaggtggttaagtacgtaaggttaaggtaaaagttaaaacttaaacgttaacgttagtacgaccgtaacggtaccgttaccgggtaagggaaccggggtaccctaaccgttacccgaacccctacgttacccgtaacgaacggtaaccgtaaacttaaaccgtaccccgaaagtaacccgtacgtacgttaacgtcgttacgacgtaaacgtaacgaaccgtaaccgcggtacccgtaggtacggaaccggaccgggaacgtaccggcgttagttagttacgttagtaccggtaggcggtaaggtacttaacgttaacgtttcgttaacggtaacccttccgtaaccgttaccggg

SEQ ID NO: 276009 - DNA, 800 bp, Homo sapiens
  misc_feature: GYAE6OF01D23B5.44.85.H08.1.454.CMB.1.raw
tcagacagtatatacacgaccggtgctcgatttagtatcactcagtcgcgggggggagaggagcccagcactagaagtcggcggtgtttccattcggtgatcagcactgaacacagaggactcaccatgggagtttgggctgagcgttgggttttcctcgttgcttcttttaaggaggtgtccagtgtcaggtgcagctggtggagtcgtgggggagcgtggtccaggccgtgggacgtcctgagctctcctgtgcagcgtctggacttcctaccttcacgtacctagtcggctagtcgaccgtacggttcggggtccccgaccgacgggtccctaccggaagggaccggtaagggggtcgtaggggtaacgggttggggtcggacctaacgtttagtagtggttataggtaagtaagggtaaaattaaataaattacgtagttacggactaacggtaaccgtccgggtaagggaaaccggggtccgtaacttacccgaacctacgttacccttaaccggaaaggtaaaccgtaaaccgttaaaccttaaccccgaaaacggtaaacccgtaaccggtaccgtttaagttaacgttaccgtaacgaaactaaaacgttacgaaaccgtacggtacccggtaacgggaaacgaacccgggaccggaaacggacccgtacgggtaccgttagggttacgtttaaacgttacggttacgggtacgggtaccgggtaaacgggtaactttaacgggtttaacgtttaaaccggttaaccgttaaacccctaacccggttaccgg

SEQ ID NO: 276010 - DNA, 770 bp, Homo sapiens
  misc_feature: GYAE6OF01ETTIA.44.85.H08.1.454.CMB.1.raw
  modified_base (230)..(230): a, c, t, g, unknown or other
  misc_feature (230)..(230): n is a, c, g, or t
tcagacagtatatacacgaccggtgctcgatttagtatcactcagtcgcgggggctgtgggctcagaagcagagttctggggtgtctccaccatggcctggacccctctctggctcactctcctcactctttgcataggttctgtggtttcttctgagctgactcaggaccctgctgtgtctgtggccttgggacagacagtcaggatcacatgccaaggagacagcctnagaagctatactgacaagctggtaccagcaagaacgccaggacacggcccctgttacttgctatctatagaaactaaaaaccgaccggaccctacgaacggggacctacccgaacggtaaccgtaacgtttcctccgtcggaccttacccgacggtcctaccgaaacggaaaaccaccgtacgtcctttaccttacgaccctactccgaacgtcggggtccctacggagggtacggaaagagtacgggacggtctacggtaacttacgtttaaccgtacggtaacccggtacccgggaactaaaccggtaggttaaccgggttaaaccgttacgggtttacgggggttacgggtttacccggggacgggggtaaaccggggtaaacccgtaaacgggtcccggtttacccggggtaaacccccggtttcccgggttaaaccggggttacccggaaacccggtaaccccccggtaaacggggtacccccgtttccccggggtacccccccccgtttcggggtacccctttaaccccccggg

SEQ ID NO: 276011 - DNA, 768 bp, Homo sapiens
  misc_feature: GYAE6OF01CAGK9.44.85.H08.1.454.CMB.1.raw
tcagacagtatatacacgaccggtgctcgatttagtatcactcagtcgcgggggctgtgggctcagaagcagagttctggggtgtctccaccatggcctcggacccctctctggctcactctcctcactctttgcataggttctgtggtttcttctgagctgactcaggaccctgctgtgtctgtggccttgggacagacagtcaggatcacatcgaccaaggacacagcctacgaagaagcttattatgacaagcgtaggtaaccagacgaagaacgacgaggaccacggtccctgtactgtacatctatacgaaactaaaacgacccgcctacgacggactacccgaacgtaccgtacttcgtacgtacggacctccgtaacgacgtaaccgaaacggaaacctaaccgtacgttacctttacccgttaaccgaacctacgtaccgtaaccggttcggggtacctacggaacgggaaccggtaaaggaacgttcggaacggtaccgttacgtaacgtttaacgtacgttaaccggtaaacccggtaccccgggaaactaaccggttaaacgggttaccgggtaaaccgttaggggttttaccggggtacgggttacccggggaacgggggaacccggtaaaccgtaacgggtccccggttacgggtaaacccccgttacccgggttacgggttacccgaacccgggtaacccgtacccgggggttccctaccccgggtaccccccgtttcgggaccctttaccccg

SEQ ID NO: 276012 - DNA, 776 bp, Homo sapiens
  misc_feature: GYAE6OF01CXN9D.44.85.H08.1.454.CMB.1.raw
  modified_base (354)..(354): a, c, t, g, unknown or other
  misc_feature (354)..(354): n is a, c, g, or t
  modified_base (731)..(731): a, c, t, g, unknown or other
  misc_feature (731)..(731): n is a, c, g, or t
tcagacagtatatacacgaccggtgctcgatttagtatcactcagtcgcggggggggagaggagcccagcactagaagtcggcggtgttccattcggtgatcagcactgaacacagaggactcaccatggagtttgggctgagtcgttgggttttcctcggtttgtcttactttttaaggaggttcgtcctagtgtcgaggtgcaggtcgtgggtggaggtcgggtgggggaggcgtcggtccacggccgtggggacggtccctggacgtactctccgtggtcgcagtcgtctggacttccacctttacaacgttacctagtcggacagtcgaccgtacggtcgggggtacccnccggacggccctaccggaaggggaccggaagggggtcgtaggggagggttcggggtcgacgttaactttaggtagttaggttaataggtaaggttaacggtaaaagttaaaattaaacgtacttaagcgtacgtaacggtccgttacggtagggtaacgggacctaacttccaaccgtacttacccgaaccgtaagtaaacgtaaaccttaacgtacccgaaacgaaccgtaccgtcttaacggttaacttccgaacgtaacgaaacttacgaaaccgtacgtaccgtaggaaccgggaaccggccggaaacggaacccgtagggtccggttaagttacggtttaacgttaccggttgggtaaccgacggggtaaanaacgttacgttaagtttccggtaaacgtacccttacccgtaacgg

SEQ ID NO: 276013 - DNA, 775 bp, Homo sapiens
  misc_feature: GYAE6OF01CQHLV.44.85.H08.1.454.CMB.1.raw
  modified_base (317)..(317): a, c, t, g, unknown or other
  misc_feature (317)..(317): n is a, c, g, or t
tcagacagtatatacacgaccggtgctcgatttagtatcactcagtcgcggggagctctgggagaggagcccagcactagaagtcggcggtgtttccattcggtgatcagcactgaacacagaggactcaccatggagtttgggctgagcttgggttttcctcgttgcttcttttaagaggtgtccagtgtcaggtgcagctggtggagtcgtggggagcgtggtccagccgtgggagtccctgacgactctcctgtgcagcgtctggacttccaccttcaacgttacctagtggcagtcgctacgtcggggtcccnccgagggtcctaccggagggaccgaaagggggtcttaggggacggttggggtcgtcctaacgtttaatagtggtaatggtaataggaaaattaaataaaattacgtaagtcgactaacggtaccgttaccggtaggaacggggtacctaacgttacccgaaccgtaacgttcccgttaaccgaaaggtaaccgtaaacctaaacgttaaccccaaaacggaaacccgtaaccggtaccgtttaagttaaccgttaccgtaacggtaaacgtaaaacgttacggaaaaccctagggtacccgttaaacggaacggtaaccgggaacccgggtaaacggggaacccggtaaccgggttccgtttaacgggtttaaacggttaaacctttaaccgggtaccggtttaacgggaacgggaaaaccggttaaccgttaaaggtttaaacggttttaaaccggg

SEQ ID NO: 276014 - DNA, 829 bp, Homo sapiens
  misc_feature: GYAE6OF01CX8X4.44.85.H08.1.454.CMB.1.raw
  modified_base (172)..(172): a, c, t, g, unknown or other
  misc_feature (172)..(172): n is a, c, g, or t
  modified_base (190)..(190): a, c, t, g, unknown or other
  misc_feature (190)..(190): n is a, c, g, or t
  modified_base (450)..(450): a, c, t, g, unknown or other
  misc_feature (450)..(450): n is a, c, g, or t
tcagacagtatatacacgaccggtgctcgatttagtatcactcagtcgcgggggggagaggagcccagcactagaagtcggcggtgtttccattcggtgatcagcactgaacacagaggactcaccatggtagtttgggctgagtctgggttttcctgttgctactttaagnggtgtccagtgtcaggtncagctggtggtagtcgtgggggagcgtggtccaggcctggggacgtccctagacgactctcctggtacgcgagtccgtcgtggacttccaccttcgaacgttcggaacctaacctaatacgtggtaaccgtcggggtacccgacccgacggtccgtacccggaagggggaacgggtcggtagggtaacggttcggtccggttgggaccgtaacgtaaaacgtaaaaaaacgtaaggttaccgaccgtaagtacctttaanacctaacgaacggtaacggtaccgtacccgtacggttccgtaaggtacggaaaaccggtccgaacggttacctttacccgtaacccccgttaccgttaaaccggaaagtaacgtaacgtacgttaacccgttaaccgaaaacggttaacttaaccccgtaagtttacggtaacttttacgtaacgtaaacgtaaaacgttaccgtaaaaccccgttaaaacccgttaaaacgggaaaaacccggaacggaaccgggtaaccgggtacgttaaacgttaggtttacctttaaaggttgtttacggtttagtttaagtttacttaacgccggttaaaagtaccgttcgtaacctaccgggcgggtacccgtaaacccgggg

SEQ ID NO: 276015 - DNA, 878 bp, Homo sapiens
  misc_feature: GYAE6OF01BSHLU.44.85.H08.1.454.CMB.1.raw
  modified_base (198)..(198): a, c, t, g, unknown or other
  misc_feature (198)..(198): n is a, c, g, or t
tcagacagtatatacacgaccggtgctcgatttagtatcactcagtcgcgggggcagaagtctctctcagtcaggacacagcatggacatgagggtccctgctcagctcctggactcctgctgctctggctccagataccagatgtgacatccagatcgacccagtctccatcctcctgtctgcatcgtggtcggganacgtagacgtccaaccatccgtacgttcgggaccggggacgaacgttcgacggggtactaagttacggaccttaaagtttacgttaggcccgttaggtacttaccgaaggtaccgaaaaccggtaaaaaccggtaacgggggtaaaaaccgtcccgttaaccgttaacgggtcccgtttacccggttaggtaacctttacccgttaaaagttaaccgtaaaaaccttactttacccgttaaagtttttacgaaaccttaaacggttacccggtaacccggggttaccctttaaacgtttcccggttaccgggtttaaccgaaccggggttaccggtaaccggttaaggggttaccggttaacgtttcccggggtaacgggtaaccgttaacggtttaacctttacccgtaaaccgttacccgttaacccggtaaccggtacctaaccgggtcctaaaccgggtccccgttcggaacccgtacgggtacccctaaggtaacggttacgtttccgttaacggtaaccctttaaacgtttacgtttaacctagttaaaacccgtaaagttaaccgtacccgttaagggtcccctacccgttaaaccgtccgtttacccggttcccggtaccgtaaccggtactaacggtacggtacggtaactacgtaacgacggttaaccgg

SEQ ID NO: 276016 - DNA, 559 bp, Homo sapiens
  misc_feature: GYAE6OF01DL6U2.44.85.H08.1.454.CMB.1.raw
  modified_base (276)..(276): a, c, t, g, unknown or other
  misc_feature (276)..(276): n is a, c, g, or t
  modified_base (297)..(297): a, c, t, g, unknown or other
  misc_feature (297)..(297): n is a, c, g, or t
  modified_base (337)..(337): a, c, t, g, unknown or other
  misc_feature (337)..(337): n is a, c, g, or t
  modified_base (354)..(354): a, c, t, g, unknown or other
  misc_feature (354)..(354): n is a, c, g, or t
  modified_base (399)..(399): a, c, t, g, unknown or other
  misc_feature (399)..(399): n is a, c, g, or t
  modified_base (446)..(446): a, c, t, g, unknown or other
  misc_feature (446)..(446): n is a, c, g, or t
tcagacagtatatacacgaccggtgctcgatttagtatcactcagtcggcgggggggagaggagcccagcactagaagtcggcggtgtttccattcggtgatcagcactgaacacagaggactcaccatggagtttgggctgagcttgggttttcctcgttgcttcttttaagaggtgtccagtgtcaggtgcagctggtggagtcgtgggggagcgtggtccagcctgggacgtccctgagactctctgtgcagcgtctggattcacttcagtanctactggatgcagtgggtccncagctccgaggggacgggctggtgtggtctcacgtattangtgatggggatagcaanaaggctacggcggtactcggtagacggcattcacactctccaganacaacgacaacgaccacgtcctagtacttctagactaaagtgaaacncgtactggaagacggccgaaggacaccgggtcttaggtacgttagttacgtggtgacgaaagggcggtcccgggtaggtaccgggggtaaggttcgggggtattggcgtaacg

SEQ ID NO: 276017 - DNA, 720 bp, Homo sapiens
  misc_feature: GYAE6OF01DW5C8.44.85.H08.1.454.CMB.1.raw
tcagacagtatatacacgaccggtgctcgatttagtatcactcagtcggcgggggggagaggagcccagcactagaagtcggcggtgttccattcggtgatcagcactgaacacagaggactcaccatggagtttgggctgagtcttgggttttcctcgttgcttactttttaagaggttgtccagtgtcaggtgcagctgggtgagtcgtgggggagcgtggtaccagccgtgggacgtccctgacgctctcctgtgcagcgtctggacttccacctttcaaggttaccctagtcggactatcgctaccgtcggggtcccacgaggtcctacccggagggtccgaacggggtctagggagggttcggggtacggtactaacgtttagtagttggttatcggtaagtaggtaaaaggttaaacttaaaacgtcgttaatcgtaaccgaagtaccgttccgggtaaggaacggggtccctaagttcccaacgtactaccgtacccgaaggaacactaaccgttaccaaagacctacggtcgttaacgtacgttccgaagtactaaagttcgaaaccgtcggtaccgtaggaacggtacgaccgggaaggtaacccggtacggttccgttaggttaccgtttaagttaccggtcggttacggaacccggttacggtaattacgttttaacggttaccgtaacgttaacctaccccgttacgg

SEQ ID NO: 276018 - DNA, 918 bp, Homo sapiens
  misc_feature: GYAE6OF01B8BBI.44.85.H08.1.454.CMB.1.raw
  modified_base (865)..(865): a, c, t, g, unknown or other
  misc_feature (865)..(865): n is a, c, g, or t
tcagacagtatatacacgaccggtgctcgatttagtatcactcagtcggcggggggggagaggagcccagcactagaagtcggcggtgtttccattcggtgatcagcactgaacacagagactcacatggagtttgggctgagtcgttgggttttcctcgttgcttacgttttaaggaggttcgtccagttcggtcgagggttgcgaggtcgttgggtcggtaggtcgggtagggggggacggtcggttcggtcccgaggtcccgttgggggaccgttccccgtggaacgtccgttccgttccgttggtacggccgtacggtccggtttcgtacggtacttttacccggacccctttacgtacggttaccttaggtcgggtacctacgttcggacccgttacgggtccgggggtttacccccgaccggtaacggggtccccttaaccgggacgggggtaacgggaaccgggggttccggtagggggttaggggtcgggggttaccgtaacctttaacggttttagtaacgggtttggtaacggttaggtaaggtaagggttaaaacgttaaaatttaaacggttactaggtacggacgtaacgttaccggtacggtacgggtaaccggggtcttacgtacccgtaaccacttaccgtaaccgaacgtaacgtaaccctaaacgttaacccgaaacgaacccgttaacggttaccgttaacgttaccgttacgttaaccgaaacttaaaacgaccggtaaccggttaccgtaccggtaacggtacccggaccggtacgggaaaccgttacccggtaacggttcgttaacggttagttaaccgttcgggtaggaccggacggttaanaaccgtttaattacgggtaacctttaaccggaaaccccttccggttaaccggg

SEQ ID NO: 276019 - DNA, 896 bp, Homo sapiens
  misc_feature: GYAE6OF01DKHY5.44.85.H08.1.454.CMB.1.raw
  modified_base (152)..(152): a, c, t, g, unknown or other
  misc_feature (152)..(152): n is a, c, g, or t
  modified_base (868)..(868): a, c, t, g, unknown or other
  misc_feature (868)..(868): n is a, c, g, or t
tcagacagtatatacacgaccggtgctcgatttagtatcactcagtcggcggggcagaagtcctctctcagtcagacacagcatggacatgaggtcctgctcagtctcctggactcctgctgctctggctccagactaccaagactgtgacntaccagtctcgaccctagtcgtaccactccctcctggtcctcgacctattaccgtaggtacggggaagaaccgagtacgtaaccaaccctaattccgtaacggtttccgggcccgggtaccgtaaggttaccggaacgggggtacctaacgtttaacggtaccttaaaacttttacgtttaaccgtaccgttacgggttaactaccgaaccgtaccgaaaaacggtaaaaccgtaaagggtaaacggtaccttaacccgttaaacggccctttaaaccgtacggtaaacctttaacgtaacggtaactaaaaccgtacttaccccttaagttttaccgaaccgtaacgttacccggtacggggttacccctaacgtttcccggtacggttaccgaagggttacccgggacggtaacgggtttcggtaaccggtttacggggtaacgggttaaaccgttaccgggtttaacttttacccggtaacctttaccccggtttaaccccgtaaaccggtttacccgtaacgttaacccggtcccggttacgacccgttaccggaacccgttaggttaaacggtacgtttacgggtaaacctacccggtttaaacctttacgttaacccgtacgttaaaaccctaaacggtaacctaacggtacccgtaccggtaccccttacccgaccgttaccgttccccgacggttacgaacgtaacgngtaactaacgaagtacgacgtgtaccgg

SEQ ID NO: 276020 - DNA, 715 bp, Homo sapiens
  misc_feature: GYAE6OF01E4UAQ.44.85.H08.1.454.CMB.1.raw
  modified_base (177)..(177): a, c, t, g, unknown or other
  misc_feature (177)..(177): n is a, c, g, or t
  modified_base (275)..(275): a, c, t, g, unknown or other
  misc_feature (275)..(275): n is a, c, g, or t
  modified_base (682)..(682): a, c, t, g, unknown or other
  misc_feature (682)..(682): n is a, c, g, or t
  modified_base (705)..(705): a, c, t, g, unknown or other
  misc_feature (705)..(705): n is a, c, g, or t
tcagacagtatatacacgaccggtgctcgatttagtatcactcagtcggcggggggggagaggagcccagcactagaagtcggcggtgtttccattcggtgatcagcactgaacacagagactcacatggtagtttgggctgagcgttgggttttcctcgttgcttacttttaaggnggtgtccagtgtcgaggtgcagtctgggtggagtcggtgggggagtcgtcgtccaggccgtgggacgtcctgacgtacttcctctggtgcagtcgtcnggtacttccgtaccttcaacgtacctagtggactagtcggacctacggtccgggtaccccgaccgtacccggcccccgggaagggtccggggaacgggggttccggagggggttacgggttcgggggtaacgtacccttaagtttagtacggttacgggttaagtacggtaaggttaaacggggtaaaattaaaacctttaaagtaccgtaggtacgtaaccgacgtaccggtcggtaagggaccgtccgtactaccgactaccgtctaacgaagactaactaacctaacgaaccgatacgtcgttactacgtacgaacgtaacaaacgtgaaaccggtcgtacgaacgacggaccgtaggacggataccggtgttacggtataccgttgacgtcggagaaccgttnttagtacttagaaccgttacccncggtcctagg

SEQ ID NO: 276021 - DNA, 825 bp, Homo sapiens
  misc_feature: GYAE6OF01DU520.44.85.H08.1.454.CMB.1.raw
  modified_base (160)..(160): a, c, t, g, unknown or other
  misc_feature (160)..(160): n is a, c, g, or t
  modified_base (178)..(178): a, c, t, g, unknown or other
  misc_feature (178)..(178): n is a, c, g, or t
  modified_base (182)..(182): a, c, t, g, unknown or other
  misc_feature (182)..(182): n is a, c, g, or t
  modified_base (197)..(197): a, c, t, g, unknown or other
  misc_feature (197)..(197): n is a, c, g, or t
  modified_base (700)..(700): a, c, t, g, unknown or other
  misc_feature (700)..(700): n is a, c, g, or t
  modified_base (764)..(764): a, c, t, g, unknown or other
  misc_feature (764)..(764): n is a, c, g, or t
tcagacagtatatacacgaccggtgctcgatttagtatcactcagtcgcgggggggagaggagcccagcactagaagtcggcggtgtttccattcggtgatcagcactgaacacagaggactcaccgatgggtagtttgggctgagtcgttggttttccngttagcttacgtttaagnggtntccagtgtacaggtncgagtcgtgggtggtacgtcgggtagggggcgtcgtcggtaccaggtccggttagggacgtccctaggagtccttcttcgtggtcgacgacggtcgttcgacgttacttcgaccttgaacgttactagtcggactagttccggacttccggtcggccgtacggcgttccgacgacggggacgttaacggggcgttagggcggttcgggtataccgttaagttatttacgggtagttagtaagggtagttaacggaaaaatttaacgtaaagttagttgaagtacccggaaacttcgggttaaccggtaacggggaaccgtaccgtaacgtttacccgaaccgtttccgtaaccgtaaaccgaacgggtaactttaaaacccgaaacggttaacccgaaaagtaacccgggttctaactttaggttaaccttacccgaagaaaacgttaacggtacaacccacggggtttaaccgaacggtacggaccgggtaccgggtaaacnccccgggtttagtaccttaagggtttaaccgttttacgggtactacgggtaaggtaaacccggnggttaaaacccttttagggttaaacgttaaacccggtcttaaaccccgtcgtaaaccgggg

SEQ ID NO: 276022 - DNA, 873 bp, Homo sapiens
  misc_feature: GYAE6OF01D56V1.44.85.H08.1.454.CMB.1.raw
tcagacagtatatacacgaccggtgctcgatttagtatcactcagtcgcggggagctctgggagaggagcccagcactagaagtcggcggtgtttccattcggtgatcagcactgaacacagaggactcacagtggtagtttggctgagtcgttcgggtttttcctcgttgtctttacgtttttaaggtaggttcgtcctaggttgtacgtagggttcgacgtaggtcggttgggtagggtacggttcggggtagggggggacggtccgggttacgggtaccgtacggtcccggtgggggtaccgtcccgtaggacgtaccttccgtccgttggtccgaccgtaggttccgttacggtagtacctttccctaccgtttcgaaaccgttaccgtaggtcgtactacgtcggaccgttaccgggttccggggtccccggtaccgaccggtcccgtaaccggggaacgggtaacgggaacgggggtcggttaggggtacgggttcgggtacggtaaccttaacgttttagtacgttaggttagtacggtaaggtaaggttaaaacgttaaagttaaaccttagtagtacggtactacgggtaccgttacgggtacggaacggtaccgtacgttaccgacctactccgaaccgtaagaacttaaccgtaacctaaccgaacgtaaacgtacgtacgttagtaaccgtacgtactaacgtaacgacgtaacgtacggaccgaacgggtacgaaccggcccgggtaaggaaccggttcccgggttaaggttaaccgggttttacttaacgggtttacgggttcggttaaccgggtaacgttaacggggttaaactttacgtttaaacgggtttaacccg

SEQ ID NO: 276023 - DNA, 769 bp, Homo sapiens
  misc_feature: GYAE6OF01EPRKR.44.85.H08.1.454.CMB.1.raw
  modified_base (289)..(289): a, c, t, g, unknown or other
  misc_feature (289)..(289): n is a, c, g, or t
tcagacagtatatacacgaccggtgctcgatttagtatcactcagtcgcgggggggagaggagcccagcactagaagtcggcggtgtttccattcggtgatcagcactgaacacagaggactcacatggagtttggctgagcttgggttttcctgttgtcttctttttaaggaggttgtccgagttcgtcgaggtgcgagtcgtgggtggagtcgggtggggaggcgtcggtcaggccgtgggacgtccctgacgtccttcgctgtgcagcgtcgtgtacttcaccttnagtacctagtcgcagtcgctcggtcgggtccgccgaggtcctaccggagggccggtaaggggtcgtacggggaggttcggggtacggtaccttaacggtttagtaggttaggtatacggtaagttaaggaaaagttaactaaaagtttcaagtacggactaacggtaacgttaccgggtaagggtaaccgggtaccgttacgttaccgtaaccgtacgttacccgtaaccgaaaggtacgtaaactaccgtttaacccgaaacgttacccgacgttaccgttagttaactacgtagtaaacgtaacgtacgaaaaccgtcgttaccgaacggaacgaaccgggaccggtacgggtaaccgtaccgggttaccgttagggttaaccgtttaacggttaccgtaagggttaccgaacggggtacttaaacggtacgttttaacggttaacgttaaccggtttaaacccaccccgttaacggg

SEQ ID NO: 276024 - DNA, 828 bp, Homo sapiens
  misc_feature: GYAE6OF01AGMZZ.44.85.H08.1.454.CMB.1.raw
  modified_base (181)..(181): a, c, t, g, unknown or other
  misc_feature (181)..(181): n is a, c, g, or t
  modified_base (343)..(343): a, c, t, g, unknown or other
  misc_feature (343)..(343): n is a, c, g, or t
  modified_base (656)..(656): a, c, t, g, unknown or other
  misc_feature (656)..(656): n is a, c, g, or t
  modified_base (767)..(767): a, c, t, g, unknown or other
  misc_feature (767)..(767): n is a, c, g, or t
  modified_base (780)..(780): a, c, t, g, unknown or other
  misc_feature (780)..(780): n is a, c, g, or t
  modified_base (799)..(799): a, c, t, g, unknown or other
  misc_feature (799)..(799): n is a, c, g, or t
tcagacagtatatacacgaccggtgctcgatttagtatcactcagtcggcggggggggagaggagcccagcactagaagtcggcggtgtttccattcggtgatcagcactgaacacagaggactcaccatggagtttgggctgagtcgttgggttttcctcgttgaccttacttttaaggnggttgtccaggttcgtcgagggtgctaggtcgtagggtggacggtcgggtgggggacgcgtggtaccaggcccggtggggtaccgtccgtgaacgtccttcgtcgtagcgcgacggtcgtcgtaggtactttccgacctttacggaacttacgtagtccggntacgtcggtacctacgggttccggggcccacgacggccgttacggagggacgggaacggggtcgtaggggtcggtcggggtacctttaaacggttatagggttagtaagtcgggttaaagttacgggtaaaatttaaaactacgttacgtaaacgtcggtaacggttaacggtacccgggttaaaccgggtacgggtaaccggggtaccctttaagtaccccgtaacctacccggtttacgaaaccccggtagttaaacgtaaacctaacccggttaaccgaaaaggttaacccccgtgtaaacccggttttntaacccggtaacgttacggtaaacctaacggaaccgttaacgcgttaaccgggagtaaccggaaccgtacggacgttacggacgtttagttacggtaggttacttacgggngtaacggtacggngttaaagttaccggtttanaaccgttacccggtacttacccggtacgg

SEQ ID NO: 276025 - DNA, 904 bp, Homo sapiens
  misc_feature: GYAE6OF01A48HS.44.85.H08.1.454.CMB.1.raw
  modified_base (226)..(226): a, c, t, g, unknown or other
  misc_feature (226)..(226): n is a, c, g, or t
tcagacagtatatacacgaccggtgctcgatttagtatcactcagtcgcgggggggagaggagcccagcactagaagtcggcggtgtttccattcggtgatcagcactgaacacagaggactcaccatggagtttgggctgagtcgttgggttttcctcgttgtcttacttttaagaggtcgtccagtgtcgaggtgcgagtcgtggtggtaggtcggtagggggnggtcggtggtccgaggtccggtgggacgtcccgtggacgtcctccgtccgtggtcgcgtagtccgttcgtaggtacctttaccgtacccttagtacgttacccgtagtcggactagtcggccgtaccgggttcgggtaccccaccggtaaccggtcccggtaccgggaaggggggtaacgggtccggtaggggttcggttcgggttaccgttaaccgttaaggtttaacgttaagtacggtaggtaacgggtagggtaacgtacgaactaaacggtacgccggttaaccggaccggttaccggttaccggaggtaccggtccttacgtccaaccgtaccgtacgtaccgaaacgtaacccgtaaacccgaagaaaccccaaacggtaaccgtaccgtacgtttaacggtaacctaccgtaacggaaacttaaacgtaacggtaaccgttaagggtaacgtaaccggggaaccggaacccgggttacccggggaaaccggtacccggtaccggttaacggtttaacggttaaacgtttacgggttttaaccggtaacggtacgggaaacccgggttaacgggggtacccggggttacccgggttaacgggggggttaacccgggttacggggggtttaaccggggtaaccgttttaccggtaaccgtttaaaacccggg

SEQ ID NO: 276026 - DNA, 524 bp, Homo sapiens
  misc_feature: GYAE6OF02IKATS.44.85.H08.1.454.CMB.1.raw
  modified_base (335)..(335): a, c, t, g, unknown or other
  misc_feature (335)..(335): n is a, c, g, or t
  modified_base (483)..(483): a, c, t, g, unknown or other
  misc_feature (483)..(483): n is a, c, g, or t
tcagacagtatatacacgaccggtgctcgatttagtatcactcagtcgcggggggagaggagcccagcactagaagtcggcggtgtttccattcggtgatcagcactgaacacagaggactcaccatggagtttgggctgagcggtggtttcgtcgtaggctctttaagaggtgtccagtgtcaggtgcagctggtggagtcgtgggggaggcgtggtccagcctgggaggtccctgagactctcctgtgcagcgtctggattcaccttcagtacctatggcatgcactgggtccgccaggctccgaggcaaggggctggagtgggtgcacttanatggtatgatggaataataatactatgacagactccgtgaacggcgattcactatctcagagacaattccaagaacacgctgtatctgacaaatcgaacagcctagacgacgaccggaggaccacgggctaggttagtaactttacgnggtcgacgaaggacagttagttagtactacctacctaaccg

SEQ ID NO: 276027 - DNA, 496 bp, Homo sapiens
  misc_feature: GYAE6OF02GI92G.44.85.H08.1.454.CMB.1.raw
  modified_base (390)..(390): a, c, t, g, unknown or other
  misc_feature (390)..(390): n is a, c, g, or t
tcagacagtatatacacgaccggtgctcgatttagtatcactcagtcgcgggggcagaagtctctctcagtcaggacacagcatggacatgagggtccctgctcagctcctgggactcctgctgctctggctcccagataccagatgtgacatccagatgacccagtctccatcctccctgtctgcatctgtgggagacagagtcaccatcacttgccgggcgagtcagggcattagcaattattagcctggtatcagcagaaaccagggaaagctcctaagctcctgatctatgaaacatccattttgcaatcagggtcccatctcgttcagcggcagtggatctgggacagatttcactctcaccgtcagcagcctgcagcctgaagntgttgctaactttattactgtacaaaagttataacagtcgcccctcaactaccttttccggccccttacgggaccctacgacgtacggactatacgaagtacccgg

SEQ ID NO: 276028 - DNA, 496 bp, Homo sapiens
  misc_feature: GYAE6OF02FZI3K.44.85.H08.1.454.CMB.1.raw
tcagacagtatatacacgaccggtgctcgatttagtatcactcagtcgcgggggcagaagtctctctcagtcaggacacagcatggacatgagggtccctgctcagctcctgggactcctgctgctctggctcccagataccagatgtgacatccagatgacccagtctccatcctccctgtctgcatctgtgggagacagagtcaccatcacttgccgggcagtcagggcattagcaattatttagcctggtatcagcagaaaccagggaaagctcctaagctcctgatctatgaaacatccattttgcaatcagggtccatctcgttcagcggcagtggatctggacagatttcactctcaccgtcagcagcctgcagcctggagtagtttcgcgtacttattactgccaacaattattactttttatccgttactagttttgtaccgtacggggtaccaagtcgtaggacgtatacgaaacggtactgtacgg

SEQ ID NO: 276029 - DNA, 534 bp, Homo sapiens
  misc_feature: GYAE6OF02IM1C0.44.85.H08.1.454.CMB.1.raw
tcagacagtatatacacgaccggtgctcgatttagtatcactcagtcgcgggggcagaagtctctctcagtcaggacacagcatggacatgagggtccctgctcagctcctgggactcctgctgctctggctcccagataccagatgtgacatccagatgacccagtctccatcctccctgtctgcatctgtgggagacagagtcaccatcacttgccgggcgagtcagggcattagcaattatttagcctggtatcagcagaaaccaggggaaacctcctaacctcctgatctttgctgcatccacttgcaatcagggtcccatctcgttcagcgcagtggatctgggacagatttcactctcaccgtcagcagcctgcagcctgaagactgttgactaactttactacttgtaccaacagaagttactactacgtccccggtttactaccgtttttcggggtaccgggggtaaccctaacggaccgttcgggtaacggtacgttaccaaaaccggtacgttaggttaccggg

SEQ ID NO: 276030 - DNA, 506 bp, Homo sapiens
  misc_feature: GYAE6OF02HBH1O.44.85.H08.1.454.CMB.1.raw
tcagacagtatatacacgaccggtgctcgatttagtatcactcagtcgcgggggggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtctgggggagcgtggtccagcctgggaggtccctgagactctcctgtgcagcgtctggattcaccttcagtacctatggcatgcactgggtccgccaggcctccgaggcaaggggctgggagtgggtggcacttatatggtatgatggaagtaataaatactatgcagactccgtagaacgggcatcacatctacagagacaatccaagaacacgactgtactctgacaaatgaacagacctgagacgcgaggacgacggctgtgtattacgtgtgacgagactagtatgtacgtactacctacg

SEQ ID NO: 276031 - DNA, 544 bp, Homo sapiens
  misc_feature: GYAE6OF02IPH1T.44.85.H08.1.454.CMB.1.raw
tcagacagtatatacacgaccggtgctcgatttagtatcactcagtcgcgggggctgtgggctcagaagcagagttctggggtgtctccaccatggcctggacccctctctggctcactctcctcactctttgcataggttctgtggtttcttctgagctgactcaggaccctgctgtgtctgtggccttgggacagacagtcaggatcacatgccaaaggagacagcctcagaagctattatgcaagctggtaccagcagaagccaggacaggcccctgtacttgtcatctatgaactaaaaaccaccggcctacggggactccagaccgtattctctcggctccagctcaagaaacacagcctttctgaccatccacgtgggctacgagggacggaagatggaggctgaacttattacgtacgtaaccgtccggaacaacgtagtacggtaacctagttgggttcgttcgggacggtacgggaccagcgtcggacccgtcctaggtccacgaccaaggcctccgccccgtcgtccacttccg

SEQ ID NO: 276032 - DNA, 497 bp, Homo sapiens
  misc_feature: GYAE6OF02HSEE3.44.85.H08.1.454.CMB.1.raw
  modified_base (260)..(260): a, c, t, g, unknown or other
  misc_feature (260)..(260): n is a, c, g, or t
  modified_base (390)..(390): a, c, t, g, unknown or other
  misc_feature (390)..(390): n is a, c, g, or t
  modified_base (395)..(395): a, c, t, g, unknown or other
  misc_feature (395)..(395): n is a, c, g, or t
  modified_base (410)..(410): a, c, t, g, unknown or other
  misc_feature (410)..(410): n is a, c, g, or t
  modified_base (430)..(430): a, c, t, g, unknown or other
  misc_feature (430)..(430): n is a, c, g, or t
tcagacagtatatacacgaccggtgctcgatttagtatcactcagtcgcgggggcagaagtctctctcagtcaggacacagcatggacatgagggtccctgctcagctcctgggactcctgctgctctggctcccagataccagatgtgacatccagatgacccagtctccatcctccctgtctgcatctggtgggagacagagtcaccatcacttggccgggcagtcagggcattagcaattatttagcctggtatcancagaaaccagggaaacctcctaacctcctgatctttgctgcatccactttgcatcagggtccatctcgtcagcgcagtgatcgtggacagtatttctctctcacctatcagcagcctgcagcctgaagtntgttnactaactttatactntactaaaagctaacagttcnccctactaactacctttcggcccttagggaacctaaaggtacggattacgtacaaacgtactacggg

SEQ ID NO: 276033 - DNA, 667 bp, Homo sapiens
  misc_feature: GYAE6OF02JYFAF.44.85.H08.1.454.CMB.1.raw
  modified_base (194)..(194): a, c, t, g, unknown or other
  misc_feature (194)..(194): n is a, c, g, or t
  modified_base (242)..(242): a, c, t, g, unknown or other
  misc_feature (242)..(242): n is a, c, g, or t
tcagacagtatatacacgaccggtgctcgatttagtatcactcagtcgcggggctgtgggctcagaagcagagttctggggtgtctccaccatggcctggacccctctctggctcactctcctcactcttgcataggttctgtggtttcttctgagctgactcaggaccctgctgtgtctgtggccttgggacngacagtcaggatcacatgaccaaggagacagcctacagaagctattangacaagctaggtaccagcagaagccagacaggcccctagtacttgcatcatagaactaaaaaccaccggtccctagaacgggactacccaagacccgtattcctactcggactaccgagtcctacgaacggaaaaccacaacggtcctttacccgttacgaacctactaccgtaccggtcggggtacctacgaacgggaccgggtaaaagacgtgggaacgtccgttaacggtaacctttaacgttaacgtaccggttaaaacccgttcccggggaaacctaaacggtaggttaaccgtaaaccgttaggttacggggttacgttccggggtacgggaacgggtacccgaaggtacgtcggtaacccgtcgtaacggtacgtacggaccccgtaaggccctccggtacccccgtggtaccctacg

SEQ ID NO: 276034 - DNA, 527 bp, Homo sapiens
  misc_feature: GYAE6OF02FMVU7.44.85.H08.1.454.CMB.1.raw
  modified_base (259)..(259): a, c, t, g, unknown or other
  misc_feature (259)..(259): n is a, c, g, or t
  modified_base (271)..(271): a, c, t, g, unknown or other
  misc_feature (271)..(271): n is a, c, g, or t
  modified_base (298)..(298): a, c, t, g, unknown or other
  misc_feature (298)..(298): n is a, c, g, or t
tcagacagtatatacacgaccggtgctcgatttagtatcactcagtcgcgggggggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggaggcgtggtccagcctgggaggtccctgagactctcctgtgcagcgtcnggattcaccttnagtacctatggcatgcacgtgggtccnccaggcctccgagggcaagggggctgggaggtggggtggctacttatatggtatggatggaaataataaatactatgcagactccggtagaacggcgatcaccatctccagacgaacaacttccaaagaaccacgctgtatctgacaaatgaacagcctaggacgacgccgaaggacgacgctagtagtaattactgtgacgaggacagtattggtactactacctacg

SEQ ID NO: 276035 - DNA, 572 bp, Homo sapiens
  misc_feature: GYAE6OF02JIDHH.44.85.H08.1.454.CMB.1.raw
tcagacagtatatacacgaccggtgctcgatttagtatcactcagtcgcggggagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctgggtggagtctgggggaggcgtggtcccaggccctggggaggtccctgaggactctcctgtgcagcgtctggattcaccttcagtacctatggcatgcacgtgggtcccgccaggcctccgaggcaaggggctgggagtgggtgctacgttatagtggtatggataggaaagtaataaatactatgacagactccgtaggaacgggccgtattccacctatcctaccgagacgactaacgttacccaaagaaccacgtctagtactctagactaaagtcgaaaccagacctagagacgaccggaaggacgaaccggtcttaggtcgttaacttacgtaggttcggaccggtaaggtacctagttagttacgg

SEQ ID NO: 276036 - DNA, 499 bp, Homo sapiens
  misc_feature: GYAE6OF02IHLL2.44.85.H08.1.454.CMB.1.raw
  modified_base (276)..(276): a, c, t, g, unknown or other
  misc_feature (276)..(276): n is a, c, g, or t
  modified_base (302)..(302): a, c, t, g, unknown or other
  misc_feature (302)..(302): n is a, c, g, or t
  modified_base (343)..(343): a, c, t, g, unknown or other
  misc_feature (343)..(343): n is a, c, g, or t
  modified_base (357)..(357): a, c, t, g, unknown or other
  misc_feature (357)..(357): n is a, c, g, or t
  modified_base (463)..(463): a, c, t, g, unknown or other
  misc_feature (463)..(463): n is a, c, g, or t
tcagacagtatatacacgaccggtgctcgatttagtatcactcagtcgcggggagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtctgggggagcgtggtccagcctggggaggtccctgagactctcctgtgcagcgtctggattcaccttnagtacctatggcatgcactgggtccncaggctccaggcaagggctggagtgggtctcgagtcattanactggtgatttcanatactacgcagctcgtgaagggtcgattcacatctcaggacaattccagacacgttatcttacaatgaacactagacgaggcgacgacacggcctactatactgtnacgagacagtcggcgcgtggagtggttatagttcgg

SEQ ID NO: 276037 - DNA, 590 bp, Homo sapiens
  misc_feature: GYAE6OF02GO1ZI.44.85.H08.1.454.CMB.1.raw
  modified_base (302)..(302): a, c, t, g, unknown or other
  misc_feature (302)..(302): n is a, c, g, or t
  modified_base (347)..(347): a, c, t, g, unknown or other
  misc_feature (347)..(347): n is a, c, g, or t
  modified_base (354)..(354): a, c, t, g, unknown or other
  misc_feature (354)..(354): n is a, c, g, or t
  modified_base (375)..(375): a, c, t, g, unknown or other
  misc_feature (375)..(375): n is a, c, g, or t
tcagacagtatatacacgaccggtgctcgatttagtatcactcagtcgcgggggggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggaggcgtggtccagcctggggacggtccctgagactctcctgtgcagcgtctggattcaccttcagtacctatggcatgcacgtcggggtccnccaggcctccgagggccgaaggggctgggaggtgggtgcacttanatggtangatggaagtaataaatactangacagactcgtagaacgggcatcactatcctcagacgactaactaccaaagaacacgctagtactctagaacaaacgtacgaacctacgacctaggaagacggacccggtaaggaaccgtacgggtcttacggtagttaacgttacttgggtacggaccggtaaggaaccgttaagttaacgtttacggtaacgttacccgtaaccctaacccgg

SEQ ID NO: 276038 - DNA, 640 bp, Homo sapiens
  misc_feature: GYAE6OF02IT8U1.44.85.H08.1.454.CMB.1.raw
tcagacagtatatacacgaccggtgctcgatttagtatcactcagtcgcgggggctgtgggctcagaagcagagttctggggtgtctccaccatggcctggacccctctctggctcactctcctcactctttgcataggttctgtggttttcttctgagctgactcaggaccctgctgtgtctgtggccttgggacagacagtcaggatcacatgccaaaggagacagcctcaagaagctattatgcaagctggtaccagcagaagccaggacacggcccctgtacttgtcatctatgaactaaaaaccaccggcctacgacggactcccagaccgattctctggctccagctacgaggaaacacacgtcttcctgaccctatccacgtcggggcctacgaggacggaagacgtggaacggtcttacggtaaccttaagtttaccgtacggtaaacccgtcccgggaactaaacgtacggttaacggttaaccgtacgggtttcggggttacggtttacggggacgggtaacgggacccgtaaggtccgtacggtaacccggttaccggtaacggtaccgaaccggtaccccggaacgggtcccgtacccggtccccccggttacgggtacccttacccg

SEQ ID NO: 276039 - DNA, 616 bp, Homo sapiens
  misc_feature: GYAE6OF02H2RS6.44.85.H08.1.454.CMB.1.raw
  modified_base (302)..(302): a, c, t, g, unknown or other
  misc_feature (302)..(302): n is a, c, g, or t
tcagacagtatatacacgaccggtgctcgatttagtatcactcagtcgcgggggggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccagcctggggacggtccctgagactcttctgtgcagcgtctggacttcaccttcagtacctagtggcatgcactcggggtccnccaggcctccgaggcgaaggggctgggaggtgggtgcacgttatagtggtatgagtggaaattaataaatactatcgcaggactccggtaggaacgggtccgtattcacctatcctacgagacgactaaacttaccaaagaaccacgtcgtagttactcgtagactaaagtcggaaactacgaccgtagaacgacggaccggaagggaccgaccggtacgttcggttaacggttaagtttaccgtaggttccggaacggtaaggtaacgtaagtttaaccgtttaggtaacggttaccctaacccgtaacccgg

SEQ ID NO: 276040 - DNA, 530 bp, Homo sapiens
  misc_feature: GYAE6OF02GSBTP.44.85.H08.1.454.CMB.1.raw
  modified_base (338)..(338): a, c, t, g, unknown or other
  misc_feature (338)..(338): n is a, c, g, or t
tcagacagtatatacacgaccggtgctcgatttagtatcactcagtcgcgggggggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtctgggggagcgtggtccagcctgggaggtccctgagactctcctgtgcagcgtctggattcaccttcagtacctatggcatgcactgggtccgccaggcctccgaggcaagggggctgggagtggggtgcacttanagtggtatgatgggaataataaatactatgcagactcgtagaacgggccattcacctatctccagagacaattaccaagaaccacgctagtactctagacaaagtcgaacagcctagacgacgccgaggaccacggctgtcgtattacgtgtgacgaggtactagttagttaggtacgtacctaccgtaccg

SEQ ID NO: 276041 - DNA, 748 bp, Homo sapiens
  misc_feature: GYAE6OF02HKXFC.44.85.H08.1.454.CMB.1.raw
tcagacagtatatacacgaccggtgctcgatttagtatcactcagtcgcgggggcagaagtctctctcagtcaggacacagcatggacatgagggtccctgctcagctcctgggactcctgctgctctggctcccagataccagatgtgacatccagatgacccagtctccatccctccctgtctgcatctggtggatacagagtcaccatcacttggccgggcgagtcgagggctaagttacgcgtaattaatttagcccttggtataccagtaccaagtaaaaccgagggaaacgtcctaccgtaagccttacctgtattctatacgaaactactacctacttttacgactaaacttcgtaacgggggtaccctaacgttccgttacgggtttaccgaggtacccggacgtaacgggtagggttaacgttcggtaggggtaaccctaaggttaacttttaccgaacccgtttcccttaccgaacccgggttacacggtacctacggtacccgtacgtccgtaaccggtccgtaaggtaaacgtacgtttacgggttacttaacccgtaaacgttttaaacgtttaacgttacggtaaacctttaaaaaaggttaaccgttaaaaccgtaccgggttaccgtacccccttaccgtaacccgttaaccgttttccccgggtaacccgttacggggtaacccctacgtaacgggtaccggtaacttaacgtaccgtaacggtaacccgg

SEQ ID NO: 276042 - DNA, 691 bp, Homo sapiens
  misc_feature: GYAE6OF02GJJWK.44.85.H08.1.454.CMB.1.raw
  modified_base (197)..(197): a, c, t, g, unknown or other
  misc_feature (197)..(197): n is a, c, g, or t
tcagacagtatatacacgaccggtgctcgatttagtatcactcagtcgcgggggcagaagtctctctcagtcaggacacagcatggacatgagggtccctgctcagctcctgggactcctgctgctctggctcccagataccagatgtgacatccagatgacccagtctccatcctccctgtctgcatctgtggganacagagtcaccatcacttcggccgggcgagtcgagggcattagactaattatttagctggtatcagcaagaaaccagggaaagctacctaagctactgatctaatagaaactacttacctaattttcgactaaacgttaccgtaacgggggttacccctacgttaccggtttcggttacgaacggtccgggtaccgtaggttacgggtaacttccggtaggggtaactaaggttaactttttaccgtaaccttccgttacccgtacccggttacgaaccgtaccacggtcccgtacggaccacggtcccgtaagaaaggtacgttacggttacgtaccttaaacgttttaactttaacgttaacgtttaaactaaaaaggtttaacgtaaacgtacgtacccgtaccccttacgtaaccgttaccgttttacccgggccccgttacgggaaccctacggtacggttacggtaactacgtactaacggtaaccgg

SEQ ID NO: 276043 - DNA, 862 bp, Homo sapiens
  misc_feature: GYAE6OF02HMRQH.44.85.H08.1.454.CMB.1.raw
  modified_base (429)..(429): a, c, t, g, unknown or other
  misc_feature (429)..(429): n is a, c, g, or t
tcagacagtatatacacgaccggtgctcgatttagtatcactcagtcgcgggggggagaggagcccagcactagaagtcggcggtgtttccattcggtgatcagcactgaacacagaggactcaccatggagtttgggctgagcttgggttttcctcgttgcttcttttaagaggtgtccagtgtcaggtgcagctggtggagtcgtgggggagcgtggtccagccgtgggacgtccctgagactctcctgtgcagcgtctggacttccaccttcacgtacctagtcggcagtcgctacggtcggggtcccgccgaggcctaccggaagggggaacggggtcgtaggggtaggtcgggtcgttcgggacccgtaacgtaaaaacggtaaaaaaaccgtaacggttcgacccgtaaggttaccttttaanaccgaaacgaaggtaacggtaccgcccggtacgttacgtaggtaacgaaaacgtcccgtaaacggttacctttacccccgaacccccgttacgtaaccgaaaagggtaacgtaacgttaccggtaaacctttaaccgaaaacggttaacccttacgttaacgtttacgtaacttttccgtaagaaccggttaaacgttaccggtaaaacccgtttaaacccggtaaacgggaaaaaaccccgggtaacgggtaaacccggtaaccggggtaacttaacggtttacggttttaacgttttttaagggttttcgggtttaggtttttaacgggttttaaggtttttaacgttaacggtttaaccgggtaaacgggttaacccgtttcccgggtttaaccccggttaccgggggttacccgggggtaacccccggg

SEQ ID NO: 276044 - DNA, 604 bp, Homo sapiens
  misc_feature: GYAE6OF02HQVX6.44.85.H08.1.454.CMB.1.raw
  modified_base (189)..(189): a, c, t, g, unknown or other
  misc_feature (189)..(189): n is a, c, g, or t
tcagacagtatatacacgaccggtgctcgatttagtatcactcagtcgcgggggggagaggagcccagcactagaagtcggcggtgtttccattcggtgatcagcactgaacacagaggactcaccatggagtttgggctgagctgggttttcctcgttgctcttttaagaggtgtccagtgtcaggtncagctggtggagtcgtgggggagcgtggtccagccgtggggaggtccctgagaccttctcctgtgcagcgtctggattcaccttcagtacctatggcatgcacgtcgggtccgccgaggcctccgaggacgaaggggcgtgggaggtgggtggctacttatagtaggtatgtagtaggtaaagtaaataaaatactatacgacacacgggggggggtacctaggaacgggaccgacttacacctatcctaccaagacgaactaaactaccaaacgaaaccacgacttagtactactacgactaaatacgaactacgactagaacgacggaccggaaggaccgacggcgttaggtagtaattacgtggtacgtacggaggacgtacgttagttacggttacgtacctaccctaccg

SEQ ID NO: 276045 - DNA, 738 bp, Homo sapiens
  misc_feature: GYAE6OF02ICP36.44.85.H08.1.454.CMB.1.raw
  modified_base (202)..(202): a, c, t, g, unknown or other
  misc_feature (202)..(202): n is a, c, g, or t
tcagacagtatatacacgaccggtgctcgatttagtatcactcagtcgcgggggcagaagtctctctcagtcaggacacagcatggacatgagggtccctgctcagctcctgggactcctgctgctctggcctcccagataccactggagaaatagtgatgacgcggtctccagccacctgtctgtgtctcgaggggaaacncgccaccctctcctgcacgggccagtcagacgtgttaccagacaacttacgcctacggtaccaccaagaaaccgtgggcacggccctccgaggtcctcctacgactcttactgattcgactactacccgaaacgtacggggtccacgtcggacccaccccgaggaccgtaggtttcaacggtcggacgtacgggttggggttaccgtagggggaacctaacgggttaccttaccgtaccgttccttacccggtaccgggttaccaacggtacgtaaaccgttacggtaaccgtacggtacccgttaaggtaaagtttacttttcggaccgttttaagttttaacttaccgtttagggtaccaacggttccgtacggtttcccgttacccgtacccgtaccggggtaccctccgtttacccgttaccgggtttcccggggggaaccggggggtaacccaagggggtttacggacggtaacgtaccggaaccggtacgtaaccggttcgggttacggtacctaccggtacccttaacg

SEQ ID NO: 276046 - DNA, 764 bp, Homo sapiens
  misc_feature: GYAE6OF02JJX70.44.85.H08.1.454.CMB.1.raw
  modified_base (188)..(188): a, c, t, g, unknown or other
  misc_feature (188)..(188): n is a, c, g, or t
tcagacagtatatacacgaccggtgctcgatttagtatcactcagtcgcgggggggagaggagcccagcactagaagtcggcggtgtttccattcggtgatcagcactgaacacagaggactcaccatggagtttgggctgagctgggttttcctcgttgctctttaagaggtgtccagtgtcaggtncagctggtgagtcgtgggggagcgtggtccagcctgggacgtccctgagactctcctgtgcagcgtctggacttcaccttcaacgtacctagtcggactatcggctaccgttcggggtcccgccacgggtcctccgacgggccgaaagggggtcctaggggtaggttcggggtacgggtacgtaaccgtttaagtacggttggttaacgtggtaaagtagggtaaaacgtttaaaagttaaaacttaacgttaagtcggaacctaacggtacccgttacccgggtaaggtaaaccggggtacccgtaactttacccgtaacccgtaacgttcccgtacccgtaaacggtaacgtaacctaaaccgttacccgaaagtaaccgtaacgtaccgttagttaactcgtaacgtaaccgtaaaagttacgaaaaccgtacgaccgtaaggaacgtaacggaccggtaacggaaccgtaccggtaccgttaggtacggtttaacgtaacgttagggtaccggtacggtaacggtacgttaacgttagttaacggtaacgttaacccgtacccgtaacccgg

SEQ ID NO: 276047 - DNA, 939 bp, Homo sapiens
  misc_feature: GYAE6OF02GH4T9.44.85.H08.1.454.CMB.1.raw
  modified_base (201)..(201): a, c, t, g, unknown or other
  misc_feature (201)..(201): n is a, c, g, or t
tcagacagtatatacacgaccggtgctcgatttagtatcactcagtcgcgggggcagaagtctctctcagtcaggacacagcatggacatgagggtccctgctcagctcctgggactcctgctgctctggctcccagataccagatgtgacatccagatcgacccagtctccactccctccctgtctgcatctggtggganacagtacgtcaaccatcacttggccgggcgagtcaggggcattagctaattatttagcctggtatcagcagaaaccacgggaaacctcctaacctcctgtacttctttagcttagctacgtccctacgtttacgactaaagtcgtaaccgggggttccccaagtttcccgtttcgggtttccgaacggggtccgggtaccgtacggggttacgggtacgtttccgggtaagggggtacctaacgggttaacgtttttcctccgtttacctacccgtaaccctaacgttaccgtaacggacccgtaacggttccccgtacggtaccgtacccggttaccccgttagggtaaacttttacgggtttaaacgttttttaccgtaacccgtttttaaaacttttttaaacccggttttaaacccgtttaccgttaaaacccccggttaaaaaactttaaaaacgtttttaaacccggtttttaaaacgtttttttaaacgggggttttttttttaacccccgggttaacggggggggttttaaacccccggtttttttaaaccccggggggtaaccccggggtttaaaaaaccgggggggtttaaaccccgggttttttaaaaaagggggggtttacccggggttttaaaaaaccggggttaaaccccgggttaaaaaaaccccggggttttaaaaccgggggttttcggggttttaaacccgggggtttaaccccccgggg

SEQ ID NO: 276048 - DNA, 690 bp, Homo sapiens
  misc_feature: GYAE6OF02GQ9O5.44.85.H08.1.454.CMB.1.raw
  modified_base (208)..(208): a, c, t, g, unknown or other
  misc_feature (208)..(208): n is a, c, g, or t
  modified_base (225)..(225): a, c, t, g, unknown or other
  misc_feature (225)..(225): n is a, c, g, or t
  modified_base (235)..(235): a, c, t, g, unknown or other
  misc_feature (235)..(235): n is a, c, g, or t
  modified_base (240)..(240): a, c, t, g, unknown or other
  misc_feature (240)..(240): n is a, c, g, or t
  modified_base (247)..(247): a, c, t, g, unknown or other
  misc_feature (247)..(247): n is a, c, g, or t
  modified_base (253)..(253): a, c, t, g, unknown or other
  misc_feature (253)..(253): n is a, c, g, or t
tcagacagtatatacacgaccggtgctcgatttagtatcactcagtcgcgggggctgtgggctcagaagcagagttctggggtgtctccaccatggcctggacccctctctggctcactctcctcactctttgcataggttctgtggtttctctgagctgactcaggaccctgctgtgtctgtcggtccttgggacagacagtcaggntcacatcgaccaagganaccagcctanaaganctattangacagntcgtaccagacagaacgcgaggaccgacggtccctaggttacttggtactacgtactaagtacgtaaacgtaaaaacccgacccggtacctacggaacggtacctcccgaacgtaccgtactttaccgtcctacgggccctacgacgtaccgtaaccgaaacggtaaaccacgtaccgttacccttcccgtagaacccacttaccggtacggtcgggggacccttacgggaacgggtcgaaacggtacgtagggtacggtacgtacgttaactttaacgttaccgtaccggtaaccccggtaaccgggaactaacggttaacggttactaacgttgggttacggtacgttacgggaccgggacggtacgaacggcgttaccgaaccgttcgtaacggacgacgaccgtaggcccgtcccgtccccgtagtctacccg

SEQ ID NO: 276049 - DNA, 643 bp, Homo sapiens
  misc_feature: GYAE6OF02HYIQF.44.85.H08.1.454.CMB.1.raw
  modified_base (269)..(269): a, c, t, g, unknown or other
  misc_feature (269)..(269): n is a, c, g, or t
tcagacagtatatacacgaccggtgctcgatttagtatcactcagtcgcgggggggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccagcctgggagtccctgagcctctctgtgcagcgtctggattccaccttnagtacctatggctagtgcctacgtcgggtcccgccgacgggcctaccgaggccgaaggggtcctaggggaggtggggtcggacctaacgtttaagtgttagggtattaggatagggtaaagtttaaacgtaaattaacgtagtgacaacgttaccgtaccggtaggaacgggtccgtacttccaaccgatccgtaccaggaactaactaacgtaaccaaacgaaccacgtacttcgtaatccgtagaacaaacgtacgaacgtacgcgtagacgacggaccgaagggacctaggtcgtagttagttaacttacggttggacggtaccggtaggtaaccttagttacgttaggtaaccttaccgaccccttacgg

SEQ ID NO: 276050 - DNA, 674 bp, Homo sapiens
  misc_feature: GYAE6OF02F5S3U.44.85.H08.1.454.CMB.1.raw
  modified_base (202)..(202): a, c, t, g, unknown or other
  misc_feature (202)..(202): n is a, c, g, or t
tcagacagtatatacacgaccggtgctcgatttagtatcactcagtcgcgggggcagaagtctctctcagtcaggacacagcatggacatgagggtccctgctcagctctgggactcctgctgctctggctcccagactaccagatgtgacatccagatcgaccagtctccatccctccctgtctcgacatcgtgtaggganacagagtccacatcacgttcggccggcgagtcgaggctatagactaatttattacgtccgttagtatcagtacaacggtaaaccgaagggaaactacctaccgtaaacgtccttaccgtagtacttaacttaataacgaaacctacttaccttacttttacgactaacgtccggtaaccgggtaccctagttaccgttacggtacgacggtcgacgtagggtacgtacgtcggtacgggtaactacgttactttccgtaactttcccgaccgtaccgtacgtacgacgtaccgctaccggacgtaccgtacgtagtaaggttacgtacgttacgttaaccgttactttaactttacgtaacgtaaacttaaaacgttagtaacgtaccggtccctaacccgtacctacccgttacggtttcccgacccggttacggacctacggacgttacagtaaccgttcgaagtaccgg

SEQ ID NO: 276051 - DNA, 624 bp, Homo sapiens
  misc_feature: GYAE6OF02F9IS4.44.85.H08.1.454.CMB.1.raw
  modified_base (341)..(341): a, c, t, g, unknown or other
  misc_feature (341)..(341): n is a, c, g, or t
tcagacagtatatacacgaccggtgctcgatttagtatcactcagtcgcgggggggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtgagtcgtgggggaggcgtggtccagccgtgggaggtccctgagacctctccgtgtcgcagcgtctggattcaccttcagtacctatggcatgcacgtgggtcccgccgaggcctccgaggcgaaggggctgggagtggggtcgntacttagtagtggtatgataggaaagttaattaaagtactatcgacaagtaccgtcggtaggaacgggccgaacgttccaaccatcctaccgtagaacgtaaccaacttacccaaacgaaccgtacgtcttagtactccgtagtacaaagttacgaagtacgccgtaggaagacggaaccggaggaccgacggcgttagggtacgttaacgttacgttacgggtacggaccggtaggtactaagtttaaggttaagtaacgttaccgttaacccgtaacccgg

SEQ ID NO: 276052 - DNA, 902 bp, Homo sapiens
  misc_feature: GYAE6OF02HELH6.44.85.H08.1.454.CMB.1.raw
  modified_base (689)..(689): a, c, t, g, unknown or other
  misc_feature (689)..(689): n is a, c, g, or t
tcagacagtatatacacgaccggtgctcgatttagtatcactcagtcgcgggggggagaggagcccagcactagaagtcggcggtgtttccattcggtgatcagcactttagaacacgaggacggtactccaaccagtgggtaggtttgggctaggagtcggttttcgggttttcccgtcggtttgccttttacgttttaaaggagggttccgtaccgtaggttcgtacgtagggtcgacgaggtcggttggggtagggtacggttcggggtagggggggacgggtccgggttccgggtacccgacgggtcccgggggttccgggggggttcccctaggaacgtaccgttcccgttcccgttggtaccggaccgtaccggtccccgttcggtaggttacctttacccgttacccgtttacgtaaggttacccgtaccgtttaaccggtagggtacctcggtaccgtaccgggttcccgggtaccccgaaccgtaaccggtcccgtaccgggaagggggtacggtcgttgggtcggtcgggtctacgtacgttaagttaagtggtagacggtagggacgtacgacgaagtacgacgtacggacgtacccgtcggtaacgggaccgggtaccttactaccgaccgtacttccgaaccgaagaaccggaaccgaccgaaccgaaaggtaccnccgtacgttcgtactcgtacaacgttaagaccgaagttcgtaccgtaaggaccggtaccgggtaccgggaacggtaacccggacggtttcgttacggttagttaccctttaggtacggaacggaaccggtaacgggtacccggggtcgggggtaccggtaacggggggtttccgggtttacggggacgttccgtaacttaacggtttaacccg

SEQ ID NO: 276053 - DNA, 660 bp, Homo sapiens
  misc_feature: GYAE6OF02IBXAP.44.85.H08.1.454.CMB.1.raw
  modified_base (170)..(170): a, c, t, g, unknown or other
  misc_feature (170)..(170): n is a, c, g, or t
  modified_base (312)..(312): a, c, t, g, unknown or other
  misc_feature (312)..(312): n is a, c, g, or t
  modified_base (357)..(357): a, c, t, g, unknown or other
  misc_feature (357)..(357): n is a, c, g, or t
  modified_base (360)..(360): a, c, t, g, unknown or other
  misc_feature (360)..(360): n is a, c, g, or t
  modified_base (386)..(386): a, c, t, g, unknown or other
  misc_feature (386)..(386): n is a, c, g, or t
tcagacagtatatacacgaccggtgctcgatttagtatcactcagtcgcggggggagaggagcccagcactagaagtcggcggtgtttccattcggtgatcagcactgaacacagaggactcaccatggagtttgggctgagcttgggttttcctgttgctcttttaagnggtgtccagtgtcaggtgcagcgtggtggagtcgtgggggagcgtggtccagccgtgggagtccctggagacctctccgtgtagccgagtcgtctggatttccgaccttcgaggtaccctatcgcctatgcacgtcggtccncgtacggctccgaggcgaagggctgggaggtggtggactaagttntancaaggacagtgaattggaaactaacncgtaaacggagtaccgaccggaaggaacgggacccgtagttaccgaccggtaccgtacgaacggacgaacaacgttaccaacggtaaaccactacgtacgactaacctctacgacgtaaacgtacgtaaacctaccgtaaccaacgtaacgtagtaacgggaactaaccggtacgttcgttaacgtttacgtttacgttaggtacgtacggtacgacccggtccccgttacggaccggtaccggtccccgttacgttaccgtaccggtaccggg

SEQ ID NO: 276054 - DNA, 694 bp, Homo sapiens
  misc_feature: GYAE6OF02G2HWW.44.85.H08.1.454.CMB.1.raw
  modified_base (289)..(289): a, c, t, g, unknown or other
  misc_feature (289)..(289): n is a, c, g, or t
  modified_base (305)..(305): a, c, t, g, unknown or other
  misc_feature (305)..(305): n is a, c, g, or t
  modified_base (397)..(397): a, c, t, g, unknown or other
  misc_feature (397)..(397): n is a, c, g, or t
tcagacagtatatacacgaccggtgctcgatttagtatcactcagtcgcggggggggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccagccgtgggacgtccctgacgactctcctgtgcagcgtgtggattccaccttcacgtacctagtcggnatgcacgtcgggtccncgagcctcgaggacgacgggtctgggaggtgggtcggtactacttagtagttggtagtagtagtaggtaaaagttaataaacgtacgttaancgtacgaacggttaccgtacccgggtaggaacggggtacctactttaccgaaccctacgttccctaaccggaacgaagtaaaccttaacccgtaccgaaacggaaaccgtacccgttcgttaggtacctacgtacgaaacgtaacgttaacgaaccgcgtaaccgtaggacggtaaccgggacggaaccgaaccgggcggttacgtaggtttacgttacgttacggtcgggtaacggaacggtaaccggatttaacgttaccggtttaacgttaacggttacccttacccggtacgg

SEQ ID NO: 276055 - DNA, 748 bp, Homo sapiens
  misc_feature: GYAE6OF02JCXSB.44.85.H08.1.454.CMB.1.raw
  modified_base (154)..(154): a, c, t, g, unknown or other
  misc_feature (154)..(154): n is a, c, g, or t
tcagacagtatatacacgaccggtgctcgatttagtatcactcagtcgcgggggctgtgggctcagaagcagagttctggggtgtctccaccatggcctggacccctctctggctcactctcctcactcttgcataggttctgtggtttcttcngagctgactcaggaccctgctgtgtctggtggccttgggacagacagtcaggatcacatcgaccaaggagacacgcctacaagaacgcttattactagacaacgtcgtacggtaaccgacgacgaagtaacggccgaacggaccgaccggccccgttagttacttcgtacgtactacctagtaacggtaaaactaaaaacccgaaccccggtaccctaccggtaacgggtaaccgtaccccgaacggtaacccgtaacgtttccgtacggtccggtacctaccgacgtacctacgaaacggaaacctacgtacgtaccctttacctaacgaacccgtaatccgacggtccggggacttaccggacggggtaacggaacgtaggtagggacggtacttacggtaaaccttgtttaacccggcgtaaacccggttacccgggaactaacggtaccggttaacggtaaccttagggtttgggtaccggttcgggaacggggtaccggtacgacggtcggtaaccggtacccgttacggtacggtaccaccggtacccggtaaggcccgttacccgtccccgggttatacccgtaccc

SEQ ID NO: 276056 - DNA, 777 bp, Homo sapiens
  misc_feature: GYAE6OF02IK1O2.44.85.H08.1.454.CMB.1.raw
  modified_base (154)..(154): a, c, t, g, unknown or other
  misc_feature (154)..(154): n is a, c, g, or t
  modified_base (310)..(310): a, c, t, g, unknown or other
  misc_feature (310)..(310): n is a, c, g, or t
  modified_base (373)..(373): a, c, t, g, unknown or other
  misc_feature (373)..(373): n is a, c, g, or t
tcagacagtatatacacgaccggtgctcgatttagtatcactcagtcgcggggggagaggagccccagccttgggattcccaggtgtttccattcggtgatcagcactgaacacagaggactcaccatggagtttggctgagctgggttttccncgttgtctctttaagtaggtgtccagtgtcaggtgcagctggtggagtcgtgggggaggcgtcggtcgagccgtgggaggtccctgagacgtctccgtgtgacagcgtctggattcaccttgtagtacctagtggcatgcaccgttcggggtcccnccgagggcctaccgacgggacgaacggggcgtgggtaggtcggggttcggacctacgtttaanagttaggtagttggaacgtttagggaaaacgttaaaattaaaagttaaccgtattacggactaaacggtaacccgttcccggggttaaggaaacggggtacccgtactttaccgaacccgtaacgttacccgtacccgaaggttaaacgaaacccgttaaacgttaacgaaaacggaaacgtacccggtacttacgggtaatccgtaacgtaaccgtaaaactaacggtaaacctaccggacgttacggaacgttaggacccgggaaacgaccggtaacgggtcccgttagttacggtttacgttaaaccggttcggacggtttaaccgggaacggtttaaccgttaaaggttacggtttacggtaaacccggtttaaccgttaaccccccgtaggttcccggg

SEQ ID NO: 276057 - DNA, 778 bp, Homo sapiens
  misc_feature: GYAE6OF02IV2BJ.44.85.H08.1.454.CMB.1.raw
  modified_base (286)..(286): a, c, t, g, unknown or other
  misc_feature (286)..(286): n is a, c, g, or t
tcagacagtatatacacgaccggtgctcgatttagtatcactcagtcgcgggggctgtgggctcagaagcagagttctggggtgtctccaaccatggcctggacccctctctggctcactctcctcactctttgcataggttctgttggtttcttctgagtctgtactcgacggtaccctgcttgtgttcgtggtaggtcccgtttgggactacgaacaggtcgaggtactacacgtagtacgaccgaaaggacgtaacctacggcctacgagaacgtctagttangaacgacgtcgtacgtacagacagaacgtcgacgacgtaccggtcccctagttacggtctacgtactactagaactaaaacgaaaacccgtacgtacctacgaaggtcctaccggacgtcctaagttcctaccgtcgacccgtactacggtactaacgaaacgaactaaccggccgttttacttacgtaacccggactacgttaccggtaggtacggtccgtaacgggtacggaacggtaaacgtacgagggtaaccgtacgtaacgtttaacgtaaccgttacccgtttaaggaccccgggtaaaccgtaacgtaaacgttacgggttaaacgtacgttacgggttaacgggtaccggttgggaaacccgggttagaacccgggttagtaacccggtccgggttaaccgttacgggtaacccggtacgggtaacccgacggttacccgttcccggaccccgggttacccttacccggaccgtttaccccgg

SEQ ID NO: 276058 - DNA, 882 bp, Homo sapiens
  misc_feature: GYAE6OF02IRL2I.44.85.H08.1.454.CMB.1.raw
tcagacagtatatacacgaccggtgctcgatttagtatcactcagtcgcgggggggagaggagcccagcactagaagtcggcggtgtttccattcggtgatcagcactgaacacagaggactcaccatggagtttgggctgagctgggttttcctcgttgcttcttttaagaggtgtccagtgtcaggtgcagctggtggagttcgtgggggagcggtgtccagcccgtgggacgtccctaggacgtactccgtcctgtacgcgagtccgtagtggtaacttccgtaccttcgaacgttaccttagtcggactaacgtcgacctacggttccgggggtacccaccgtaggggtcccttaccggaaggggtaccgtaaacgggggtccttaggggaacggtttcgggggtcggtacttaacgttttaacgtaaggttcgggttaatagggttaacgttaggggaaaaatttaaacgttaaaacgtttaccgttaagtccggacctaaacgggtaacccctttcggggtaaggtaaaccggggtacccgttaactttaaccccggaaccttaaccggttcccgtaaaccccgtaaagggtaaaccgttaacccgtaaaaccgtttaaccccggaaaacggttaaaccgaccggtttacgttaaacgttaacgtaaccttaaccgggaaaccttaaaaattaccgggaaaacccgtggtaaaccccggttaaggaaaccgggaaccgggtaacccggtaaagggacccgttaccgggtgtttaaaggttaccgtttaacggtttaaccggtcgggtaacggaccgtaaacggtaacctttacgggtttaattaaccgggtaacgtttaacccctaaccggtccgg

SEQ ID NO: 276059 - DNA, 707 bp, Homo sapiens
  misc_feature: GYAE6OF02HK27P.44.85.H08.1.454.CMB.1.raw
  modified_base (172)..(172): a, c, t, g, unknown or other
  misc_feature (172)..(172): n is a, c, g, or t
  modified_base (191)..(191): a, c, t, g, unknown or other
  misc_feature (191)..(191): n is a, c, g, or t
  modified_base (275)..(275): a, c, t, g, unknown or other
  misc_feature (275)..(275): n is a, c, g, or t
  modified_base (309)..(309): a, c, t, g, unknown or other
  misc_feature (309)..(309): n is a, c, g, or t
tcagacagtatatacacgaccggtgctcgatttagtatcactcagtcgcgggggggagaggagcccagcactagaagtcggcggtgtttccattcggtgatcagcactgaacacagaggactcaccatggagtttgggctgagcttgggttttcctcgttgctcttttaagnggtgtccagttgtcaggtncagctggtgagtcgtgggggagcgtgtccagccgtgggacgtcctgagacctctcctgtgcagtcgtcgtggtattccaccttnagtacctagtcggcagtcgactacgtcgggcccnccgtaggcctaccggaggacgtaggggcttagggaggttcgggtacgtactacgttaagtagttaggtatcgaaggtacggtaaacgtttaaataaaacgttcgtaagtacgacctaacgggttaccctaccgggttagggaaaccggggtacccgttaaacggtttaccgaaaccgttaccgtacccgttaaccgaaggtaacgtaaccgttaaactacccgaaaacgtaaaccgtaccggtaccgttagtacgttaacgtacgtaactaaaagtcgaaacgactaccggtacgaacgtacggaccggaacgtaccgacggtacgttagttacgttaagttaccgtaggtcgacgggagtaacgtacgttaagttacgtaaccgttactaccctacg

SEQ ID NO: 276060 - DNA, 781 bp, Homo sapiens
  misc_feature: GYAE6OF02J1CJV.44.85.H08.1.454.CMB.1.raw
  modified_base (150)..(150): a, c, t, g, unknown or other
  misc_feature (150)..(150): n is a, c, g, or t
tcagacagtatatacacgaccggtgctcgatttagtatcactcagtcgcgggggcagaagtctctctcagtcaggacacagcatggacatggacgggtccctgctcagctccgtgggacctcctgctgctcgtggcctccagtactaccngatggtgacctatccgaaggtatccgaacccgtgttcctcctacttcccttccgtgtctcgactacgtcgtcgggagggactacgacggtactaccacctactaccgtaccggttcggggccggtacgtacggtacgtaggtctaacgttaacggtacttaactttacgttacgtccgtagttactacgacgtaacgtaacgtaaaccggacggtaacgtcctaacgtacgtcctacgtagtacgtacgtaacgtacgtaactaccttacgtttcgaaacttttacggccgtaacgggtcctaaggggttcccctaaggttccacgggttccgtaacggtgggtccgtaacgtttcggggaagttactaggggtaaccttcggaactttccgtaccgtaccgtacgtacggtcgtacggtccttaggccgttacgtacctaagggtaccttcgggttaactcgttacctttaaccgtttacgtaaacgtttacggttaaacgttaagtaaccgttaaacgttaccttaacccgtaccgtacggtaacccttcggtaacccgttaaccgttacccgggaaccgtacgggttaaccgtaccgtaaggttacggaactacggttactaaccggg

SEQ ID NO: 276061 - DNA, 507 bp, Homo sapiens
  misc_feature: GYAE6OF01BJ1RV.12.2.A02.1.454.CMB.1.raw
tcagatacgacgtacacgaccggtgctcgatttagactcatctacaggggacccaaaaccacacccctccttgggagaatcccctagatcacagctcctcaccatggactggacctggagcatccttttcttggtggcagcagcaacaggtgcccactcccaggttcagctggtgcagtctggagctgaggtgaagaagcctggggcctcggtgaaggtctcctgcaaggcttctggttacacctttaccagctatggtatcagctgggtgcgacaggccctggacaagggcttgagtggatgggatggatcagcgcttacaatggtaacacagactatgcacagaagttcaggacagagtcacatgacacagacacatccacgagcacagcctacatggagctgaggagcctgagatctagacgacacggccgtgtattacgtgtgcgagtaggtttagtgtatacttagttgtagtggttaggtacctgtcgttcgttttacggg

SEQ ID NO: 276062 - DNA, 513 bp, Homo sapiens
  misc_feature: GYAE6OF01BZ0Y1.12.2.A02.1.454.CMB.1.raw
  modified_base (334)..(334): a, c, t, g, unknown or other
  misc_feature (334)..(334): n is a, c, g, or t
  modified_base (345)..(345): a, c, t, g, unknown or other
  misc_feature (345)..(345): n is a, c, g, or t
tcagatacgacgtacacgaccggtgctcgatttagactcatctacaggggacccaaaaaccacacccctccttgggagaatcccctagatcacagctcctcaccatggactggacctggagcatccttttcttggtggcagcagcaacaggtgcccactcccaggttcagctggtgcagtctggagctgaggtgaagaagcctggggcctcggtgaaggtctcctgcaaggcttctggttacacctttaccagctatggtatcagctgggtgcgacaggccctggacaagggcttggagtggatgggatggatcagcgcttacaatggtaacanagactatgcanagaagttccagacagagtcacatgacacagacacactccacgagacacagcctacataggagcgtgaggagcctagagatcgtagacgacacggcgtagtatacgtgtgcgtagtaggtttagagtatacttagttgtaggtggtggttactgtcgttcgttttcggg

SEQ ID NO: 276063 - DNA, 617 bp, Homo sapiens
  misc_feature: GYAE6OF01BRJ4E.12.2.A02.1.454.CMB.1.raw
tcagatacgacgtacacgaccggtgctcgatttagactcatctacaggggacccaaaaaccacacccctccttgggagaatcccctagatcacagctcctcaccatggactggacctggagcatccttttcttggtggcagcagcaacaggtgcccactcccaggttcagctggtgcagtctggagctgaggtgaagaagcctggggcctcggtgaaggtctcctgcaaggcttctggttaccacctttaccagctatggtatcagctgggtgcgacaggccctggacaagggcttgagtggagtgggatggatcgagcgcttacaatggtaacacagactatgcacagtaagttccaggacagagtacacatgaccacagacacactaccacgagcaacacgcctaacagtggacgctaggacggacgtcccgtaggaacgtattaccgaggtaacccggaccgaacccggggtcccggtttagttaacgtttaccgtgggttacgcgggtaaaggttagggtttttacgtaggttactttaacgtttagtttaggttaacgggtttgggttacggtttacccgttggttcccgttttacggtttttttcccgggg

SEQ ID NO: 276064 - DNA, 592 bp, Homo sapiens
  misc_feature: GYAE6OF01AYWPI.12.2.A02.1.454.CMB.1.raw
tcagatacgacgtacacgaccggtgctcgatttagactcatctacaggggacccaaaaaccacacccctccttgggagaatcccctagatcacagctcctcaccatggactggacctggagcatccttttcttggtggcagcagcaacaggtgcccactcccaggttcagctggtgcagtctggagctgaggtgaagaagcctggggcctcggtgaaggtctcctgcaaggcttctggttacacctttaccagctatggtatcagctgggtgcgacacggccctggacaagggcttggagtggagtgggatggatcgagcgcttacaatggtaacacgagactagtgacaacgagaagttccgaggacagagtcacatgaccacagacacactaccacgagaccacacgcctaacagtggagccgtaggaggacgccgtaggacgatccgtaggaaccgtacgaccgggtacccgttaggttaacttacgtggttcggacggtaaggttacgggtttttagaggttaatttacgtttagtttggttaggttcggttacggttaccgttgttaccgtttcggttttacccggg

SEQ ID NO: 276065 - DNA, 711 bp, Homo sapiens
  misc_feature: GYAE6OF01AGE8L.12.2.A02.1.454.CMB.1.raw
tcagatacgacgtacacgaccggtgctcgatttagactcatctacaggggacccaaaaaccacacccctccttgggagaatcccctagatcacagctcctcaccatggactggacctggagcattcctttttcttggtggcagcagcaacaggtgcccactcccaggttcagctggtgcagtctggagctgaggtgaaggagccgtggggcctcagtaaaaatctcctgcagtcttctggttacgcactcaccgccaatggtatcagctggctgcgacacggccctggacagtcttgagtgatgtcagtggatcagctactttcaagtggaagacaacaaagtagtaggagtaagtaacttccgaggcaagctacaccatacgacacgtagacagaatacaaacgaactagtacgtacctaagttacggaaacgtgggacgggtccgtagggtacggttaccgacggaacccgtaacggtaccccgggttacccctttagttaaacggttttacgttaacgggttacgttaaacggttaaacgtttaaagttttttaaaacggttttttccggttttaaaggttttccggttttaccgggtttagggggtttcgggttttagggtttacggttttaccgggttttaacttaaacgggtttttaccgggtttacggtaaaccccggtttaggggtttaacccccgggggggg

SEQ ID NO: 276066 - DNA, 579 bp, Homo sapiens
  misc_feature: GYAE6OF01DHBCL.12.2.A02.1.454.CMB.1.raw
  modified_base (339)..(339): a, c, t, g, unknown or other
  misc_feature (339)..(339): n is a, c, g, or t
  modified_base (371)..(371): a, c, t, g, unknown or other
  misc_feature (371)..(371): n is a, c, g, or t
  modified_base (394)..(394): a, c, t, g, unknown or other
  misc_feature (394)..(394): n is a, c, g, or t
  modified_base (405)..(405): a, c, t, g, unknown or other
  misc_feature (405)..(405): n is a, c, g, or t
  modified_base (418)..(418): a, c, t, g, unknown or other
  misc_feature (418)..(418): n is a, c, g, or t
  modified_base (423)..(423): a, c, t, g, unknown or other
  misc_feature (423)..(423): n is a, c, g, or t
tcagatacgacgtacacgaccggtgctcgatttagactcatctacaggggacccaaaaaccacacccctccttgggagaatcccctagatcacagctcctcaccatggactggacctggagcatcctttttcttggtggcagcagcaacaggtgcccactcccaggttcagctggtgcagtctggagctgaggtgaagaagcctggggcctcggtgaaggtctcctgcaaggcttctggtacacctttaccagctatggtatcagcgtgggtgcgacgacggccctggacaagggctgagtggatgggatggatcgagcgtacttacgaatggtaacanagactatgcacagaagttcagacagatcacancgacacagacacactccacgacncacacgcctanatgagcgtgacgngccgngagatcgtacgacgacgacggtcccgtagttactaaccggttggtacgtacggtaggttaagggtttttagtaggtaatttacctttaagtttggttaacggtttcggggtttacggttacccgtttggttccgttttacggttttttacccgggg

SEQ ID NO: 276067 - DNA, 580 bp, Homo sapiens
  misc_feature: GYAE6OF01A5L5B.12.2.A02.1.454.CMB.1.raw
  modified_base (404)..(404): a, c, t, g, unknown or other
  misc_feature (404)..(404): n is a, c, g, or t
tcagatacgacgtacacgaccggtgctcgatttagactcatctacaggggacccaaaaaccacacccctccttgggagaatcccctagatcacagctcctcaccatggactggacctggagcatccttttcttggtggcagcagcaacaggtgcccactcccaggttcagctggtgcagtctggagctgaggtgaagaagcctggggcctcggtgaaggtctcctgcaaggcttctggttacacctttaccagctatggtatcagctgggtgcgacaggccctggacaagggcttgagtggatgggatggatcagcgcttacaatggtaacacagactatgcacagaagtcaggacagagtcacatcgaccacagacacatccacgagcacagcctacatggancgtggaacggacgacccgttagaacgactacgtacggaaccgtaccgaccgggtccgttaggttaacttacgtggtcgacggtaaggttagggtttttagtaggtaactttacgtttagttggttagggttcggttacgggttaaccctggttaccgtttacggtttttcccgggg

SEQ ID NO: 276068 - DNA, 550 bp, Homo sapiens
  misc_feature: GYAE6OF01A8VC7.12.2.A02.1.454.CMB.1.raw
tcagatacgacgtacacgaccggtgctcgatttagactcatctacaggggacccaaaaaccacacccctccttgggagaatcccctagatcacagctcctcaccatggactggacctggagcatccttttcttggtggcagcagcaacaggtgcccactcccaggttcagctggtgcagtctggagctgaggtgaagaagcctggggcctcgggtgaaggtctcctgcaaggcttctggttacacctttaccagctatggtatcagctgggtgcgacaggccctggacaagggcttgagtggatgggatggatcagcgcttacatggtaacacagactatgcacagaagttcaggacagagtcacatgaccacagacacatccacgagcacacgcctacatggagctaggaggagcctgagactcgtgaccgtacgacggtccgtagttattaacgtggtagtccggaaggttagggttttagtagtatttacgttagtttggttagggttgggttacggttacgttgtccgtttcggtttttaccgggg

SEQ ID NO: 276069 - DNA, 532 bp, Homo sapiens
  misc_feature: GYAE6OF01ANSL4.12.2.A02.1.454.CMB.1.raw
tcagatacgacgtacacgaccggtgctcgatttagactcatctacaggggacccaaaaaccacacccctccttgggagaatcccctagatcacagctcctcaccatggactggacctggagcatccttttcttggtggcagcagcaacaggtgcccactcccaggttcagctggtgcagtctggagctgaggtgaagaagcctggggcctcggtgaaggtctcctgcaaggcttctggttacacctttaccagctatggtatcagctgggtgcgacaggccctggacaagggcttgagtggatgggatggatcagcgcttacaatggtaacacagactatgcacagaagttcaggacagagtcaccatcgaccacagacacatccacgagcacacgcctacatggagctggaggacgcctgagactacgtgaccgacacgggtccgtagtattacgtgtcggcgtaggtaggttttagtgtattacttagttgttaggtggttacggttacctggtcgttacgttttccggg

SEQ ID NO: 276070 - DNA, 558 bp, Homo sapiens
  misc_feature: GYAE6OF01BWD5G.12.2.A02.1.454.CMB.1.raw
  modified_base (378)..(378): a, c, t, g, unknown or other
  misc_feature (378)..(378): n is a, c, g, or t
  modified_base (427)..(427): a, c, t, g, unknown or other
  misc_feature (427)..(427): n is a, c, g, or t
tcagatacgacgtacacgaccggtgctcgatttagactcatctacaggggacccaaaaaccacacccctccttgggagaatcccctagatcacagctcctcaccatggactggacctggagcatccttttcttggtggcagcagcaacaggtgcccactcccaggttcagctggtgcagtctggagctgaggtgaagaagcctggggcctcggtgaaggtctcctgcaaggcttctggttacacctttaccagctatggtatcagctgggtgcgacacggccctggacaagggcttgagtggagtgggatggatcgagcgcttacaatggtaacacgagactatgcaacagagttccaggacagagtcacatgaccanacgacacatccacgagacacgagaccctacagtggacgcgtaggacggngcctagagactcgtagaccgtacgacggtccgttagtacttacgtggtaggcggtaggttagggttttagagttattacgttagtttggttaagttgggttacggttacctggtcgtttagttttccgggg

SEQ ID NO: 276071 - DNA, 532 bp, Homo sapiens
  misc_feature: GYAE6OF01ENG6L.12.2.A02.1.454.CMB.1.raw
  modified_base (337)..(337): a, c, t, g, unknown or other
  misc_feature (337)..(337): n is a, c, g, or t
  modified_base (413)..(413): a, c, t, g, unknown or other
  misc_feature (413)..(413): n is a, c, g, or t
  modified_base (454)..(454): a, c, t, g, unknown or other
  misc_feature (454)..(454): n is a, c, g, or t
tcagatacgacgtacacgaccggtgctcgatttagactcatctacaggggacccaaaaaccacacccctccttgggagaatcccctagatcacagctcctcaccatggactggacctggagcatccttttcttggtggcagcagcaacaggtgcccactcccaggttcagctggtgcagtctggagctgaggtgaagaagcctggggcctcggtgaaggtctcctgcaaggcttctggttacacctttaccagctatggtatcagcgtgggtgcgacgaggccctggacaagggcttgagtggagtgggatggatcgagcgcttacaatggtaacanagactatgcacagagtcagacagagtcacatgacacagacacatccacgagcacacgcctacatggagctggaggngccgtagagtatcgtagacgaacacgggtcgtgtatactgngcggtagttaggtttagtagtattacgttagttaggtaggttcgggttagttaccgttgttccgtttacgttttcggg

SEQ ID NO: 276072 - DNA, 690 bp, Homo sapiens
  misc_feature: GYAE6OF01DKJ87.12.2.A02.1.454.CMB.1.raw
  modified_base (177)..(177): a, c, t, g, unknown or other
  misc_feature (177)..(177): n is a, c, g, or t
  modified_base (187)..(187): a, c, t, g, unknown or other
  misc_feature (187)..(187): n is a, c, g, or t
  modified_base (448)..(448): a, c, t, g, unknown or other
  misc_feature (448)..(448): n is a, c, g, or t
tcagatacgacgtacacgaccggtgctcgatttagactcatctacaggggacccgaaaaaccgacacccctccttgggagaactcccctagatcacagctcctcaccatggactggacctggagcatccttttctggtggcagcagcaacaggtcgcccactccaggttcagctggncagtctgganctgagtgaagagccgtggggcctcgggtgaacggtctccgtgaccaaggtcttcgtcggttacctacccgttttacgagtccttagtggtactcagtcgtgggtcgaccgacgaccggcccgtaggacgtaacgggtcgttaggaggttggagtgggtatggatccgagtcgtacttaacgagtacggtaacacgtaatacttagacgacaacgtaaggtaacgttcgaagtacgagtacggtccaacgagtaccgaccanacgaacacctaactaccgaacgacgtaccaacgacgtacccttagaacggtcggaacgttcgacggaaggtccacgttaggactacgttacaacgggacctacggaccggtcgtttagtacgtttcgtacggtaggtacggtacgggtttaaagttttcggtaagttacccttttaagtttagggtacgtttaggggtccgttacggttaccgttcgttccggtttacggttttacccgggg

SEQ ID NO: 276073 - DNA, 646 bp, Homo sapiens
  misc_feature: GYAE6OF01DU9ZI.12.2.A02.1.454.CMB.1.raw
tcagatacgacgtacacgaccggtgctcgatttagactcatctacaggggacccaaaaaccacacccctccttgggagaatcccctagatcacagctcctcaccatggactggacctggagcatccttttcttggtggcagcagcaacaggtgcccactcccaggttcagctggtgcagtctggagctgaggtgaagaagccgtggggcctcggtgaaggtctcctgcaaggtcttcgtggttactacctttaccagctatggtatcagtcgtgggtgcgacgacggccctaggacgaagggcttggagtggagtgggtatggatcgagcgtacttaacaagtaggtaaacacgagtactagtcgacaacgtaagtaacgttaccgaaggtaacaggtacgtacaaccgtaagtaccgaaccaacgaacgaaccaacacgtacccgaacgacgacccaacgaccgaccctaacgacggtaggacgtacgtaggaacggacgtccgtaggaagtacgtaccgtacggaaccgtaccgaccggtcgttagttacgttacgtggtcggacgtaggttaggttttagtagtatttagttagttaggttaggttcggttcgttaccttgttccgtttcggttttacccggg

SEQ ID NO: 276074 - DNA, 671 bp, Homo sapiens
  misc_feature: GYAE6OF01DOHRN.12.2.A02.1.454.CMB.1.raw
tcagatacgacgtacacgaccggtgctcgatttagactcatctacaggggacccaaaaaccacacccctccttgggagaatcccctagatcacagctcctcaccatggactggacctggagcattccttttcttggtggcagcagcaacaggtgcccactcccaggttcagctggtgcagtctggagctgaggtgaagaagccgtggggcctcggtgaaggtctcctgcaaggtcttcgtggttaccacctttaccagtctagtggtatcgagtcgtgggtgcgacgacggcccgtaggacgagggcttaggaggtggagtgggatggatcgagcgtacttaacaagtcggtaaacacgaagtactatgacaacgaagtaacgttccgaaggaacaggacgtaccaacctatacgaacccaacgaacgaccaactacgtacccgaacggacgtaccaaaccacggtaccctaacgtacgtagggaacgtccgtaagggacggtacgtacccgtagaagtactcggtacgaaccgtaccgaccggtccgttagtaaccttcgtggtacgtacgtaagggttaggttttacgagttaaccttaagttttaggttaggttacggttacgggtttacgttaaccgttgtttaaccgtttcggtttttacccgggg

SEQ ID NO: 276075 - DNA, 666 bp, Homo sapiens
  misc_feature: GYAE6OF01DFCVV.12.2.A02.1.454.CMB.1.raw
tcagatacgacgtacacgaccggtgctcgatttagactcatctacaggggacccaaaaaccacacccctccttgggagaatcccctagatcacagctcctcaccatggactggacctggagcattccttttcttggtggcagcagcaacaggtgcccactcccaggttcagctggtgcagtctggagctgaggtgaagaagccgtggggcctcgggtgaaggtctcctgcaaggcttctggttaccacctttaccagctagtggtatcagcgtgggtgcgacgacggccctaggacgaagggcttggaggtggagtgggatggatcgagcggtacttaacgaagttacgggtaaacacgtaagacctagtcggaccaacgaagtaacgttaccgaaggaacaggaacgtaccaaccgagtacgaacccaacgacgtaaccaccaactaccgaacggactaccaacgaccgtactaaccgagtaggacacgtggaacggacgcctagacgactccgtaggaccgtacggaccggtacgttaggttacttacgtaggtaggtacggtagggttttagggttttacgtagttactttaacgtttagttagggttaagggttcgggttaggttaacccgttggttacccgtttttcggttttacccgggg

SEQ ID NO: 276076 - DNA, 715 bp, Homo sapiens
  misc_feature: GYAE6OF01DP8NR.12.2.A02.1.454.CMB.1.raw
  modified_base (510)..(510): a, c, t, g, unknown or other
  misc_feature (510)..(510): n is a, c, g, or t
tcagatacgacgtacacgaccggtgctcgatttagactcatctacaggggacccaaaaaccacacccctccttgggagaatcccctagatcacagctcctcaccatggactggacctggagcattccttttcttggtggcagcagcaacaggtgcccactcccaggttcagctggtgcagtctggagctgaggtgaagagccgtggggcctcggtgaaggtctcctgccaaggtcttcgtggttacctaccgtttaccagtcttatggtatcgagtcgttgggtacgccgaacgacggccctaggaaccgtaaggggtcttggaggtggagtggggtatggatacgaggtcgtacttaacgaagttagggtaaccacgaacgtaccttagcgactaacgaaggtaaacgttcgaaggaacaacggacgtaccaacgagtacgaaacctacgaacgaaccactaccgtaccgaacgaacgtaccacgaacggtacctacgaggttacgganaccggtaggacggtaaccgccgtagggacgtaacgtactaccgggaacgggtaccgtaccgggtacgttacgtaacgtttacgtacgggttcgaacgggttagttttacgggttttagtaggttaactttacggttaagtttcgggtaaacgtttcggggttaccgtttaccgttacggttccggttttaaggttttccccgggg

SEQ ID NO: 276077 - DNA, 706 bp, Homo sapiens
  misc_feature: GYAE6OF01DVMTC.12.2.A02.1.454.CMB.1.raw
  modified_base (284)..(284): a, c, t, g, unknown or other
  misc_feature (284)..(284): n is a, c, g, or t
tcagatacgacgtacacgaccggtgctcgatttagactcatctacaggggacccaaaaaccacacccctccttgggagaatcccctagatcacagctcctcaccatggactggacctggagcatcctttttcttggtggcagcagcaacaggtgcccactcccaggttcagctggtgcagtctggagctggaggtgaagaagccgtgggcctcggtgaaggtctcctgcgaaggtcttcgtaggttacctaccttttaccagtctatggtatcagtcgtgggtnacaacgcggccccgtaggaacgaaggtcgttggagtggagtggggatggatcgagcgtacttaacagtaggtaacacgaagtactagtcgacaacgaagtaacgttaccgaagggaactaaggtacgtacaacccgtataccgaaccacgaacgaaccaacaccgtaccgaacgacgacccaaccgacgtacctaacgacgtacggaagccgtaggaaggccgtaccaggacgattacggacgaacggtaaccgaccgggtcgttaacgttacgttaacggttcggtacggtacgggttaagggttttaacgggttttaaggttacgttaaggtttaactttttaagggtttaggtttagggttacggggtttacggttaaccggtttcggtttacccgttttacggtttttaccccggggg

SEQ ID NO: 276078 - DNA, 624 bp, Homo sapiens
  misc_feature: GYAE6OF01EX9Y1.12.2.A02.1.454.CMB.1.raw
  modified_base (422)..(422): a, c, t, g, unknown or other
  misc_feature (422)..(422): n is a, c, g, or t
  modified_base (470)..(470): a, c, t, g, unknown or other
  misc_feature (470)..(470): n is a, c, g, or t
tcagatacgacgtacacgaccggtgctcgatttagactcatctacaggggacccaaaaaccacacccctccttgggagaatcccctagatcacagctcctcaccatggactggacctggagcatccttttcttggtggcagcagcaacaggtgcccactcccaggttcagctggtgcagtctggagctgaggtgaagaagccgtgggcctcggtgaggtcgtcctgcaaggcttctggttacgtacctttacctagctatggtatcagcgtgggtgcgacacggcccgtggacgaacgggcttcggtaggtgggtagtggggtaggtggtagtcgtagcgtacttaacgtaagtaggtaaacacgaagtactatagcaacgagtaacgttacaggacagagtacacatcgacacagacaacnctacacgacgacacagcctacagtcggagcgtaggacggacgtaccgnggaactacgtacgtacggaaccgacgacccgggtcgtagttacgttacgttcggtaggtacggtacggttaagggtttttacggttagtaacttaacgttttagttagggttagttgggttcggtaacctttgtccgttcgggtttttaccggg

SEQ ID NO: 276079 - DNA, 562 bp, Homo sapiens
  misc_feature: GYAE6OF01CV1HK.12.2.A02.1.454.CMB.1.raw
  modified_base (400)..(400): a, c, t, g, unknown or other
  misc_feature (400)..(400): n is a, c, g, or t
tcagatacgacgtacacgaccggtgctcgatttagactcatctacaggggacccaaaaaaccacacccctccttgggagaatcccctagatcacagctcctcaccatggactggacctggagcatcctttttcttggtggcagcagcaacaggtgcccactcccaggttcagctggtgcagtctggagctgaggtgaagaagcctggggcctcggtgaaggtctcctgcaaggcttctggttacacctttaccagctatggtatcagctgggtgcgacaggccctggacaagggcttgagtggatgggatggatcagcgcttacagtggtaacacagactatgcacagaacgttcaggacagagtcacatcgaccacagacacactaccaacgagccaanacgacctacacgtggagccgtaggaacggtacgccctaggagtactcgtacgacgtacgacggtccgtagttattaccgtgtcgcgtaggtaggttttagagtattacgtttagttggttaggttgggttacggttaccttggtcgttttacgttttccggg

SEQ ID NO: 276080 - DNA, 818 bp, Homo sapiens
  misc_feature: GYAE6OF01DGLEK.12.2.A02.1.454.CMB.1.raw
  modified_base (156)..(156): a, c, t, g, unknown or other
  misc_feature (156)..(156): n is a, c, g, or t
  modified_base (653)..(653): a, c, t, g, unknown or other
  misc_feature (653)..(653): n is a, c, g, or t
  modified_base (667)..(667): a, c, t, g, unknown or other
  misc_feature (667)..(667): n is a, c, g, or t
tcagatacgacgtacacgaccggtgctcgatttagactcatctacaggggacccaaaaaccaccacccctccttgggagaactcccctagatcacagctccctcaccagtggactggacctggagctattcctttttgtggtggcagcagcaacgnggtcgcccacctcccgaggttcacgtcgtggtcgacgtagtcgtagggacgtcgtaggaggtagaaaggaccggtccggtcggggtccgtgggtaggaaccggttcctccgtaggacgtacggttcctttaccggttaccggtttaaccctaccgttttaccgacgtacgttaacgtgggttaactccggtaggtcgggttgggaccggaacccgaaccggtcccggtacccggtaagggaaccggtaaggggttcgttagggtacgggttaggggaggttacggggaagttacgggacgttacccggaaggtttaccgtaacgttaaagaaaacggttaccgtaaaaccaggtaacgtaaacgtagtaacggaacctaaaggtaacggtaaccgtacgaaacgggttacaacgtaccgtaaacacgttagtacccgaaacgaacgttacgacaccgtaacacgaaacgtcaacgtacgaacgccaaagtgaggtanccggtagacgacgnttaggaactcgtaacgcggaaccgtacgtcggttatacggttacgttcgtcggagtaacggggttaagttttaaggttaccgatttaacggtttgttaagggtggtttaacggtcgttacgcgtttacggtttgttacccgtttaccgggg

SEQ ID NO: 276081 - DNA, 744 bp, Homo sapiens
  misc_feature: GYAE6OF01EPAC5.12.2.A02.1.454.CMB.1.raw
tcagatacgacgtacacgaccggtgctcgatttagactcatctacaggggacccaaaaaccacacccctccttgggagaatcccctagatcacagctcctcaccatggactggacctggagcatccttttcttggtggcagcagcaacaggtgcccactcccaggttcagctggtgcagtctggagctgaggtgaagaagccgtggggcctggtgaaggtctcctgcaaggtcttcgtggttacctacctttacagtctagtggtatcgagtcgtgggtcgcgacgacggcccgtaggaacgagggtcttggaggtggagtgggagtggatcgagtcgtacttaacgaagtacggtaacacgtagtactagacgacaacgtaaggtaacgttaccgaaggtacagtacgtaccaactagtacgaacctacgaacgaaccacctaaccgtaccgaacggacacctaacgaacgtacctaacgaggtcgggtaacgtcgtagggaacggtacgtccgtaaggacgtacgtaccggtaacggaaccggtacccgaccggggttacttaacggttaacgttacgtagggtacggtaccgggtttaaaggggttttacgggttttaacgttaaggtttaaccgttttaaacggttttaaggtttacggggttaacgggtttacggggttttaccgttaaccgttttcgggttttaacccgtttttaccggggtttttaacccccggggg

SEQ ID NO: 276082 - DNA, 614 bp, Homo sapiens
  misc_feature: GYAE6OF01EY3KN.12.2.A02.1.454.CMB.1.raw
  modified_base (105)..(105): a, c, t, g, unknown or other
  misc_feature (105)..(105): n is a, c, g, or t
  modified_base (185)..(185): a, c, t, g, unknown or other
  misc_feature (185)..(185): n is a, c, g, or t
  modified_base (195)..(195): a, c, t, g, unknown or other
  misc_feature (195)..(195): n is a, c, g, or t
  modified_base (275)..(275): a, c, t, g, unknown or other
  misc_feature (275)..(275): n is a, c, g, or t
  modified_base (308)..(308): a, c, t, g, unknown or other
  misc_feature (308)..(308): n is a, c, g, or t
  modified_base (338)..(338): a, c, t, g, unknown or other
  misc_feature (338)..(338): n is a, c, g, or t
  modified_base (344)..(344): a, c, t, g, unknown or other
  misc_feature (344)..(344): n is a, c, g, or t
  modified_base (472)..(472): a, c, t, g, unknown or other
  misc_feature (472)..(472): n is a, c, g, or t
  modified_base (556)..(556): a, c, t, g, unknown or other
  misc_feature (556)..(556): n is a, c, g, or t
tcagatacgacgtacacgaccggtgctcgatttagactcatctacaggggacccaaaaaccacacccctccttgggagaatcccctagatcacagctcctcaccntggactggacctggagcacttcctttttcttggtggcagcagacaacgaggtcgacccacctcccgaggttcagctggtncagtctgganctgaggtgaagacgccgtgggcctcggtgaacggtcctcgtgacaaggtcttcgtcggttacctaccctttaccgagttnctagttggtactcgtagtcgtcgggtcggccgnacgaccggaccccgtcggacgaaggtcgangtgtanttaggtagtacgggacgtacgtacgtacgtacgtacgtaacgttaacgtaacgtacgtaacgacgtacgtacgtacgtacgacgaacgtacgtacgtacgacgacgacgacacacacacacacacacnacaccacgccgacgacctacgacgtaccggtacgacggtaggacggtacgaccggtaggacgtacgtacgacgtaccgtaccgnaccggtaccgtacggtccgttacgtagttacgtcggtagtagttagtagtttagtacg

SEQ ID NO: 276083 - DNA, 773 bp, Homo sapiens
  misc_feature: GYAE6OF01AFL7Q.12.2.A02.1.454.CMB.1.raw
tcagatacgacgtacacgaccggtgctcgatttagactcatctacaggggacccaaaaaccacacccctccttgggagaatcccctagatcacagctcctcaccatggactggacctggagcatccttttctggtggcagcagcaacaggtgcccactcccaggttcagctggtgcagtctggagctgaggtgaagaagccgtggggcctcggtgaaggtctcctgcaaggcttctggttacacctttaccagctagtggtatcgagcgtgggtgcgacgacggccctaggacaagggtcttgacggtggtagtgggacgtaggacgtcgaacggccgtacgttacgaagtacggttaaacacgaagacgttacgtgaccgaacgagtaacgttaccgaagggtacaaggtaacgtaccaacctacgtacgaaccacgaacgaccacacgtacccacgacgtacaaccgacgtacctaacgacgttaggaacgccgtagggaacggtacgaccgttaggaacgtacgtccgtaacggacccgtaccggtaacccgggtccgtttacgtaacgtttacggtaggttaccgggtacgggttaaacgggtttaaaggggttttttaacggtagtttaaaccggttttaaccggtttttaaaggttttacggggttttaaacggggttttaccgggggtttaaccgggttttaaaccccggtttcggggtttttaaacccgttttttaaaccggggttttttttccccccggggggg

SEQ ID NO: 276084 - DNA, 738 bp, Homo sapiens
  misc_feature: GYAE6OF01CEVJK.12.2.A02.1.454.CMB.1.raw
tcagatacgacgtacacgaccggtgctcgatttagactcatctacaggggacccaaaaaccacacccctccttgggagaatcccctagatcacagctcctcaccatggactggacctggagcattccttttctggtggcagcagcaacaggtgcccactcccaggttcagctggtgcagtctggagctgaggtgaagacgcgtgggcctcggtgaagtctccgtgacaaggtcttcgtcgttacctacctttacgagtctagtggtactcgagtcgttgggtcgccggaaccgaccgggcccgtaggaacggtagggtcgttagggaggtggtacggtgggtagttcggactacgacgtccgttacgttaacgaacgttaacggaacacgaagtacgttacgacgacgtacgaacggtaacgtacgacgtaacgtacggtacgtaccctaacgacgtaccaaccgtacgaacgaaccctacgtaacccgtacccgaacgtaacgacccgtaaccgtacgtacccgtaaggtacgtacgggtacgtacggtaggaccggtacgacgtagtactccggtacgtaccggaaccgttccgggaccgttacgttcgttagtacgggtacgttaggtaagggttacggttaagttacggttattacggtttaggtttagttagggtccggtttacggttacccgtttagggttcccgttttcgggtttcccggttaccccgggg

SEQ ID NO: 276085 - DNA, 625 bp, Homo sapiens
  misc_feature: GYAE6OF01D1WSC.12.2.A02.1.454.CMB.1.raw
tcagatacgacgtacacgaccggtgctcgatttagactcatctacaggggacccaaaaaccacacccctccttgggagaatcccctagatcacagctcctcaccatggactggacctggagcattcctttttcttggtggcagcagcaacaggtgcccactcccaggttcagctggtgcagtctggagctgaggtgaagaagccgtggggcctcggtgaaggtctcctgcaaggctttctggttacctacctttaccagtctatggtatcagcgtgggtgcgacgacggccctggacgaaggtcttggagtggagtgggatggatcgagcgtacttaacaaagtaggtaaacaacgagtaactatcgacaacgaagtaacgttccgaaggaacacggacgtaccaaccagtacgaaccaacgacgaaccaaccactaccgaacgacgacaacgacgacctacagtggacgcgtaggacggacgccgtagagaactcgtacggacgacgaccggtccgtagttacttacgtgtgacggtaggttaggttttaggtagttaactttacgttagtttaggttacggttgggttacggttaccgtcgtttcgtttcgttttacccgggg

SEQ ID NO: 276086 - DNA, 655 bp, Homo sapiens
  misc_feature: GYAE6OF01CMNVE.12.2.A02.1.454.CMB.1.raw
  modified_base (277)..(277): a, c, t, g, unknown or other
  misc_feature (277)..(277): n is a, c, g, or t
  modified_base (439)..(439): a, c, t, g, unknown or other
  misc_feature (439)..(439): n is a, c, g, or t
  modified_base (488)..(488): a, c, t, g, unknown or other
  misc_feature (488)..(488): n is a, c, g, or t
tcagatacgacgtacacgaccggtgctcgatttagactcatctacaggggacccaaaaaccacacccctccttgggagaatcccctagatcacagctcctcaccatggactggacctggagcatccttttcttggtggcagcagcaacaggtgcccactcccaggttcagctggtgcagtctggagctgaggtgaagaagccgtggggcctcggtgaaggtctcgtgcaaggtcttcgtggttacacctttaccagtctatggtatcgagcgttggngcgacgacggccctggaacacgggtcttaggaggttggagtgggactggatcgagcgtacttaacgaagttacggtaacagaacgtacttagcgaacaacgtaaggtaaacgttccgaaaggtaccgaaggtacgtaccaaccgtaagcgaacccacgtaanacccaagtacaccaacggacacctaacgacgaccctaagagtcgggacncggtagacggacgtcgtagagttacaccgtggaacccgacgtccggtacgttagttaactcgtggtacggacggttaaggttacggtttttacaggttaaatttccgtttagttcggtttaggtcgggttacttaaccgtttgtaccgttttaaggttttcccgggg

SEQ ID NO: 276087 - DNA, 676 bp, Homo sapiens
  misc_feature: GYAE6OF01EGD5T.12.2.A02.1.454.CMB.1.raw
  modified_base (407)..(407): a, c, t, g, unknown or other
  misc_feature (407)..(407): n is a, c, g, or t
  modified_base (439)..(439): a, c, t, g, unknown or other
  misc_feature (439)..(439): n is a, c, g, or t
  modified_base (447)..(447): a, c, t, g, unknown or other
  misc_feature (447)..(447): n is a, c, g, or t
tcagatacgacgtacacgaccggtgctcgatttagactcatctacaggggacccaaaaaccacacccctccttgggagaatcccctagatcacagctcctcaccatggactggacctggagcatccttttcttggtggcagcagcaacaggtgcccactcccaggttcagctggtgcagtctggagctgaggtgaagagccgtggggcctcggtgaaggtctccgtgcaaggtcttctggttacacctttaccagctatggtatcagcgtgggtgcgtacacggccctggacagggcttgacgtggagtgggatggatcgagcgtcgttacaagtacggtaacacgagtactagtcgacaagacgtaacgttaccaggacgagagtaccgacgatacgaccaacganaccgactacaccgacgacgacacacgacctanagtggacncgtaggacggactcccggtagaacgtacgtaccgtacgggaacccgtaccggtaaccgggtcccggtttaggttaacgtttacccggtaggttacgggtacccggtaagggttttaacgggtttttaaagttggttaaacgtttaccgttttaaggttaggtttacggggttcgggtttaccggttaaccggttttcggtacccgtttttacgggtttttaccccgggg

SEQ ID NO: 276088 - DNA, 611 bp, Homo sapiens
  misc_feature: GYAE6OF01CF8VY.12.2.A02.1.454.CMB.1.raw
tcagatacgacgtacacgaccggtgctcgatttagactcatctacaggggacccaaaaaccacacccctccttgggagaatcccctagatcacagctcctcaccatggactggacctggagcatccttttcttggtggcagcagcaacaggtgcccactcccaggttcagctggtgcagtctggagctgaggtgaagaagcctggggcctcggtgaaggtctcctgcaaggcttctggttacacctttaccagctatggtatcagctgggtgcgacgacggccctggacaagggcttgagtggatgggatggatcgagcgacttaacaatacggtaaacacgaagactatgacaacgagaacttcgaaggaacagatacgaccatcgaacacgaagacacactaccacgagacaacacgacctacagtacggagacgtaggacggacgccgtaggaagtataccgtacggaaccggaccgtaccggtaccggtagttacgttaccgtaggtggacggtaagggttaaggttttacggagttacgtttactttaaggttggttaaggttcgggttacggtacgtttcggtgttttaccgtttttacccgggg

SEQ ID NO: 276089 - DNA, 623 bp, Homo sapiens
  misc_feature: GYAE6OF01BKX49.12.2.A02.1.454.CMB.1.raw
tcagatacgacgtacacgaccggtgctcgatttagactcatctacaggggacccaaaaaccacacccctccttgggagaatcccctagatcacagctcctcaccatggactggacctggagcatccttttctggtggcagcagcaacaggtgcccactcccaggttcagctggtgcagtctggagctgaggtgaagaagcctggggcctcggtgaaggtctcctgcaaggcttctggttaccacctttacagctatggtatcagctgggtgcgacacggccctggacgaaggtcttggaggtggagtgggatggatcgagcgacttacaagtggtaaacacagactatcgacacgagaacgttcaaggacagacgtcaacatacgaccacacgaccacactaccgaacgacgacccaacgacgtaccctacgagttacgggacgtcgtagggaacggtacgtacccgtaggaacgtactacggtacggaaccgtaaccggtaccgggtccgttagttacttacgtggtcggtacgtagggtttaggtttgtagtacgtttactttagttggttaaggttcgggttacggttaccttggttaccgttttcggttttacccgggg

SEQ ID NO: 276090 - DNA, 706 bp, Homo sapiens
  misc_feature: GYAE6OF01DPD11.12.2.A02.1.454.CMB.1.raw
  modified_base (342)..(342): a, c, t, g, unknown or other
  misc_feature (342)..(342): n is a, c, g, or t
  modified_base (355)..(355): a, c, t, g, unknown or other
  misc_feature (355)..(355): n is a, c, g, or t
tcagatacgacgtacacgaccggtgctcgatttagactcatctacaggggacccaaaaaccacacccctccttgggagaatcccctagatcacagctcctcaccatggactggacctggagcatccttttcttggtgtcagcagcaacaggtgcccactcccaggttcagctggtgcagtctggagctgaggtgaagaagccgtggggcctcggtgaaggtcctcctgcaaggtcttctaggttactacctttaccagtctatggtatcagcgtgggtcgcgacgacggcccgtaggacgaagggcttggagtggtagtgggatggatcgaggcgacttaanagtaggtaaccanacgactagtcgacgaacgtaagtaacgttaccgaggtaacgagtacgtaccacgtacgtacgaacctacgaacgaaccaacaactcccgaacggacgaacaaccgacgtccctaaagcgtaggtacgtcggtaggaacggaccggtacgtaggtaacgtacgttaccgacggtaaccgtaccggaccgggttaccgttacgttacgttacgttggtccgggtaacggttaacgggtttaacggggttttagtacggttaacgttttaacgttttaggtttagggttaacggggttcgggttaacggttaccgtttcggtttacccggtttttacggtttttaccccggggg

SEQ ID NO: 276091 - DNA, 711 bp, Homo sapiens
  misc_feature: GYAE6OF01CC83K.12.2.A02.1.454.CMB.1.raw
  modified_base (501)..(501): a, c, t, g, unknown or other
  misc_feature (501)..(501): n is a, c, g, or t
tcagatacgacgtacacgaccggtgctcgatttagactcatctacaggggacccaaaaaccacacccctccttgggagaatcccctagatcacagctcctcaccatggactggacctggagcatcctttttcttggtggcagcagcaacaggtgcccactcccaggttcagctggtgcagtctggagctgaggtgaagaagccgtggggcctcggtgaaggtcctccgtgcaaggtcttcgtcggttacctacctttaccagtctagtggtatcgagcgtgggtcgcgacgacggcccgtaggaccgaagggtcttaggaggtaggagtagggagtggtactcgacggtcgtacttaacgaagttacggtaaacacaagtacttagtcgacaacgtaagtaacgttaccgaaggacaggtacgtaccaactatacgaaccaacgaacgaaccaacctactaccgaacggacgaccaacgacgtacctacgtacgtgggacncgtaggacggtacgtaccgtaggacgtacgtacgtaccggaaccgtaccggtaccggttcgttacgttacgttacggtcggtacggtacgggttaagggtttaggtttagttacggttaacgttttacggtttaggtttaagggtttacgggttacgggtttacggttaccggtttcggtttccggtttttaaccgggttttccccgggg

SEQ ID NO: 276092 - DNA, 729 bp, Homo sapiens
  misc_feature: GYAE6OF01DXKPB.12.2.A02.1.454.CMB.1.raw
tcagatacgacgtacacgaccggtgctcgattttagactcatctacaggggacccaaaaaaccacacccctccttgggagaatcccctagatcacagctcctcaccatggactggacctggagcatccttttcttggtggcagcagcaacaggtgcccactcccaggttcagctggtgcagtctggagctgaggtgaagaagccgtggggcctcggtgaaggtctcctgcaaggcttctggttacacctttacagtctatggtattcgagctgggtgcgacgacggccctggaccgaaggtcttgagtggagtgggatggatcgagcgtcttacgaattcggtaacacgagtaactagtcgacaacgtaagaacgtttccgaaaggtaaccaggtaacgtaccaaaccgtagtacgaacccaacgaacgaccaaccgtaacgtaccgaacggacgtaccaaccgacggtacctacgaagtcggacgtacgtaggacgggtacgtccgaaggacgtacgtaccgtacggaaacccggtaaccgacccggttacggttacggtttaacgtttaccggttaggtaccgggacggttaagggtttaaacgggttttttacgttaggggttaaaccttttacccggttttaagtttaggggtttaacggttggggttttaacccggtttaacccgtttcgggttaccgtttttaccggttttttaccccggggg

SEQ ID NO: 276093 - DNA, 771 bp, Homo sapiens
  misc_feature: GYAE6OF01A4YYC.12.2.A02.1.454.CMB.1.raw
  modified_base (186)..(186): a, c, t, g, unknown or other
  misc_feature (186)..(186): n is a, c, g, or t
tcagatacgacgtacacgaccggtgctcgatttagactcatctacaggggacccaaaaaccacacccctccttgggagaatcccctagatcacagctcctcaccatggactggacctggagcattccttttcttggtggcagcagcaacaggtgcccactcccaggttcagctggtgcagtctggngaaactgaggtgaagagcctgggcctcggtgaaggtctcctgcaaggcttcgtggttaccacctttaccagtctatggtatcagcgtgggtgcgacgacggcccgtggacgaggtcttgagtaggagtgggagtgacgtcgagcgtactaactaagtacgtaacacagtactagtcgacaactaaggtaacgttacgaaggaacgagacgtaccaacgtatacgaaccaacgaacgaacaactactaccgacgaacacaaaccacgtacctaacgagtacggacgtcgtacggaacgggtacgtaccgtaaggtaacgtaccgttaaccggacgggtaaacccgtaaccgggtaccgggttaacccggtttacgtttaaaccgttaccggttacgggttacgggtaaaccgggtttaaggggttttaaaccgggtttttaagggttaaacggtttaaacgttttaaaccggttttttaagggttacgggttttaaacgggttttaccgggggtttaaccggttttaaccggttttaccgggtttttaaccggttttttaacccgggggttttttacccccggggg

SEQ ID NO: 276094 - DNA, 734 bp, Homo sapiens
  misc_feature: GYAE6OF01DI3AC.12.2.A02.1.454.CMB.1.raw
tcagatacgacgtacacgaccggtgctcgatttagactcatctacagggacccaaaaaccacacccctccttgggagaatcccctagatcacagctcctcaccatggactggacctggagcattccttttcttggtggcagcagcaacaggtcgcccactcccaggttcagctggtgcagtctggagctgaggtagaagaagccgtggggcctgggtagaacggtctccgtgacaaggtcttcgtcggttacctacctttaccagtctagtggtatcgagtcgtgggtgacgacgaccggtccctagggaccgaaggtctggacgtggacgtgggatggactcgacggtcgtacttaacgaagtacggaacacgagtactgtcgacaacgaagtacgtacgaaggacagtacgaccacgagtacgaaccacgacgaacctacacgtacccgaacgacgtacccacgaacgtacccgtaacaagggtgggaaccgtccgtagggaacgggtacccgtaccgagggaacgtaacgtacggtaccggaacccggtacggtcccgggttacctttaaggttaccttacgggttccggtaaggtccggtttaaggggtttaacggttttacgtagtttaaccgttttagttttaaacgggtttggtaaacggggttttcccgtttacgggtttacccgtttacgggtttcccgtttttacggggtttttacccccgggg

SEQ ID NO: 276095 - DNA, 925 bp, Homo sapiens
  misc_feature: GYAE6OF01CEM3S.12.2.A02.1.454.CMB.1.raw
  modified_base (270)..(270): a, c, t, g, unknown or other
  misc_feature (270)..(270): n is a, c, g, or t
tcagatacgacgtacacgaccggtgctcgatttagactcatctacaggggacccaaaaccacacccctccttgggagaatcccctagatcacagctcctcaccatggactggacctggagcatccttttcttggtggcagcagcaacaggtgcccactcccaggttcagctggtgcagtctggagctggaggtgaagacgccgtggggcctgggtagacggtcctcctgacaggtcttcgtcggttactaccttacagtctatggtactnacggcgtgggtgaccgacgaccgggtcccgtaggaacggacggtcgttaggtagggtaggacggttaggggactgggtaactaccgggtacgtaccggtaacgttaaccgtaaaggttacgggtaaaccaaccgttaaacggtacgttacgttacggtacctaaacggtaacggtaaccggtttaacccggaagggtaaaccggaacggttaacccgtacccgtaaaacccgggttacttaacccggaaaccccgaacgaaaccggaccccgaaaccttaacccggtaacccccggaaacccgggtaaccgtaacccccgaaacccggtaccggtaaaccccgttaacgggtacgggttaccgggtaacccgggtaccggtaacggggtaacggttaccggtaccggtaacgggtaacgtaccggtttaccggaacgggtaacccggaaccggggttccgggtaacccgttttaaggttaccgttaacggttcggtacggggtaaccggttaaacggggtttttagggttttaacggttaaggtttaacgtttaaccgggtttttagggtttacccggtttaaagggggtttcgggtttacggtttacccggttttacgtttacccggttttttacggggttttaccccccgggg

SEQ ID NO: 276096 - DNA, 730 bp, Homo sapiens
  misc_feature: GYAE6OF01BLFK7.12.2.A02.1.454.CMB.1.raw
  modified_base (153)..(153): a, c, t, g, unknown or other
  misc_feature (153)..(153): n is a, c, g, or t
  modified_base (317)..(317): a, c, t, g, unknown or other
  misc_feature (317)..(317): n is a, c, g, or t
  modified_base (479)..(479): a, c, t, g, unknown or other
  misc_feature (479)..(479): n is a, c, g, or t
  modified_base (523)..(523): a, c, t, g, unknown or other
  misc_feature (523)..(523): n is a, c, g, or t
tcagatacgacgtacacgaccggtgctcgatttagactcatctacaggggacccaaaaaccacacccctccttgggagaatcccctagatcacagctcctcaccatggactggacctggagctacttcctttttcgttggtggcagcagcaanaggtcgcccactcccaggttcagcgtggtgcagtcgtggacgcgttggaggtagaaggaacgtccgtgggggcctagggtacggaacgggtcctccgtggaccgtaagggttcctttacgttcggttacctaccgtttaccgagtacgttagttacggtatcgnggtcgtggggtcgcggacgaccggtacccggtaggaaccgtagggtccgttaggaggtagggaggtacggtagtagggtactggacgtccggttaacgttaacgaagttagtaaaccaggtaactacgtagcgaactaacgaaggtacgtaacgaggaacgngtacgacacgtaactacgactacaacaccgtacacgacgacganacccaaccgtacgtacctaaggacggtacgacggtaccgaggaaccggacgactaagggaccttgaccgaaccggaccgtaccgttcggacccgtttaagttacctggttacggcgggtagttaaccggtttaggtacttaggaatttcgtttagtaggttacggtttgggtaccttagtttacgtttcgtttccgggtttaaccgg

SEQ ID NO: 276097 - DNA, 811 bp, Homo sapiens
  misc_feature: GYAE6OF01AODTU.12.2.A02.1.454.CMB.1.raw
tcagatacgacgtacacgaccggtgctcgatttagactcatctacaggggacccaaaaaccacacccctccttgggagaatcccctagatcacagctcctcaccatggactggacctggagcatccttttcttggtggcagcagcaacaggtgcccactcccaggttcagctggtgcagtctggagctggaggtgaagaagccgtggggcctcggtgaaggtctccgtgcgaaggtcttcgtggttactacctttacagtctagtggtatcgagcgtgggtcgcgacgacggccccgtggaacgaacgggtcgttggacggtgggagtaggggagtaggtagtcgaggcgtacttaacgaagttacggtaaaccaacgtagacttagtacgacaacgaacggtaacgtaccgaggaacacggtaacgtaccaaccgagtaccgaaccaaccgaacgactaaccaacgtacccgaacgacgacccaacgtacgtaccctaacgaggttacggggacgtaccggttagggaacgggtaccgtaccggtaaggaacgtaacgttcggtaaccgggaacccggggtaaccccgggttacgggtacccggtttaacgtttacggttaacccgggtttacgggtacgggtaaacccgggttaagggtttttaacggggttttttaaagggtacgggttttaaacttttaaacgggttttacgttttaagggggttttacggttacggggtttaaccgggttacccgtttacgggttttaccccgggtttttttccgggttttttaacccccgggggg

SEQ ID NO: 276098 - DNA, 690 bp, Homo sapiens
  misc_feature: GYAE6OF01A4FUO.12.2.A02.1.454.CMB.1.raw
tcagatacgacgtacacgaccggtgctcgatttagactcatctacaggggacccaaaaaccacacccctccttgggagaatcccctagatcacagctcctcaccatggactggacctggagcatccttttctggtggcagcagcaacaggtgcccactcccaggttcagctggtgcagtctggagctgaggtgaagagccgtgggcctcgggtgaaggtcctccgtgaccgaaggtctttcgtaggttacctaccctttaccagtctagtggtatcgagtcgtgggtgccgacgaccggcccgtaggacgaagggtcttaggacggtggagtggggagtaggacttccgaaggtccgtacttaacgaagttacggtaaccacgacgtactagtacgacaacgtaaggtacgttaccgaaggactacggacgtaccgacctagtaccgaccaacgacgaacctacactaccgacgacgaccaacgacgtacctacgagtagggacgtcgtacgggacggacggtacgtaggtagtcgtacgtaccggaaccgtaccggtaccggtaccgttacgttacttacggttggtacggtaccggtaggtttagggtttagtagttaacgtttacgtttagttaggttaggttacggttacggttacttcggtttacgttttcggtttaccccgggg

SEQ ID NO: 276099 - DNA, 790 bp, Homo sapiens
  misc_feature: GYAE6OF01CMV99.12.2.A02.1.454.CMB.1.raw
tcagatacgacgtacacgaccggtgctcgatttagactcatctacaggggacccaaaaaccacacccctccttgggagaatcccctagatcacagctcctcaccatggactggacctggagcattccttttctggtggcagcagcaacaggtcgcccactcccgtaggttcagtctggtgctagtctgggagtcgtggagggtcgaaaggaacggccggttgggggccctacgggtacgtaacggtccttaccgtgaccgtaaggtcctttacgttacggttaacctaacccgttttaccgagtaccttagtcgggttaactcgacggtcggtagggtcgaccgaacgtaccggcccgtaggaaccgtaagggtcttaggacggtgggaacgtgggtacgtggaatcgaggtaccgtacgtttaaacgtaacggttacggtaaaacctacgaacgtaacttacggcgtaaccgaacgtaaggtaaccggttccgaaaggacaaggtacgaccaaccgtagtaccgaacaacgaacgacaacctacgacccgaagactaaccacgaccgtaacgttacgacgtggaacgcgtaaaggacggacgtacggtaagacgtacgtaccgtacggaaaccggtcgtaaccgggttcgttaaacggttacgtaccggttgggtaccgtacgggttaaggttaacggtttaagacggtttaacttacggtttggtttaacgggtacggtttacgggttaacgttaggttacgtttcggttttaaccggtttcccgggg

SEQ ID NO: 276100 - DNA, 660 bp, Homo sapiens
  misc_feature: GYAE6OF01CDQW1.12.2.A02.1.454.CMB.1.raw
tcagatacgacgtacacgaccggtgctcgatttagactcatctacaggggacccaaaaaccacacccctccttgggagaatcccctagatcacagctcctcaccatggactggacctggagcatccttttcttggtggcagcagcaacaggtgcccactcccaggttcagctggtgcagtcgtggagcgtgaggtgaagaagccgtggggcctcggtgaaggtctcctgcaaggtcttcgtggttacacctttacagctagtggtatcgagtcgtagggtgacgacgacggcccgtaggacgaagggtcttggaggtaggagtgggatggatacgagtacgttaacaagttacggtaacacgtagtactagcgacaacgtaagtaacgttccgaaggacaaggtacgtaccaaccgtagtaccggaacccacgaacgaccctaacgtacgtacccgaacgaacgaccaaaccgacgtaccctaagacgtagggactcggtacgagggacctcgtagaacgtagtaccgtacgaaccgtccgacgggtccgttagttactagtcggtaggacgtaggttaggttttagacgttatttaacggtttgtaggttagttggtacggttacctgtttaccgtttacggttttcggtaaccccggg

SEQ ID NO: 276101 - DNA, 757 bp, Homo sapiens
  misc_feature: GYAE6OF01EHEM8.12.2.A02.1.454.CMB.1.raw
tcagatacgacgtacacgaccggtgctcgatttagactcatctacaggggacccaaaaaaccacacccctccttgggagaatcccctagatcacagctcctcaccatggactggacctggagcatccttttcttggtggcagcagcaacaggtgcccactcccaggttcagctggtgcagtctggagctggaggtgaagaagccgtggggcctcgggtagaaggttctcctgacgaaggtcttcgtacggttacctacctttaccagtctatggtatcgagtcgtgggtcgcgaccgaccggtcccgtaggacggaagggtcttaggacggtgggaggttggggagttcgggagtaccgtaggccgtactaaactaaggttacgggtaactaacgtaaggtaaccttagtcgaaccgtaacgtaaacggtaaccgttaccggaaggaaccgtaacggtaacgtaccaaacccgtaagtacccgaaaccgaacgaaccgaacctaacctaccgtaccccgaaaggtaccgactaaaccgaccgtactaaacgtaggtaggcgtacggtagacgggtacctacgtaggacgtcgttacgaaccggaacgtaccgtaccgggttcgttagttacggttccggtaggtcgttaagggtaggtttaaggtttaacggtattaaggtttaacgtttaggttagggttacggtttcggggttaccttacgggtttacgttccgtttttcggtttaaccccgggg

SEQ ID NO: 276102 - DNA, 631 bp, Homo sapiens
  misc_feature: GYAE6OF01AWNDG.12.2.A02.1.454.CMB.1.raw
tcagatacgacgtacacgaccggtgctcgatttagactcatctacaggggacccaaaaaccacacccctccttgggagaatcccctagatcacagctcctcaccatggactggacctggagcatccttttcttggtggcagcagcaacaggtgcccactcccaggttcagctggtgcagtctggagctgaggtgaagaagcctggggcctcgggtgaacggtctcctgcaaggcttcgtggttaccacctttaccagtcttagtggtatcagcgtgggtgcgacacggccctggacagggtcttggagtggagtgggatggatcgaggcgtacttaacgaagttacggtaaacacgaagtaacttagtcgacaacgtaaggtaacggttaccggaagtacgaagtacaccacgtacgacaccaacgaacactactaccacgacgacgacacgactacctaagcggcgagtacgaggacgcgtacgagagtcgtacgacgaaccgtacggccgttagttagttacgtaggtggaggtacggttaggtttaggtttacgtagtttactttgtttaggttggttacgggttggttaccgttagtttcggtttcgttttccgggtttaccccggg

SEQ ID NO: 276103 - DNA, 745 bp, Homo sapiens
  misc_feature: GYAE6OF01DZ88G.12.2.A02.1.454.CMB.1.raw
  modified_base (198)..(198): a, c, t, g, unknown or other
  misc_feature (198)..(198): n is a, c, g, or t
  modified_base (291)..(291): a, c, t, g, unknown or other
  misc_feature (291)..(291): n is a, c, g, or t
tcagatacgacgtacacgaccggtgctcgatttagactcatctacaggggacccaaaaaccacacccctcttgggagaactcccctagatcacagctcctcaccatggactggacctggagctattcctttttcgtgggtggcagcaggacaacgtaggtcacccactcccgaggttcagtcttgggcgctagttcgnggacgtcgtggaggtagaagacgccgtcggggtacctgggtagaacggttctcgtgaccgaaggttcttcgttacggtacctaccgtttacgngtacttagtggtaactcgagtcggtggggtcgacgaacggccggacccgtagggaaccgtaaggggttcttgggaaggtagggaggtacggggtaatcggtacagacggtctacttaacgaaggtacggaaactacgaagtacttacacgaacgaacgtaggtaacgtaccgaaggactaggactacagagtacgaaccaatacgacgactacgaccaacgacgtcaacaacgtacgtaaccgagggttagaccgttagacggaggtaacgccgaagacgtacggtacgaaccggtaccggtaccggaccgggtcgtttaagttacttacggttaggtaacgggtaccggttaagggttagggtttaacggtacttaaacggtttgtttaagggttcgggttaggttacgggttaccgttagttcggtttaacgttttcccgggtttaccgggg

SEQ ID NO: 276104 - DNA, 765 bp, Homo sapiens
  misc_feature: GYAE6OF01DECPP.12.2.A02.1.454.CMB.1.raw
  modified_base (374)..(374): a, c, t, g, unknown or other
  misc_feature (374)..(374): n is a, c, g, or t
  modified_base (395)..(395): a, c, t, g, unknown or other
  misc_feature (395)..(395): n is a, c, g, or t
  modified_base (599)..(599): a, c, t, g, unknown or other
  misc_feature (599)..(599): n is a, c, g, or t
tcagatacgacgtacacgaccggtgctcgatttagactcatctacaggggacccaaaacacaccctcctgggagaatccctagatcacagctcctacaccatggactcggacctgggagcactttcctttttcgttgggtggcagcagcaacgaggtcgcccactcccgaggttcagcgtggtgcgagtcgtggagcgtaggaggtggaaaggacgccgtcgggggtcctcgggtaggtaacggttcctccggtaggcggtaacggtctttcggtacggttaacccttaccctttacgacgtacgttaaggtcggtaactccgtaggtcgggttggcgaccggacgacccggtccgtaaggacggtaacgggtntgggtaggtggaggttagggngtaggacgtacggacgtacgtacgttaagtaacggtacgtaacacgtaccgaatttacgacggaacctaaacgtaacgggttaaccgacgaaaacgggacgtacggtaacgtacccacgaaccgtacaaccaacgaccgtacactacaccgaacgacactaccgacgtaccgtacgacgaggacggtagacggacggcgtacgngaacgtagtacgtcgaacgtacggtaccggtacgttccgttagttaggtacggtacggtacggttaggaacggtttttttaggactttaacggtttacgtttaggttagggttcgggtaccgggtttaggtaccgtttcgttacggttttcggttttaccccgggg

SEQ ID NO: 276105 - DNA, 726 bp, Homo sapiens
  misc_feature: GYAE6OF01DI8J3.12.2.A02.1.454.CMB.1.raw
  modified_base (199)..(199): a, c, t, g, unknown or other
  misc_feature (199)..(199): n is a, c, g, or t
  modified_base (693)..(693): a, c, t, g, unknown or other
  misc_feature (693)..(693): n is a, c, g, or t
tcagatacgacgtacacgaccggtgctcgatttagactcatctacaggggacccaaaaccacaccctcttgggagaatccctagatcacagctcctcaccatggactggacctggagctattcctttttcttgggtggcagcagcaacaggtcgcccactcccgaggttcagcgtggtgctagtctggagcgtggaggngaaagaacggtccgtcgggggcctgggtaggaaggttctccgtgacgaacgggttcctttcgttacgggtaactacccgttttaacgagtacttagtacggtattcgaggtcgtagggtcgacgacgaccggacccgtaggaaccgtaaggggtctttagggaagttggggagtggggtatggtactacgacggtcgtaacttaagaagtacggtaacaagacgtaactacgtacggaccaaggtaacgtaacggtaccggaggaccgtaggtaacgtacccaaacgtagaaccgaaccaacgtacgaacctaacgacaccgaagacgacacaacgctacggagtgagtcgcgaggactctaggaactgacgtaggacccgacggtccggttacgtaagtttactacggtaggtcgtaaacgtagggttttacggttaacggtagttaacgtttaaccggtttagttccgggtaaagttccgggtttaaacgtntttaacgggttccgttttacgggtttacccggg

SEQ ID NO: 276106 - DNA, 744 bp, Homo sapiens
  misc_feature: GYAE6OF01B5LX3.12.2.A02.1.454.CMB.1.raw
  modified_base (261)..(261): a, c, t, g, unknown or other
  misc_feature (261)..(261): n is a, c, g, or t
  modified_base (320)..(320): a, c, t, g, unknown or other
  misc_feature (320)..(320): n is a, c, g, or t
tcagatacgacgtacacgaccggtgctcgatttagactcatctacaggggacccaaaaaaccacacccctccttgggagaatcccctagatcacagctcctcaccatggactggacctggagcattccttttcttggtggcagcagcaacaggtgcccactcccaggttcagctggtgcagtctggagctggaggtgaagaagccgtggggcctgggtagaaggtcctcctgcaaggtctttctggttaccacctttaccngtctatggtatcgagcgtgggtgcgacgacggcccgtggacgtaagggcttggagtggngtggtatggatcagcgtacttaacaagtaggtaaccacgagtaactagtcgacgaacaaggtaacgttacccgaaggtaacgaaggtaacgtacccaaaccgtacgtaccggaaccctaaccggaacgtaaccaacccgtaccgtacccgtaacggaacgaccgaaccgacggtcccctaagacggttacgggacgtcgtaccgggaagggccgtaccggtagacgtaactaccggtacggaccgtaccgtaccgggttacggttacgttaacgtttcgtagggtacgggacgttaacgggtttgggttttaaagttaggttaactttttaaaggtttacggtttagggttttaacgggtttcgggtttaaccggtttacccgtttgggtttaaccgtttttcccgggtttttaaccccggggg

SEQ ID NO: 276107 - DNA, 768 bp, Homo sapiens
  misc_feature: GYAE6OF01BHL2N.12.2.A02.1.454.CMB.1.raw
  modified_base (396)..(396): a, c, t, g, unknown or other
  misc_feature (396)..(396): n is a, c, g, or t
tcagatacgacgtacacgaccggtgctcgatttagactcatctacaggggacccaaaaaaccacacccctccttgggagaatcccctagatcacagctcctcaccatggactggacctggagcattccttttcttggtggcagcagcaacaggtgcccactccccaggttcagcgtggtgcagtcgtggagctgaggtagaaggaacgccgtggggcctcgggtaggaacgtctcctgctatgtcttcgtcgttacctaccttaccgagtctagtcgtatcgaggtcgtgggtcgcgacgacggtcccgtaggacgagggtcttaggaggtggtacggtgggtagtacggactacgacggtcgttaacttacgtaacgtacgtaacacgacgatanacgacaacgtacggtaacgtaccgaggtaacgagtacgtacaaccgtactaaccgaaccaacgacgaaccctaccgtactaccccggaagaacctaccgacgtaaccgtaccgacgtaggtggaaccttgggtacggacggtacctacggtaaggtaacgcgttacggaacccggaacggttaacccgggtacggttcgttaacgtttaacgttacgggttaggacgggtttaacggttaacgggtttttaagttttagggtaaacgttttcgtttaaacggggttttcggtttaaggggttacgggtttacggggtttaaacccttttccggttttcccggggtttttcgtttttaaacccccccgggggg

SEQ ID NO: 276108 - DNA, 757 bp, Homo sapiens
  misc_feature: GYAE6OF01CSS4S.12.2.A02.1.454.CMB.1.raw
  modified_base (178)..(178): a, c, t, g, unknown or other
  misc_feature (178)..(178): n is a, c, g, or t
  modified_base (184)..(184): a, c, t, g, unknown or other
  misc_feature (184)..(184): n is a, c, g, or t
  modified_base (233)..(233): a, c, t, g, unknown or other
  misc_feature (233)..(233): n is a, c, g, or t
  modified_base (499)..(499): a, c, t, g, unknown or other
  misc_feature (499)..(499): n is a, c, g, or t
tcagatacgacgtacacgaccggtgctcgatttagactcatctacaggggacccaaaaaccacacccctccttgggagaatcccctagatcacagctcctcaccatggactggacctggagcattcctttttcgtggtggcagcagcaacaggtcgcccactccaggttcagctggtncagtcnggatctggagtgaagacgccgtggggcctgggtagaacggtccttccgngggacctaagggtcctttcgttaccggttacctaaccgtttaccagtagttacgtaggtaactcgaggtcgtgggtcgacgtacgaccggccgtagacgaaggtcttaggagtacggtagtagggataggacctacgtacgtacggtacctttaaagaaggttaacggaaacccaggtactaacgttacgacgaacgaccgaaagttactacgaacgtacgaaggctaccagttacacgaacaatacgaacacaactccgaaccgngaactaccaagtacccgtacgaagtaccgggagtacggaacgccggtaacgtctacggggaaacttacgcggaaacggcccccgaaggttaccccggtagtttagtaacccggtttgacccggtaagtaccggggtttaagttacgggtttacaggttttaaaccctttggggtttaatttgggttaacccgggttgggtttaaaccccgtttagtttcccggtttaaaggtttttcccgggttttaaacccccgggg

SEQ ID NO: 276109 - DNA, 696 bp, Homo sapiens
  misc_feature: GYAE6OF01BNT5L.12.2.A02.1.454.CMB.1.raw
  modified_base (155)..(155): a, c, t, g, unknown or other
  misc_feature (155)..(155): n is a, c, g, or t
  modified_base (177)..(177): a, c, t, g, unknown or other
  misc_feature (177)..(177): n is a, c, g, or t
  modified_base (187)..(187): a, c, t, g, unknown or other
  misc_feature (187)..(187): n is a, c, g, or t
  modified_base (211)..(211): a, c, t, g, unknown or other
  misc_feature (211)..(211): n is a, c, g, or t
  modified_base (256)..(256): a, c, t, g, unknown or other
  misc_feature (256)..(256): n is a, c, g, or t
tcagatacgacgtacacgaccggtgctcgatttagactcatctacaggggacccaaaaaccacacccctccttgggagaatcccctagatcacagctcctcaccatggactggacctggagcattccttttcttggtggcagcagcaacaggtcncccactcccagttcagctggtncagtctgganctgagtagaagagccgtgggctgngagtctctgcaggtcttcgtcgttacctcttacgagtctagtgtntcagtcgtggtgcgacgccggtcctaggaacgagggtctaggtggtggaggtggagtggactcgagtcgtacgttaacgagtacggtaacacgacgtacagtaccgataacaacggtacgtaccgaacgggacaacggtaacgtacccaacgtaaccgtacggaaccctacgaacgaacctaccgtaaccgtaccgaacgaaccggtacccaaccgttaacgacccgttaacgacggttacgggacgtacgtaaccgggacgtaccggtacctaggtaaccgtacggtacgtaccggacggtaaacggtcccggttacgtagtttaccgttacgtaggttcgtaacggttaggttaaccgttaggtacttacgtttacgttagttgggttacggttacggttacgttaccggttcctttaggtttaccggtttacccggg

SEQ ID NO: 276110 - DNA, 846 bp, Homo sapiens
  misc_feature: GYAE6OF01C0NHU.12.2.A02.1.454.CMB.1.raw
  modified_base (607)..(607): a, c, t, g, unknown or other
  misc_feature (607)..(607): n is a, c, g, or t
tcagatacgacgtacacgaccggtgctcgatttagactcatctacaggggacccaaaaccacacccctctgggagaatccctagatcacagctcctcaccatggactggacctggagcattcctttttcgttggtggcagcagacaacgaggtcgcccactcccgaggttccagtcgtggtgcagtcgtggagtcgtaggaagggtaggaaaggaacggtccggtcgggggtccctaggggtgtaacggttcctccgtaggaccgtaagggttcctttaccggttacggttaacccttacccgtttaccgacgtacttaggttaggtactacgtggtcgggttagggcgaccgtaacggacccggtccgtagggaacggtagggttacgttggagggtagggtaggtgggtagtaggactcggacgtacgtaacctaagtaaggtaacgaacaacgtaatagtactcggaaacaacggtaaacggtaaccgtacggaaacgtacgtaacgtaaccgtacctaaacgacggtaacccgaaaccctaacggaactaaacctacctaacccgaccgaaacggaccctaacggaacaccggtaacttacgnggtacggacggtaggacgggaaggtcctacgaggaacttcgtacggaacgggaacctccggggtacgttagttaacgtttagtaacgggttcggtaaagggtggttttaaaggggtttacgtttacgtaaacggttttaacttttaagggtttagggttaggtttcggggttaacccgggtttacgttaccgttttaacgggttttaacccggttttccggggtttaaccccccggggg

SEQ ID NO: 276111 - DNA, 812 bp, Homo sapiens
  misc_feature: GYAE6OF01C2EP3.12.2.A02.1.454.CMB.1.raw
  modified_base (178)..(178): a, c, t, g, unknown or other
  misc_feature (178)..(178): n is a, c, g, or t
tcagatacgacgtacacgaccggtgctcgatttagactcatctacagggacccaaaaaccacacccctcctgggagaatcccctagatcacagctcctcaccatggactggacctggagcattcctttttcttggtggcagcagcaacaggtcgcccactcccaggttcagcgtggtncagtctggagctggaggtgaagacgccgtgggcctggtgtaggtctccgtgcgtaaggtcttcgtcggttacctacctttaccagtactagtggtatcgagtcgtggggtcgaccggtaccgaccggtccccgtagggaaccgtaacgggtcgttagggaggttggggaagttggggtagtggtacgtacgaggtcgtacgtttaacgaagtacggtaaccacgtaacgtacgtagtacgaccaacgtaaaggtaacgttaccgaaaggacgtaacggtacgtaccgaacctaagtaccgaaaccgaacgaacgaacctaacgaaccgtacccgaacggacgtaaccgaaacctacgtaacccgtaacgtagtacgggaacgtcggtaaggaacgggtaaccggtccgtaaggaacgtaaccgtaccggtaccggaaccggtacccggtaccgggttccgtttaacggttacggtttacgttacgggtaaggtacgggttaaagggtttaagggttttacggtaaggttttaacgtttaagttttaacgggtttagggtttacgggtttaacgggtttaccggttaccgttttaccgggtttacgttttttaccccgggtttttaccccggggg

SEQ ID NO: 276112 - DNA, 752 bp, Homo sapiens
  misc_feature: GYAE6OF01DLFQ5.12.2.A02.1.454.CMB.1.raw
  modified_base (700)..(700): a, c, t, g, unknown or other
  misc_feature (700)..(700): n is a, c, g, or t
tcagatacgacgtacacgaccggtgctcgatttagactcatctacaggggacccaaaaaccacacccctccttgggagaatcccctagatcacagctcctcaccatggactggacctggagcatccttttcttggtggcagcagcaacaggtgcccactcccgaggttcagctggtgcagtcgtggagctggaggtgaagagccgtgggccgtggtgaacggtcctccgtgacgtacggtcttcgttacggttacctaccgtttacgagtcttagtcggtactcgaggtcgtgggtacgccggaacgtacgggtccccgtagggaaccgtaacggggtcgttaggtaggtagggtagtaggggtagtaggtacgtcggaggtccgtaacgtttaacgaagtttacggaaaccgaacgtaacgtaacttacgttacgaaccgaaacgtaaacggtaacccggttaccgaacgggtaaccgaacgttaacgtacccgaaccgtaacgtaccggaaacccaaccgaacgaacctaaccgtaaccgtaccccgaaacggaccgaaccctaaacggaacctacccgttaagaccgggtaggtaacggccggtacgggacggaaccgtcgtacggagtaccgtacgtacggaccgtaccggacggtcgtttacgtattacgtgacggtacgtaggttaggtttagngttaattcgttagtagtaggttcgtacgttactcgtttacggttcgttcggg

SEQ ID NO: 276113 - DNA, 675 bp, Homo sapiens
  misc_feature: GYAE6OF01AYSON.12.2.A02.1.454.CMB.1.raw
  modified_base (477)..(477): a, c, t, g, unknown or other
  misc_feature (477)..(477): n is a, c, g, or t
  modified_base (486)..(486): a, c, t, g, unknown or other
  misc_feature (486)..(486): n is a, c, g, or t
  modified_base (585)..(585): a, c, t, g, unknown or other
  misc_feature (585)..(585): n is a, c, g, or t
tcagatacgacgtacacgaccggtgctcgatttagactcatctacaggggacccaaaaaaccacacccctccttgggagaatcccctagatcacagctcctcaccatggactggacctggagcatccttttcttggtggcagcagcaacaggtgcccactcccaggttcagctggtgcagtctggagctgaggtagaagagccgtgggcctcggtgaacggtctcctgactaaggtctttcgtcggttacctacctttaccagtctagtgtatcgagtcgtgggtggcgtacgaccggcccgtaggaccgaagggtcttggtaggtcggtagtgggagtacggtacgtacgaggtccgtacttaacgaagttaggtaaccagtaacgtactagtacgacgtaacgaagtacgtcgaaggacgaaggtactaccgaacacgtacgaaccaactacgaacacgaacgtaccaaccgganacccgtaanaccgtacctaacgtaggtcggactacggtacgggactaccggtacgtagacggttacacgggtacgaacccgtccggacggttcttaagtaacgttcgnggtccggtaagggttaaggtttaggtttagacgttagttgttacgttggttaggtcgtacggttacttgttccgtttacggttcccgggg

SEQ ID NO: 276114 - DNA, 723 bp, Homo sapiens
  misc_feature: GYAE6OF01EY2C8.12.2.A02.1.454.CMB.1.raw
  modified_base (152)..(152): a, c, t, g, unknown or other
  misc_feature (152)..(152): n is a, c, g, or t
  modified_base (157)..(157): a, c, t, g, unknown or other
  misc_feature (157)..(157): n is a, c, g, or t
  modified_base (181)..(181): a, c, t, g, unknown or other
  misc_feature (181)..(181): n is a, c, g, or t
tcagatacgacgtacacgaccggtgctcgattttagactcatctacaggggacccaaaaaccacaccccctcccttggggagaatcccctagatcacagctcctcaccatggactggacctggagcatccttttctggtggcagcagcaacnggtcncccactcccaggttcagctaggtnctagtcctggagtcgtaggaggtgaagacgccgtggggcctcgggtagacggttctccgtgacgaaggtcctttcgtacggttacctacctttaccgagtcttagtggtactcgagtccgtgggtcaccgacgaccggtacccgtggaacgtaacgggtcgttaggagggtcggaggttggggaagttcggaacgttcgacggtccgtacgttaacgaaggttcgtaaacacacggtactagtacgaccgaaggtacggttaaccgcggaaggtacgaagtccgtaccactacgaccaacgacgtaccatacgtaccgaccagacccgaacaaccgctacctaaggacgtacggtagacccgaggaccggtacgtccgtagactagttacccgacggtaccggaaccgtacggtcgttaactttacggtaacgtgggtaaccggtaggtaacggtttaggttacgtaagttagttacgtttaggtacggttaggtttaccgggtcgttaacgtttccgtttcggttttccggttacccgggg

SEQ ID NO: 276115 - DNA, 678 bp, Homo sapiens
  misc_feature: GYAE6OF01B0XXG.12.2.A02.1.454.CMB.1.raw
tcagatacgacgtacacgaccggtgctcgatttagactcatctacagggacccaaaaaccacacccctccttgggagaatcccctagatcacagctcctcaccatggactggacctggagcattcctttttcttggtggcagcagcaacaggtgcccactcccaggttcagctggtgcagtctggagctgaggtgaagaagccgtggggcctcgggtgaaggtcctccgtgcaaggtctttcgtcggttaacctaccttttaccagtccttagtcgtatcgagcgtgggtgcgaacgacggccccgtggaacgagggtccttaggaggtgggtagtggggatggactcgaggtccgacttagaacgttacggtaacaaccaagtaacttagtcgacaacgaaaggtaacgttacccgaaggaacaggtacgtaccaacgataccgaaccaacgaacgaaccacactaccgaacgacgaccaacgtacgaccctaactagtacggcgtaggtacggaaggtcgaccgtagagacgtcgacgacggacgaccgggttaccgttgtttaacgtcgtggtaggtaccggtaaggttttagggttacgtagttatttacgtttaggttaggtttcggtaggttcgggttaccctttggttacccgttttggttttaccccggg

SEQ ID NO: 276116 - DNA, 843 bp, Homo sapiens
  misc_feature: GYAE6OF01C9S4X.12.2.A02.1.454.CMB.1.raw
  modified_base (137)..(137): a, c, t, g, unknown or other
  misc_feature (137)..(137): n is a, c, g, or t
  modified_base (530)..(530): a, c, t, g, unknown or other
  misc_feature (530)..(530): n is a, c, g, or t
tcagatacgacgtacacgaccggtgctcgatttagactcatctacaggggacccaaaaaccacacccctcctgggagaactcccctagatcacagctcctcaccatggactggacctggagcattcccttttctggnggcagcagcaacaggtcgcccactcccaggttcagtctggtgcagtcgtggagtctggacggtagaaaggtacgccggtggggcctaggtgaacggttctcctggcgtaaggtccttacggtaccggttacctaccctttaccgaagtcctaagtcgggtatacgcggtcggttcggggacgtaccgaccgtaccgggtaccccgtaagggaaacccgtaaggggttaccgttgggaacggggttagggtaacggttacggggaggtttaccggtaacgtccgaacggttacctacgttaaaacctaagggtaacggtaaccaccgtagtactgacgtacaacgtagggtaaccttccgggaagtaacgagtccgaccactacgtaccgaaanacctacgaccaactaccgaccgacgactaccgaccgaacgtacctcgaacggtggaactcggacgggttaacgaacggtacgttggtaatacccgttcgggaacgtaaacccggccgtaccggggttccctttaaggttacccgttaggtaccggttacggaaccgggttttagggttttaaaagggttttacggtaacccggtttaaacttttaaacggggttttcgttttaacgggggtaaccgtttcggggttttaacccggtccttttaccgggttaacccgtttttcccgggggtttaaacccccggg

SEQ ID NO: 276117 - DNA, 759 bp, Homo sapiens
  misc_feature: GYAE6OF01DZUJ7.12.2.A02.1.454.CMB.1.raw
  modified_base (241)..(241): a, c, t, g, unknown or other
  misc_feature (241)..(241): n is a, c, g, or t
  modified_base (272)..(272): a, c, t, g, unknown or other
  misc_feature (272)..(272): n is a, c, g, or t
tcagatacgacgtacacgaccggtgctcgatttagactcatctacaggggacccaaaaaccacacccctccttgggagaatcccctagatcacagctcctcaccatggactggacctggagcattcctttttcttggtggcagcagcaacaggtgcccactcccaggttcagctggtgcagtctggagctgagtgaagagccgtggggcctcggtagaaggtctcctgacaaggtcttcgnggttacacctttaccagtctagtgtatcagngtgggtgacgaacgacgggcccgtaggacgaaggggtcttaggagtgggtagttcggggagttagggacttcggaacggaccgtacgtttaaacaagtttacgggaaactaacgaagtaaccgtaagtcggactaacgaagtaacgttacgaacggtaacagacgtacaaccagtacgaacctacaacgaaccgaaccacgtacccgaacggtagaccaaacgtacgacctaacgacgttaggaacgtgtacggaaggacgtacgtacgaaggtacgtacgttacggaaccgggtacgtacccggggttacgtttacgggtacgtttaaccggtaggttagggaacccggtttaaagggttaacgggtttttaacgtaagggttttaagtttaaaccggttttaaagtttaggggttaacggtttcggggtttaaccggtttaacggtttcgtttaaccggtttttaacccggttttttcccggggg

SEQ ID NO: 276118 - DNA, 790 bp, Homo sapiens
  misc_feature: GYAE6OF01A61S1.12.2.A02.1.454.CMB.1.raw
  modified_base (188)..(188): a, c, t, g, unknown or other
  misc_feature (188)..(188): n is a, c, g, or t
  modified_base (275)..(275): a, c, t, g, unknown or other
  misc_feature (275)..(275): n is a, c, g, or t
tcagatacgacgtacacgaccggtgctcgatttagactcatctacaggggacccaaaaaccacacccctccttgggagaatcccctagatcacagctcctcaccatggactggacctggagcattccttttcttggtggcagcagcaacaggtgcccactcccaggttcagctggtgcagtcgtgganctgaggtgaagagccgtgggcctggtgaaggtctccgtgacaaggtccttcgtacggttacctacctttaccagtcgtagtggtacngtacgtcgttgggtcgcgtacgaccggtcccgtaggacgaagggtcttagggaggtcggtagtcgggagtcgggtactcgacggtcgtaccttagaagtacggtaaacacgtacgtacgtagtacggacaacggtaagtacgttaccgaacggaactacggacgtaccaacctacggtaacgacccaacgtaacgtaacccactaaccggtaccgaacggaaccgtcccgaaacgacccgtaaccgttaagtaacggtcggaaccggtacgtacgggtaacggtaaccgtacccgtagggaacgtaccgttacggttaaccgggaacccgttaacccgggtaccgggttaccgtttaacgtttaacgtttacccggttgggttaccgttaccggggttaaagggttttaccgggttttaacggtaagtacccgttttaaaggtttaccgtttaggtagggttttacggtaccgtttaggttcggttttaaccgttttcggggttttaaccccggg

SEQ ID NO: 276119 - DNA, 902 bp, Homo sapiens
  misc_feature: GYAE6OF01AS7DG.12.2.A02.1.454.CMB.1.raw
tcagatacgacgtacacgaccggtgctcgatttagactcatctacaggggacccaaaaaaccacacccctccttgggagaatcccctagatcacagctcctcaccatggactggacctggagcatccttttcttggtggcagcagcaacaggtgcccactcccaggttcagctggtgcagtctggagctgaggtgaagaagccgtggggcctcggtgaaggtctccgtgcgaaggtcttcgtggttacctacctttaccagtctatcggtatcgagtcgtgggtcgacgacgacggccccgtaggacgaagggtcgttaggacggtggagtgggagtggatcgacgcgtacttaacgtaacgtacgggtaaacaacgtaacggtaaccttagtacgaaccgtaacggtaaacggtaacggttaccgaacggtaaccgaaggtaaccgttaccgaaccgtacgtaacccgaaccgtaaccgaacgtaacaaccgttaccaacccggacgaaccgacccgtaaccgacccgtaaccgttaaacggacggtaccgggtaacgtcggtaacggggaacgggtacccgtacggtaacgggtaacgttaccgtaaccgggttaccggggaaacccggtaccccgggttaacggggttacccgttttaacgggttttaaccgtttaccggggttacgggttaccggggtaaacgggttttaaaacggggtttttaacgggtttttaaaggttaccgggttttaaacgtttttaacgggtttttaaacggggtttaaacggggtttttaccggggtttaacggggtttttaaccccggttttaaacgggtttccccggtttttttaaacccgggttttttaacccgggggtttttaaaccccccgggggg

SEQ ID NO: 276120 - DNA, 868 bp, Homo sapiens
  misc_feature: GYAE6OF01C5QLT.12.2.A02.1.454.CMB.1.raw
tcagatacgacgtacacgaccggtgctcgatttagactcatctacagggacccaaaaaccacacccctcctgggagaatcccctagatcacagctcctcaccatggactggacctggagctattccctttttcttgggtggcagcagacaacgaggtcgcccactcccaggttcagcgtggtgcagtcgtggagcgtggaggtagaaggacgccggtgggtccgtcgggtaggaacggttcctaccgtgacgtaacgggtcttcgtacggttacctaccgtttaccgagtctagttcggtactacgtggtcggtgggtcgaccgtacggacccggtcccggtaggaacggtaacgggtcgttaggtacgggtaggtaacgggtgggtacggttggtaccgttacggaccggtcgttaccgttaaacgaacggttaacgaaacaaccgtaagtaacgtagtaccgaacgtaacgtaacggtaaccgtaccggtaaacggaacgtaacggtaccgtaacccgaaccgtaacgtaacccgaacctaacgaacgtaaccaaccgtaaccgtaacccggacgtaaacccgtccgaaaccgttacgtaaaccgtaacggtcggtaagggtaccagggtacggtaaccgggacgttaacgaggtaacgttccgtacggtaacccggaacggtacccgggtaaaccggttccgtttaggtttaaccgtaccgggttagggtccggttaagggtttaaacggtttttagggtttaccggtaatttaaacggttttcgttaggggtttttaaggcggttttagggtacccggtttacccgtttaggtttacccgttttttcccggggtttaccccggg

SEQ ID NO: 276121 - DNA, 1007 bp, Homo sapiens
  misc_feature: GYAE6OF01CW8EQ.12.2.A02.1.454.CMB.1.raw
tcagatacgacgtacacgaccggtgctcgatttagactcatctacagggggacccaaaaaccaccacccctcctgggagaatcccctagatcacagctcctcaccatggactggacctgggagctacttcctttttgtgggtcggcaggcaggacaacgagggtccgccccaccttcccgaggttccaggtcgtgggtcgcgtacggttcgtgggaggtccgtagggtaaggggtacggaaacggtaacgggtccccgggtcggggggaccgttaccggggttacggtaaacgggttccctccggtaggtaccggtaacggttccgtttaccggttacgtttaacccgttaccctttaccgacgtacgttagttccgggtaactccggtacggtccgggttggggaccgtaaccggtaccgtacccgggtacccggtaagggtaaccggtaacgggttcgtaggggtaggtacgggtaaggttacggggtacgtcgggtaacttcccggtacggttaacccggttaacgttaacgtaaaacgggtttaaccgggtaaaacctaccggttaaccggtagtaaccgtcggaaacccgtaaggtaaaccggttaaaccggtacggaaacggtaccgaacggttaaccgaccgtaaccggtaaacgtaccccggaaaccgtaaaccgaccgtaaaccgtaacccgtaaccgtaacccggtaacgaacccggtaacccgaacccggtaacccggtaacccttaaaccgggtacgggtaacccgggtaaccggttaacgggacgggtaaccgggtaccggtaccggtaacgggacgttaacggtaccggtaaccggaccgggtaccggtaacggttaccgttacggttacgtacggtacggttaggtaccggttaggtttacggttaagttacgtttagtttacgtttacgggttacggttaggtttacggttaccgttacggttacggtttaccgttcgggtttaccccggg

SEQ ID NO: 276122 - DNA, 956 bp, Homo sapiens
  misc_feature: GYAE6OF01EAM4M.12.2.A02.1.454.CMB.1.raw
  modified_base (129)..(129): a, c, t, g, unknown or other
  misc_feature (129)..(129): n is a, c, g, or t
  modified_base (164)..(164): a, c, t, g, unknown or other
  misc_feature (164)..(164): n is a, c, g, or t
  modified_base (213)..(213): a, c, t, g, unknown or other
  misc_feature (213)..(213): n is a, c, g, or t
tcagatacgacgtacacgaccggtgctcgattttagactcatctacaggggaacccaaaaaaccaccacccctccttgggagaactcccctagatcacagctccctcaccagtggactggacctggganctattcctttttcgttggtggcaggcagacaacgnggtcgacccactccgaggttccagtcgtaggtgtctaggtcgtgggacngtaggacgggtagaaacggtaccgtcggtcggggtccttagggtacggaacgttccgtccgtacggaacctacgggtttcctttacggttaacggttaacccctttaccgttaaccgaagttcgttaacggtttacggtactacggtacggttcgggttacggggtaccgtacccggaccggggggtaccgtacccggtaagggtaacggggtacgggttaccggtttagggtaagggtacgggttaaggggtacgggttaacggtaccggttaagccgggtaaccgtaccgtttaaatttacgaaaggtaaccgttaaaccgaagtacggttaactcggaaccaagtaaaccgtaaaggttaaaccggttacggaacggtaacgtacgtaaccggtaaccactaacggtaccaaaccctaaggaaccaaccgacgtaacccgtaccgaacgaccgaaccgaactaccgtaactacggtacggtacgggtacgtacggtaacggtaacggtacggtttaccggaacgtaacgtacggttaccgtaaccggaaccggtaccggtttaccgggttacgttaacggttacggtacgtttaccggtaggttacgggtttaacgggtttaaggtttacgggtttattttaacgggttacttttacggggttaagggtttaccggggtttacgttacgggttttacccgtttacggttttccccggtttttaacgggtttaccccgggg

SEQ ID NO: 276123 - DNA, 748 bp, Homo sapiens
  misc_feature: GYAE6OF01DHSK3.12.2.A02.1.454.CMB.1.raw
  modified_base (197)..(197): a, c, t, g, unknown or other
  misc_feature (197)..(197): n is a, c, g, or t
  modified_base (518)..(518): a, c, t, g, unknown or other
  misc_feature (518)..(518): n is a, c, g, or t
  modified_base (524)..(524): a, c, t, g, unknown or other
  misc_feature (524)..(524): n is a, c, g, or t
  modified_base (551)..(551): a, c, t, g, unknown or other
  misc_feature (551)..(551): n is a, c, g, or t
tcagatacgacgtacacgaccggtgctcgatttagactcatctacaggggaacccaaaaaccacacccctcctgggagaactccctagatcacagctcctcaccatggactggacctggagcattccttttttcgtggtggcagcagaccaacgaggtgccccactcccgaggttcagcgtggtcgcgagtcgtggngcgtagggaggtagaaggacggccggtcgggggtcccgtgggtaggtaacggttcctaccgtggacgtaagggtctttcgtacggttacctacccgtttacgagcttagtcggtactacgaggtccggtggggtacgaccggaccgtaccgggacccgtgggaacggtaacgggtcgtaggtagggtagggtaggtgggtggtagtacgtacggacggtacgttacgttaacgaagtacgggtaaacaactacggtaatagtacgacaaagtaaggaccgtacgaggaagacgtacgacctacgatacgacacagaacacncgacanacgacacacggactagacggtaggacncggaggaacggcacggttagacgttaacgcgtacgggaaccgaccgtaccgggtcgtttaacgttcgttaagggtccggtagggtaccgggtttaaaggttacggtttaaggtcggtttaatttcggttaggtttacggttaagggttggttaacccgttcggttttaacgttcggtttttacggggttaccccggg

SEQ ID NO: 276124 - DNA, 634 bp, Homo sapiens
  misc_feature: GYAE6OF01D0F7X.12.2.A02.1.454.CMB.1.raw
  modified_base (187)..(187): a, c, t, g, unknown or other
  misc_feature (187)..(187): n is a, c, g, or t
  modified_base (195)..(195): a, c, t, g, unknown or other
  misc_feature (195)..(195): n is a, c, g, or t
  modified_base (215)..(215): a, c, t, g, unknown or other
  misc_feature (215)..(215): n is a, c, g, or t
  modified_base (225)..(225): a, c, t, g, unknown or other
  misc_feature (225)..(225): n is a, c, g, or t
  modified_base (264)..(264): a, c, t, g, unknown or other
  misc_feature (264)..(264): n is a, c, g, or t
  modified_base (430)..(430): a, c, t, g, unknown or other
  misc_feature (430)..(430): n is a, c, g, or t
tcagatacgacgtacacgaccggtgctcgatttagactcatctacaggggacccaaaaaccacaccccctccttgggagaatcccctagatcacagctcctcaccatggactggacctggagcattccttttcttggtggcagcagcaacaggtgcccactcccaggttcagctgtgcagtctgganctgaggtnaagaagccgtgggcctcggngaagtctccngcaaggtcttctaggttaccaaccttttacaggtcttancggttaatcagcgttgggtgccgaacaccggcccgtaggacgaacgggtctggtacggtaggagttcgggaagtggatccgaagcgtacttacgaataggtaacacgtagactagtcggacaacgagtaacgtaccgaggaactagacgtacacatacgacacganacacgactacgaacgagtacaacgactcgtaacagtaggctagtacgacgagtccgtagagtaccgtggttaacaccgtaacgtacgtccgtagtacttacgtgtacggtacgtaagttacgggtttaactaggttaacttcgttaaggttaggttacgggtcgtttacgggttcgtactttccggttacgggttttaccccgg

SEQ ID NO: 276125 - DNA, 783 bp, Homo sapiens
  misc_feature: GYAE6OF01DIMJC.12.2.A02.1.454.CMB.1.raw
  modified_base (120)..(120): a, c, t, g, unknown or other
  misc_feature (120)..(120): n is a, c, g, or t
  modified_base (189)..(189): a, c, t, g, unknown or other
  misc_feature (189)..(189): n is a, c, g, or t
tcagatacgacgtacacgaccggtgctcgatttagactcatctacaggggacccaaaaccacacccctccttgggagaatcccctagatcacagctcctcaccatggactggacctggancattcctttttctggtggcagcagcaacgaggtcgcccactcccgaggttcagctggtgcagtctgganctggaggtgaaggagtcgtcgggcctcggtagacggtctaccgtgacgaggtcttacgtaggttacctaccgtttaccagtacttagtcggtatcgagtcgtgggtacgcgacgtacgcccgtaggaccgaaggtcttaggacggtgggacgtgggtactacggtactacgacggtaccgtacttaaccgtaaggttaccgggtaaacaacggtaacgtacgttaacgtacgaacgtaacggtaaggtaaccggttaccgaaacggtacgaacgtacgtacccaacgtacgtacgaaccacgaactaccgaactacgtaccgaacggacgtaccaaaccggtactacccggtaaatccgggtaggacgtaccggtacggacggaccgttacgtagggtaacgtcggtaaccgtccggaaccgtaaccgtaccgggacgttttagtaaccggttacgtccgggtacgtaaccggggttaagtttttaaccggggttatacggtttaactttacgggttttaacggtgggttaaccgggtttacggttaacccgtttcgggttaacgttttacccggttcgggttttaccccgggg

SEQ ID NO: 276126 - DNA, 855 bp, Homo sapiens
  misc_feature: GYAE6OF01C4FQ7.12.2.A02.1.454.CMB.1.raw
  modified_base (149)..(149): a, c, t, g, unknown or other
  misc_feature (149)..(149): n is a, c, g, or t
tcagatacgacgtacacgaccggtgctcgatttagactcatctacaggggacccaaaaaccgacacccctcctgggagaatcccctagatcacagctcctccaccatggactggacctggagcatccttttctggtgacagtagcaacnggtgtccactcccaggtgcatctggagcagtctggagctagaggtgaggagccgtggggcctacaagtaaaactcgtacctagcaaaggttcttacgttagggttaccgcctaacgtccgaacccgcctaaagtggttaactccgaaggtcctcggacttccggaccggaaccgacggtaccccccgttagggaaccgtaaggttccggtttaggaggtacggtataggttacaacggtggtactccgaacggtacctacgtttacaaggttacggagtaaccgaacgtaaagtagtacgggaagtaacggtaaccttacgacgggtactacgtacgtaccaaccttacgacgtaccaacgttaacgacctaacgtaacgtaaaccgtaaacgaaccgtaactaaccgtaccccggttaacgttacggtaaacgggtacggtaccccggggttacgtaacgggtacggtaccggtttacggaaacccgaccggtaacccgttaccccgtttaagtaccgtttaacgttcgggttacgtaaccggtaaacggttttaaaacgttttaaccggtttttaacgttttaggttttacgggtttaggtttacgggggttacgggtttcggttaacgggttttcggtttaaaccctaggggtttttttaccgttaacgggtaccccggtttaggggtttaaaccccgggggg

SEQ ID NO: 276127 - DNA, 799 bp, Homo sapiens
  misc_feature: GYAE6OF01AN66T.12.2.A02.1.454.CMB.1.raw
  modified_base (494)..(494): a, c, t, g, unknown or other
  misc_feature (494)..(494): n is a, c, g, or t
tcagatacgacgtacacgaccggtgctcgatttagactcatctacaggggacccaaaaaccacacccctccttgggagaactcccctagatcacagctcctcaccatggactggacctggagcattccttttcttggtggcagcagcaacaggtgcccactcccaggttcagctggtgcagtctggagctgaggtgaagagccgtggggcctcggtgaggtcctccgtgcgaaggccttcgtcggttacctaccttttaccaggtcttagtggtatctagcgtgggtacgcgtaacgcggcccgtaggaacgtacgggtctgaggtcggtaagtgggatggatcgacggtcgtactaacaggtacgtaacagtacgaacttagacgaccgaagtaacggtaacgttaccgaacgggtacgtaacgacgtaccgtaaaccagtaccgaacccaacgtaacgaacgaacctacgacccgaaaggctacccgaaacnccggtaacctaacgtacggtaggaaccggtacggtacggtacggggaacaccgttaacgggaaggttacttacccgggacggaacccggtaccgggaaaccccgggttccggtttaggtttaaaccccgtttagggttccgggacgggtttaacgggttaaacggggtttttaccgggttttaacggttaacggttaaaccgtttttaaggttaccgggtttttagggttaaccggggtttaggttacccggggtttaaacttccgggtttttaaccggtttttacccggggttttacccggggg

SEQ ID NO: 276128 - DNA, 702 bp, Homo sapiens
  misc_feature: GYAE6OF01A0MAN.12.2.A02.1.454.CMB.1.raw
  modified_base (151)..(151): a, c, t, g, unknown or other
  misc_feature (151)..(151): n is a, c, g, or t
  modified_base (226)..(226): a, c, t, g, unknown or other
  misc_feature (226)..(226): n is a, c, g, or t
  modified_base (248)..(248): a, c, t, g, unknown or other
  misc_feature (248)..(248): n is a, c, g, or t
  modified_base (491)..(491): a, c, t, g, unknown or other
  misc_feature (491)..(491): n is a, c, g, or t
tcagatacgacgtacacgaccggtgctcgatttagactcatctacagggggacccaaaaaccacacccctccttgggagaatcccctagatcacagctcctcaccatggactggacctggagcattcctttttcttggtggcagcagcaanaggtgcccactcccaggttcagctggtgtcagtctggagctgaggtgaagagccgtgggcctggagaggtctcgngcaggctcgtgtacaccttacngtctataggtatcagcgtgggtcgcgaccgacggcccgtaggacgtaaggggtcttaggaggtacgggagtcgggtagtggtactcgaggtccgtaccgtactaacggtcggtaaacaacgtagtactagtacgacaagaacggtacgttaccgaacggtacgtaggtaacgtacctaaccacgtaccgaaccaccgtaacgactaccagtaccccgaagactacgaacgacgtacctaacgnggtacgggaacgtcgtaacggaggtaccgtacgagtaccgttaccgtaccggtacgggtaacccgggacgtaacccggggttcgttaggttaactcggtacggttacggtaccggttaaggttacggttttagggatttacgttagtttaggttgtttaacgggttcgggttccttaccgtcggtttacccgttttaccggtttcccgggg

SEQ ID NO: 276129 - DNA, 653 bp, Homo sapiens
  misc_feature: GYAE6OF01EUOR7.12.2.A02.1.454.CMB.1.raw
  modified_base (220)..(220): a, c, t, g, unknown or other
  misc_feature (220)..(220): n is a, c, g, or t
  modified_base (379)..(379): a, c, t, g, unknown or other
  misc_feature (379)..(379): n is a, c, g, or t
  modified_base (572)..(572): a, c, t, g, unknown or other
  misc_feature (572)..(572): n is a, c, g, or t
tcagatacgacgtacacgaccggtgctcgatttagactcatctacaggggacccaaaaaaccacacccctccttgggagaatcccctagatcacagctcctcaccatggactggacctgggagcacttccttttcttggtggcagcagcaacaggtcgcccactcccaggttcagctggtgcagtctggagctgaggtagaagacgccgtgggcctcggngagtctctgcaggtcttcgtcgttacctacctttacagtctagtaggtatcgaggtcgtgggtcacgacgtaccggtcccgtaggaacgtagggtcttggtaggtggaggtgggagtggatcgagccgttactacaagtacgtaaacacgtagtactancgacaacgtacgtaacgtcgaacggacaacggacgtaccaacctaagtaccgaaccacgaacaaccactaccgtaccgacggactaaccgaacctaaccggtacctaagacgtacggacgtacggacgggacgtaccgtacgtaggactaccggtcgaacgaccgggtacccgacgttcgtagttaccgttgnggtacgtaggtagtttaggttatagttacttacgtttggtcgtttaggtacggttcgtacttgttaccgtttcggttccgg

SEQ ID NO: 276130 - DNA, 835 bp, Homo sapiens
  misc_feature: GYAE6OF01BYKNF.12.2.A02.1.454.CMB.1.raw
tcagatacgacgtacacgaccggtgctcgatttagactcatctacaggggacccaaaaaccacacccctccttgggagaatcccctagatcacagctcctcaccatggactggacctggagcatccttttctggtggcagcagcaacaggtgcccactcccaggttcagctggtgcagtctggagctgaggtgaagagccgtgggcctcggtagaacggtctccgtgacgaaggtccttctcggttaacctacccgttttaaccgagtccgttaagtcggttaacgtcgtaggtccgttggggtcgtaccggaccgtacgggtccccgtagggaaccgaacggggtccttagggaacgggttagggtacgttaggggtagtacgggaacgttaccggacggtccgttaacgtttaacgtaaacgttaccggtaaacgaaccgtaaggtacttaacgtcggaacccttaacggaaacggtaaccgtttacccggaagggtaacgtaacggtacgtacccgaaaccgtagtaaccgaacccaacgtacgtaaccaccgaacctaccgaacgaaccgtaacccaacggacccgtaacctaacgtacgtacgggtacgcggtaacgacgggtaccgtacggtacgtaagccgttaacgacggtaacccgggaccggttaaccgggtccgtttaaggttaaccgtttcggtaaccgggtgtaacccgggttaggtttaacgggtttacggtagttaacgttaccgtttagggttaaggttcgggttaggttaacgggttaccctttacgggttccgttttacccgggttttaccccgggg

SEQ ID NO: 276131 - DNA, 672 bp, Homo sapiens
  misc_feature: GYAE6OF01B23TX.12.2.A02.1.454.CMB.1.raw
  modified_base (223)..(223): a, c, t, g, unknown or other
  misc_feature (223)..(223): n is a, c, g, or t
  modified_base (289)..(289): a, c, t, g, unknown or other
  misc_feature (289)..(289): n is a, c, g, or t
  modified_base (440)..(440): a, c, t, g, unknown or other
  misc_feature (440)..(440): n is a, c, g, or t
  modified_base (497)..(497): a, c, t, g, unknown or other
  misc_feature (497)..(497): n is a, c, g, or t
  modified_base (511)..(511): a, c, t, g, unknown or other
  misc_feature (511)..(511): n is a, c, g, or t
tcagatacgacgtacacgaccggtgctcgatttagactcatctacaggggacccaaaaaccacacccctcttgggagaactcccctagatcacagcctcctcaccatggactggacctggagcattccttttcttggtggcagcagcaacaggtcgcccactcccgaggttccagctggtgctagtcgtggagcgtgaggtagaagacgccgtggggcctggngagtctcgtgcgagtcttcgtagttacctacctttaccgagtctgtggtactgacgtcgtgggtcncgaacgcggcccgtaggaacgtaggtcttggaggtcggtagtagggacgtggactcgagtcggtacttaacgtaacggtacgtaaacactaggtaacctagtacgactaacgaagggttaactcgaacggaactaggacgtacctaacganaccaacaccgtaacacacactccgacgacgtcaacgcgacctagacggttcgggaancgtacgggacgacncgtacgggatacctaggaccgtacggaacccgcgggttacctaacggttactaggttcgtaggaccggttaaggtttaggtttaggatttaagtttcggttaaggtttggaccgggttttggtacccggttattccgggtttattttcccggtttaccggg

SEQ ID NO: 276132 - DNA, 729 bp, Homo sapiens
  misc_feature: GYAE6OF01EOO0Q.12.2.A02.1.454.CMB.1.raw
  modified_base (302)..(302): a, c, t, g, unknown or other
  misc_feature (302)..(302): n is a, c, g, or t
  modified_base (703)..(703): a, c, t, g, unknown or other
  misc_feature (703)..(703): n is a, c, g, or t
tcagatacgacgtacacgaccggtgctcgatttagactcatctacaggggacccaaaaaccacacccctccttgggagaatcccctagatcacagctcctcaccatggactggacctggagcattccttttcttggtggcagcagcaacaggtcgcccactcccaggttcagtcgtggtgccaggttctgggagtcgtggagggttagaaaggacggccgtcggggtccgtcgggtagacggttcctccgtggacgaaggtccttcgttaggttacctacctttacagtctagtggtactcngcgtgggtgcgacgacggcccgtagggacgtacggtgttacggaggtgggacggtgggagtggacgtcggacgtcggtacttaacgtagtacggtaaccacgagtacgtagtacgactaagacgttaacgtacgaacggtaacgacgactaccgtaacgacgtacgaacccagaaccgacctaacgaaccctccgaacggacgacctaaaccgacgtaccgacgttagggaccggacgttagcggaacggtaccaggtacgacggtctacggacgtaacggccggtaccgtcggttaactacgttggtacgggttacgtagggtagttttaaggggttctaaggtttactttacggttagggttacgggtttacggttccgggtttagacccgggtttttnttacccgggtttacggtttccccggg

SEQ ID NO: 276133 - DNA, 820 bp, Homo sapiens
  misc_feature: GYAE6OF01DIHKS.12.2.A02.1.454.CMB.1.raw
tcagatacgacgtacacgaccggtgctcgatttagactcatctacaggggacccaaaaaccacacccctcctgggagaatcccctagatcacagctcctcaccatggactggacctggagcattcctttttcttggtggcagcagcaacaggtgcccactcccaggttcagctggtgcagtcgtggagctggaggtgaagagccgtggggcctcggtgaaggtcctccgtgacgaaggtccttcgttggttacctaccctttaccagtactagttggtatcgaggtcgtgggtgaccgtacgaccggcccgtggaaccgtaaggtcgttggaggtagggagtggggagtggatcgaggtcgtacttaacaagtaggtaacacgtagactagtcgacgaacgtaaggtaacgttaccgaacggtaacaacggtaacgtacccgaaccggtaactaaccggaaacccaaaccgtacggaaacccaacctaaccctaaccccgaacggaaccgaaccgtaacaaccgtaacctacgaagtacggtacgtaccggacgggtaaccggacgtacccggtaaggtaacgtacgtaacggttaacccggaaccggtaaaccgggacccgggtttaaccgttaaggtttaccgttaaccggggtttaacggaccgggtaacgggtttaaggggtttttaaggggttttaaccgtaaggttttaacgttttaacgggttttaaacggtttgggttttaaacgggttggggtttaacccggtttaccgttttacgggttaccccgtttttacgggggttttaaccccggg

SEQ ID NO: 276134 - DNA, 814 bp, Homo sapiens
  misc_feature: GYAE6OF01DY9TY.12.2.A02.1.454.CMB.1.raw
  modified_base (513)..(513): a, c, t, g, unknown or other
  misc_feature (513)..(513): n is a, c, g, or t
tcagatacgacgtacacgaccggtgctcgatttagactcatctacagggacccaaaaaccacaccctccttgggagaatccctagatcacagctcctcaccatggactggacctggagcattccttttcttggtggcagcagcaacaggtcgcccactcccaggttcagctggtgcagtctggagctgaggtagaagagccgtggggctcgggtgaacggtctccgtgacaaggtctttacgttggttacctacccgtttaccaggtacttacgttggttaatacgtacggttcggtcggggttacgccgtaaccgacgggtaccctagggaaccgtaaggggtctttcgggaggtagggtaggtggggtaagtcgggtaagttaccgacggtccgttacgttaaaccgaagttacgggtaaaacctacgaggtaactagtacgactaacggaaacgttaacggtccgaaaggtaaccgaggtaacctcgtaaacacgttacgaacccggaanaaccggaacctaaaccgtaccgtaaccgtaacgaacccgacgaaccgtaacgaaccctacgaagtcggaacggtgtaacgggacggtacggtaccgttagaacggtactaccgtacggaaccgtacggtaccgggttaccttacggttaccgttttaagccggttacggtaccggttaaggggtttaacggttttacgtaaaggttactttaaaccggtttaggtttagggtttaacgggtttccggggttaacggtttacccggttaacggtttcgttttaccggggttttaccccgggg

SEQ ID NO: 276135 - DNA, 883 bp, Homo sapiens
  misc_feature: GYAE6OF01D1ZZF.12.2.A02.1.454.CMB.1.raw
  modified_base (154)..(154): a, c, t, g, unknown or other
  misc_feature (154)..(154): n is a, c, g, or t
  modified_base (188)..(188): a, c, t, g, unknown or other
  misc_feature (188)..(188): n is a, c, g, or t
tcagatacgacgtacacgaccggtgctcgatttagactcatctacaggggacccaaaaaccacacccctccgttgggagaactcccctagatcacagcctcctcaccagtggactggacctggagcattccttttctggtgcaggcagcaaacnggtcgccctacctcccgaggttcagtctgggtcncgtagttccgtaggacgcgtaggtagggtagaaacgggaacgccgggttggggtacccttagggtaggtaaccgggttctacccgttcgacgtaacgggtcctttcgtaggttaaccctacctttaccggatcgttaccgtagggttactacgtaggttaccggtgggtacgaccggaccgttacccggggtcccgtaaggaacggtaacggggttcgtttacgggaacggtggggtacggtggggtaaacgttcggaacgtcgaaccggtgttaacctaagtaggacgttaaccagactactagacctacgtagaaccggtgttacggaagaaacggtcgtacgaccggtaacctacgtacccgaaacacggtaacgaacccgaactacccggtacgaccgacaccctaacggtaacctaacgttaccacggttcggaaacggtcgaacgggttaccggtacgtacgtacggtaaccggtcggttaaccgaacccgggaacggtccccggttaaggttaaccggtttacggttacgttaaccgggttcgggtaccgggttaggtttaaccggggttaaggttttacccggtaggttttaactttacggttaagggttttaacgggttaacgggtttccggtttaaacggttccgtttaaacggtttccggttttcccgggtttaacccccgggg

SEQ ID NO: 276136 - DNA, 506 bp, Homo sapiens
  misc_feature: GYAE6OF02GCWGK.12.2.A02.1.454.CMB.1.raw
  modified_base (375)..(375): a, c, t, g, unknown or other
  misc_feature (375)..(375): n is a, c, g, or t
  modified_base (407)..(407): a, c, t, g, unknown or other
  misc_feature (407)..(407): n is a, c, g, or t
  modified_base (467)..(467): a, c, t, g, unknown or other
  misc_feature (467)..(467): n is a, c, g, or t
tcagatacgacgtacacgaccggtgctcgatttagactcatctacaggggacccaaaaaccacacccctccttgggagaatcccctagatcacagctcctcaccatggactggacctggagcatccttttcttggtggcagcagcaacaggtgcccactcccaggttcagctggtgcagtctggagctgaggtgaagaagcctggggcctcggtgaaggtctcctgcaaggcttctggttacacctttaccagctatggtatcagctgggtgcgacaggaccctggacaagggcttgagtggatgggatggatcagcgcttacaatggtaacacagactatgcacagaagttccaggacagagtcacatgaccanagacacatccacgagcacacgcctacatgganctgaggagcctgagatcgtgacgacgacggccgtgtattacgtgtgcgagtaggtttagngtatacttagttgtagttggtgtactgtacttgtttcgg

SEQ ID NO: 276137 - DNA, 513 bp, Homo sapiens
  misc_feature: GYAE6OF02IWIZH.12.2.A02.1.454.CMB.1.raw
  modified_base (430)..(430): a, c, t, g, unknown or other
  misc_feature (430)..(430): n is a, c, g, or t
  modified_base (452)..(452): a, c, t, g, unknown or other
  misc_feature (452)..(452): n is a, c, g, or t
  modified_base (460)..(460): a, c, t, g, unknown or other
  misc_feature (460)..(460): n is a, c, g, or t
tcagatacgacgtacacgaccggtgctcgatttagactcatctacaggggacccaaaaaccacacccctccttgggagaatcccctagatcacagctcctcaccatggactggacctggagcatccttttcttggtggcagcagcaacaggtgcccactcccaggttcagctggtgcagtctggagctgaggtgaagaagcctggggcctcggtgaaggtctcctgcaaggcttctggttacacctttaccagctatggtatcagctgggtgcgacaggccccctggacaagggcttgagtggatggggtggatcgaacgtacagactggtggcacagactatgcacgaggggctccaggggcagactcaccatgaccacagacacatcagcgaacacagtacaacatggagttgcggagcctgcgatcngaccgacgcggcgtatattacngtgcgagngtacgtagcggcttcgtccttgacttacgtcgggcctagggaactcgtggtcc

SEQ ID NO: 276138 - DNA, 514 bp, Homo sapiens
  misc_feature: GYAE6OF02GM2FO.12.2.A02.1.454.CMB.1.raw
  modified_base (471)..(471): a, c, t, g, unknown or other
  misc_feature (471)..(471): n is a, c, g, or t
tcagatacgacgtacacgaccggtgctcgatttagactcatctacaggggacccaaaaaccacacccctccttgggagaatcccctagatcacagctcctcaccatggactggacctggagcatccttttcttggtggcagcagcaacaggtgcccactcccaggttcagctggtgcagtctggagctgaggtgaagaagcctggggcctcggtgaaggtctcctgcaaggcttctggttacacctttaccagctatggtatcagctgggtgcgacaggccccctggacaagggcttgagtggatgggatggatcagcgcttacaatggtaacacagactatgcacagaagttccaggacagagtcaccatgaccacagacacatccacgagcacagcctacatggagctagaggagcctgagatctgacgactacgggccgtgtacttactgtgcgaggtaggttttagngtattacttattgtagtggtacggtacctgtcttagttttcgg

SEQ ID NO: 276139 - DNA, 568 bp, Homo sapiens
  misc_feature: GYAE6OF02IO8CC.12.2.A02.1.454.CMB.1.raw
tcagatacgacgtacacgaccggtgctcgatttagactcatctacaggggacccaaaaaccacacccctccttgggagaatcccctagatcacagctcctcaccatggactggacctggagcatccttttcttggtggcagcagcaacaggtgcccactcccaggttcagctggtgcagtctggagctgaggtgaagaagcctggggcctcggtgaaggtctcctgcaaggcttctggttacacctttaccagctatggtatcagctgggtgcgacaggcccctggacaagggcttgagtggatggggatggatcagcgcttacaagtggtaacacgagactatgacacagaagttccaggacagagtcaccatgaccacagacacactccacgacgcacacgctaacagtacggagcgtggacggacgcctaggagatcgtaggaccgaccgacgggtaccgttgtaactttaccgtgttcgacggtaaggttagggtttttagtaggtattacgtttagtttaggttacggttgggttggttaccgttgtacttacgtttttcggg

SEQ ID NO: 276140 - DNA, 624 bp, Homo sapiens
  misc_feature: GYAE6OF02H4WJW.12.2.A02.1.454.CMB.1.raw
tcagatacgacgtacacgaccggtgctcgatttagactcatctacaggggacccaaaaaccacacccctccttgggagaatcccctagatcacagctcctcaccatggactggacctggagcatccttttcttggtggcagcagcaacaggtgcccactcccaggttcagctggtgcagtctggagctgaggtgaagaagcctggggcctcggtgaaggtctctgcaaggcttctggttacacctttacagctatggtatcagcgtgggtgcgacgacggcccctggacgaagggcttgagtggagtggatggatcgagcgtcttacaagtggtaacacagactatgcaacgagtaacgttccgaaggacaggacgtacaccatacgaaccacgacgacacactacccaacgacgacaacgacgaccctaacgagtacgggacgtacgtacggaacgggacgccgtaggaacgtacgttacgtacggtaaccgaccgtacccgggtaccgttacgtaagttacgttgtacggacgtaggtttaaggttttgtacgttaattacgttttaagttggttaggtgggttacgttaccgttggttacccgtttaggtttttacccggg

SEQ ID NO: 276141 - DNA, 541 bp, Homo sapiens
  misc_feature: GYAE6OF02IRP0B.12.2.A02.1.454.CMB.1.raw
  modified_base (212)..(212): a, c, t, g, unknown or other
  misc_feature (212)..(212): n is a, c, g, or t
  modified_base (221)..(221): a, c, t, g, unknown or other
  misc_feature (221)..(221): n is a, c, g, or t
  modified_base (269)..(269): a, c, t, g, unknown or other
  misc_feature (269)..(269): n is a, c, g, or t
  modified_base (347)..(347): a, c, t, g, unknown or other
  misc_feature (347)..(347): n is a, c, g, or t
  modified_base (382)..(382): a, c, t, g, unknown or other
  misc_feature (382)..(382): n is a, c, g, or t
  modified_base (395)..(395): a, c, t, g, unknown or other
  misc_feature (395)..(395): n is a, c, g, or t
  modified_base (483)..(483): a, c, t, g, unknown or other
  misc_feature (483)..(483): n is a, c, g, or t
tcagatacgacgtacacgaccggtgctcgatttagactcatctacaggggacccgaaaaaccgacacccctccttgggagaactcccctagatcacagctcctcaccatggacctggacctggagcatccttttctggtggcagcagcaacaggtgcccatcccaggttcagctggtgcagtctggagctgaggtgagagcctgggcctggnaaggtctcngcaaggtcttctggttacacctttacagctagtggtatctagctggtncgacaggcccctggacaagggcttgagtggatgggatggatcgagcgtcttacaagtggtaacacgagactatgcaanagaagttcaggacaggatcaaccgatggaccacgngacactataccgngagcacacgctacatcggaagcgtagacgagcctgagactacgtgacgagaccggccgtagtatacgtgtgacgtagttaggtttagnggattaccgttagttggtaaggtggttacggttaaccgtgtacgtttacgtttccggg

SEQ ID NO: 276142 - DNA, 632 bp, Homo sapiens
  misc_feature: GYAE6OF02IJZP6.12.2.A02.1.454.CMB.1.raw
  modified_base (439)..(439): a, c, t, g, unknown or other
  misc_feature (439)..(439): n is a, c, g, or t
tcagatacgacgtacacgaccggtgctcgatttagactcatctacaggggacccaaaaaccacacccctccttgggagaatcccctagatcacagctcctcaccatggactggacctggagcatccttttcttggtggcagcagcaacaggtgcccactcccaggttcagctggtgcagtctggagctgaggtgaagaagccgtgggctcggtgaaggtctcctgcaaggcttctggttacaccgtttaccagctatggtatcagctgggtgcgacaggccccgtggacgaagggcttggagtggagtgggatggatcgagcgcttaacaagttggtaacacgagtactagtcgactaacgaagtaacgttccgaaggaacagacgtacaccatacgaccacaagacacactaccgaacgacgacacgaacgccctaanagtggaacgtcgttaggaacggacgtacctggaacgaactctacggaccgaaccgtacgggccgttagttaacgttacttacgggtagacgtaacggtttaggggttttaacgagttaagttaacctttagtttagggttcggttagggtttaccggttacccgttaggttacccgtttaggtttttaccggg

SEQ ID NO: 276143 - DNA, 618 bp, Homo sapiens
  misc_feature: GYAE6OF02FMCZC.12.2.A02.1.454.CMB.1.raw
  modified_base (423)..(423): a, c, t, g, unknown or other
  misc_feature (423)..(423): n is a, c, g, or t
tcagatacgacgtacacgaccggtgctcgatttagactcatctacaggggacccaaaaaccacacccctccttgggagaatcccctagatcacagctcctcaccatggactggacctggagcatccttttcttggtggcagcagcaacaggtgcccactcccaggttcagctggtgcagtctggagctgaggtgaagaagcctggggcctcggtgaaggtctcctgcaaggcttctggttacacctttaccagctatggtatcagctgggtgcgacacggcccctggacaagggcttgagtggatgggatggatcagcgcttacaatggtaacacagactatgcacagaagttccaggacagagtcacatcgaccacagacaacactccaacgacgacacgacgtaccctaacagtagggacncgtaggaggacgtccgtaggagtactcgtaggaaccgacgaccgggtaccgttagttaacgtttacgtaggttacgacggtaaggttagggtttttaacggtagttaacgtttaacgttttaagtttagggttagggtttcggggttacggtttacccggttacggttaccgtttttacggttttttacccgggg

SEQ ID NO: 276144 - DNA, 509 bp, Homo sapiens
  misc_feature: GYAE6OF02FKR3H.12.2.A02.1.454.CMB.1.raw
  modified_base (448)..(448): a, c, t, g, unknown or other
  misc_feature (448)..(448): n is a, c, g, or t
  modified_base (465)..(465): a, c, t, g, unknown or other
  misc_feature (465)..(465): n is a, c, g, or t
tcagatacgacgtacacgaccggtgctcgatttagactcatctacaggggacccaaaaaccacacccctccttgggagaatcccctagatcacagctcctcaccatggactggacctggagcatccttttcttggtggcagcagcaacaggtgcccactcccaggttcagctggtgcagtctggagctgaggtgaagaagcctggggcctcggtgaaggtctcctgcaaggcttctggttacacctttaccagctatggtatcagctgggtgcgacaggcccctggacaagggcttgagtggatgggatggatcagcgcttacaatggtaacacagactatgcacagaagttccaggacagagtcaccatgaccacagacacatccacgagcacagcctacatggagctgaggagcctgagatctagacgacacggccgtgtattacngtgcgagaggttttagngtatacttatggttagtggtggtacctggtcttacgttttcggg

SEQ ID NO: 276145 - DNA, 630 bp, Homo sapiens
  misc_feature: GYAE6OF02F5KZO.12.2.A02.1.454.CMB.1.raw
  modified_base (385)..(385): a, c, t, g, unknown or other
  misc_feature (385)..(385): n is a, c, g, or t
tcagatacgacgtacacgaccggtgctcgatttagactcatctacaggggacccaaaaaccacacccctccttgggagaatcccctagatcacagctcctcaccatggactggacctggagcattcctttttcttggtggcagcagcaacaggtgcccactcccaggttcagctggtgcagtctggagctgaggtgaagaagcctggggcctcggtgaaggtctcctgcaaggcttctggttacacctttaccagctatggtatcagcgtgggtgcgacacggcccctggacaagggtcttgagtggatgggatggatcaggcgcttacaatggtaacacagactatgacacaagaacgttccgaggacagagtcacatgaccanagacacactaccacgagacacacgacctacagtagggacgcgtaggaagggacgccgttaggaagtagtacgtacggaaccgaaccggaccgggttaccgttcgttaacgtttacgtagggttcggacgggttaaggttaaggggttttttaaggaggttaacgtttaacgtttttagtttaggtttacgggttagggtttaccgggttacgtttcggttaccgttttaccgttttttaccgggg

SEQ ID NO: 276146 - DNA, 618 bp, Homo sapiens
  misc_feature: GYAE6OF02IVD0X.12.2.A02.1.454.CMB.1.raw
  modified_base (356)..(356): a, c, t, g, unknown or other
  misc_feature (356)..(356): n is a, c, g, or t
  modified_base (410)..(410): a, c, t, g, unknown or other
  misc_feature (410)..(410): n is a, c, g, or t
  modified_base (532)..(532): a, c, t, g, unknown or other
  misc_feature (532)..(532): n is a, c, g, or t
tcagatacgacgtacacgaccggtgctcgatttagactcatctacaggggacccaaaaaccgacacccctccttgggagaactcccctagatcacagctcctcaccatggactggacctggagcatccttttcttggtggcagcagcaacaggtgcccactcccaggttcagctggtgcagtctggagctgaggtgaagaagcctggggcctcgggtgaaggtctcctgcaagggcttctggttacacctttaccagctatggtatcagctgggttgcgacaggccccctggacaagggcttggagtggagtcgggatgggatcgggcgcgttacaagtggtaacgacaggactangcacagaagttccgaaggacagagtcaccatcgaccacagacacatccacgacncacacgcctaacatagagtcgtcgagggtagcccgtagacgtctcgttacggacgtaaccgaccgggtacccgttaggtaactttaccgttaggttcgtacggtagttagggtttttacggngtaacgtttacgtttaagttaggttaggtttacgggttacggttcccgttaggttccgtttaacggtttttccgggttaccccggg

SEQ ID NO: 276147 - DNA, 669 bp, Homo sapiens
  misc_feature: GYAE6OF02H28HO.12.2.A02.1.454.CMB.1.raw
  modified_base (435)..(435): a, c, t, g, unknown or other
  misc_feature (435)..(435): n is a, c, g, or t
tcagatacgacgtacacgaccggtgctcgatttagactcatctacaggggacccaaaaaccacacccctccttgggagaatcccctagatcacagctcctcaccatggactggacctggagcatccttttcttggtggcagcagcaacaggtgcccactcccaggttcagctggtgcagtctggagctgaggtgaagaagcctggggcctcggtgaaggtctcctgcaaggcttctggttacacctttaccagctatggtatcagctgggtgcgacacggcccctggacaagggcttgagtggatgggatggatcgagcgacttacgaagtggtaacacgagacctatcgacaacaggaagttccaaggtacaaggacgtacaaccagtcgaactaacagacacactaccgaacgagactaacgacgaccctaanacgtagggacgaccgttaggaacgggacgtaccgtaggaagtaccgtaccgttaggaacccggtaccggaaccgggttccggttacgttaacgttaaccgttgggtacgtaccgggtaagggtttaagggttttacggtacggtttaacgttaacgttttaacgtttaggttacggttcggggttaccggttaacccggtttggttacccgttttaccggttttttacccgggg

SEQ ID NO: 276148 - DNA, 523 bp, Homo sapiens
  misc_feature: GYAE6OF02F6SDF.12.2.A02.1.454.CMB.1.raw
  modified_base (394)..(394): a, c, t, g, unknown or other
  misc_feature (394)..(394): n is a, c, g, or t
  modified_base (411)..(411): a, c, t, g, unknown or other
  misc_feature (411)..(411): n is a, c, g, or t
  modified_base (479)..(479): a, c, t, g, unknown or other
  misc_feature (479)..(479): n is a, c, g, or t
tcagatacgacgtacacgaccggtgctcgatttagactcatctacaggggacccaaaaaccacacccctccttgggagaatcccctagatcacagctcctcaccatggactggacctggagcatccttttcttggtggcagcagcaacaggtgcccactcccaggttcagctggtgcagtctggagctgaggtgaagaagcctggggcctcggtgaaggtctcctgcaaggcttctggttacacctttaccagctatggtatcagctgggtgcgacaggccccctggacaagggcttgagtggagtgggatggatcagcgcttacaatggtaacacagactatgcacagaagttccaggacagacgtcaccatgaccacagacacatccacgancacagcctacatggacncgtgagggacgcctagagatcgtgaccgacgaccggtccgtagtattacgtgcgcgtagtggtttagngtatcttagttgtaggtggtcggtactgtcgttagttttccggg

SEQ ID NO: 276149 - DNA, 722 bp, Homo sapiens
  misc_feature: GYAE6OF02J1ASG.12.2.A02.1.454.CMB.1.raw
  modified_base (275)..(275): a, c, t, g, unknown or other
  misc_feature (275)..(275): n is a, c, g, or t
  modified_base (562)..(562): a, c, t, g, unknown or other
  misc_feature (562)..(562): n is a, c, g, or t
tcagatacgacgtacacgaccggtgctcgatttagactcatctacagggacccaaaaaccacacccctccttgggagaatcccctagatcacagctcctcaccatggactggacctggagcatccttttcttggtggcagcagcaacaggtgcccactcccaggttcagctggtgcagtctggagctgaggtgaagagccgtggggcctcggtgaaggtctccgtgcaaggcttcgtggttacacctttaccagctagtggtatcagctgggtcncgtacacggtcccctaggactaagggcttggagttggagtgggatggatcgagtccgtacttaacgaagtcgggtaaactacgagtacttaagcgtacaactaaggtaacggttccaaggacgaaggacggttccaaccgtatcggaaccaacgtaagccgaaacacgtacccaacggaacggccctaacgaacggacccttaacgataccgggagtaccgtaggacgggaacgtccgtaggaacgacttacggacggtaaccgaaccggtaccggttaccgggttntttaaaccggtttaacgtcgtaccggggacgttacgggttaagggttttttaacggacggttaacgtttaaacgtttacggttttagggttaacgggtttaggggttaccggtttaacccggtttagggtttccgttttaaaccggttttttcccggggg

SEQ ID NO: 276150 - DNA, 700 bp, Homo sapiens
  misc_feature: GYAE6OF02HA5FX.12.2.A02.1.454.CMB.1.raw
  modified_base (243)..(243): a, c, t, g, unknown or other
  misc_feature (243)..(243): n is a, c, g, or t
  modified_base (250)..(250): a, c, t, g, unknown or other
  misc_feature (250)..(250): n is a, c, g, or t
  modified_base (258)..(258): a, c, t, g, unknown or other
  misc_feature (258)..(258): n is a, c, g, or t
  modified_base (278)..(278): a, c, t, g, unknown or other
  misc_feature (278)..(278): n is a, c, g, or t
  modified_base (527)..(527): a, c, t, g, unknown or other
  misc_feature (527)..(527): n is a, c, g, or t
  modified_base (586)..(586): a, c, t, g, unknown or other
  misc_feature (586)..(586): n is a, c, g, or t
tcagatacgacgtacacgaccggtgctcgatttagactcatctacaggggacccaaaaaccgacacccctccttgggagaatcccctagatcacagctcctcaccatggactggacctggagcatccttttcttggtggcagcagcaacaggtgcccactcccaggttcagtctggtgcagtctggagctgaggtgaagaagccgtgggggcctcggtgaaggtctccgtggcaaggcttcgnggttacncctttacngctatggtatcagctgggtncgacacggccccctaggacaagggtcttacggagtcggagtggggactggatcgaaggtcgtacgtttaacgaagttcgggtaaaccacgtacgtaacttaagcgacgaacgtaaggtaacggtttacccaagggtaaccaaggtacgtacccaaaccgagttacggaacccaaggacgaccaactactaccccgaacacgacaccgaacggtaccctaacgtacgtacggaactcgtaggacggtacncccgtagacgtacgtacgtagacccgacgtaccgggtaccgttacgtactttaaccggnggtacgtacgggttagtttaacgggttttagtacggtaactttaaccgttagtttagggtaacggtttggggttaacgttaccgtcggttaccgttttaggttttaccccgggg

SEQ ID NO: 276151 - DNA, 594 bp, Homo sapiens
  misc_feature: GYAE6OF02F56H5.12.2.A02.1.454.CMB.1.raw
tcagatacgacgtacacgaccggtgctcgatttagactcatctacaggggacccaaaaaccacacccctccttgggagaatcccctagatcacagctcctcaccatggactggacctggagcatccttttcttggtggcagcagcaacaggtgcccactcccaggttcagctggtgcagtctggagctgaggtgaagaagcctggggcctcggtgaaggtctcctgcaaggcttctggttacacctttaccagctatggtatcagctgggtgcgacaggcccctggacaagggcttggagtggatgggatggatcgagcgcttacaagtggtaacacagactatgacacagaacgttccaggacagacgtacaccatcgaccacagacaacactaccacgacgacaacgacgacctaacagtggacgtcgtaggacgggacgccgtaggacgtactcgtagaccgacgtaccgggtccgttagttactttacgtgtacggacggtagttacgggtttttaggagttaactttacgtttagtttacggttaggttcgggttacggttacctggttccgtttacgtttttccgggg

SEQ ID NO: 276152 - DNA, 572 bp, Homo sapiens
  misc_feature: GYAE6OF02GKHE8.12.2.A02.1.454.CMB.1.raw
tcagatacgacgtacacgaccggtgctcgatttagactcatctacaggggacccaaaaaccacacccctccttgggagaatcccctagatcacagctcctcaccatggactggacctggagcatccttttcttggtggcagcagcaacaggtgcccactcccaggttcagctggtgcagtctggagctgaggtgaagaagcctggggcctcggtgaaggtctcctgcaaggcttctggttacacctttaccagctatggtatcagctgggtgcgacaggcccctggacaagggcttgagtggatgggatggatcgagcgcttacaatggtaacacagactatgcacagagttccaggacagagtcacatgaccacagacacactaccacgacgcaacacgaccctacagtgggaagccgtaggaacgggacgcccgtaggacgtaacgttccgtacggaaccggaaccgtaccgggtccgttagttactttaacgtgtgacggtaaggttaggttttaagagttattacgttagttggtagttggttcggtacgtgtacttagttttccggg

SEQ ID NO: 276153 - DNA, 517 bp, Homo sapiens
  misc_feature: GYAE6OF02GQZMM.12.2.A02.1.454.CMB.1.raw
  modified_base (375)..(375): a, c, t, g, unknown or other
  misc_feature (375)..(375): n is a, c, g, or t
  modified_base (391)..(391): a, c, t, g, unknown or other
  misc_feature (391)..(391): n is a, c, g, or t
  modified_base (428)..(428): a, c, t, g, unknown or other
  misc_feature (428)..(428): n is a, c, g, or t
tcagatacgacgtacacgaccggtgctcgatttagactcatctacaggggacccaaaaaccacacccctccttgggagaatcccctagatcacagctcctcaccatggactggacctggagcatccttttcttggtggcagcagcaacaggtgcccactcccaggttcagctggtgcagtctggagctgaggtgaagaagcctggggcctcggtgaaggtctcctgcaaggcttctggtacacctttaccagctatggtatcagctgggtgcgacaggcccctggacaagggcttgagtggatgggatggatcgagcgcttacaatggtaacacagactatgcacagaagttccaggacagagtcacatgaccanagacacactccacgancacagcctacatggagctaggaggagccgtgagatcngacgacacggccgtgtattacgtgtgcgagtaggttttagagtagtaacttagttggtagttggtcgttacctgtcttacgttttcggg

SEQ ID NO: 276154 - DNA, 539 bp, Homo sapiens
  misc_feature: GYAE6OF02GTP2C.12.2.A02.1.454.CMB.1.raw
tcagatacgacgtacacgaccggtgctcgatttagactcatctacaggggacccaaaaaccacacccctccttgggagaatcccctagatcacagctcctcaccatggactggacctggagcatccttttcttggtggcagcagcaacaggtgcccactcccaggttcagctggtgcagtctggagctgaggtgaagaagcctggggcctcggtgaaggtctcctgcaaggcttctggttacacctttaccagctatggtatcagctgggtgcgacaggcccctggacaagggcttgagtggatgggatggatcagcgcttacaatggtaacacagactatgcacagaagttcaggacagagtcaccatcgaccacagacacacaccacgagcaacacgcctacagtggagctggaggcgacctgagatacgtagacgacgacggccgtagtacttacgtgtggacgtaggtacggttttagtagtattacgtttagttaggtagttggtacggttaccgtgttcgttacgttttcggg

SEQ ID NO: 276155 - DNA, 563 bp, Homo sapiens
  misc_feature: GYAE6OF02FVY10.12.2.A02.1.454.CMB.1.raw
  modified_base (495)..(495): a, c, t, g, unknown or other
  misc_feature (495)..(495): n is a, c, g, or t
tcagatacgacgtacacgaccggtgctcgatttagactcatctacaggggacccaaaaaccacacccctccttgggagaatcccctagatcacagctcctcaccatggactggacctggagcatccttttcttggtggcagcagcaacaggtgcccactcccaggttcagctggtgcagtctggagctgagatgaagaagcctggggcctcggtgaaggtctcctgcaaggcttctggttacaccttttaccagctatggtataagctgggtgcgacaggcccctggacaagggcttgagtggatgggatggatcagcgcttacaatggtaacacagactatgcacagaagttccaggacagagtcacatgaccacagacacatccacgagcacacgcctacactggagctaggaggacgccgtggacgacgtcgtagaccgacgaccgggccgttagtactttacgtgtacgcggtaggtagggtttttaaggngtaacttacgtttaagtttggttacggttgggttacggttaccttggtacctttacgttttttccggg

SEQ ID NO: 276156 - DNA, 579 bp, Homo sapiens
  misc_feature: GYAE6OF02I5VB2.12.2.A02.1.454.CMB.1.raw
  modified_base (402)..(402): a, c, t, g, unknown or other
  misc_feature (402)..(402): n is a, c, g, or t
  modified_base (414)..(414): a, c, t, g, unknown or other
  misc_feature (414)..(414): n is a, c, g, or t
tcagatacgacgtacacgaccggtgctcgatttagactcatctacaggggacccaaaaaccacacccctccttgggagaatcccctagatcacagctcctcaccatggactggacctggagcatccttttcttggtggcagcagcaacaggtgcccactcccaggttcagctggtgcagtctggagctgaggtgaagaagcctggggcctcggtgaaggtctcctgcaaggcttctggttacacctttacagctatggtatcagctgggtgcgacaggcccctggacaagggcttgagtggatgggatggatcagcgcttacagtggtaacacagactagtcgacacgaagtaacgttccgaaggacagacgtcaccatacgaccacagacacatccacgancacacgcctaanagtggagtctagggaacggacgtcccgtaggaagagttccgtaggaccgtaacggaccggtccgttaggtacttacgtgtcgacgtaaggttaggttttaggacgtaagttaccgtttagttggttaggttcggttaggttacctggttacgtttcgttttcggg

SEQ ID NO: 276157 - DNA, 621 bp, Homo sapiens
  misc_feature: GYAE6OF02IU3QG.12.2.A02.1.454.CMB.1.raw
  modified_base (393)..(393): a, c, t, g, unknown or other
  misc_feature (393)..(393): n is a, c, g, or t
  modified_base (508)..(508): a, c, t, g, unknown or other
  misc_feature (508)..(508): n is a, c, g, or t
tcagatacgacgtacacgaccggtgctcgattttagactcatctacaggggacccaaaaaaccacacccctccttgggagaatcccctagatcacagctcctcaccatggactggacctggagcatccttttcttggtggcagcagcaacaggtgcccactcccaggttcagctggtgcagtctggagctgaggtgaagaagcctggggcctcggtgaaggtctcctgcaaggcttctggttacacctttaccagctatggtatcagctgggtgcgacgaggccccctggacaagggcttggagtggatggggatgggatcgagcgcttaacaagtaggtaacacgagactatgacacaagaacgttcaggacagagtacaccatcgaccaanacgacaacactaccaacgagcaacgacgaccctacagtcgggaagccgtggacggacgcctaggacgattacgtacgaccggaaccgacgggaccggttagttaaccgtttacgnggttacggcggtaaggtttaagggtttttacgtaggttaactttaacgtttaggtttagttaacggttgggtttaagttacccgttaggttacctttacggttttttccgggg

SEQ ID NO: 276158 - DNA, 566 bp, Homo sapiens
  misc_feature: GYAE6OF02I428U.12.2.A02.1.454.CMB.1.raw
tcagatacgacgtacacgaccggtgctcgatttagactcatctacaggggacccaaaaaccacacccctccttgggagaatcccctagatcacagctcctcaccatggactggacctggagcatccttttcttggtggcagcagcaacaggtgcccactcccaggttcagctggtgcagtctggagctgaggtgaagaagcctggggcctcggtgaaggtctcctgcaaggcttctggttacacctttaccagctatggtatcagctgggtgcgacaggcccctggacaagggcttgagtggatgggatggatcgagcgcttacaagtggtaacacagactatgcacagagttcgaggacagagtcacatcgaccacacgacacataccacgacgcacacgacctacagtacggacgtcgtacggaggacgtcccgtaggaacgagtcgtacggacgaccgaccggtacgttagttacttacgtgtacggcgtaggttaggtttaggtgtaattacgtttagttggttaggtggttcggtacgttcgttccgttagttttcccggg

SEQ ID NO: 276159 - DNA, 574 bp, Homo sapiens
  misc_feature: GYAE6OF02G47X9.12.2.A02.1.454.CMB.1.raw
  modified_base (323)..(323): a, c, t, g, unknown or other
  misc_feature (323)..(323): n is a, c, g, or t
  modified_base (410)..(410): a, c, t, g, unknown or other
  misc_feature (410)..(410): n is a, c, g, or t
tcagatacgacgtacacgaccggtgctcgatttagactcatctacaggggacccaaaaaccacacccctccttgggagaatcccctagatcacagctcctcaccatggactggacctggagcatccttttcttggtggcagcagcaacaggtgcccactcccaggttcagctggtgcagtctggagctgaggtgaagaagcctggggcctcggtgaagggtctcctgcaaggcttctggttacacctttaccagctatggtatcagctgggtgcgacaggcccctggacaagggctgagtggatgggatggatcagcgcttanatgtaacacagactatgcacagaacgttccaggacagagtcacatcgaccacagacacactccaacgagcacagccctacatggacncgtaggaggacgcctagaggatcgtacggacgaaccgacgggtccgtgttaacttaacgtggtagtaccggaaggttagggtttttagtaggtaactttaacgtttagtttaggttacggttgggtaccggttaaccgtcggttacctttacgtttttaccggg

SEQ ID NO: 276160 - DNA, 575 bp, Homo sapiens
  misc_feature: GYAE6OF02I17CW.12.2.A02.1.454.CMB.1.raw
  modified_base (380)..(380): a, c, t, g, unknown or other
  misc_feature (380)..(380): n is a, c, g, or t
  modified_base (510)..(510): a, c, t, g, unknown or other
  misc_feature (510)..(510): n is a, c, g, or t
tcagatacgacgtacacgaccggtgctcgatttagactcatctacaggggacccaaaaaccacacccctccttgggagaatcccctagatcacagctcctcaccatggactggacctggagcatccttttcttggtggcagcagcaacaggtgcccactcccaggttcagctggtgcagtctggagctgaggtgaagaagcctggggcctcggtgaaggtctcctgcaaggcttctggttacacctttaccagctatggtatcagctgggtgcgacgaggccccctggacaagggcttgagtggagtgggatggatcagcgcttacatggtaacacagactatgcacagaacgttcaggacagacgtcacatacgaccanacgacacacgtaccaacgacgacaacgacgccctaacagttggagctaggacggcgccgtaggagactcgtaggaccgtaacgaccggtccgttagtacttacgtgtacgacggtaggttaggttttagngtaattacgtttagtttggttagttgggttacggtaccgttggttacctttcggtttttaccggg

SEQ ID NO: 276161 - DNA, 652 bp, Homo sapiens
  misc_feature: GYAE6OF02IWO96.12.2.A02.1.454.CMB.1.raw
tcagatacgacgtacacgaccggtgctcgatttagactcatctacaggggacccaaaaaccacacccctccttgggagaatcccctagatcacagctcctcaccatggactggacctggagcatccttttcttggtggcagcagcaacaggtgcccactccccaggttcagctggtgcagtctggagctgaggtgaagaagcctggggcctcggtgaaggtctcctgcaaggcttctggttaccacctttaccagctatggtatcagctgggtgcgacacggcccctggacaagggcttggagtggatgggatgggatcgagcgtcttacgaatggtaacacgagactatgaccacgaagtaacgttccgaaggacagaacgtaccaaccctagtacgaacccaacacgaaccgaacctaactacccgaacggacgaccaacgacgaccctaacgaacgttgggaacgtctgggaacggacgtcccgtagaacggtaacgttaccgtaggaaccgtacggacccgggtccgtagttacttacgtgttacgacggtaggttacggttttagtaggttaactttacgtttaagtttaggttacggttacgggttacggttacccgtaggtttaccctttacggtttttaccggg

SEQ ID NO: 276162 - DNA, 576 bp, Homo sapiens
  misc_feature: GYAE6OF02FIV9V.12.2.A02.1.454.CMB.1.raw
  modified_base (410)..(410): a, c, t, g, unknown or other
  misc_feature (410)..(410): n is a, c, g, or t
tcagatacgacgtacacgaccggtgctcgatttagactcatctacaggggacccaaaaaccacacccctccttgggagaatcccctagatcacagctcctcaccatggactggacctggagcatccttttcttggtggcagcagcaacaggtgcccactcccaggttcagctggtgcagtctggagctgaggtgaagaagcctggggcctcggtgaaggtctcctgcaaggcttctggttacacctttacagctatggtatcagctgggtgcgacaggcccctggacaagggcttgagtggatgggatggatcagcgcttacaatggtaacacagactatgcacagaagttcaggacagagtcacatcgaccacagacacatacccacgagcacacgcctacagtggaanctaggaggacgcctaggatatacgtagaccgacgacgggtcccgttagtacgtttaccgtgtcgacgtaggttagggtttttaagcggttaacttaaccgttttagttggttaaggttcgggttacggtttaaccgttggttaccgttttaaggtttttcccgggg

SEQ ID NO: 276163 - DNA, 645 bp, Homo sapiens
  misc_feature: GYAE6OF02FPW21.12.2.A02.1.454.CMB.1.raw
  modified_base (396)..(396): a, c, t, g, unknown or other
  misc_feature (396)..(396): n is a, c, g, or t
tcagatacgacgtacacgaccggtgctcgatttagactcatctacaggggacccaaaaaccacacccctccttgggagaatcccctagatcacagctcctcaccatggactggacctggagcatccttttcttggtggcagcagcaacaggtgcccactcccaggttcagctggtgcagtctggagctgaggtgaagaagcctggggcctcggtgaaggtctcctgcaaggcttctggttacacctttaccagctatggtatcagctgggtgcgacacggcccctggacaagggcttaggagtggatggggatgggatcgacggcgtacttacaagtgggtaacacgagactatcgacacagtaagttccaaggacagagtcaacagtcgaccaanagaccacactaccgaacgagaccaacgacgacctacactagggacgacgtacggacgggtaacgccgtaggacgtagtaccgtagaaccgaccgtaccgggtaccgttacgttaacgtttacgtcggtacggtaggtaacgggttaagggtttttaaggtaggtttaacgttaacgttttaaggtttaggtttaacgggttcgggtttacggttaccgtttaggttaccgtttacggtttttaccgggg

SEQ ID NO: 276164 - DNA, 602 bp, Homo sapiens
  misc_feature: GYAE6OF02H2E48.12.2.A02.1.454.CMB.1.raw
  modified_base (277)..(277): a, c, t, g, unknown or other
  misc_feature (277)..(277): n is a, c, g, or t
  modified_base (317)..(317): a, c, t, g, unknown or other
  misc_feature (317)..(317): n is a, c, g, or t
  modified_base (354)..(354): a, c, t, g, unknown or other
  misc_feature (354)..(354): n is a, c, g, or t
tcagatacgacgtacacgaccggtgctcgattttagactcatctacaggggacccaaaaaccacacccctccttgggagaatcccctagatcacagctcctcaccatggactggacctggagcatccttttcttggtggcagcagcaacaggtgcccactcccaggttcagctggtgcagtctggagctgaggtgaagaagcctggggcctcggtgaaggtctcctgcaaggcttctggttacacctttacagctatggtatcagctgggtgcgacnggccccgtggacgaagggcttggagtgggatggggatggntcgagcgcttaacaagtggtaacacagactatagcanagagttcaaggacagagtacacatcgaccacagaacacatacccgagacgacaacgacgacctacaagtggacgcgtaggacggacgcctagagtacgtcgtagaccgaacgaccgggtccgttagtacgtttaccgtgtaccgacggttaggttaagggtttttagaggttaattaccgttttaagttggtttaacgggttcgggttacggttacccgttggttaccttttacggtttttcccgggg

SEQ ID NO: 276165 - DNA, 646 bp, Homo sapiens
  misc_feature: GYAE6OF02HZWSX.12.2.A02.1.454.CMB.1.raw
tcagatacgacgtacacgaccggtgctcgatttagactcatctacaggggacccaaaaaccacacccctccttgggagaatcccctagatcacagctcctcaccatggactggacctggagcatccttttcttggtggcagcagcaacaggtgcccactcccaggttcagctggtgcagtctggagctgaggtgaagaagccgtggggcctcggtgaaggtctctgcaaggcttctggttacacctttaccagctatggtatcagcgtgggtgcgacacggcccctggacgaagggcttggagtggagtgggatggatcagcgacttacgaagtggtaacacgagactatgacacagaagttcaggacagagtcacatacgaccacacgacacactccaacgagacacacgcctaaccagtaggacgtcgtaggacggacgccctaggaacgacgttaccgtaggtaaccgaaccgaccgggtccccggttagttaaacgttacgttcggtacggtaccggtaagggtttacggggtttttaaacggtgttaaacgtttaacgttttaagttttacgggtttaggtttacggggttacggttttaacccgtcggtttacccgttttacggtttttttacccggggg

SEQ ID NO: 276166 - DNA, 691 bp, Homo sapiens
  misc_feature: GYAE6OF02H64WR.12.2.A02.1.454.CMB.1.raw
tcagatacgacgtacacgaccggtgctcgatttagactcatctacaggggacccaaaaaccacacccctccttgggagaatcccctagatcacagctcctcaccatggactggacctggagcatcctttttcttggtggcagcagcaacaggtgcccactcccaggttcagctggtgcagtctggagctgaggtgaagaagccgtggggcctcggtgaaggtctctgcaaggtcttctggttacctacctttacagtctatggtatcagcgtgggtgcgacgcggccccgtggacgagggtcgttggaggtggtagtggggtagtggatacgaggccgtacttacgaagtacggtaacacgagtactagtcgacaacgagtaacgttcgaagacgagacgtacacctagaccgaaccacgacgacacactaccgagacacacacgacctagagtaggcgtagtacggacgcgtaccaggactacgtacgtacggaaccgtaaccggtaccgggttaccgttagttaacgttttaccggtagggttacggtaaccgggtttagggtttaacgggtttttaaggtaacgtttaacgttttaacgttttaggttacgggttttaagggttccggggtttaaccggttttacccggttagttttaccccggtttttaggttttttcccccggggg

SEQ ID NO: 276167 - DNA, 609 bp, Homo sapiens
  misc_feature: GYAE6OF02GO0M8.12.2.A02.1.454.CMB.1.raw
  modified_base (347)..(347): a, c, t, g, unknown or other
  misc_feature (347)..(347): n is a, c, g, or t
  modified_base (531)..(531): a, c, t, g, unknown or other
  misc_feature (531)..(531): n is a, c, g, or t
tcagatacgacgtacacgaccggtgctcgatttagactcatctacaggggacccaaaaaccacacccctccttgggagaatcccctagatcacagctcctcaccatggactggacctggagcatccttttcttggtggcagcagcaacaggtgcccactcccaggttcagctggtgcagtctggagctgaggtgaagagccgtggggcctcgggtgaaggtctcctgcaaggtcttcgtggttactacctttaccagtctagtggtatcgagtcgtgggtgcggacgacggccccgtggacgaagggtcttggaggtggagtgggatgggatcgaggcgtacttaanaagtaggtaacacgagtactagtcgacaacgtagtaacgtcgaaggacaggacgtacacagtcgaccacacgacacactacccgaacgacgacaacgacgtaccctagacgtagggactcggtaggaagggacctccgtaggaacgtactacgacgacgtaccgacggtcttagtacttcgtgngtacgttaggttaggtttagtagtattacgttagttggtagggttgttcggttacgtgtttacgttacggtttccggg

SEQ ID NO: 276168 - DNA, 727 bp, Homo sapiens
  misc_feature: GYAE6OF02I3R9L.12.2.A02.1.454.CMB.1.raw
  modified_base (275)..(275): a, c, t, g, unknown or other
  misc_feature (275)..(275): n is a, c, g, or t
tcagatacgacgtacacgaccggtgctcgatttagactcatctacaggggacccaaaaaaccacacccctccttgggagaatcccctagatcacagctcctcaccatggactggacctggagcatccttttcttggtggcagcagcaacaggtgcccactcccaggttcagctggtgcagtctggagctgaggtgaagaagccgtggggcctcggtgaaggtctcctgcaaggcttctggttacctacctttaccagctatgtatcagctgggtncgacgacggcccctggacgagggtcgtggacggtggagtgggagtgggacgtcgagcggtacctttaacgaacgttacgggtaaaccaacgaaggtacctagtacgacgaacgtaacgtaacggttaccgaacggtaacgtaacggtaacggtaccaaccgtaataccggaacccaacgtaacggaacctaacctaacgtaccccgaacgtacggacctaaaccgaacgtaccctaaacggtacggtacggggtaacgtcgtaacgggacggtaaccgtccgaaggtacgtactacggtacgtaaccggaacgacccgggtcgtttaacggtattaaccggtgtacggtggtaaggtttacgggtttttaagcgtaagtttaccgttttaaggttaggttaggttacggggttccgttaacccgtggttccgttttaaccggttttcccggg

SEQ ID NO: 276169 - DNA, 768 bp, Homo sapiens
  misc_feature: GYAE6OF02HONVX.12.2.A02.1.454.CMB.1.raw
tcagatacgacgtacacgaccggtgctcgatttagactcatctacaggggacccaaaaaccacacccctccttgggagaatcccctagatcacagctcctcaccatggactggacctggagcatccttttcttggtggcagcagcaacaggtgcccactcccaggttcagctggtgcagtctggagctgaggtgaagaagccgtggggcctcggtgaaggtctcctgcaaggtcttcgtggttaacctacctttaccagtctagtggtatcgagtcgtgggtgacggaacgacggtcccccgtaggacgaagggtcttaggaggtggagtgggagtggatcgagtcgtacttaacgaagttaggtaaaccacaggtaaccttagtcgactaacgtaaggtaacgttaccgaacggaacagtaacgtaccaaccgtaagtaccgaaccaacgaacgaaccactaaccgtacccgaacgtaccgaaccgaaccgtaaccgtaccctaacgtacgtaacgggcgtacgtagggaacgggtaaccgtcgtacggaagtaccgttaccgtacggaacccgtaaccggtaacccgggttccgttaacgggttaacctttaacgggtcggttaacgggaccgggttaagggttttaacgggttttacggtaacggttaacttttaacgttttaaaggtttcggggtttaacggttcgggttacccgggtttaaccgtttggtttaccccggtttttacggtttttaccccggggg

SEQ ID NO: 276170 - DNA, 615 bp, Homo sapiens
  misc_feature: GYAE6OF02GNJO5.12.2.A02.1.454.CMB.1.raw
tcagatacgacgtacacgaccggtgctcgatttagactcatctacaggggacccaaaaaccacacccctccttgggagaatcccctagatcacagctcctcaccatggactggacctggagcatccttttcttggtggcagcagcaacaggtgcccactcccaggttcagctggtgcagtctggagctgaggtgaagaagccgtggggcctcggtgaaggtctcctgcaaggcttctggttacacctttaccagtctatggtatcagcgtgggtgcgacacggcccctggacgagggcttgaggtggagtgggatggatcgagcgtcttacaagtaggtaacacagactagtcgacacagtaacgttaccgaaggacagtacgtacacatcgaaccacgacgaccacaactacccacgacgaccaacgacaccctaacaggtaggacgtacgtaggaacgggacgccgtaggacgtactcgtacgaaccgacgtaccgggtccgttagtacttacgtgtacggtcggtaaggtttaggttttagagttacgttaacgtttagtttaggttaggttcgggttcgttacttcggttacgttttacggttttaccggg

SEQ ID NO: 276171 - DNA, 609 bp, Homo sapiens
  misc_feature: GYAE6OF02JYWS9.12.2.A02.1.454.CMB.1.raw
tcagatacgacgtacacgaccggtgctcgatttagactcatctacaggggacccaaaaaccacacccctccttgggagaatcccctagatcacagctcctcaccatggactggacctggagcatccttttcttggtggcagcagcaacaggtgcccactcccaggttcagctggtgcagtctggagctgaggtgaagagcctggggcctcggtgaaggtctcctgcaaggcttctggttacacctttaccagctatggtatcagctgggtgcgacaggcccctggacagggcttgagtggagtgggatggatcgagcgcttacgaagtggtaacacgagaactatgacacaagtaacgttaccgaggaacaggaagtccaacatacgaaccagagacacgactaccgaacgacgcaacacgacctaacgactgggaacgctaggacggacgtacctggaacgtagtccgtaacgtaaccgaaccgaccgggtccgtaagttaacgttacgtgtggaccgttaggttaacgggttttagtacggtaatttaccgtttagttaggttaggttcgggttaggttaccgtcgttacgtttaccggttttcggg

SEQ ID NO: 276172 - DNA, 638 bp, Homo sapiens
  misc_feature: GYAE6OF02G4JAE.12.2.A02.1.454.CMB.1.raw
tcagatacgacgtacacgaccggtgctcgatttagactcatctacaggggacccaaaaaccacacccctccttgggagaatcccctagatcacagctcctcaccatggactggacctggagcattcctttttcttggtggcagcagcaacaggtgcccactcccaggttcagctggtgcagtctggagctgaggtgaagaagcctggggcctcggtgaaggtctcctgcaaggcttctggttacacctttaccagctatggtatcagcgtgggtgcgacaggcccctggacagggtcttgagtggagtgggatggagtcaggcgtcttaacgaagttggtaaactacgagtactatgacacgaggtaacgttaccgaaggtacgagtactccacatacgacacacgacactataccagacgacacacgtacctacagtcggagtcgtaggagtaacgccgtaggagtacgtccgtacggaccgaaccgtacgggtaccgttagttacgttaacgtggtcgtacgggtaggtttacgggttttaggttacgttaacgtttacgttttacggtttagtttacggggttacgggtttccgggttaaccgtttcggttaccgtttttacggttttacccggg

SEQ ID NO: 276173 - DNA, 648 bp, Homo sapiens
  misc_feature: GYAE6OF02GM0ZX.12.2.A02.1.454.CMB.1.raw
  modified_base (308)..(308): a, c, t, g, unknown or other
  misc_feature (308)..(308): n is a, c, g, or t
tcagatacgacgtacacgaccggtgctcgatttagactcatctacaggggacccaaaaaccacacccctccttgggagaatcccctagatcacagctcctcaccatggactggacctggagcattccttttcttggtggcagcagcaacaggtgcccactcccaggttcagctggtgcagtctggagctgaggtgaagaagccgtggggcctcgggtgaaggtctcgtgcgaaggtcttcgtggttactacctttacgagctatggtatcagcgtggtgcgacgacggccctaggacgaagggcttgnggtggagtgggagtggactcgaggcgtcttaagaagttacggtaaacacgagtaactagtcggacaacgtaacggtaacgttaccggaaggtaacgtaggtaacgtaccaaccctagtaccgtaacccaacgaacgtaacccaacaccgtaccaacggacaccaacgaccgacctaaccgtagtacgggactacgaacgacggtacgcctaggacgtacttcgacggtacgaccggtaacggtccgttaattacgtaacgtggtagtcggtaggtttaggtttagacgttatactttagtaggttaggttcggtagttcgtgttacgttacgttttccgg

SEQ ID NO: 276174 - DNA, 678 bp, Homo sapiens
  misc_feature: GYAE6OF02JB216.12.2.A02.1.454.CMB.1.raw
tcagatacgacgtacacgaccggtgctcgatttagactcatctacagggacccaaaaaccacacccctccttgggagaatcccctagatcacagctcctcaccatggactggacctggagcattccttttcttggtggcagcagcaacgaggtgcccactcccgaggttcagctggtgcagtctggagctggaggtgaagagccgtggggcctcgggtagaaggtctccgtgacgaaggtctttcgtggttacctacctttaccgagtctagtggtatcgagtcgtggtcgacgtacgacggtccccgtaggacgaagggtcttaggaagttggaacgtgggagtacggactcgacgcgtactttaacgaagttacggaacagaagtacgtagcgacgaacgaagtacgttaccgaggtaaccaggtagtaccaaaccgtagtaccgaaccgaagaacgaactaacaacgtaccgaaacggacacgaacgacgtacctaacgagtcggagtacgtggaacgtcgacggttagaacgtcgtacgtaacgaccgaacggaccggttcgttactaacggttcgtcgggtagtcggttaaggtacggttttgacgttacgtttaacgttagtttggaaggtttcggttacgtaccgtttggttaccgttttcgggtttccgg

SEQ ID NO: 276175 - DNA, 634 bp, Homo sapiens
  misc_feature: GYAE6OF02FF93K.12.2.A02.1.454.CMB.1.raw
  modified_base (556)..(556): a, c, t, g, unknown or other
  misc_feature (556)..(556): n is a, c, g, or t
  modified_base (574)..(574): a, c, t, g, unknown or other
  misc_feature (574)..(574): n is a, c, g, or t
tcagatacgacgtacacgaccggtgctcgatttagactcatctacaggggacccaaaaaccacacccctccttgggagaatcccctagatcacagctcctcaccatggactggacctggagcatccttttctggtggcagcagcaacaggtgcccactcccaggttcagctggtgcagtctggagctgaggtgaagagcctggggcctcggtgaaggtctcctgcaaggcttcgtggttacacctttacagtcctagtcggtatcgagctgggtgcgactacggccccctgggacaagggtcttgagtggatgggatggatcagcgtacttacgaagttacggaacacgagacttagtcgacacgaagtaacgttaccaggaacgagacgtcgaaccagttacggaaccacgacgaaccacaactcccaacggacgacccaaccgaccggtaccctaacacggttacgggacgtccggtaggacgggacgcccgtagaacgggtactaccggtacgtaacccgaccgaccgggtaccgtagtacttacgtgtacgngaaggtagggttttaagngtaacttcgttagttggttagttcgggtaccggttcgtcgtacgtttccgttttaccggg

SEQ ID NO: 276176 - DNA, 626 bp, Homo sapiens
  misc_feature: GYAE6OF02IGNP3.12.2.A02.1.454.CMB.1.raw
  modified_base (276)..(276): a, c, t, g, unknown or other
  misc_feature (276)..(276): n is a, c, g, or t
  modified_base (350)..(350): a, c, t, g, unknown or other
  misc_feature (350)..(350): n is a, c, g, or t
  modified_base (357)..(357): a, c, t, g, unknown or other
  misc_feature (357)..(357): n is a, c, g, or t
  modified_base (437)..(437): a, c, t, g, unknown or other
  misc_feature (437)..(437): n is a, c, g, or t
tcagatacgacgtacacgaccggtgctcgatttagactcatctacaggggacccaaaaaccacacccctccttggagaatccctagatcacagctcctcaccatggactggacctggagcatccttttcttggtggcagcagcacaggtgcccactcccaggttcagctggtgcagtctggagcgtgaggtgaaagaagccgtggggcctcgggtgaaggtctcctgcaaggcttctgggttacacctttaccagtctatggtatcagctggggtnacgacgacggccccgtggaacgagggtcttggaagtggattggggatggatcgagcgtcttacagtcgtaacanagacttnagcacagacgttcaggtacagtgactacatcggaccaagacgtaacacaagtaccgaacgagtacaacacggtacccaancgtacgggaactcgtagacggacgtctaggacgtagcctagacccgaagaccggtccgtagtacgttacttgggacgcggtaaggtttacgggttttaacgtagtacgtttaagtttccggtttaaggtttaccggttaggggtaccggtttaccggtggtttacccgtttagggttttttacccgggg

SEQ ID NO: 276177 - DNA, 609 bp, Homo sapiens
  misc_feature: GYAE6OF02FXZJ1.12.2.A02.1.454.CMB.1.raw
  modified_base (278)..(278): a, c, t, g, unknown or other
  misc_feature (278)..(278): n is a, c, g, or t
  modified_base (300)..(300): a, c, t, g, unknown or other
  misc_feature (300)..(300): n is a, c, g, or t
  modified_base (309)..(309): a, c, t, g, unknown or other
  misc_feature (309)..(309): n is a, c, g, or t
  modified_base (320)..(320): a, c, t, g, unknown or other
  misc_feature (320)..(320): n is a, c, g, or t
  modified_base (337)..(337): a, c, t, g, unknown or other
  misc_feature (337)..(337): n is a, c, g, or t
  modified_base (342)..(342): a, c, t, g, unknown or other
  misc_feature (342)..(342): n is a, c, g, or t
tcagatacgacgtacacgaccggtgctcgatttagactcatctacagggggacccaaaaaccacacccctccgttgggagaatcccctagatcacagctcctcaccatggactggacctggagcatccttttctggtggcagcagcaacaggtgcccactcccaggttcagctggtgcagtctggagctgaggtgaagaagcctggggcctcggtgaaggtctctgcaggcttcgtggttacacctttacagtctatggtatcagcgtgggtgcgacnggcccctgacaggctgagtggngtggatggntcgagctctanagtcgtaacatagactntcganacgagtacgtcgaggacagtacgaccacgatacgacccaacgacgaccacactacgacgagacctacacgtaccagacgtaggactctagggacgacgtcgtaggaactgttcgtacggacgtaaccggtccgggtacgttagttacgttcgtacgtggtaccgggtaggtttacgggttttaaggacgttacgtttaacgtttaggttggttacggttcgggttacccgttacggttacggtttccgtttacggttttccccgggg

SEQ ID NO: 276178 - DNA, 844 bp, Homo sapiens
  misc_feature: GYAE6OF02I6RFN.12.2.A02.1.454.CMB.1.raw
tcagatacgacgtacacgaccggtgctcgatttagactcatctacaggggacccaaaaaccacacccctccttgggagaatcccctagatcacagctcctcaccatggactggacctggagcattccttttcttggtggcagcagcaacaggtgcccactcccaggttcagctggtgcagtctggagctgaggtagaagagccgtgggcctcggtagaaggtcctctgcaaggtcttcgtggttacctacctttaccgagtctagtcggtactcgacgtccgtgggtgaccggacgacggtcccccgtgggaaccgtaacgggtcgttaggacggtagggagtggggtacgtggactcgaggtaccgtacttaacgaagttacggtaaaccacgtaagtaaccgtagtacgtaccgaacgtaacggtaaacgttccggaaggaaccgtaggtaacgtaccaaccgtacgtacgtaacccacgaacgtaaccaacgtaactaacccggaacgtaccgaacgtaaaccgtaccgtaaccctaacggtacgtaacgggacgttacgtacgggtaaacgggtaccgtacggtacggaacgtaccgtaaccgtacgggtaaacccgtaccgggtaacccgggttaccgtttaacggttaaaccgtttaacccgggtgggtttaaccgggtaccgggtttaacgggtttaaccggggttttttaacgggaaccttttaaacgggttttaaccggtttaagggtttttaccgggttaaggggttttcgggttaaaccggttttaaccggtttccgggttttaacccgtttttccgggtttttaccccgggg

SEQ ID NO: 276179 - DNA, 775 bp, Homo sapiens
  misc_feature: GYAE6OF02IUBYI.12.2.A02.1.454.CMB.1.raw
tcagatacgacgtacacgaccggtgctcgatttagactcatctacaggggacccaaaaaccacacccctccttgggagaatcccctagatcacagctcctcaccatggactggacctggagcatccttttcttggtggcagcagcaacaggtgcccactcccaggttcagctggtgcagtctggagctgaggtgaagagcctggggcctcggtgaacggtcctccgtgcaaggtccttcgtcggttaccacctttaccagtctatcggtactcagtcgtgggtcgccgacgacggcccccgtaggacgaacgggtcttaggaaggtgggaagttggggtattgggattccgacggtccgtacctttaacgaagttacgggtaaccaacgtaggtactacgtcgaccaacgaagtaacgttccgaaggacaggaacgtaccaacgtataccggacccaacgacgaaccaactacctaccgaacggacgtaccaacgaccgtaccgtaaccgtagttacgggaacgtcgtagggaacggtaccggtaccgtaggaacgtacgttaccggtacggaacccgggtaaccgtaccggggttaccccgtttaaggtttaaacccgtttaccggtaggggttaccgtaccggttaagggttttacggggttttagtacgggttaaactttaaccgtttaaggtttaggtttaacggggtttacgggtttacccgggttaaacccgtttcgggtttacccgtttttacggttttccccggggg

SEQ ID NO: 276180 - DNA, 756 bp, Homo sapiens
  misc_feature: GYAE6OF02J04X0.12.2.A02.1.454.CMB.1.raw
tcagatacgacgtacacgaccggtgctcgatttagactcatctacaggggacccaaaaaccacacccctccttgggagaatcccctagatcacagctcctcaccatggactggacctggagcatccttttcttggtggcagcagcaacaggtgcccactcccaggttcagctggtgcagtctggagctgaggtgaagagcctggggcctcggtagaaggtctccgtgcaaggtcttctcggttacaccttttaccagtctactggtactccagtcgtgggtcgacgacacgggtccccgtaggacgtaagggccttaggacggttagggagtaggggacgtacggtagtcgacggcggtaccttacgaaaggtcggttaaacaccgaagtaacttagtacggactaaccgaaggttaaccggttcccgaagggtaccgaaggtaacggtacctaaaccgtaacgtaccggaacccaacgacggaactaaccaactaccggaacgacgacctaaccgacggaaccttaacgtaacgagggtaaccgtcgtacgggaacgggtaaccgtccgttaacgggaagtaccttacgtaacgggaaccgtaaccgggtaccgggttaaccgtttacggtttaaacgttacggtaacggttacggtaccggttaagggtttacggttttaggaacgttaagttaccgtttagttacggtggtttacggacggtttaccctggtttaccgttggttttacccggg

SEQ ID NO: 276181 - DNA, 703 bp, Homo sapiens
  misc_feature: GYAE6OF02FOEHX.12.2.A02.1.454.CMB.1.raw
tcagatacgacgtacacgaccggtgctcgatttagactcatctacaggggacccaaaaaaccacacccctccttgggagaatcccctagatcacagctcctcaccatggactggacctggagcattccttttcttggtggcagcagcaacaggtgcccactcccaggttcagctggtgcagtctggagctgaggtgaagagccgtggggcctcggtgaaggtctccgtgcaaggtcttcgtaggttacctaccttttaccagtacttatggtactcgtagtcgttggggtcgccggaacgaccggcccccgtggaaccgtaaggggtcgttggacggtggaggtgggacgtggactccgaggcgtacgttacgaaagttacgggtaaactaacgaaggtaccttaagtcgacaacgaagtaaccgttacgaaggacaggtacgtaccaacctagtaccgaaccgaacgaagtaaccaacactacccgaagtaccgaactaccacgtaccaatacgtaggactcgtaggacgacgccgtagacgtatcgtacgaacgtaccgaccggtagttacgttaacgttcgtaggtacggacgttagggttacgggttttaaggacttaacgttttaacgttagtttagggttaggtttacgggttaccgttaaccgttacggtttaccgtttaccggttttacccgggg

SEQ ID NO: 276182 - DNA, 691 bp, Homo sapiens
  misc_feature: GYAE6OF02G6ZOH.12.2.A02.1.454.CMB.1.raw
tcagatacgacgtacacgaccggtgctcgatttagactcatctacaggggacccaaaaaccacacccctccttgggagaatcccctagatcacagctcctcaccatggactggacctggagcatccttttcttggtggcagcagcaacaggtgccactcccaggttcagctggtgcagtctggagctgaggtgaagaagcctggggcctcggtgaaggtctcctgcaaggcttctggttacacctttaccagctatggtatcagctgggtgcgacaggcccctggacaagggcttagaggtggagtgggagtggatcgaggcgtacttacaagtaggtaacacgaagacgtagtacgacaacaaggtaacgttccgaggacagacgtacacagtcgaaccacacgaacacgtactacccgaacgacgaccaacagtacccgtaacaggttacggacgtccgtaggacgggaccgtacccgtaggacgtacgttacgtacggtaaccggaccggtaaccgggtccgtttaaggttacgttaccggtttaggtaccgggtacgggttaacgggtttaagggtttttaacggtaggtttaaactttacgttttaaggtttacgggttttaagggttcggggtttacggtttacccgttacgggtttaccgtttttaccggtttttacccggggg

SEQ ID NO: 276183 - DNA, 700 bp, Homo sapiens
  misc_feature: GYAE6OF02HOH4Q.12.2.A02.1.454.CMB.1.raw
tcagatacgacgtacacgaccggtgctcgattttagactcatctacaggggacccaaaaaaccacacccctccttgggagaatcccctagatcacagctcctcaccatggactggacctggagcattcctttttcttggtggcagcagcaacaggtgcccactcccaggttcagctggtgcagtctggagctgaggtgaagaagccgtggggcctcggtgaaggtctcctgcaaggcttctggttacacctttaccagtctatggtatcagcgtgggtgcgacacggcccccgtggacaagggtcttggaggtggagtgggagtggatcgagcgtacgttaacaagttaggtaaaccacgtaagactagtagacaacgaagaacgtttaccgaaggtaacaaggaacgtaccaaccgagttacgaacccaacgaacgaaccaacctacgtacccaacggaacgaccaaccacgaccctacgagtcggagtcgtagaacggacgacctggaactagtaccgtacgaaccgaaccggtaccggtaccgttaagttaacttaacggttcgtaggtccggtaaaggttttaacgggtttttaaggacgttaacgtttaacgttttaagtttagggtttaagggtttcgggttaacggtttaaccggtttcgtttacccggtttaacggtttttttaccccgggg

SEQ ID NO: 276184 - DNA, 649 bp, Homo sapiens
  misc_feature: GYAE6OF02HGSPN.12.2.A02.1.454.CMB.1.raw
  modified_base (172)..(172): a, c, t, g, unknown or other
  misc_feature (172)..(172): n is a, c, g, or t
  modified_base (406)..(406): a, c, t, g, unknown or other
  misc_feature (406)..(406): n is a, c, g, or t
tcagatacgacgtacacgaccggtgctcgatttagactcatctacaggggacccaaaaaaccacacccctccttgggagaactcccctagatcacagctcctcaccatggactggacctggagcatccttttcttggtggcagcagcaacaggtgcccactccctaggttcngctggtgcagtctggagctgaggtgaagagccgtggggcctcgggtgacggtctcctggacaagggtccttcgtggttaccaccttttaccagtctagtggtactccagtcgtgggtgcgacacggtccccgtggacaagggtctcggagtggagtggagtggagtcggcgtacttacgaagttgtaacgcgagtactatgacacgtacgtaagtcgaaggacagacgtacacntacgacacgacgtaccactacctcccgaacgaaccgccaacctacgaccctaacaaggtacgaacgtcgtaacggacggtacgccgtagaagacttcgaggtacgaccgacggtcgttcttaacgtcgtagtcgtaggtagttacggttttaggagtacttttagttaacggttagggtttaacgttgggttccggttaaccgttacggtaccgttttacgggttttcccggttaaccccggg

SEQ ID NO: 276185 - DNA, 777 bp, Homo sapiens
  misc_feature: GYAE6OF02JO28N.12.2.A02.1.454.CMB.1.raw
  modified_base (186)..(186): a, c, t, g, unknown or other
  misc_feature (186)..(186): n is a, c, g, or t
tcagatacgacgtacacgaccggtgctcgatttagactcatctacagggacccaaaaaccacacccctccttgggagaatcccctagatcacagctcctcaccatggactggacctggagcatccttttcttggtggcagcagcaacaggtcgcccactcccaggttcagctggtgcagtctgganctgaggtgaagagccgtggggcctcgggtgaaggtctccgtgcgaaggtcttcgtaggttacctacctttaccgagtcttagtcggtaatccagtcgtgggtcgacggacgaccggtccccgtagggaaccgtaagggtcctttaggacggtcgggtaaggtgggtagtaggaccgtcgaacggtccggtacgttaaaccgtaaggttacgggtaaccaacgtaaggtaacccttagtacggtacaaccggtaaggtaaccggtttaaccggaggaaccgtaaggtaccgtacaacccgtaagtaccgaacccgaacgtaacgaccgaaacgtacgtacccgaacgtaccgaccgaaaccgtaccgtaaccgtacgtaacggtaggaccggttacgacggaacgggtcgaccgtacggtaacgtacgtacgtaccggtaaccggaccgtaccgggtaccgttacgttaacgtacggttacggtcggacggttagtttaacggttaaggtacgtttacgttaagtttacggttagttacggttacgggttaccggtttacgtttcggtttaccgtttccgggtttacccggg

SEQ ID NO: 276186 - DNA, 687 bp, Homo sapiens
  misc_feature: GYAE6OF02FIZFE.12.2.A02.1.454.CMB.1.raw
tcagatacgacgtacacgaccggtgctcgatttagactcatctacaggggacccaaaaaccacacccctccttgggagaatcccctagatcacagctcctcaccatggactggacctggagcatccttttcttggtggcagcagcaacaggtgcccactcccaggttcagctggtgcagtctggagctgaggtgaagaagccgtggggcctcggtgaaggtctcctgcaaggcttctggttacacctttaccagctagtggtatcagcgtgggtgcgacacggcccctggacaagggtcttagaggtggagtgggatggatcgaggtccgactttaacaagtacggtaactacgagactatgacacagtaacgttaccgaggacagacgtacaccatcgaacccaacgacgtaccacactaccgaacgacgaccaacgacgtacctacgagtagggacgcgttaggaacgggtacgtacccgtagacgtacgttaccgtacgggaaaccgtaccggtacccggggtaccgttaaggtttaacgtttaacgttacgggtcgggtacggtaacgggtttaaggggttttttaacggtagtaaccgttttaacgtttaaggtttaggttacgggtttcggggttaacggtttacccgtggtttacccgttttacggttttttacccgggg

SEQ ID NO: 276187 - DNA, 838 bp, Homo sapiens
  misc_feature: GYAE6OF02H3EW0.12.2.A02.1.454.CMB.1.raw
tcagatacgacgtacacgaccggtgctcgatttagactcatctacaggggacccaaaaaccacacccctccttgggagaatcccctagatcacagctcctcaccatggactggacctggagcattcctttttcttggtggcagcagcaacaggtcgcccacctcccaggttcagctggtgcagtctggagcgtgaggtgaaggaagccgtggggccttcgggtaggaacggttcctccgtgaccgaagggtcttcggttaggttaccgacccttttaccgagtacgtagttagggttactcgacggtcgtacgggggtcgacggaaccgtaccgggtcccccgttagggaaaccgtaaggggtccgtttagggagggtgggaaggttacggggtagttcgggaatccgaggtaccggtactttaacggaaagttacggtaaacgaacgtaacggtaaccgttaataccggaccgaaacgtaaacgggtaacggtttacccggaaacgggaaacaaacgggtacgttaacccgaaccctaagtacccgaacccgaaacgtacgaaaccacctaaccgtaccccgaaacggacgaacccaaacgtaccggtaaccctagaacgtacgggacgtaccggttaggaacggtaacggtccgtaaggacgacggtttacgaaccggaccgtaaccggacgggttccgttaagttacggttaacgtggtacgtacgggttacggtttaggggtttcaagttaaccgttagttttaacggtggtttacgggtacgggttaccgtttacccgggtttattccccggttttaaggtttttccccgggg

SEQ ID NO: 276188 - DNA, 732 bp, Homo sapiens
  misc_feature: GYAE6OF02G6PQM.12.2.A02.1.454.CMB.1.raw
  modified_base (331)..(331): a, c, t, g, unknown or other
  misc_feature (331)..(331): n is a, c, g, or t
tcagatacgacgtacacgaccggtgctcgatttagactcatctacaggggacccaaaaaccacacccctccttgggagaatcccctagatcacagctcctcaccatggactggacctggaacatccttttcttggtggcagcagcaacaggtgcccactcccaggttcagctggtgcagtctggagctgaggtgaagagccgtggggcctcggtgaggtctcctgcgaaggtcttctcggtactaccttacagtctatggtatcagtcgtggtgcgacgacggtccccgtaggacgtagggtcttacggaggtggacgtgggtagttcggntacgagtccgtacttaacgtagtagtaaccgacgtacgtacgtatcggacacgtaagtaacgtcgaaggacaaggtcgtaccaactagtacaccgtacgaacgacctactactacccgtaagacctaccgaactaccgtacccgtagaacggtacggagtcgacggaggtaccgtcgacggtaagtctaccgggtacgaccggtaacgaccgggttacgttagttaaccgttacggttcggtacgttaaccggggttaggttttaacgggttttaccgtaacggtttaacgtttaacggttttaaggttacgggtttaagggttaccgggttttaccgggttaaccgttttacggttaacccggtttttttcgggtttaccccggggttaaccccccgggg

SEQ ID NO: 276189 - DNA, 690 bp, Homo sapiens
  misc_feature: GYAE6OF02HILYD.12.2.A02.1.454.CMB.1.raw
  modified_base (184)..(184): a, c, t, g, unknown or other
  misc_feature (184)..(184): n is a, c, g, or t
  modified_base (507)..(507): a, c, t, g, unknown or other
  misc_feature (507)..(507): n is a, c, g, or t
tcagatacgacgtacacgaccggtgctcgatttagactcatctacagggggacccaaaaaccacacccctccttgggagaatcccctagatcacagctcctcaccatggactggacctggagcattccctttttcgttggtggacagcagacaacaggtcgcccactcccaggttcagctggtncagtctggagctggaggtgaagagccgtgggcctcggtagaacgtctccgtgacgagtcttcgtcgtactccttacagtctagtgtactacgagtcgtggtcgcgacgacggccccgtggacgaacggtcgttagcggtaggtacgtggggatagggatcgagccgtacttaacgaagtacggtaacaacgtaggtactagtacgtaacaagtaaggtaccgttacgaaggaccgaagtctaaccgtaacagtaccgaccgtaacgaacgtacccaagtaccaccgaacggactacccgagacctaccgtacacggaggtacncggtacggacggaccgtcggtacgaagggtacctacggtggaaccccgtaggtacccggtacgttaccgttaggtcgttacggtagtaccggttaggtttacggtttagactttaaggttacgttcgttaggtaaggttcgggtttccgtaccgtttggtttccgttaaccggggtttcccgg

SEQ ID NO: 276190 - DNA, 694 bp, Homo sapiens
  misc_feature: GYAE6OF02IEYGT.12.2.A02.1.454.CMB.1.raw
  modified_base (361)..(361): a, c, t, g, unknown or other
  misc_feature (361)..(361): n is a, c, g, or t
tcagatacgacgtacacgaccggtgctcgatttagactcatctacaggggacccaaaaaaccacacccctccttgggagaatcccctagatcacagctcctcaccatggactggacctggagcatccttttcttggtggcagcagcaacaggtgcccactcccaggttcagctggtgcagtctggagctgaggtgaagaagccgtggggcctcggtgaaggtctcctgcaaggtcttctggttaccacctttacagtctatggtatcgagcgtgggtgcgacgacggccccgtggacgaagggtcttagagtgggagtgggagtggatcgagcgtacttagaagtagtaacacagtactangaccagaagtaacgttccgaaggacagacgtacaccagtacgaaccaacgacgacaccactacccaggacacgaactacggaccctagagtacggtacgcgtacgggaggacgtctaggacgaattcccgtacggaaccggtaaccggaccgggtaccgtttagttaacgttacggtaggttacggtacgggttaagggttttaagggtttttaaggtacggttaaacgttttaaccggtttttaagtttaggggtttaacggtttcgggggtttaaccggtttaccggttcggtttttaacccggttttacccggttttttaaccccggggg

SEQ ID NO: 276191 - DNA, 643 bp, Homo sapiens
  misc_feature: GYAE6OF02IUE8G.12.2.A02.1.454.CMB.1.raw
tcagatacgacgtacacgaccggtgctcgatttagactcatctacaggggacccaaaaaccacacccctccttgggagaatcccctagatcacagctcctcaccatggactggacctggagcatccttttcttggtggcagcagcaacaggtgcccactcccaggttcagctggtgcagtctggagctgaggtgaagaagccgtggggcctcggtgaagtctcctgcaggcttctggttacacctttaccagctatggtatcagtctgggtgcgacgacggcccctaggacaagggcttggaggtgggagtggggatagggatcgaggccgtacttaacaacgttaggtaacacaagactatgacaacgaagtacgtaccgaaggacgagacgtacaccgaatcgaacccgaacacgaacaacactacccgaacgacgacacgaacgtacccaacgagtacggacgtacgtaggacggacgccgttaggacgtacttacgtacggaaccggtaaccgaccgggtcccgtttaagtacgtttagttcggtacggcgtaggtttaagggtttcgttaagtacttaacgtttagttggttacggttggttacggttaacctttcggtaccgttttacgttttccgg

SEQ ID NO: 276192 - DNA, 651 bp, Homo sapiens
  misc_feature: GYAE6OF02H73QJ.12.2.A02.1.454.CMB.1.raw
  modified_base (537)..(537): a, c, t, g, unknown or other
  misc_feature (537)..(537): n is a, c, g, or t
tcagatacgacgtacacgaccggtgctcgatttagactcatctacaggggacccaaaaaccacacccctccttgggagaatcccctagatcacagctcctcaccatggactggacctggagcatccttttcttggtggcagcagcaacaggtgccactcccaggttcagctggtgcagtctggagctgaggtgaagaagcctggggctcggtgaaggtctccgtgcaaggcttctggttacacctttacagctatggtatcagcgtgggtgcgaacgcggccccgtggacgaagggtcttaggagtgggagtggggtagtggagtcgagcgtacttacaagtcggtaaacacagacttagtgacaacgagaacgttccgaaggacaaggacgtacaactatacgaccaacgacgactaacacttaccgaacgaccgacctaacgacgtaccctaacaggtacggacgacgtacgggaacggacgtccgtagacgtatacgttcgaaccgtaacggccggtacgttgtactttaacgnggtagtaccggtaggttaacggttttggtaacgttactttaaagttttcgttaggttacgggtttacggttacgggttcctacgggtttacctttagggttttttaccccgggg

SEQ ID NO: 276193 - DNA, 629 bp, Homo sapiens
  misc_feature: GYAE6OF02I0XAV.12.2.A02.1.454.CMB.1.raw
  modified_base (449)..(449): a, c, t, g, unknown or other
  misc_feature (449)..(449): n is a, c, g, or t
  modified_base (470)..(470): a, c, t, g, unknown or other
  misc_feature (470)..(470): n is a, c, g, or t
  modified_base (475)..(475): a, c, t, g, unknown or other
  misc_feature (475)..(475): n is a, c, g, or t
  modified_base (526)..(526): a, c, t, g, unknown or other
  misc_feature (526)..(526): n is a, c, g, or t
tcagatacgacgtacacgaccggtgctcgatttagactcatctacaggggacccaaaaaaccacacccctccttgggagaatcccctagatcacagctcctcaccatggactggaccgtggacgcatccttttcttggtgcagcagcaacaggtgcccactcccaggttcagcgtggtcgcagtctggagctgaggtacgaagaagccgtcgggggcctacgggtgaaacggtctcctgcaaggtcttactcggttacacctttaccaggctagtggtatcgagctgggtcgcgacgacggccccgtggacaaggggtcttcgaagttggagtggatggatacagcgctaacgaagttgtaacacgagaactgtacgctaacaggtacgtacaggtacaggtacgacaccagtacgaacctacgacgtaacctacactaccgaaggacnccgtaccaagaccctatacgnggacngtaggacgtacgacctagggatacgtacgtcgaaccgacgaccggtacgtnttaacgttccgtaggtcctaggacgtttacggttaagtcttaagttaacttcgttaggtagttaggttaccggtacttaggttacgtttccgttttaaccggg

SEQ ID NO: 276194 - DNA, 648 bp, Homo sapiens
  misc_feature: GYAE6OF02IZ6DH.12.2.A02.1.454.CMB.1.raw
  modified_base (186)..(186): a, c, t, g, unknown or other
  misc_feature (186)..(186): n is a, c, g, or t
  modified_base (281)..(281): a, c, t, g, unknown or other
  misc_feature (281)..(281): n is a, c, g, or t
  modified_base (286)..(286): a, c, t, g, unknown or other
  misc_feature (286)..(286): n is a, c, g, or t
  modified_base (294)..(294): a, c, t, g, unknown or other
  misc_feature (294)..(294): n is a, c, g, or t
  modified_base (465)..(465): a, c, t, g, unknown or other
  misc_feature (465)..(465): n is a, c, g, or t
  modified_base (473)..(473): a, c, t, g, unknown or other
  misc_feature (473)..(473): n is a, c, g, or t
tcagatacgacgtacacgaccggtgctcgatttagactcatctacaggggacccaaaaaccacacccctccttgggagaatcccctagatcacagctcctcaccatggactggacctggagcatccttttcttggtggcagcagcaacaggtgcccactcccaggttcagctggtgcagtctgganctgaggtgaagaagccgtggggcctcggtagaaggtctccgtgacgaaggcttctggttacctacctttaccgagctatggtatcagcgtgggtncgacncgccccgnggacgagggcttggagtgggagtgggagtgggatcgacggtcgtacttaacgtaagtaacggtaacaacgaaggtactagtcgacgaacggaacgttaacgttaccggaagtacgaagtacgtaccacagaccgaacgaacacgaccagtacctacgacgacgacacgacnccgtaacnggtacgacgtcgaaggaggacgctacgtatgtaccacgtaccgacgtccgacgttctacgttacgtgtacggtacggttaggttaggtttaacgtgttaactttacggtttaggttaggtttaggttcgggtaccgtttaggttaccgtttaccggttttcggttttacccgggg

SEQ ID NO: 276195 - DNA, 694 bp, Homo sapiens
  misc_feature: GYAE6OF02G3I1N.12.2.A02.1.454.CMB.1.raw
  modified_base (285)..(285): a, c, t, g, unknown or other
  misc_feature (285)..(285): n is a, c, g, or t
  modified_base (323)..(323): a, c, t, g, unknown or other
  misc_feature (323)..(323): n is a, c, g, or t
tcagatacgacgtacacgaccggtgctcgatttagactcatctacaggggacccaaaaaccacacccctccttgggagaatcccctagatcacagctcctcaccatggactggacctggagcatccttttcttggtggcagcagcaacgaggtgcccactcccaggttcagctggtgcagtctggagctgaggtgaagaagcctggggcctcgggtgaaggtctcgtgcgaaggcttcgtggttacacctttaccagctatggtactcagctggggtgacgtacncggcccctggaccaaggcttggagtggagtggatggtncgagtcgataacaagtacgtaacacgacgtactatcgacaactaggaacgttcgaggacagtacgaccactagtcgtaaccacgagaaccgaaccctacgtaccgaaccggtacaccgaaacgaccgtaaccctaacgttaggaacggggtactacgtaacggggtacgaccggtaccgtaacggtacggtaacttacggtaaccgggaaaccggtaaacggccccgggttacgtttaagtaaccgtttaaccgtgggtacggtaacgggttacggttttaacgggtttaggtattaacggtttattttacggtaggttacgggttagggttaccgttaccggtcgtttaccgtttaccggttttcccggg

SEQ ID NO: 276196 - DNA, 712 bp, Homo sapiens
  misc_feature: GYAE6OF02IC0MQ.12.2.A02.1.454.CMB.1.raw
  modified_base (376)..(376): a, c, t, g, unknown or other
  misc_feature (376)..(376): n is a, c, g, or t
  modified_base (383)..(383): a, c, t, g, unknown or other
  misc_feature (383)..(383): n is a, c, g, or t
  modified_base (385)..(385): a, c, t, g, unknown or other
  misc_feature (385)..(385): n is a, c, g, or t
  modified_base (430)..(430): a, c, t, g, unknown or other
  misc_feature (430)..(430): n is a, c, g, or t
tcagatacgacgtacacgaccggtgctcgatttagactcatctacaggggacccaaaaaaccacacccctccttgggagaatcccctagatcacagctcctcaccatggactggacctggagcattccttttcttggtggcagcagacaacaggtgcccactcccaggttcagctggtgcagttcgtgggagctaggtaggtgaaacggaacggcccggttacggggcccgttcgggtaggtaaagggttcctcgttcggacgaacggtctttcgttcgggtttaacctaacccgtttaccaggtcttagttggttattcgagtcgtggggtcgcgtaacgaccgcccgtggacgaggtcgttagcggtggtacgnggtaggngngtcacggtgtacctaataggaacgtaagacctagtactacggtanacgtacgagtacgtacgaacggacgacgtacgacaacgtacgtcgaaccacgacaacgtctaccgaacacggcaacctcgacgtaacccagagtcggagaccgtacggaacggtcgtaacgtagaacggtccgtacggtaaccgaaccggtagggtacccgttcggttacggttaaacctcgggttgtacggacggttaagttttcggtaggattacgtagtttttacgacggttggttaacggccggttttaccgtaggttacctttcgggtttacccggg

SEQ ID NO: 276197 - DNA, 669 bp, Homo sapiens
  misc_feature: GYAE6OF02GXLO6.12.2.A02.1.454.CMB.1.raw
tcagatacgacgtacacgaccggtgctcgatttagactcatctacaggggacccaaaaaccacacccctccttgggagaatcccctagatcacagctcctcaccatggactggacctggagcatccttttcttggtggcagcagcaacaggtgcccactcccaggttcagctggtgcagtctggagctgaggtgaagaagccgtggggcctgggtgaaggtctccgtgcgaaggtcttcgtaggttacctaccctttaccagtctagtggtatcagcgtgggtcgcgacgacggccccgtggacgaagggcttgacggtggagtgggatggatcgagcgtacttacgaatacggtaacacgagactagtgacacgaagtaacgttacgaggtacgagacgtacaccatacgaccacacgaccacactaccacgtagaccacacggtaccaacgtagtgggtacgcgtacggaacggtacgacccgtagggtaactacgtacgtacggacgtaccggaccggttcgttacgttaacttaccgttagtcggtagggttacggttaacgggtttttaggtacgttaacgtttacgtttacggtttagggttacgggtttacgggttaccggttaccgttacggttaccgttttacggttttttaccccgggg

SEQ ID NO: 276198 - DNA, 659 bp, Homo sapiens
  misc_feature: GYAE6OF02H1Q14.12.2.A02.1.454.CMB.1.raw
  modified_base (317)..(317): a, c, t, g, unknown or other
  misc_feature (317)..(317): n is a, c, g, or t
  modified_base (349)..(349): a, c, t, g, unknown or other
  misc_feature (349)..(349): n is a, c, g, or t
  modified_base (375)..(375): a, c, t, g, unknown or other
  misc_feature (375)..(375): n is a, c, g, or t
  modified_base (489)..(489): a, c, t, g, unknown or other
  misc_feature (489)..(489): n is a, c, g, or t
  modified_base (497)..(497): a, c, t, g, unknown or other
  misc_feature (497)..(497): n is a, c, g, or t
tcagatacgacgtacacgaccggtgctcgatttagactcatctacagggacccaaaaaccacacccctccttgggagaatcccctagatcacagctcctcaccatggactggacctggagcattccttttcttggtggcagcagcaacaggtcgcccactcccgaggttcagcgtggtgcagtctggagctgaggtagaagagccgtggggcctgggtagaaggtctccgtgacgaaggcttcgttggttacctacctttacagctatggtatcgagtcgttgggcgcgacgccggcctgggaccaagggtcttggngtaggagtgggatggatcgatccgtacgttanaagtcggtaacaacgtagaacttagngacctacaggtaacgttccgaaagtaccgaagtaccgtacaaccgtataccggaaaccaccaacgaacactaacgtaccgaacgacgacaagccgacccttaagcggtaacggngttaccgngggaacgcctcggagtagtactacggtacgaaccgaaccggtccggtaacttcgtttaacgtgttacgacgtacggttaggtttaggttggtactacttagtttaaggttggttacggttacggtccggttaccttaggttccgttttacgtttacccgggg

SEQ ID NO: 276199 - DNA, 562 bp, Homo sapiens
  misc_feature: GYAE6OF02FO1NN.12.2.A02.1.454.CMB.1.raw
  modified_base (435)..(435): a, c, t, g, unknown or other
  misc_feature (435)..(435): n is a, c, g, or t
  modified_base (482)..(482): a, c, t, g, unknown or other
  misc_feature (482)..(482): n is a, c, g, or t
  modified_base (503)..(503): a, c, t, g, unknown or other
  misc_feature (503)..(503): n is a, c, g, or t
tcagatacgacgtacacgaccggtgctcgatttagactcatctacaggggacccaaaaaccacacccctccttgggagaatcccctagatcacagctcctcaccatggactggacctggagcatccttttcttggtggcagcagcaacaggtgcccactcccaggttcagctggtgcagtctggagctgaggtgaagaagcctggggcctcggtgaaggtctcctgcaaggcttctggttacacctttaccagctatggtatcagcgtgggtgcgacaggcccctgggacaagggcttgagtggagtgggatggatcagcgcttacgaatggtaacacgagactatgacacagaacgttccgaaggtacaggagtacacatgaccacagacacataccacgagaccacacgacctacagtggagacgtggagganccgtagacgactcggtagacgaccgacggtccgtagtacttacgtgnggtacgtaggtagggttttanacggtattacgttagttagtacggttaggttccggtacctgttcgttacgttttccggg

SEQ ID NO: 276200 - DNA, 659 bp, Homo sapiens
  misc_feature: GYAE6OF02HTFRQ.12.2.A02.1.454.CMB.1.raw
  modified_base (439)..(439): a, c, t, g, unknown or other
  misc_feature (439)..(439): n is a, c, g, or t
  modified_base (593)..(593): a, c, t, g, unknown or other
  misc_feature (593)..(593): n is a, c, g, or t
tcagatacgacgtacacgaccggtgctcgatttagactcatctacaggggacccaaaaaaccacacccctccttgggagaatcccctagatcacagctcctcaccatggactggacctggagcatccttttcttggtggcagcagcaacaggtgcccactcccaggttcagctggtgcagtctggagctgaggtgaagagccgtggggcctcggtgaaggtctcctgcgaagggtctttcgtaggttacctacctttaccagtctaagtggtatcagcgtgggtcgcgacacggcccctaggacgaagggtctagaggtggagtgggagtggactcgacgcgtacttaacgaagtagtaaccagagtactagtcgacgaagtacgtaacgtacgaaggaacgagtacgtacaccgtaagtaccgaaccagaaccgaaanacctaacgtaccccgaagaccgaaccgtacaccggaccttacgaagtacgggacgttacgagggtaacgggacgtccgtagggaacgtactacggtacggaacgaccggtaccggcgtttaggtacttagtggcggagttaggtttaaggtttnacgttaattcgtttagttaggttcgttagggttaccgttcgtttaggtccgttttagttacccggg

SEQ ID NO: 276201 - DNA, 687 bp, Homo sapiens
  misc_feature: GYAE6OF02GJURL.12.2.A02.1.454.CMB.1.raw
  modified_base (284)..(284): a, c, t, g, unknown or other
  misc_feature (284)..(284): n is a, c, g, or t
  modified_base (353)..(353): a, c, t, g, unknown or other
  misc_feature (353)..(353): n is a, c, g, or t
  modified_base (501)..(501): a, c, t, g, unknown or other
  misc_feature (501)..(501): n is a, c, g, or t
tcagatacgacgtacacgaccggtgctcgattttagactcatctacagggggacccaaaaaccacacccctccttgggagaatcccctagatcacagctcctcaccatggactggacctggagcatccttttcttggtggcagcagcaacaggtgcccactcccaggttcagctggtgcagtctggagctggaggtgaagaagccgtggggcctgggtgaagggtctcctgcaaggctttctaggttactacctttacagcttagtggtatcgagcgtgggtcncgacgacggtccccgtggaccgaagggtcgttggaggtggaggtgggatggatacgaggcgtacttaanaacgtagggtaaccagaggtacttagtacggcaacggaagtaacgttacgaacgggtaacagggtaactacgtaaccaagtaccgaaccctaacaacggaaccaacgactaccgaacgtacgactaacgacgaccctagacgtggacncggtagaggacgtaccgtagagtagtacgacgaaccgacggtccggtaacggttattacggttaccgtgtacggttacggtaaggttacgggttttaacggtagttaagtttaacgtttaggtttacggttaggtttcgggttaaccggttccgttacggttttacgtttaccggttttcccgggg

SEQ ID NO: 276202 - DNA, 608 bp, Homo sapiens
  misc_feature: GYAE6OF02IJ4ML.12.2.A02.1.454.CMB.1.raw
  modified_base (479)..(479): a, c, t, g, unknown or other
  misc_feature (479)..(479): n is a, c, g, or t
tcagatacgacgtacacgaccggtgctcgatttagactcatctacaggggacccgaaaaaccacacccctccttgggagaactcccctagatcacagctcctcaccatggactggacctggagcatccttttcttggtggcagcagcaacaggtgcccactcccaggttcagctggtgcagtctggagctgaggtgaagaagccgtggggcctggtgaggtctcctgcaaggcttctggttaccacctttaccagctagtggtatcagcgtgggtgcgtacgacggcccccgtggacgaagggcttggagtcggagtggggatagggactcgagtcgtttaacaagttacggtaacacgacgaactagtcgacaacgaagtaacgttccgaaggacagactaccacgatacgaccacaacgacacacgtaccgacgacgacacacgacctacagtaggcgacgtagacggacgccgtanacggatccgtagaccgacgaccggtaccgttacgtacgttaccgtgtcgtacggtaggttacggttttagtcgtaattacggttatggtagttgggtacgttcgtcgtacgttcgtttcggtacccggg

SEQ ID NO: 276203 - DNA, 805 bp, Homo sapiens
  misc_feature: GYAE6OF02IT76M.12.2.A02.1.454.CMB.1.raw
  modified_base (304)..(304): a, c, t, g, unknown or other
  misc_feature (304)..(304): n is a, c, g, or t
tcagatacgacgtacacgaccggtgctcgattttagactcatctacaggggacccaaaaaaccacacccctccttgggagaatcccctagatcacagctcctcaccatggactgaccgtggagctattcctttttcgttgggtggcagcagcaacgaggtcgcccactaccgaggttcagtcgtggtgcagtcgtggagtcgtgagggtagaaggtacgccggtcggggtcccttgggtacggtaacggttccgtacctagaccggaacggtccgtttacttacggttacctaccctttaaccnggtacttagttagtactcgtagtcggttgggtacgacgtaaccgacccggtccccgtaaggaccggtagggtcgtacgtaggtaggtaggtaggtaaggcggtaacgtcgaagtacctacgttacgagttacggtaaccacgttaacgactgtaccacggtaataacgggttacctaccgggaacgtcgaaggtaccctaaccaaccgtacgtaccgtaaccgtaacaacggtacccaccgtaccacggacgacgaccaacgtacgtaccaacgtacgtcggtcgttacggaggtacggcccgtacgtacggtaacgtacggttccgtaccgggaaaccgtccgtaacgggttacctttacggtaacgtttacggaccggttaggtacggttttaaggtttacggttttagtaaaccggtttatttaacggtttagtttaagggttaggtaccggttttcggtacccggtttatttccgggtttttacccgtttcccgggg

SEQ ID NO: 276204 - DNA, 679 bp, Homo sapiens
  misc_feature: GYAE6OF02GNANP.12.2.A02.1.454.CMB.1.raw
  modified_base (302)..(302): a, c, t, g, unknown or other
  misc_feature (302)..(302): n is a, c, g, or t
  modified_base (326)..(326): a, c, t, g, unknown or other
  misc_feature (326)..(326): n is a, c, g, or t
tcagatacgacgtacacgaccggtgctcgatttagactcatctacaggggacccgaaaaaccacacccctccttgggagaatcccctagatcacagctcctcaccatggactggacctggagcatccttttcttggtggcagcagcaacaggtgcccactcccaggttcagctggtgcagtctggagctgaggtgaagaagccgtggggcctcggtgaaggtctcctgcaaggcttctggttacacctttaccagctatggtatcagctgggtgcgacacggcccctggacgaagggcttgnggtggagtgggatggatcgagcgnttaacaagttcgggtaacacgaacgtactaagtcgactaacgaggtaaacgttcccgaaggaacctaaggacgtacaaccagtcgaacccaacgaacgaccaacactaccgaacgtacacctaacgacgtaccctacgagtcggacgtcgttacgggaacgtacgaccgtaggaacgtacgttaccgtacggaaccgaccggtaccgggtaccgtttaacggttacgtttaaccgtggtacggtacggtaaggtttaacgggttttacgtacggttaactttacggttttagttaggttacggttacgggtttacgttaccgttaggttaccgttttacggtttttacccggg

SEQ ID NO: 276205 - DNA, 695 bp, Homo sapiens
  misc_feature: GYAE6OF02GX0C3.12.2.A02.1.454.CMB.1.raw
  modified_base (538)..(538): a, c, t, g, unknown or other
  misc_feature (538)..(538): n is a, c, g, or t
tcagatacgacgtacacgaccggtgctcgatttagactcatctacaggggacccaaaaaaccacacccctccttgggagaatcccctagatcacagctcctcaccatggactggacctggagcatccttttctggtggcagcagcaacaggtgcccactccaggttcagctggtgcagtctggagctgaggtgaagaagcctggggcctggtgaaggtctcctgacgaaggtcttctggttacacctttaccagctagtcggtatcagcgttgggtcgacgaccaacggcccccgtagggacgaagggtccttaggaggttgggaacgttgggagttaggaacgttcacggtaccgtactttaacgagttaacgggtaaccaacgtacgtaactagtacgacaacggtaagtaaccgttaccgaaggtaaaccgtaggaacgtaccctaaccgtaactacggaaccctaacgacgaacctaaccaccgtaccgaacgaacgtacaacccgtacgtaccctacgaacgttacgggaacncgttaggacggaccgtcgtgaaagacgttacgacgggaccgaacggtccggacgttacttaacgttacgtggctacggtaggtttaacggttgtattaccgttatttaacgttggttaacggtggtaccgttacgtcgttacgttttcgtttaccgg

SEQ ID NO: 276206 - DNA, 651 bp, Homo sapiens
  misc_feature: GYAE6OF02FWXXG.12.2.A02.1.454.CMB.1.raw
  modified_base (177)..(177): a, c, t, g, unknown or other
  misc_feature (177)..(177): n is a, c, g, or t
  modified_base (187)..(187): a, c, t, g, unknown or other
  misc_feature (187)..(187): n is a, c, g, or t
  modified_base (236)..(236): a, c, t, g, unknown or other
  misc_feature (236)..(236): n is a, c, g, or t
  modified_base (243)..(243): a, c, t, g, unknown or other
  misc_feature (243)..(243): n is a, c, g, or t
  modified_base (433)..(433): a, c, t, g, unknown or other
  misc_feature (433)..(433): n is a, c, g, or t
  modified_base (455)..(455): a, c, t, g, unknown or other
  misc_feature (455)..(455): n is a, c, g, or t
  modified_base (464)..(464): a, c, t, g, unknown or other
  misc_feature (464)..(464): n is a, c, g, or t
  modified_base (490)..(490): a, c, t, g, unknown or other
  misc_feature (490)..(490): n is a, c, g, or t
tcagatacgacgtacacgaccggtgctcgatttagactcatctacaggggacccaaaaaaccacacccctccttgggagaatcccctagatcacagctcctcaccatggactggacctggagcatccttttcttggtggcagcagcaacaggtgcccactcccaggttcagctggtncagtctgganctgaggtgaagagcgtgggcctcggtgaaggtctcctgcaggtcttcgngttaccncctttacagtctagtgtatcagtcgtggtgacgacgcggtccccgtaggacgaggtcgtaggacgtgggaggtgggtgttacggactcggaggaccgttacttaacgaaggttacgaaaccacgtaagactaggtcgacgacggtacgggcctaccgggagggacacgtactcgacactacgtacccaanacgacacgtatcaacgaccaanacgtacaanaacgtgtaggtagtacggacgtccgngtacgcgttacgtcgacgacggccgtacggttacgttaacttcgttaccgtgggtacgacgtaggtacggttcgggtaggacccgttggttacccgtttaggttacccgtacggttaccgggtccggtaccggttaacggttacccgtcggtttaacccgg

SEQ ID NO: 276207 - DNA, 834 bp, Homo sapiens
  misc_feature: GYAE6OF02FM6EI.12.2.A02.1.454.CMB.1.raw
  modified_base (240)..(240): a, c, t, g, unknown or other
  misc_feature (240)..(240): n is a, c, g, or t
  modified_base (275)..(275): a, c, t, g, unknown or other
  misc_feature (275)..(275): n is a, c, g, or t
  modified_base (373)..(373): a, c, t, g, unknown or other
  misc_feature (373)..(373): n is a, c, g, or t
tcagatacgacgtacacgaccggtgctcgatttagactcatctacaggggacccaaaaaccacacccctccttgggagaatcccctagatcacacgctcctcaccatggactcggacctggagctattccttttctggtgcagcagcaacaggtgcccactcccaggttcagtcgtggtgctagtcgtggacgtcgtaggaggtagaagacgtcggtggggacctggagagtccttccgngacgacgtcttcggtacgttacctaccttacagtntagtaggtactcgacgtcgttgggtagacccgacggtacccggccccgtaaggacggaacggttcgttaggacggtggagtgggacgtgtacgtacgnggtactactagtaagttaccggaacagtacgtaacttgaccgtaacgtacgtaacgggtaacgttaccggaaacgggtaacgaacgggtaacctaacccgaacgtaacggtaccccgaaaccaaacggtacgtaaaccctaccggtaaccgtaaccccggaagaacccgttaccaaccggttaacgacccgtaacggtaacgtaccgggggtaactaccgggtacgggtaaacggtaaccggttacgtaacgggttaacgtacccgtttaacccggaccgggaaacgtacccgggttacggtacggtttacgtttacggtaaccgttcgggttaaggacggtttaacggttacggtttacgtaggtttaaacccgtttacggtttaacggtttcggttaacgggtgggtttaaaccgttacccggtttggtttaacccgtttttcggtttaacccccgggg

SEQ ID NO: 276208 - DNA, 665 bp, Homo sapiens
  misc_feature: GYAE6OF02IVYKH.12.2.A02.1.454.CMB.1.raw
  modified_base (462)..(462): a, c, t, g, unknown or other
  misc_feature (462)..(462): n is a, c, g, or t
tcagatacgacgtacacgaccggtgctcgatttagactcatctacaggggacccaaaaaccacacccctccttgggagaatcccctagatcacagctcctcaccatggactggacctggagcattccttttcttggtggcagcagcaacaggtgcccactcccaggttcagctggtgcagtctggagctggaggtgaagagccgtggggcctcggtgaaggtctccgtgacgaaggtcttgtaggttaccaccgtttaccaggtctagtggtactcgagcgtgggtgcgacgcggtccccgaggaacgaacggggtcttaggacggttagggagttagggggtaatcgggtaactcgacggtccggtactttaacgaagttaacggtaaacacgaagtactagtacgacctaagacggttaacgtccgaaggaacgagtactacaacataccgaaccagaanacacgactaccgacgacgccaacgacgtacctacgagtcggacgtacgaaggaacggtcgacggtaggacgtacgtcgtacggaccgtacggaccggtacgttatacgtcgtaggcgtagtaggtttacggtttgtagtaacttacgtttagttgttagggtacggttccgttacgttacggtttacgtttacggtttaccgg

SEQ ID NO: 276209 - DNA, 838 bp, Homo sapiens
  misc_feature: GYAE6OF02FV6WL.12.2.A02.1.454.CMB.1.raw
  modified_base (154)..(154): a, c, t, g, unknown or other
  misc_feature (154)..(154): n is a, c, g, or t
  modified_base (188)..(188): a, c, t, g, unknown or other
  misc_feature (188)..(188): n is a, c, g, or t
tcagatacgacgtacacgaccggtgctcgatttagactcatctacaggggacccaaaaaccgacacccctccttgggagaatcccctagatcacagctcctcaccatggactggacctggagcattccttttctggtggcagcagcaacaggtncccactcccaggttcagctggtgctagtctggancgtgaggtgaagacgccgtgggcctggtagaacggtctccgtggaccgtaacgggtcctttacgtacggtttaacccaaccgttttaccgaggttctaaggttcggtaactcgacggtcgtggggtcgacgaccgaccggccccgtaggaacgtagggtcttaggaggtggagtggtagtggactcgacggtcgtaacgttaacaaggttaccggaaccacgtaagtactagtacgacgaacgacgttacgtacgaaggtacagtacgtaccaaccgtacgtaccaacccgacgaccgtaaccgtaactaacccggttaccgaacggtaaccgaccgtaaccgggtaacttaacccctaaagtaacgggtacggtaacggtccgggttaacgggaaccgggttaacgtaccgggtaggtaacgtaaccggttaccggttaacggaaccgggtaccccggtaacgggttaccggttaacctttaacggtttaaccggtgggttaacgggtaccgggtttaacgggttttaacgggttttaacggtaaccgttaaacgttttaccggtttttacggttaagggttaccgggtttagggttaaccccggtttaccgttaggttttaccccggttttacggttttaccccgggg

SEQ ID NO: 276210 - DNA, 665 bp, Homo sapiens
  misc_feature: GYAE6OF02G7WNB.12.2.A02.1.454.CMB.1.raw
  modified_base (174)..(174): a, c, t, g, unknown or other
  misc_feature (174)..(174): n is a, c, g, or t
  modified_base (318)..(318): a, c, t, g, unknown or other
  misc_feature (318)..(318): n is a, c, g, or t
  modified_base (375)..(375): a, c, t, g, unknown or other
  misc_feature (375)..(375): n is a, c, g, or t
  modified_base (477)..(477): a, c, t, g, unknown or other
  misc_feature (477)..(477): n is a, c, g, or t
tcagatacgacgtacacgaccggtgctcgatttagactcatctacaggggacccaaaaaccacaccctccttgggagaatcccctagatcacagctcctcaccatggactggacctggagcatccttttcttggtggcagcagcaacaggtgcccactccaggttcagctggtncagtctggacgctagaggtagaagacgccgtggggcctggtagaacggtcctccgtgacgaaggtctttcgtacggttacctacctttaccagtctagtgtatcagcgtggtgacgacgacgccctaggacgaagggtcttagnggtacccggtaggtggtgtaggagtcgagcgtcttaacgaagtagacacacgactanacgacacgtacgtactacgagacgagtactacaccgactactaccacgaacgacaactacaccgacgacgactaacgacacctacgtagtacggacgtacgnggacggacgtcgacgacgtacgttacggtacgtaacgaccggtaacggtccgttaacgttacgttacgtgttacggtacggtaacggtttaggtttaggtacgttaacgtttaagtttacgtttacgggttacggtttacgggttacggtttaccggttacgtttaccgtttacggtttttacccggg

SEQ ID NO: 276211 - DNA, 794 bp, Homo sapiens
  misc_feature: GYAE6OF02HYOHA.12.2.A02.1.454.CMB.1.raw
  modified_base (179)..(179): a, c, t, g, unknown or other
  misc_feature (179)..(179): n is a, c, g, or t
  modified_base (189)..(189): a, c, t, g, unknown or other
  misc_feature (189)..(189): n is a, c, g, or t
  modified_base (255)..(255): a, c, t, g, unknown or other
  misc_feature (255)..(255): n is a, c, g, or t
tcagatacgacgtacacgaccggtgctcgatttagactcatctacaggggacccaaaaaccacacccctccttgggagaatcccctagatcacagctcctcaccatggactggacctggagcattcctttttcttggtggcagcagcaacaggtgcccactcccgaggttcagctggtncgagtctggngctgaggtgagagcgtgggctggtagaaggtctcgtgcgaggtcttcgtaggttaccacttacagnttagtggtatcgagtcgtcgggtcgacgtaccgacggtccccgtaggacgtacgggtcgttggaggtggtaggtcgggtagtggatcggacgccgtacttaacgtaagtacggtaaaccaacgtagtaaccgttgtaccgacgaagtaacggttaaccggtaccgaaagggtaccgaaacggtacgtaaccgtaacccgattaacccgaccgtaaccaacggtaacccaacgtaccgaacccgtaccgaacgtccgaaacgacggtaacctacggtacgacggtcgtagtacgggacgtacgtacggtaggaccgttagtaccggtaaacccggtcgtaaccgggtacccggtttaacgttaccgggtttaaacgttaccgggttacgtaccggggttacgggttaacggtttttcgggtttaaaccgtttgggttaaacggttttacgtttaacgggtttagggtttcgggttaacccgggtttaagttttcccgggtaggtttttaacccggttttcccggggttttaaccccgggg

SEQ ID NO: 276212 - DNA, 735 bp, Homo sapiens
  misc_feature: GYAE6OF02HI0KK.12.2.A02.1.454.CMB.1.raw
tcagatacgacgtacacgaccggtgctcgatttagactcatctacaggggacccaaaaaaccacacccctccttgggagaatcccctagatcacagctcctcaccatggactggacctggagcattccttttcttggtggcagcagcaacaggtgcccactcccaggttcagctggtgcagtcgtggacgctggaggtgaaagacggccgtggggacctcgggtagaaggtcctccgtgacgaacggtcttcgtacggttacctacctttaccgagtacttagtcggtatccaggtacgtgggtacgacggaccgaccggtccccgtaggaaccgtaagggtctaggaggtacggtagtggaatggacgtcgacggtctacttaaacgaagtaccgtaacacgaacgtattacgcgacgtaacgaagtaacgttcgaacggactaagtaccgtaccaacgtacgtaccgaacaacgtaacgaacgaactacgtacccaaaccggataacccacgaaccgtaactacggtaacgttgggaactacggtaccggaaggtacctaccgtaaggtacgtaccgttaacggttccggaaaccgttaccggaaccggttccgttaagtaccttcgtagggttaacgcggtaaggtaccgggtaacgacggttcgtaaccgttccgtttccgttaacggtaccggtacgggtaccgggtaccgttacgggtaccgttccggg

SEQ ID NO: 276213 - DNA, 730 bp, Homo sapiens
  misc_feature: GYAE6OF02H81LB.12.2.A02.1.454.CMB.1.raw
  modified_base (125)..(125): a, c, t, g, unknown or other
  misc_feature (125)..(125): n is a, c, g, or t
  modified_base (194)..(194): a, c, t, g, unknown or other
  misc_feature (194)..(194): n is a, c, g, or t
tcagatacgacgtacacgaccggtgctcgatttagactcatctacaggggacccaaaaaccacacccctccttgggagaactcccctagatcacagcctcctccaccagtggactggacctggancattccttttcgttggtggcagcagcaacgcggtcgccctaccgtcccgaaggtttcacgtcgtgggtnccaggtctaggagcgtggaggtgaaagacgtccggtgggccgttggtaggtaacgtcctcgtacgaccgacgttcttcggtacgttaacctaccgtttacgacgtacttacgtaggtaccttgacgtaggtcggtacgacgaccgtacgaccgtaggaccggtaacggtgttacgaggttacggaggtacggtagtcgacgtatcgtaggtaccttaacgaacggtagtaaacgcgtaacgtactatacggactaagacgacgttacgaaacgataacggcgtaaccaacggtctaccggacaaccgtacaacgaactaccgtaaccgaacgaacgtacgacctacgacgtagtaccgagacgtgaacgtctaggtacgaagttcgacgttacggtacgaccggtacgttacgtaagttacgtacggtaccgtaggtaacccgttaggttaacgttaggtacttaagttacgttacgtttagtaggttcgtaacggtccggttaaccgtttcgttttacggttccgttaacccggg

SEQ ID NO: 276214 - DNA, 360 bp, Homo sapiens
  misc_feature: GYAE6OF01BEVWC.35.55.E11.1.454.CMB.1.raw
  modified_base (357)..(360): a, c, t, g, unknown or other
  misc_feature (357)..(360): n is a, c, g, or t
tcagtacagatcgtcacgaccggtgctcgatttagcactcgcacgttgggttgggtctttgtctcggccgacaagtccatcaataccgcctacctccagtttgaatacctggaggcctccgacactgccatttattattgtgtgagacgctcatcctctgggtacgactggaggagcgcttttgacatctggggccaagggacaacagtcaccgtctcttccgcctccaccaagggcccatcggtcttccccctggcaccctcctccaagagcacctctggggcacagcggccctgggctgcctggtcaaggactacttccacgatctgtactgagcgggctggcaaggcgcatagnnnn

SEQ ID NO: 276215 - DNA, 254 bp, Homo sapiens
  misc_feature: GYAE6OF01CEK3H.35.55.E11.1.454.CMB.1.raw
  modified_base (252)..(254): a, c, t, g, unknown or other
  misc_feature (252)..(254): n is a, c, g, or t
tcagtacagatcgtcacgaccggtgctcgatttagcactcgcacgttgggtttgggacagacttcactctcaccatcagtcgactggagtctgaggattttgcagtgtattattgtcagcagtatggtaactctcctacaactttcggccagggaccaagttggagatcaagcgaactgtggctgcaccatctgtcttcatcttcccgccatctgaacgatctgtactgagcgggctggcaaggcgcatagnnn

SEQ ID NO: 276216 - DNA, 366 bp, Homo sapiens
  misc_feature: GYAE6OF01C5HH6.35.55.E11.1.454.CMB.1.raw
  modified_base (360)..(366): a, c, t, g, unknown or other
  misc_feature (360)..(366): n is a, c, g, or t
tcagtacagatcgtcacgaccggtgctcgatttagcactcgcacgttggggtttgggtctttgtctcggccgacaagtccatcaataccgcctacctccagtttgaatacctggaggcctccgacactgccatttattattgtgtgagacgctcatcctctgggtacgactggaggagcgcttttgacatctggggccaagggacaacagtcaccgtctcttccgcctccaccaagggcccatcggtcttccccctggcaccctcctccaagagcacctctgggggcacagcggccctgggctgcctggtcaaggactacttccacgatctgtactgagcgggctggcaaggcgcatagnnnnnnn

SEQ ID NO: 276217 - DNA, 364 bp, Homo sapiens
  misc_feature: GYAE6OF01B40WZ.35.55.E11.1.454.CMB.1.raw
  modified_base (358)..(364): a, c, t, g, unknown or other
  misc_feature (358)..(364): n is a, c, g, or t
tcagtacagatcgtcacgaccggtgctcgatttagcactcgcacgttgggtttgggtctttgtctcggccgacaagtccatcaataccgcctacctccagtttgaatacctggaggcctccgacactgccatttattattgtgtgagacgctcatcctctgggtacgactggaggagcgcttttgacatctggggccaagggacaacagccaccgtctcttccgcctccaccaagggcccatcggtcttccccctggcaccctcctccaagagcacctctggggcacagcggccctgggctgcctggtcaaggactacttccacgatctgtactgagcgggctggcaaggcgcatagnnnnnnn

SEQ ID NO: 276218 - DNA, 254 bp, Homo sapiens
  misc_feature: GYAE6OF01CB55Q.35.55.E11.1.454.CMB.1.raw
  modified_base (252)..(254): a, c, t, g, unknown or other
  misc_feature (252)..(254): n is a, c, g, or t
tcagtacagatcgtcacgaccggtgctcgatttagcactcgcacgttgggtttgggacagacttcactctcaccatcagtcgactggagtctgaggatttgcagtgtattattgtcagcagtatggtaactctcctacaactttcggccaggggaccaagttggagatcaagcgaactgtggctgcaccatctgtcttcatcttcccgccatctgaacgatctgtactgagcgggctggcaaggcgcatagnnn

SEQ ID NO: 276219 - DNA, 358 bp, Homo sapiens
  misc_feature: GYAE6OF01CQIWR.35.55.E11.1.454.CMB.1.raw
  modified_base (355)..(358): a, c, t, g, unknown or other
  misc_feature (355)..(358): n is a, c, g, or t
tcagtacagatcgtcacgaccggtgctcgatttagcactcgcacgttgggtttgggtctttgtctcggccgacaagtccatcaataccgcctacctccagtttgaatacctggaggcctccgacactgccatttattattgtgtgagacgctcatcctctgggtacgactggaggagcgcttttgacatctggggccaagggacaacagtcaccgtctcttccgcctcaccaagggcccatcggtctcccctggcaccctcctccaagagcacctctggggcacagcggccctgggctgcctggtcaaggactacttccacgatctgtactgagcgggctggcaaggcgcatagnnnn

SEQ ID NO: 276220 - DNA, 361 bp, Homo sapiens
  misc_feature: GYAE6OF01EEVZQ.35.55.E11.1.454.CMB.1.raw
  modified_base (358)..(361): a, c, t, g, unknown or other
  misc_feature (358)..(361): n is a, c, g, or t
tcagtacagatcgtcacgaccggtgctcgatttagcactcgcacgttgggttgggtctttgtctcggccgacaagtccatcaataccgcctacctccagtttgaatacctggaggcctccgacactgccatttattattgtgtgagacgctcatcctctgggtacgactggaggagcgcttttgacatctggggccaagggacaacagtcaccgtctcttccgcctccaccaagggcccatcggtcttccccctggcaccctcctccaagagcacctctgggggcacagcggccctgggctgcctggtcaaggactacttccacgatctgtactgagcgggctggcaaggcgcatagnnnn

SEQ ID NO: 276221 - DNA, 358 bp, Homo sapiens
  misc_feature: GYAE6OF01DJTOA.35.55.E11.1.454.CMB.1.raw
  modified_base (355)..(358): a, c, t, g, unknown or other
  misc_feature (355)..(358): n is a, c, g, or t
tcagtacagatcgtcacgaccggtgctcgatttagcactcgcacgttgggttgggtctttgtctcggccgacaagtccatcaataccgcctacctccagtttgaatacctggaggcctccgacactgccatttattattgtgtgagacgctcatcctctgggtacgactggaggagcgcttttgacatctggggccaagggacaacagtcaccgtctcttccgcctccaccaagggcccatcggtcttccccctggcacctcctccaagagcacctctggggcacagcggcctgggctgcctggtcaaggactacttccacgatctgtactgagcgggctggcaaggcgcatagnnnn

SEQ ID NO: 276222 - DNA, 362 bp, Homo sapiens
  misc_feature: GYAE6OF01DRI9Z.35.55.E11.1.454.CMB.1.raw
  modified_base (356)..(362): a, c, t, g, unknown or other
  misc_feature (356)..(362): n is a, c, g, or t
tcagtacagatcgtcacgaccggtgctcgatttagcactcgcacgttgggtttgggtctttgtctcggccgacaagtccatcaataccgcctacctccagtttgaatacctggaggcctccgacactgccatttattattgtgtgagacgctcatcctctgggtacgactggaggagcgcttttgacatctggggccaagggacaacagtcaccgtctcttccgcctccaccaaggccatcgtccttcccctgcaccctcctccaagagcacctcgtgggggcacagcggccctgggctgcctggtcaaggactacttccacgatctgtactgagcgggctggcaaggcgcatagnnnnnnn

SEQ ID NO: 276223 - DNA, 361 bp, Homo sapiens
  misc_feature: GYAE6OF01CY8LV.35.55.E11.1.454.CMB.1.raw
  modified_base (354)..(361): a, c, t, g, unknown or other
  misc_feature (354)..(361): n is a, c, g, or t
tcagtacagatcgtcacgaccggtgctcgatttagcactcgcacgttgggtttgggtctttgtctcggccgacaagtccatcaataccgcctacctccagtttgaatacctggaggcctccgacactgccatttattattgtgtgagacgctcatcctctgggtacgactggaggagcgcttttgacatctggggccaagggacaacagtcaccgtctcttccgcctccaccaagggcccatcggtcttccccctggccaccctcctccaagagcacctctggggcacagcggcctgggctgcctggtcaaggctactccacgatctgtactgagcggctggcaagcgcatagnnnnnnnn

SEQ ID NO: 276224 - DNA, 364 bp, Homo sapiens
  misc_feature: GYAE6OF01BD8WU.35.55.E11.1.454.CMB.1.raw
  modified_base (356)..(364): a, c, t, g, unknown or other
  misc_feature (356)..(364): n is a, c, g, or t
tcagtacagatcgtcacgaccggtgctcgatttagcactcgcacgttgggtttgggtctttgtctcggccgacaagtccatcaataccgcctacctccagtttgaatacctggaggcctccgacactgccatttattattgtgtgagacgctcatcctctgggtacgactggaggagcgcttttgacatctggggccaagggacaacagtcaccgtctcttccgcctccaccaagggcccatcggtcttccccctggcaccctcctccaagagcacctctggggcacagcggcctgggctgcctggtcaaggactacttccacgatctgtactgagcggctggcaaggcgcatagnnnnnnnnn

SEQ ID NO: 276225 - DNA, 359 bp, Homo sapiens
  misc_feature: GYAE6OF01BUQSQ.35.55.E11.1.454.CMB.1.raw
  modified_base (269)..(269): a, c, t, g, unknown or other
  misc_feature (269)..(269): n is a, c, g, or t
  modified_base (353)..(359): a, c, t, g, unknown or other
  misc_feature (353)..(359): n is a, c, g, or t
tcagtacagatcgtcacgaccggtgctcgatttagcactcgcacgttgggtttgggtctttgtctcggccgacaagtccatcaataccgcctacctccagtttgaatacctggaggcctccgacactgccatttattattgtgtgagacgctcatcctctgggtacgactggaggagcgcttttgacatctggggccaagggacaacagtcaccgtctcttccgcctccaccaagggcccatcggtctcccctggcaccctcctcaagngcacctctggggcacagcggcctgggctgcctggtcaaggctacttccacgatctgtactgagcgggctggcaaggcgcatagnnnnnnn

SEQ ID NO: 276226 - DNA, 360 bp, Homo sapiens
  misc_feature: GYAE6OF01DWZX1.35.55.E11.1.454.CMB.1.raw
  modified_base (355)..(360): a, c, t, g, unknown or other
  misc_feature (355)..(360): n is a, c, g, or t
tcagtacagatcgtcacgaccggtgctcgatttagcactcgcacgttgggttgggtctttgtctcggccgacaagtccatcaataccgcctacctccagtttgaatacctggaggcctccgacactgccatttattattgtgtgagacgctcatcctctgggtacgactggaggagcgcttttgacatctggggccaagggacaacagtcaccgtctcttccgcctccaccaagggcccatcggtctccccctggcaccctctccaagagcacctctggggcacagcggccctgggctgcctggtcaaggactacttccacgatctgtactgagcgggctggcaaggcgcatagnnnnnn

SEQ ID NO: 276227 - DNA, 363 bp, Homo sapiens
  misc_feature: GYAE6OF01D60U4.35.55.E11.1.454.CMB.1.raw
  modified_base (359)..(363): a, c, t, g, unknown or other
  misc_feature (359)..(363): n is a, c, g, or t
tcagtacagatcgtcacgaccggtgctcgatttagcactcgcacgttgggttgggtctttgtctcggccgacaagtccatcaataccgcctacctccagtttgaatacctggaggcctccgacactgccatttattattgtgtgagacgctcatcctctgggtacgactggaggagcgcttttgacatctggggccaagggacaacagtcaccgtctcttccgcctccaccaagggcccatcggtcttccccctggccaccctcctccaagagcacctctgggggcacagcggccctgggctgcctggtcaaggactacttccacgatctgtactgagcgggctggcaaggcgcatagnnnnn

SEQ ID NO: 276228 - DNA, 361 bp, Homo sapiens
  misc_feature: GYAE6OF01CJVEX.35.55.E11.1.454.CMB.1.raw
  modified_base (358)..(361): a, c, t, g, unknown or other
  misc_feature (358)..(361): n is a, c, g, or t
tcagtacagatcgtcacgaccggtgctcgatttagcactcgcacgttgggtttgggtctttgtctcggccgacaagtccatcaataccgcctacctccagtttgaatacctggaggcctccgacactgccatttattattgtgtgagacgctcatcctctgggtacgactggaggagcgcttttgacatctggggccaagggacaacagtcaccgtctcttccgcctccaccaagggcccatcggtcttccccctggcaccctctccaagagcacctctgggggcacagcggccctgggctgcctggtcaaggactacttccacgatctgtactgagcgggctggcaaggcgcatagnnnn

SEQ ID NO: 276229 - DNA, 365 bp, Homo sapiens
  misc_feature: GYAE6OF01C7RA5.35.55.E11.1.454.CMB.1.raw
  modified_base (359)..(365): a, c, t, g, unknown or other
  misc_feature (359)..(365): n is a, c, g, or t
tcagtacagatcgtcacgaccggtgctcgatttagcactcgcacgttgggtttgggtctttgtctcggccgacaagtccatcaataccgcctacctccagtttgaatacctggaggcctccgacactgccatttattattgtgtgagacgctcatcctctgggtacgactggaggagcgcttttgacatctggggccaagggacaacagtcaccgtctcttccgcctccaccaagggcccatcggtcttccccctggcaccctcctccaagagcacctctgggggcacagcggccctgggctgcctggtcaaggactacttccacgatctgtactgagcgggctggcaaggcgcatagnnnnnnn

SEQ ID NO: 276230 - DNA, 363 bp, Homo sapiens
  misc_feature: GYAE6OF01DWFM5.35.55.E11.1.454.CMB.1.raw
  modified_base (358)..(363): a, c, t, g, unknown or other
  misc_feature (358)..(363): n is a, c, g, or t
tcagtacagatcgtcacgaccggtgctcgatttagcactcgcacgttgggtttgggtctttgtctcggccgacaagtccatcaataccgcctacctccagtttgaatacctggaggcctccgacactgccatttattattgtgtgagacgctcatcctctgggtacgactggaggagcgcttttgacatctggggccaagggacaacagtcaccgtctcttccgcctccaccaagggcccatcggtcttccccctggcaccctcctccaagagcacctctgggggcacagcggccctgggctgcctggtcaaggactacttccacgatctgtactgagcggctggcaaggcgcatagnnnnnn

SEQ ID NO: 276231 - DNA, 359 bp, Homo sapiens
  misc_feature: GYAE6OF01DIB2Z.35.55.E11.1.454.CMB.1.raw
  modified_base (359)..(359): a, c, t, g, unknown or other
  misc_feature (359)..(359): n is a, c, g, or t
tcagtacagatcgtcacgaccggtgctcgatttagcactcgcacgttgggtttgggtctttgtctcggccgacaagtccatcaataccgcctacctccagtttgaatacctggaggcctccgacactgccatttattattgtgtgagacgctcatcctctgggtacgactggaggagcgcttttgacatctggggccaagggacaacagtcaccgtctcttccgcctccaccaagggcccatcggtcttccccctggcaccctcctccaagagcacctctgggggcacagcggccctgggctgcctggtcaaggactacttccacgatctgtactgagcgggctggcaaggcgcatagn

SEQ ID NO: 276232 - DNA, 361 bp, Homo sapiens
  misc_feature: GYAE6OF01DZY27.35.55.E11.1.454.CMB.1.raw
  modified_base (359)..(361): a, c, t, g, unknown or other
  misc_feature (359)..(361): n is a, c, g, or t
tcagtacagatcgtcacgaccggtgctcgatttagcactcgcacgttgggtttgggtctttgtctcggccgacaagtccatcaataccgcctacctccagtttgaatacctggaggcctccgacactgccatttattattgtgtgagacgctcatcctctgggtacgactggaggagcgcttttgacatctggggccaagggacaacagtcaccgtctcttccgcctccaccaagggcccatcggtcttccccctggcaccctcctccaagagcacctctgggggcacagcggccctgggctgcctggtcaaggactacttccacgatctgtactgagcgggctggcaaggcgcatagnnn

SEQ ID NO: 276233 - DNA, 363 bp, Homo sapiens
  misc_feature: GYAE6OF01CGC8D.35.55.E11.1.454.CMB.1.raw
  modified_base (358)..(363): a, c, t, g, unknown or other
  misc_feature (358)..(363): n is a, c, g, or t
tcagtacagatcgtcacgaccggtgctcgatttagcactcgcacgttgggttgggtctttgtctcggccgacaagtccatcaataccgcctacctccagtttgaatacctggaggcctccgacactgccatttattattgtgtgagacgctcatcctctgggtacgactggaggagcgcttttgacatctggggccaagggacaacagtcaccgtctcttccgcctccaccaaggcccatcggtcttccccctggccaccctcctccaagagcacctctgggggcacagcggccctgggctgcctggtcaaggactacttccacgatctgtactgagcgggctggcaaggcgcatagnnnnnn

SEQ ID NO: 276234 - DNA, 364 bp, Homo sapiens
  misc_feature: GYAE6OF01B1PH7.35.55.E11.1.454.CMB.1.raw
  modified_base (358)..(364): a, c, t, g, unknown or other
  misc_feature (358)..(364): n is a, c, g, or t
tcagtacagatcgtcacgaccggtgctcgatttagcactcgcacgttgggtttgggtctttgtctcggccgacaagtccatcaataccgcctacctccagtttgaatacctggaggcctccgacactgccatttattattgtgtgagacgctcatcctctgggtacgactggaggagcgcttttgacatctggggccaagggacaacagtcaccgtctcttccgcctccaccaaggcccatcggtcttccccctggcaccctcctccaagagcacctctgggggcacagcggccctgggctgcctggtcaaggactacttccacgatctgtactgagcgggctggcaaggcgcatagnnnnnnn

SEQ ID NO: 276235 - DNA, 363 bp, Homo sapiens
  misc_feature: GYAE6OF01CT66U.35.55.E11.1.454.CMB.1.raw
  modified_base (358)..(363): a, c, t, g, unknown or other
  misc_feature (358)..(363): n is a, c, g, or t
tcagtacagatcgtcacgaccggtgctcgatttagcactcgcacgttgggtttgggtctttgtctcggccgacaagtccatcaataccgcctacctccagtttgaatacctggaggcctccgacactgccatttattattgtgtgagacgctcatcctctgggtacgactggaggagcgcttttgacatctggggccaagggacaacagtcaccgtctcttccgcctccaccaagggcccatcggtcttccccctggcaccctcctccaagagcacctctgggggcacagcggccctgggctgcctggtcaaggactactccacgatctgtactgagcgggctggcaaggcgcatagnnnnnn

SEQ ID NO: 276236 - DNA, 366 bp, Homo sapiens
  misc_feature: GYAE6OF01A1AO2.35.55.E11.1.454.CMB.1.raw
  modified_base (360)..(366): a, c, t, g, unknown or other
  misc_feature (360)..(366): n is a, c, g, or t
tcagtacagatcgtcacgaccggtgctcgatttagcactcgcacgttgggtttgggtctttgtctcggccgacaagtccatcaataccgcctacctccagtttgaatacctggaggcctccgacactgccatttattattgtgtgagacgctcatcctctgggtacgactggaggagcgcttttgacatctggggccaagggacaacagtcaccgtctcttccgcctccaccaagggcccatcggtcttccccctggccaccctcctccaagagcacctctgggggcacagcggccctgggctgcctggtcaaggactacttccacgatctgtactgagcgggctggcaaggcgcatagnnnnnnn

SEQ ID NO: 276237 - DNA, 359 bp, Homo sapiens
  misc_feature: GYAE6OF01EL6W7.35.55.E11.1.454.CMB.1.raw
  modified_base (357)..(359): a, c, t, g, unknown or other
  misc_feature (357)..(359): n is a, c, g, or t
tcagtacagatcgtcacgaccggtgctcgatttagcactcgcacgttgggttgggtctttgtctcggccgacaagtccatcaataccgcctacctccagtttgaatacctggaggcctccgacactgccatttattattgtgtgagacgctcatcctctgggtacgactggaggagcgcttttgacatctggggccaagggacaacagtcaccgtctcttccgcctccaccaagggcccatcggtcttccccctggcaccctcctccaagagcacctctgggggcacagcggcctgggctgcctggtcaaggactacttccacgatctgtactgagcgggctggcaaggcgcatagnnn

SEQ ID NO: 276238 - DNA, 360 bp, Homo sapiens
  misc_feature: GYAE6OF01EGPUQ.35.55.E11.1.454.CMB.1.raw
  modified_base (357)..(360): a, c, t, g, unknown or other
  misc_feature (357)..(360): n is a, c, g, or t
tcagtacagatcgtcacgaccggtgctcgatttagcactcgcacgttgggttgggtctttgtctcggccgacaagtccatcaataccgcctacctccagtttgaatacctggaggcctccgacactgccatttattattgtgtgagacgctcatcctctgggtacgactggaggagcgcttttgacatctggggccaagggacaacagtcaccgtctcttccgcctccaccaagggcccatcggtcttccccctggcaccctcctccaagagcacctctgggggcacagcggccctggctgcctggtcaaggactacttccacgatctgtactgagcgggctggcaaggcgcatagnnnn

SEQ ID NO: 276239 - DNA, 365 bp, Homo sapiens
  misc_feature: GYAE6OF01BUFC4.35.55.E11.1.454.CMB.1.raw
  modified_base (357)..(365): a, c, t, g, unknown or other
  misc_feature (357)..(365): n is a, c, g, or t
tcagtacagatcgtcacgaccggtgctcgatttagcactcgcacgttgggttgggtctttgtctcggccgacaagtccatcaataccgcctacctccagtttgaatacctggaggcctccgacactgccatttattattgtgtgagacgctcatcctctgggtacgactggaggagcgcttttgacatctggggccaagggacaacagtcaccgtctcttccgcctccaccaaggcccatcggtcttccccctggccaccctcctccaagagcacctctgggggcacagcggcctgggctgcctggtcaaggactacttccacgatctgtactgagcgggctggcaaggcgcatagnnnnnnnnn

SEQ ID NO: 276240 - DNA, 363 bp, Homo sapiens
  misc_feature: GYAE6OF01AYKSN.35.55.E11.1.454.CMB.1.raw
  modified_base (358)..(363): a, c, t, g, unknown or other
  misc_feature (358)..(363): n is a, c, g, or t
tcagtacagatcgtcacgaccggtgctcgatttagcactcgcacgttgggttgggtctttgtctcggccgacaagtccatcaataccgcctacctccagtttgaatacctggaggcctccgacactgccatttattattgtgtgagacgctcatcctctgggtacgactggaggagcgcttttgacatctggggccaagggacaacagtcaccgtctcttccgcctccaccaagggcccatcggtcttccccctggcaccctcctccaagagcacctctgggggcacagcggccctgggctgcctggtcaaggactacttccacgatctgtactgagcgggctggcaaggcgcatagnnnnnn

SEQ ID NO: 276241 - DNA, 367 bp, Homo sapiens
  misc_feature: GYAE6OF01CMKM7.35.55.E11.1.454.CMB.1.raw
  modified_base (360)..(367): a, c, t, g, unknown or other
  misc_feature (360)..(367): n is a, c, g, or t
tcagtacagatcgtcacgaccggtgctcgatttagcactcgcacgttgggtttgggtctttgtctcggccgacaagtccatcaataccgcctacctccagtttgaatacctggaggcctccgacactgccatttattattgtgtgagacgctcatcctctgggtacgactggaggagcgcttttgacatctgggccaagggacaacagtcaccgtctcttccgcctccaccaagggcccatcggtccttccccctggccaccctcctccaagacgcacctctgggggcacagcgccctggctgcctggtcaaggactacttccacgatctgtactgagcgggctggcaaggcgcagtagnnnnnnnn

SEQ ID NO: 276242 - DNA, 363 bp, Homo sapiens; identical to SEQ ID NO: 276227
  misc_feature: GYAE6OF01B7WAC.35.55.E11.1.454.CMB.1.raw
  modified_base (359)..(363): a, c, t, g, unknown or other
  misc_feature (359)..(363): n is a, c, g, or t

SEQ ID NO: 276243 - DNA, 364 bp, Homo sapiens
  misc_feature: GYAE6OF01B9B6Q.35.55.E11.1.454.CMB.1.raw
  modified_base (358)..(364): a, c, t, g, unknown or other
  misc_feature (358)..(364): n is a, c, g, or t
tcagtacagatcgtcacgaccggtgctcgatttagcactcgcacgttgggtttgggtctttgtctcggccgacaagtccatcaataccgcctacctccagtttgaatacctggaggcctccgacactgccatttattattgtgtgagacgctcatcctctgggtacgactggaggagcgcttttgacatctggggccaagggacaacagtcaccgtctcttccgcctccaccaagggcccatcggtcttccccctggcaccctcctccaagagcacctctgggggcacagcggcctgggctgcctggtcaaggactacttccacgatctgtactgagcgggctggcaaggcgcatagnnnnnnn

SEQ ID NO: 276244 - DNA, 461 bp, Homo sapiens
  misc_feature: GYAE6OF01CTUTY.35.55.E11.1.454.CMB.1.raw
  modified_base (443)..(443): a, c, t, g, unknown or other
  misc_feature (443)..(443): n is a, c, g, or t
  modified_base (445)..(461): a, c, t, g, unknown or other
  misc_feature (445)..(461): n is a, c, g, or t
tcagtacagatcgtcacgaccggtgctcgatttagcactcgcacgttgggttgggtctttgtctcggccgacaagtccatcaataccgcctacctccagtttgaatacctggaggcctccgacactgccatttattattgtgtgagacgctcatcctctgggtacgactggaggagcgcttttgacatcgtggggccaagggacaacagtccaccgtctccttccgcctccaccgaacgggcccagtccggtcccttcccccgtcggccacccctcctaccgaacggacgccaccgttcggtcggggggaccacggtacggtccggtccggtgggtcgtcggtccgttcgggtaaccgaacggtaccttaccgtcccgaacgtacttcggtacgttacggtaggacgggccgggtcggtacgggacggaacgggccgataagngnnnnnnnnnnnnnnnnn

SEQ ID NO: 276245 - DNA, 363 bp, Homo sapiens
  misc_feature: GYAE6OF01AUMW7.35.55.E11.1.454.CMB.1.raw
  modified_base (357)..(363): a, c, t, g, unknown or other
  misc_feature (357)..(363): n is a, c, g, or t
tcagtacagatcgtcacgaccggtgctcgatttagcactcgcacgttgggttgggtctttgtctcggccgacaagtccatcaataccgcctacctccagtttgaatacctggaggcctccgacactgccatttattattgtgtgagacgctcatcctctgggtacgactggaggagcgcttttgacatctggggccaagggacaacagtcaccgtctcttccgcctccaccaagggcccatcggtcttccccctggcgccctgctccaggagcacctccgagagcacagcggccctgggctgcctggtcaaggactacttccacgattgtactgagcgggctggcaaggcgcatagnnnnnnn

SEQ ID NO: 276246 - DNA, 376 bp, Homo sapiens
  misc_feature: GYAE6OF01BGJ9B.35.55.E11.1.454.CMB.1.raw
  modified_base (360)..(361): a, c, t, g, unknown or other
  misc_feature (360)..(361): n is a, c, g, or t
  modified_base (363)..(376): a, c, t, g, unknown or other
  misc_feature (363)..(376): n is a, c, g, or t
tcagtacagatcgtcacgaccggtgctcgatttagcactcgcacgttgggttgggtctttgtctcggccgacaagtccatcaataccgcctacctccagtttgaatacctggaggcctccgacactgccatttattattggtgtgagacgctcatcctctgggtacgactggaggagcgcttttgacatctggggccaagggacaacagtcaccgtctcttccgcctccaccaagggcccatccggtcttccccctggcaccctcctccaagagcacctctgggggcacacgcggccctgggctgcctggtcaaggactaccttccacgtctgtactgagcggctggcaaggcgcatagnnannnnnnnnnnnnnn

SEQ ID NO: 276247 - DNA, 363 bp, Homo sapiens
  misc_feature: GYAE6OF01DQVUE.35.55.E11.1.454.CMB.1.raw
  modified_base (356)..(363): a, c, t, g, unknown or other
  misc_feature (356)..(363): n is a, c, g, or t
tcagtacagatcgtcacgaccggtgctcgatttagcactcgcacgttgggtttgggtctttgtctcggccgacaagtccatcaataccgcctacctccagtttgaatacctggaggcctccgacactgccatttattattgtgtgagacgctcatcctctgggtacgactggaggagcgcttttgacatctggggccaagggacaacagtcaccgtctcttccgcctccaccaagggcccatcggtcttccccctggcaccctcctccaagagcacctctggggcacagcggcctggctgcctggtcaaggactacttccacgatctgtactgagcgggctggcaaggcgcatagnnnnnnnn

SEQ ID NO: 276248 - DNA, 363 bp, Homo sapiens; identical to SEQ ID NO: 276240
  misc_feature: GYAE6OF01DAETW.35.55.E11.1.454.CMB.1.raw
  modified_base (358)..(363): a, c, t, g, unknown or other
  misc_feature (358)..(363): n is a, c, g, or t

SEQ ID NO: 276249 - DNA, 227 bp, Homo sapiens
  misc_feature: GYAE6OF01D4D2W.35.55.E11.1.454.CMB.1.raw
  modified_base (227)..(227): a, c, t, g, unknown or other
  misc_feature (227)..(227): n is a, c, g, or t
tcagtacagatcgtcacgaccggtgctcgatttagcactcgcacgttgggtttgggacagacttcactctcaccatcagtcgactggagtctgaggattttgcagtgtattattgtcagcagtatggtaactctcctacaactttcggccagggaccaagttggagatcaagcgaactgtggctgcaccatctgtcttcatcttcccgccatctgaacatctgtacn

SEQ ID NO: 276250 - DNA, 365 bp, Homo sapiens
  misc_feature: GYAE6OF01DBKRQ.35.55.E11.1.454.CMB.1.raw
  modified_base (357)..(365): a, c, t, g, unknown or other
  misc_feature (357)..(365): n is a, c, g, or t
tcagtacagatcgtcacgaccggtgctcgatttagcactcgcacgttgggttgggtctttgtctcggccgacaagtccatcaataccgcctacctccagtttgaatacctggaggcctccgacactgccatttattattgtgtgagacgctcatcctctgggtacgactggaggagcgcttttgacatctggggccaagggacaacagtcaccgtctcttccgcctccaccaagggcccatcggtcttccccctggcaccctcctccaagagcacctctgggggcacagtggccctggctgcctggtcaaggactacttccacgatctgtactgagcgggctggcaaggcgcatagnnnnnnnnn

SEQ ID NO: 276251 - DNA, 369 bp, Homo sapiens
  misc_feature: GYAE6OF01ESQNZ.35.55.E11.1.454.CMB.1.raw
  modified_base (361)..(369): a, c, t, g, unknown or other
  misc_feature (361)..(369): n is a, c, g, or t
tcagtacagatcgtcacgaccggtgctcgatttagcactcgcacgttgggtttgggtctttgtctcggccgacaagtccatcaataccgcctacctccagtttgaatacctggaggcctccgacactgccatttattattgtgtgagacgctcatcctctgggtacgactggaggagcgcttttgacatctggggccaagggacaacagtcaccgtctcttccgcctccaccaagggcccatcggtcttccccctggcaccctcctccaagagcacctctgggggcacagccggccctgggctgcctggtcaaggactacttccacgatctgtactgagcgggctggcgaaggcgcatagnnnnnnnnn

SEQ ID NO: 276252 - DNA, 370 bp, Homo sapiens
  misc_feature: GYAE6OF01BDLTV.35.55.E11.1.454.CMB.1.raw
  modified_base (361)..(370): a, c, t, g, unknown or other
  misc_feature (361)..(370): n is a, c, g, or t
tcagtacagatcgtcacgaccggtgctcgatttagcactcgcacgttgggtttgggtctttgtctcggccgacaagtccatcaataccgcctacctccagtttgaatacctggaggcctccgacactgccatttattattgtgtgagacgctcatcctctgggtacgactggaggagcgcttttgacatctggggccaagggacaacagtcaccgtctcttccgcctccaccaagggcccatcggtcttccccctggccaccctcctccaagagcacctctgggggcacagccggccctgggctgcctggtcaaggactacttccacgatctgtactgagcgggctggcaaggcgcatagnnnnnnnnnn

SEQ ID NO: 276253 - DNA, 366 bp, Homo sapiens
  misc_feature: GYAE6OF01CSNGG.35.55.E11.1.454.CMB.1.raw
  modified_base (357)..(366): a, c, t, g, unknown or other
  misc_feature (357)..(366): n is a, c, g, or t
tcagtacagatcgtcacgaccggtgctcgatttagcactcgcacgttgggtttgggtctttgtctcggccgacaagtccatcaataccgcctacctccagtttgaatacctggaggcctccgacactgccatttattattgtgtgagacgctcatcctctgggtacgactggaggagcgcttttgacatctggggccaagggacaacagtcaccgtctcttccgcctccaccaaggcccatcggtcttcccctggcaccctcctccaagagcacctctggggcacagcggccctgggctgcctggtcaaggactacttccacgatctgtactgagcggctggcaaggcgacatagcnnnnnnnnnn

SEQ ID NO: 276254 - DNA, 368 bp, Homo sapiens
  misc_feature: GYAE6OF01BNGVZ.35.55.E11.1.454.CMB.1.raw
  modified_base (274)..(274): a, c, t, g, unknown or other
  misc_feature (274)..(274): n is a, c, g, or t
  modified_base (344)..(344): a, c, t, g, unknown or other
  misc_feature (344)..(344): n is a, c, g, or t
  modified_base (362)..(368): a, c, t, g, unknown or other
  misc_feature (362)..(368): n is a, c, g, or t
tcagtacagatcgtcacgaccggtgctcgatttagcactcgcacgttgggtttgggtctttgtctcggccgacaagtccatcaataccgcctacctccagtttgaatacctggaggcctccgacactgccatttattattgtgtgagacgctcatcctctgggtacgactggaggagcgtcttttgacatctggggccaagggacaacagtcaccgtctcttccgcctccaccaaggcccatccggtcttccccctgccaccctcctccaagancacctcgtggggcacagcggccctgggctgcctggtacaaggactactccacgatctgtactgagcgggntggacaaggcgacatagnnnnnnn

SEQ ID NO: 276255 - DNA, 449 bp, Homo sapiens
  misc_feature: GYAE6OF01EWAED.35.55.E11.1.454.CMB.1.raw
  modified_base (345)..(345): a, c, t, g, unknown or other
  misc_feature (345)..(345): n is a, c, g, or t
  modified_base (426)..(449): a, c, t, g, unknown or other
  misc_feature (426)..(449): n is a, c, g, or t
tcagtacagatcgtcacgaccggtgctcgatttagcactcgcacgttgggttgggtctttgtctcggccgacaagtccatcaataccgcctacctccagtttgaatacctggaggcctccgacactgccatttattattgtgtgagacgctcatcctcgtgggtacgacgtgggaggagcgtctttgacatcgtggggccaagggacaacagtcaccgtctcttccgcctccaccaacggcccagtccggtccttccccccgtggccacccctccctccaaagacgccaccctcggtcgggggccaccgacggccggcccgtggggcctcggcccgtggtaccgntaacgggtaccctaacttccgaacgtacttcctaggtacgtgacgggccgggtcgtcggaccgaaggccggactaagtagnnnnnnnnnnnnnnnnnnnnnnnn

SEQ ID NO: 276256 - DNA, 281 bp, Homo sapiens
  misc_feature: GYAE6OF01CWGZS.35.55.E11.1.454.CMB.1.raw
  modified_base (254)..(262): a, c, t, g, unknown or other
  misc_feature (254)..(262): n is a, c, g, or t
  modified_base (265)..(265): a, c, t, g, unknown or other
  misc_feature (265)..(265): n is a, c, g, or t
  modified_base (267)..(281): a, c, t, g, unknown or other
  misc_feature (267)..(281): n is a, c, g, or t
tcagtacagatcgtcacgaccggtgctcgatttagcactcgcacgttgggtttgggacagacttcactctcaccatcagtcgactggagtctgaggattttgcagtgtattattgtcagcagtatggtaactctcctacaacttttcggccaggggaccaagttggagatcaagcgaactgtggctgcaccatctgtcttcatccttcccggcatctgaacgatctgtactgagcgggctggcaagcgcatagnnnnnnnnnagngnnnnnnnnnnnnnnn

SEQ ID NO: 276257 - DNA, 387 bp, Homo sapiens
  misc_feature: GYAE6OF01CI1CD.35.55.E11.1.454.CMB.1.raw
  modified_base (374)..(387): a, c, t, g, unknown or other
  misc_feature (374)..(387): n is a, c, g, or t
tcagtacagatcgtcacgaccggtgctcgatttagcactcgcacgttgggtttgggtctttgtctcggccgacaagtccatcaataccgcctacctccagtttgaatacctggaggcctccgacactgccatttattattgtgtgagacgctcatcctctgggtacgactggaggagcgcttttgacatctggggccaagggacaacagtcaccgtctcttccgcctccaccagggccatcggtcctcccctgcaccctcctccaagcgcacctcgtgggggcacgagccggcccgtgggcctcggcccgtggtcgaaggactacttccacgtatcgtgtactggacgcgggtcgtggcaagggcgacgatagnnnnnnnnnnnnnn

SEQ ID NO: 276258 - DNA, 365 bp, Homo sapiens
  misc_feature: GYAE6OF01AZ5HE.35.55.E11.1.454.CMB.1.raw
  modified_base (354)..(354): a, c, t, g, unknown or other
  misc_feature (354)..(354): n is a, c, g, or t
  modified_base (360)..(365): a, c, t, g, unknown or other
  misc_feature (360)..(365): n is a, c, g, or t
tcagtacagatcgtcacgaccggtgctcgatttagcactcgcacgttgggtttgggtctttgtctcggccgacaagtccatcaataccgcctacctccagtttgaatacctggaggcctccgacactgccatttattattgtgtgagacgctcatcctctgggtacgactggaggagcgcttttgacatctggggccaagggacaacagtcaccgtctcttccgcctccaccaagggcccatcggtccttccccctggccaccctcctccaagacgcacctctgggggcacagcggcctggctgcctggtcaaggactacttccacgatctgtactgagcgggctggcaaggcncatagnnnnnn

SEQ ID NO: 276259 - DNA, 373 bp, Homo sapiens
  misc_feature: GYAE6OF01BBL3Q.35.55.E11.1.454.CMB.1.raw
  modified_base (361)..(373): a, c, t, g, unknown or other
  misc_feature (361)..(373): n is a, c, g, or t
tcagtacagatcgtcacgaccggtgctcgatttagcactcgcacgttgggtttgggtctttgtctcggccgacaagtccatcaataccgcctacctccagtttgaatacctggaggcctccgacactgccatttattattgtgtgagacgctcatcctctgggtacgactggaggagcgcttttgacatcgtggggccaagggacaacagtcaccgtctcttccgcctccaccgaacggcccatcggtccttccccctggccaccctcctccaagcgcacctcgtggggcacagccggcctgggctgcctggacaaggctactccacgatctgtactgagcggctggcaaggcgacatagnnnnnnnnnnnnn

SEQ ID NO: 276260 - DNA, 424 bp, Homo sapiens
  misc_feature: GYAE6OF01C9C75.35.55.E11.1.454.CMB.1.raw
  modified_base (270)..(270): a, c, t, g, unknown or other
  misc_feature (270)..(270): n is a, c, g, or t
  modified_base (383)..(383): a, c, t, g, unknown or other
  misc_feature (383)..(383): n is a, c, g, or t
  modified_base (387)..(424): a, c, t, g, unknown or other
  misc_feature (387)..(424): n is a, c, g, or t
tcagtacagatcgtcacgaccggtgctcgatttagcactcgcacgttgggtttgggtctttgtctcggccgacaagtccatcaataccgcctacctccagtttgaatacctggaggcctccgacactgccatttattattgtgtgagacgctcatcctctgggtacgactggaggagcgcttttgacatctggggccaaagggacaacagtcaccgtctcttccgcctccaccaaggcccatcgtcctcccctgccacctcctccaagancacctacgtcgggggcaccgagtaccggccccgtgggtctagcccgtggtccaaaagggacctaccttcccacgagtctgtaactgagtcggctggactaaggccgacatagnacgnnnnnnnnnnnnnnnnnnnnnnnnnnnnnnnnnnnnnn

SEQ ID NO: 276261 - DNA, 395 bp, Homo sapiens
  misc_feature: GYAE6OF01BIAAR.35.55.E11.1.454.CMB.1.raw
  modified_base (256)..(256): a, c, t, g, unknown or other
  misc_feature (256)..(256): n is a, c, g, or t
  modified_base (377)..(377): a, c, t, g, unknown or other
  misc_feature (377)..(377): n is a, c, g, or t
  modified_base (383)..(395): a, c, t, g, unknown or other
  misc_feature (383)..(395): n is a, c, g, or t
tcagtacagatcgtcacgaccggtgctcgatttagcactcgcacgttgggttgggtctttgtctcggccgacaagtccatcaataccgcctacctccagtttgaatacctggaggcctccgacactgccatttattattgtgtgagacgctcatcctctgggtacgactggaggagcgtcttttgacatcgtggggccaagggacaacagtcaccgtctcttccgcctccaccgaaggcccatcggtccttccccnggccaccctcctccaagacgccaccgtcgtggggccacgacggccggccgtggcctcgccgtgggtacaaggtacctaccttaccgacgtactctcgtactggagcgggctggacgaggcncagtgnnnnnnnnnnnnn

SEQ ID NO: 276262 - DNA, 402 bp, Homo sapiens
  misc_feature: GYAE6OF01EGW4G.35.55.E11.1.454.CMB.1.raw
  modified_base (383)..(402): a, c, t, g, unknown or other
  misc_feature (383)..(402): n is a, c, g, or t
tcagtacagatcgtcacgaccggtgctcgatttagcactcgcacgttgggtttgggtctttgtctcggccgacaagtccatcaataccgcctacctccagtttgaatacctggaggcctccgacacctgccatttattattgtgtgagacgctcatcctctgggtacgactggaggagcgtcttttgacatcgtggggccaagggacaacagtcaccgtctcttccgcctccaccaacgggccatcggtccttccccctggccaccctcctccaagacgcacctcgtcgggggcacgacgcggcctggctcgccgtggtacaaggaccttacttccgacgtactctcgtacgtgacggccgggctggacaagggcgacatagnnnnnnnnnnnnnnnnnnnn

SEQ ID NO: 276263 - DNA, 440 bp, Homo sapiens
  misc_feature: GYAE6OF01DI2WK.35.55.E11.1.454.CMB.1.raw
  modified_base (373)..(373): a, c, t, g, unknown or other
  misc_feature (373)..(373): n is a, c, g, or t
  modified_base (405)..(406): a, c, t, g, unknown or other
  misc_feature (405)..(406): n is a, c, g, or t
  modified_base (408)..(440): a, c, t, g, unknown or other
  misc_feature (408)..(440): n is a, c, g, or t
tcagtacagatcgtcacgaccggtgctcgatttagcactcgcacgttgggtttgggtctttgtctcggccgacaagtccatcaataccgcctacctccagtttgaatacctggaggcctccgacactgcctatttattatgtgtgagacgctcatcctctgggtacgacgtggaggagcgtcttttgacatcgtggggccaagggacaacagtcaccgtctcttccgcctccaccgaagggcccagtccggtccttcccccgtggccacccctccgtaccaaggtacgcctaccgtcgtcgggggaccaacgaggccggcccgtgggcctggccctgggtcaaaggtacctacttccgaacgtatcgtgtacnggacggacggcgtcggacaacggcgcaatagnngnnnnnnnnnnnnnnnnnnnnnnnnnnnnnnnnn

SEQ ID NO: 276264 - DNA, 388 bp, Homo sapiens
  misc_feature: GYAE6OF01BV3AL.35.55.E11.1.454.CMB.1.raw
  modified_base (336)..(336): a, c, t, g, unknown or other
  misc_feature (336)..(336): n is a, c, g, or t
  modified_base (375)..(388): a, c, t, g, unknown or other
  misc_feature (375)..(388): n is a, c, g, or t
tcagtacagatcgtcacgaccggtgctcgatttagcactcgcacgttgggttgggtctttgtctcggccgacaagtccatcaataccgcctacctccagtttgaatacctggaggcctccgacactgccatttattattgtgtgagacgctcatcctctgggtacgactggaggagcgcttttgacatcgtggggccaagggacaacagtcaccgtctcttccgcctccaccgaacggcccatcggtccttccccctggccaccctcctccaagacgcacctcgtggggcacgacgccggcccgtggcctgcctggtcaaggactaccttccacgntctgtacgtgacggcggcgtcggacaaggcgacagtagnnnnnnnnnnnnnn

SEQ ID NO: 276265 - DNA, 364 bp, Homo sapiens
  misc_feature: GYAE6OF01B7Y3N.35.55.E11.1.454.CMB.1.raw
  modified_base (321)..(321): a, c, t, g, unknown or other
  misc_feature (321)..(321): n is a, c, g, or t
  modified_base (349)..(364): a, c, t, g, unknown or other
  misc_feature (349)..(364): n is a, c, g, or t
tcagtacagatcgtcacgaccggtgctcgatttagcactcgcacgttgggtttgggtctttgtctcggccgacaagtccatcaataccgcctacctccagtttgaatacctggaggcctccgacactgccatttattattgtgtgagacgctcatcctctgggtacgactggaggagcgcttttgacatctggggccaagggacaacagtcaccgtctcttccgcctccaccaaggcccatcggtctcccctgcacctcctccaagagcacctctggggcacagcggcctgggctgcctgcaagctctcacgatctgtacngaggcgggctggacgaaggcgcagtagnnnnnnnnnnnnnnnn

SEQ ID NO: 276266 - DNA, 388 bp, Homo sapiens
  misc_feature: GYAE6OF01ASSK5.35.55.E11.1.454.CMB.1.raw
  modified_base (256)..(256): a, c, t, g, unknown or other
  misc_feature (256)..(256): n is a, c, g, or t
  modified_base (259)..(259): a, c, t, g, unknown or other
  misc_feature (259)..(259): n is a, c, g, or t
  modified_base (265)..(265): a, c, t, g, unknown or other
  misc_feature (265)..(265): n is a, c, g, or t
  modified_base (269)..(269): a, c, t, g, unknown or other
  misc_feature (269)..(269): n is a, c, g, or t
  modified_base (325)..(325): a, c, t, g, unknown or other
  misc_feature (325)..(325): n is a, c, g, or t
  modified_base (341)..(341): a, c, t, g, unknown or other
  misc_feature (341)..(341): n is a, c, g, or t
  modified_base (352)..(352): a, c, t, g, unknown or other
  misc_feature (352)..(352): n is a, c, g, or t
  modified_base (355)..(355): a, c, t, g, unknown or other
  misc_feature (355)..(355): n is a, c, g, or t
  modified_base (358)..(359): a, c, t, g, unknown or other
  misc_feature (358)..(359): n is a, c, g, or t
  modified_base (361)..(362): a, c, t, g, unknown or other
  misc_feature (361)..(362): n is a, c, g, or t
  modified_base (366)..(388): a, c, t, g, unknown or other
  misc_feature (366)..(388): n is a, c, g, or t
tcagtacagatcgtcacgaccggtgctcgatttagcactcgcacgttgggtttgggtctttgtctcggccgacaagtccatcaataccgccctacctccagtttgaatacctggaggcctccgacactgccatttattattgtgtgagacgctcatcctcgtgggtaccgactgggacggagcgctttttgacatcgtggggcccaagggacaacagtcaccgtctcttccgcctccaccaggccatcgtctcccngcncctccncagngcactctggggcacgagccggcctgggctggcctggcaaggcctacttccgaccgntctgtactgagcgggntggtcaaggcncanagnngnnatcnnnnnnnnnnnnnnnnnnnnnnn

SEQ ID NO: 276267 - DNA, 407 bp, Homo sapiens
  misc_feature: GYAE6OF01BWXOI.35.55.E11.1.454.CMB.1.raw
  modified_base (395)..(407): a, c, t, g, unknown or other
  misc_feature (395)..(407): n is a, c, g, or t
tcagtacagatcgtcacgaccggtgctcgatttagcactcgcacgttgggttgggtctttgtctcggccgacaagtccatcaataccgcctacctccagtttgaatacctggaggcctccgacactgccatttattattgtgtgagacgctcatcctctgggtacgacgtggaggagcgtcttttgacatcgtggggaccaagggacaacgtagtcaccgtctcttccgcctccaccgaagggcccagtcggtccttcccccgtggccaccctcctaccaaagcgccacctcgtcgggggcacgaggccggccctgggctcgccctgggtacaacggtacctacttcccgacgatccgtagttacgcgaggcgggctcggacgaaggcgcagagnnnnnnnnnnnnn

SEQ ID NO: 276268 - DNA, 406 bp, Homo sapiens
  misc_feature: GYAE6OF01D9YUC.35.55.E11.1.454.CMB.1.raw
  modified_base (387)..(387): a, c, t, g, unknown or other
  misc_feature (387)..(387): n is a, c, g, or t
  modified_base (389)..(406): a, c, t, g, unknown or other
  misc_feature (389)..(406): n is a, c, g, or t
tcagtacagatcgtcacgaccggtgctcgatttagcactcgcacgttgggtttgggtctttgtctcggccgacaagtccatcaataccgcctacctccagtttgaatacctggaggcctccgacactgccatttattattgtgtgagacgctcatcctctgggtacgactggaggagcgtcttttgacatcgtggggccaaagggacaacagtccaccgtctcttccgcctccaccgaacgggcccatccggtccttccccccgtggccaccctcctccaagcgccacctcgtggggcacagccggccgtggctcgccgtggtacgaaggacctacgttccacgatctacgtactggaggcgggcgtggacgaaggccgacagtagnannnnnnnnnnnnnnnnnn

SEQ ID NO: 276269 - DNA, 309 bp, Homo sapiens
  misc_feature: GYAE6OF01AJM4C.35.55.E11.1.454.CMB.1.raw
  modified_base (286)..(309): a, c, t, g, unknown or other
  misc_feature (286)..(309): n is a, c, g, or t
tcagtacagatcgtcacgaccggtgctcgatttagcactcgcacgttgggtttgggacagacttcactctcaccatcagtcgactggagtctgaggattttgcagtgtattattgtcagcagtatggtaactctcctactaactttcggccaggggaccaagttggagatcaagcgaactggtggcgtgccaccatcgttgtccttcacgttccttccccgcctattcctagaaaccgtactcgtgtacgtgacgggccgggtctgggcgaacggcgtacataggnnnnnnnnnnnnnnnnnnnnnnnn

SEQ ID NO: 276270 - DNA, 498 bp, Homo sapiens
  misc_feature: GYAE6OF01E39F2.35.55.E11.1.454.CMB.1.raw
  modified_base (360)..(360): a, c, t, g, unknown or other
  misc_feature (360)..(360): n is a, c, g, or t
  modified_base (397)..(397): a, c, t, g, unknown or other
  misc_feature (397)..(397): n is a, c, g, or t
  modified_base (399)..(399): a, c, t, g, unknown or other
  misc_feature (399)..(399): n is a, c, g, or t
  modified_base (403)..(403): a, c, t, g, unknown or other
  misc_feature (403)..(403): n is a, c, g, or t
  modified_base (410)..(410): a, c, t, g, unknown or other
  misc_feature (410)..(410): n is a, c, g, or t
  modified_base (415)..(416): a, c, t, g, unknown or other
  misc_feature (415)..(416): n is a, c, g, or t
  modified_base (419)..(419): a, c, t, g, unknown or other
  misc_feature (419)..(419): n is a, c, g, or t
  modified_base (423)..(423): a, c, t, g, unknown or other
  misc_feature (423)..(423): n is a, c, g, or t
  modified_base (429)..(429): a, c, t, g, unknown or other
  misc_feature (429)..(429): n is a, c, g, or t
  modified_base (436)..(440): a, c, t, g, unknown or other
  misc_feature (436)..(440): n is a, c, g, or t
  modified_base (442)..(443): a, c, t, g, unknown or other
  misc_feature (442)..(443): n is a, c, g, or t
  modified_base (446)..(446): a, c, t, g, unknown or other
  misc_feature (446)..(446): n is a, c, g, or t
  modified_base (448)..(451): a, c, t, g, unknown or other
  misc_feature (448)..(451): n is a, c, g, or t
  modified_base (455)..(456): a, c, t, g, unknown or other
  misc_feature (455)..(456): n is a, c, g, or t
  modified_base (459)..(459): a, c, t, g, unknown or other
  misc_feature (459)..(459): n is a, c, g, or t
  modified_base (462)..(463): a, c, t, g, unknown or other
  misc_feature (462)..(463): n is a, c, g, or t
  modified_base (465)..(465): a, c, t, g, unknown or other
  misc_feature (465)..(465): n is a, c, g, or t
  modified_base (469)..(469): a, c, t, g, unknown or other
  misc_feature (469)..(469): n is a, c, g, or t
  modified_base (479)..(479): a, c, t, g, unknown or other
  misc_feature (479)..(479): n is a, c, g, or t
  modified_base (481)..(481): a, c, t, g, unknown or other
  misc_feature (481)..(481): n is a, c, g, or t
  modified_base (483)..(483): a, c, t, g, unknown or other
  misc_feature (483)..(483): n is a, c, g, or t
  modified_base (485)..(485): a, c, t, g, unknown or other
  misc_feature (485)..(485): n is a, c, g, or t
  modified_base (487)..(488): a, c, t, g, unknown or other
  misc_feature (487)..(488): n is a, c, g, or t
  modified_base (490)..(490): a, c, t, g, unknown or other
  misc_feature (490)..(490): n is a, c, g, or t
  modified_base (492)..(492): a, c, t, g, unknown or other
  misc_feature (492)..(492): n is a, c, g, or t
  modified_base (494)..(498): a, c, t, g, unknown or other
  misc_feature (494)..(498): n is a, c, g, or t
tcagtacagatcgtcacgaccggtgctcgatttagcactcgcacgttgggtttgggtctttgtctcggccgacaagtccatcaataccgcctacctccagtttgaatacctggaggcctccgacactgcccatttattattgtgtgagacgctcatcctctgggtacgactggaggagcgcttttgacatctggggcccaagggacaacagtcaccgtctcttccgcctccaccagggcccatcggtcttacccccctggcaccctcctccaagtacgcacctctgggggccacagccggtccccgtggggcctgtcccgtggtacaagggaccttcttcccaacgattcctgtttaacnggacgccgggcttacggcaacgggcttccgaatcgcnangctncgaacgnttccnnctnagcnagctanctgctannnnncnngcncnnnncgcnnctncgnncncgtncgctctcgcncncncncnncncncnnnnn

SEQ ID NO: 276271 - DNA, 454 bp, Homo sapiens
  misc_feature: GYAE6OF01AP5SO.35.55.E11.1.454.CMB.1.raw
  modified_base (82)..(82): a, c, t, g, unknown or other
  misc_feature (82)..(82): n is a, c, g, or t
  modified_base (214)..(214): a, c, t, g, unknown or other
  misc_feature (214)..(214): n is a, c, g, or t
  modified_base (259)..(259): a, c, t, g, unknown or other
  misc_feature (259)..(259): n is a, c, g, or t
  modified_base (263)..(263): a, c, t, g, unknown or other
  misc_feature (263)..(263): n is a, c, g, or t
  modified_base (385)..(385): a, c, t, g, unknown or other
  misc_feature (385)..(385): n is a, c, g, or t
  modified_base (388)..(389): a, c, t, g, unknown or other
  misc_feature (388)..(389): n is a, c, g, or t
  modified_base (392)..(392): a, c, t, g, unknown or other
  misc_feature (392)..(392): n is a, c, g, or t
  modified_base (397)..(397): a, c, t, g, unknown or other
  misc_feature (397)..(397): n is a, c, g, or t
  modified_base (399)..(403): a, c, t, g, unknown or other
  misc_feature (399)..(403): n is a, c, g, or t
  modified_base (405)..(454): a, c, t, g, unknown or other
  misc_feature (405)..(454): n is a, c, g, or t
tcagtacagatcgtcacgaccggtgctcgatttagcactcgcacgttgggtttgggtctttgtctcggccgacaagtccatnaataccgcctacctccagtttgaatacctggaggcctccgacactgccatttattattgtgtgagacgctcatcctcgtgggtacgacgtgggaggagcgtcttttgactatcgtggggccaagggacaacngtcaccgtctcttccgcctccacacggccagtcgtccttccccgngccnccctcctcaagcgctaccgcgtggggcacgaggccgccgtggctcgccgtgtacgaacgtacctacctacacgtactcgtcgtacgtcggacggcggtcgtcggacggtacggccgtcgtanagnngcngctantnnnnngnnnnnnnnnnnnnnnnnnnnnnnnnnnnnnnnnnnnnnnnnnnnnnnnnn

SEQ ID NO: 276272 - DNA, 362 bp, Homo sapiens
  misc_feature: GYAE6OF02F4BOJ.35.55.E11.1.454.CMB.1.raw
  modified_base (357)..(362): a, c, t, g, unknown or other
  misc_feature (357)..(362): n is a, c, g, or t
tcagtacagatcgtcacgaccggtgctcgatttagcactcgcacgttgggttgggtctttgtctcggccgacaagtccatcaataccgcctacctccagtttgaatacctggaggcctccgacactgccatttattattgtgtgagacgctcatcctctgggtacgactggaggagcgcttttgacatctggggccaagggacaacagtcaccgtctcttccgcctccaccaagggcccatcggtcttccccctggcaccctcctccaagagcacctctggggcacagcggccctgggctgcctggtcaaggactacttccacgatctgtactgagcgggctggcaaggcgcatagnnnnnn

SEQ ID NO: 276273 - DNA, 360 bp, Homo sapiens
  misc_feature: GYAE6OF02IU4G5.35.55.E11.1.454.CMB.1.raw
  modified_base (358)..(360): a, c, t, g, unknown or other
  misc_feature (358)..(360): n is a, c, g, or t
tcagtacagatcgtcacgaccggtgctcgatttagcactcgcacgttgggttgggtctttgtctcggccgacaagtccatcaataccgcctacctccagtttgaatacctggaggcctccgacactgccatttattattgtgtgagacgctcatcctctgggtacgactggaggagcgcttttgacatctggggccaagggacaacagtcaccgtctcttccgcctccaccaagggcccatcggtcttccccctggcaccctcctccaagagcacctctgggggcacagcggccctgggctgcctggtcaaggactacttccacgatctgtactgagcgggctggcaaggcgcatagnnn

SEQ ID NO: 276274 - DNA, 389 bp, Homo sapiens
  misc_feature: GYAE6OF02JFIDI.35.55.E11.1.454.CMB.1.raw
  modified_base (280)..(280): a, c, t, g, unknown or other
  misc_feature (280)..(280): n is a, c, g, or t
  modified_base (369)..(389): a, c, t, g, unknown or other
  misc_feature (369)..(389): n is a, c, g, or t
tcagtacagatcgtcacgaccggtgctcgatttagcactcgcacgttggggttggggtctttggtctcggccgacaagtccatcaataccgcctacctccagtttgaatacctggaggcctccgacactgccatttattattgtgtgagacgctcatcctctgggttacgactggaggagtacggcttttgacatctggggccaagggacaacagtcaccgtcgtcttccgcctccaccaaggggcccatcggtcttccccctggcaccctcctccaagngcacctctgggggcacagcggccctgggctgcctggtcaaggactacttccacgatacgtgtactgagcgggctggcaaggcgcatagnnnnnnnnnnnnnnnnnnnnn

SEQ ID NO: 276275 - DNA, 363 bp, Homo sapiens
  misc_feature: GYAE6OF02IX9NU.35.55.E11.1.454.CMB.1.raw
  modified_base (359)..(363): a, c, t, g, unknown or other
  misc_feature (359)..(363): n is a, c, g, or t
tcagtacagatcgtcacgaccggtgctcgatttagcactcgcacgttgggtttgggtctttgtctcggccgacaagtccatcaataccgcctacctccagtttgaatacctggaggcctccgacactgccatttattattgtgtgagacgctcatcctctgggtacgactggaggagcgcttttgacatctggggccaagggacaacagtcaccgtctcttccgcctccaccaagggcccatcggtcttccccctggcaccctcctccaagagcacctctgggggcacagcggccctgggctgcctggtcaaggactacttccacgatctgtactgagcgggctggcaaggcgcatagnnnnn

SEQ ID NO: 276276 - DNA, 367 bp, Homo sapiens
  misc_feature: GYAE6OF02IXTLK.35.55.E11.1.454.CMB.1.raw
  modified_base (359)..(367): a, c, t, g, unknown or other
  misc_feature (359)..(367): n is a, c, g, or t
tcagtacagatcgtcacgaccggtgctcgatttagcactcgcacgttggggttgggtctttgtctcggccgacaagtccatcaataccgcctacctccagtttgaatacctggaggcctccgacactgccatttattattgtgtgagacgctcatcctctgggtacgactggaggagcgcttttgacatctggggccaagggacaacagtcaccgtctcttccgcctccaccaagggcccatcggtcttccccctggcaccctcctccaagagcacctctgggggcacagcggccctgggctgcctggtcaaggactacttccacgatctgtactgagcgggctggcaaggcgcatagnnnnnnnnn

SEQ ID NO: 276277 - DNA, 362 bp, Homo sapiens
  misc_feature: GYAE6OF02F1TG4.35.55.E11.1.454.CMB.1.raw
  modified_base (358)..(362): a, c, t, g, unknown or other
  misc_feature (358)..(362): n is a, c, g, or t
tcagtacagatcgtcacgaccggtgctcgatttagcactcgcacgttgggttgggtctttgtctcggccgacaagtccatcaataccgcctacctccagtttgaatacctggaggcctccgacactgccatttattattgtgtgagacgctcatcctctgggtacgactggaggagcgcttttgacatctggggccaagggacaacagtcaccgtctcttccgcctccaccaagggcccatcggtcttccccctggcaccctcctccaagagcacctctgggggcacagcggccctgggctgcctggtcaaggactacttccacgatctgtactgagcgggctggcaaggcgcatagnnnnn

SEQ ID NO: 276278 - DNA, 363 bp, Homo sapiens
  misc_feature: GYAE6OF02FH1SF.35.55.E11.1.454.CMB.1.raw
  modified_base (357)..(363): a, c, t, g, unknown or other
  misc_feature (357)..(363): n is a, c, g, or t
tcagtacagatcgtcacgaccggtgctcgatttagcactcgcacgttgggtttgggtctttgtctcggccgacaagtccatcaataccgcctacctccagtttgaatacctggaggcctccgacactgccatttattattgtgtgagacgctcatcctctgggtacgactggaggagcgcttttgacatctggggccaagggacaacagtcaccgtctcttccgcctccaccagggcccatcggtcttcccctggcaccctcctccaagagcacctctgggggcacagcggccctgggctgcctggtcaaggactacttccacgatctgtactgagcgggctggcaaggcgcatagnnnnnnn

SEQ ID NO: 276279 - DNA, 362 bp, Homo sapiens
  misc_feature: GYAE6OF02G7B4D.35.55.E11.1.454.CMB.1.raw
  modified_base (357)..(362): a, c, t, g, unknown or other
  misc_feature (357)..(362): n is a, c, g, or t
tcagtacagatcgtcacgaccggtgctcgatttagcactcgcacgttgggtcgggtctttgtctcggccgacaagtccatcaataccgcctacctccagtttgaatacctggaggcctccgacactgccatttattattgtgtgagacgctcatcctctgggtacgactggaggagcgcttttgacatctggggccaagggacaacagtcaccgtctcttccgcctccaccaagggcccatcggtcttccccctggcaccctcctccaagagcacctctggggcacagcggccctgggctgcctggtcaaggactacttccacgatctgtactgagcgggctggcaaggcgcatagnnnnnn

SEQ ID NO: 276280 - DNA, 361 bp, Homo sapiens; identical to SEQ ID NO: 276220
  misc_feature: GYAE6OF02FYVCQ.35.55.E11.1.454.CMB.1.raw
  modified_base (358)..(361): a, c, t, g, unknown or other
  misc_feature (358)..(361): n is a, c, g, or t

SEQ ID NO: 276281 - DNA, 397 bp, Homo sapiens
  misc_feature: GYAE6OF02GQQTE.35.55.E11.1.454.CMB.1.raw
  modified_base (388)..(397): a, c, t, g, unknown or other
  misc_feature (388)..(397): n is a, c, g, or t
tcagtacagatcgtcacgaccggtgctcgatttagcactcgcacgttgggtttgggtctttgtctcggccgacaagtccatcaataccgcctaccctccagtttgaatacctggaggcctccgacactgccatttattattgtgtgagacgctcatcctcgtgggtacgactggaggagcgtcttttgacatcgtggggccaagggacaacagtcaccgtctcttccgcctccaccgaacggcccatcggtccttcccccgtggccacccctcctaccaagacgccacctcgtgggggcacgacggccggccccgtgggctcgccgtggtacgaaggaccttaccttcccacgactctgtactgaggcgggctggcaaggcgcatagnnnnnnnnnn

SEQ ID NO: 276282 - DNA, 363 bp, Homo sapiens; identical to SEQ ID NO: 276240
  misc_feature: GYAE6OF02IWQSM.35.55.E11.1.454.CMB.1.raw
  modified_base (358)..(363): a, c, t, g, unknown or other
  misc_feature (358)..(363): n is a, c, g, or t

SEQ ID NO: 276283 - DNA, 414 bp, Homo sapiens
  misc_feature: GYAE6OF02JHIV3.35.55.E11.1.454.CMB.1.raw
  modified_base (312)..(312): a, c, t, g, unknown or other
  misc_feature (312)..(312): n is a, c, g, or t
  modified_base (400)..(414): a, c, t, g, unknown or other
  misc_feature (400)..(414): n is a, c, g, or t
tcagtacagatcgtcacgaccggtgctcgatttagcactcgcacgttgggttgggtctttgtctcggccgacaagtccatcaataccgcctacctccagtttgaatacctggaggcctccgacactgccatttattattgtgtgagacgctcatcctctgggtacgacgtggaggagcgctttgacatcgtggggccgaagggacgaacagtacaccgtctcttccgtcctccaccgaacggacccgacgtccggtccgttccccgtcggccaccctcctaccaacgacgacacctcgtcggggcgacgacnggccggccccgtcgggcgtcgccgtcggtcgaacggacgtaccttaccacgactctgtactgagcgggcgtggacgaaggcgcatagnnnnnnnnnnnnnnn

SEQ ID NO: 276284 - DNA, 366 bp, Homo sapiens
  misc_feature: GYAE6OF02FVXD4.35.55.E11.1.454.CMB.1.raw
  modified_base (359)..(366): a, c, t, g, unknown or other
  misc_feature (359)..(366): n is a, c, g, or t
tcagtacagatcgtcacgaccggtgctcgatttagcactcgcacgttgggtttgggtctttgtctcggccgacaagtccatcaataccgcctacctccagtttgaatacctggaggcctccgacactgccatttattattgtgtgagacgctcatcctctgggtacgactggaggagcgcttttgacatctggggccaagggacaacagtcaccgtctcttccgcctccaccaagggcccatcggtcttccccctggcaccctcctccaagagcacctctgggggcacagcggtcctgggctgcctggtcaaggactacttccacgatctgtactgagcgggctggcaaggcgcatagnnnnnnnn

SEQ ID NO: 276285 - DNA, 365 bp, Homo sapiens
  misc_feature: GYAE6OF02JI2SV.35.55.E11.1.454.CMB.1.raw
  modified_base (358)..(365): a, c, t, g, unknown or other
  misc_feature (358)..(365): n is a, c, g, or t
tcagtacagatcgtcacgaccggtgctcgatttagcactcgcacgttgggttgggtctttgtctcggccgacaagtccatcaataccgcctacctccagtttgaatacctggaggcctccgacactgccatttattattgtgtgagacgctcatcctctgggtacgactggaggagcgcttttgacatctggggccaagggacaacagtcaccgtctcttccgcctccaccaagggcccatcggtcttccccctggcaccctcctccaagagcacctctgggggcacagcggccctgggctgcctggtcaaggactacttccacgatctgtactgagcgggctggcaaggcgcatagnnnnnnnn

SEQ ID NO: 276286 - DNA, 359 bp, Homo sapiens
  misc_feature: GYAE6OF02GF5AV.35.55.E11.1.454.CMB.1.raw
  modified_base (260)..(260): a, c, t, g, unknown or other
  misc_feature (260)..(260): n is a, c, g, or t
  modified_base (264)..(264): a, c, t, g, unknown or other
  misc_feature (264)..(264): n is a, c, g, or t
  modified_base (350)..(359): a, c, t, g, unknown or other
  misc_feature (350)..(359): n is a, c, g, or t
tcagtacagatcgtcacgaccggtgctcgatttagcactcgcacgttgggtttgggtctttgtctcggccgacaagtccatcaataccgcctacctccagtttgaatacctggaggcctccgacactgccatttattattgtgtgagacgctcatcctctgggtacgactggaggagcgcttttgacatctggggccaagggacaacagtcaccgtctcttccgcctccaccaaggccatcggtctcccctgcacctccncagngcacctctggggcacagcggccctgggctgcctggtcaaggactacttccacgatctgtactgagcgggctggcaaggcgcatagnnnnnnnnnn

SEQ ID NO: 276287 - DNA, 363 bp, Homo sapiens; identical to SEQ ID NO: 276275
  misc_feature: GYAE6OF02IIFXQ.35.55.E11.1.454.CMB.1.raw
  modified_base (359)..(363): a, c, t, g, unknown or other
  misc_feature (359)..(363): n is a, c, g, or t

SEQ ID NO: 276288 - DNA, 361 bp, Homo sapiens
  misc_feature: GYAE6OF02HK9IQ.35.55.E11.1.454.CMB.1.raw
  modified_base (357)..(361): a, c, t, g, unknown or other
  misc_feature (357)..(361): n is a, c, g, or t
tcagtacagatcgtcacgaccggtgctcgatttagcactcgcacgttgggttgggtctttgtctcggccgacaagtccatcaataccgcctacctccagtttgaatacctggaggcctccgacactgccatttattattgtgtgagacgctcatcctctgggtacgactggaggagcgcttttgacatctggggccaagggacaacagtcaccgtctcttccgcctccaccaagggcccatcggtcttccccctggcaccctcctccaagagcacctctgggggcacagcggccctgggctgcctggtcaaggctacttccacgatctgtactgagcgggctggcaaggcgcatagnnnnn

SEQ ID NO: 276289 - DNA, 361 bp, Homo sapiens; identical to SEQ ID NO: 276220
  misc_feature: GYAE6OF02HZTN3.35.55.E11.1.454.CMB.1.raw
  modified_base (358)..(361): a, c, t, g, unknown or other
  misc_feature (358)..(361): n is a, c, g, or t

SEQ ID NO: 276290 - DNA, 365 bp, Homo sapiens
  misc_feature: GYAE6OF02GMM2L.35.55.E11.1.454.CMB.1.raw
  modified_base (358)..(365): a, c, t, g, unknown or other
  misc_feature (358)..(365): n is a, c, g, or t
tcagtacagatcgtcacgaccggtgctcgatttagcactcgcacgttgggttgggtctttgtctcggccgacaagtccatcaataccgcctacctccagtttgaatacctggaggcctccgacactgccatttattattgtgtgagacgctcatcctctgggtacgactggaggagcgcttttgacatctggggccaagggacaacagtcaccgtctcttccgcctccaccaagggcccatcggtcttccccctggcaccctcctccaagagcacctcctgggggcacagcggccctgggctgcctggtcaaggctacttccacgatctgtactgagcgggctggcaaggcgcatagnnnnnnnn

SEQ ID NO: 276291 - DNA, 366 bp, Homo sapiens
  misc_feature: GYAE6OF02IV918.35.55.E11.1.454.CMB.1.raw
  modified_base (356)..(356): a, c, t, g, unknown or other
  misc_feature (356)..(356): n is a, c, g, or t
  modified_base (359)..(366): a, c, t, g, unknown or other
  misc_feature (359)..(366): n is a, c, g, or t
tcagtacagatcgtcacgaccggtgctcgatttagcactcgcacgttgggtttgtgtctttgtctcggccgacaagtccatcaataccgcctacctccagtttgaatacctggaggcctccgacactgccatttattattgtgtgagacgctcatcctctgggtacgactggaggagcgcttttgacatctgggccaagggcaacagtcaccgtctcttccgcctccaccaagggcccatcggtcttccccctggccaccctcctccaagagcacctctggggcacagcgccctgggctgcctggtcaaggctacttccacgactctgtacctgacgcgggctggcaaggcgctanagnnnnnnnn

SEQ ID NO: 276292 - DNA, 388 bp, Homo sapiens
  misc_feature: GYAE6OF02GJ78I.35.55.E11.1.454.CMB.1.raw
  modified_base (278)..(278): a, c, t, g, unknown or other
  misc_feature (278)..(278): n is a, c, g, or t
  modified_base (369)..(371): a, c, t, g, unknown or other
  misc_feature (369)..(371): n is a, c, g, or t
  modified_base (373)..(388): a, c, t, g, unknown or other
  misc_feature (373)..(388): n is a, c, g, or t
tcagtacagatcgtcacgaccggtgctcgatttagcactcgcacggtttggggtttgggtctttgtctcggccgacaagtcccatcaataccgcctacctccagtttgaatacctggaggcctccgacactgccatttattattgtgtgagacgctcatcctctgggtacgactggaggagcgcttttgacatctggggccaagggacaacaggtcaccgtctcttccgcctccaccaagggcccatcggtcttccccctggccaccctcctccaagngcacctctgggggcacagcggccctgggctgccctggtcaaggactacttccacggatctagtactagagcgggctggcaaggcgcatagnnnannnnnnnnnnnnnnnn

SEQ ID NO: 276293 - DNA, 364 bp, Homo sapiens
  misc_feature: GYAE6OF02IWUOA.35.55.E11.1.454.CMB.1.raw
  modified_base (358)..(364): a, c, t, g, unknown or other
  misc_feature (358)..(364): n is a, c, g, or t
tcagtacagatcgtcacgaccggtgctcgatttagcactcgcacgttgggttgggtctttgtctcggccgacaagtccatcaataccgcctacctccagtttgaatacctggaggcctccgacactgccatttatattgtgtgagacgctcatcctctgggtacgactggaggagcgcttttgacatctggggccaagggacaacagtcaccgtctcttccgcctccaccaagggcccatcggtcttccccctggccgccctgctccaggagcacctctgggggcacagcggccctgggctgcctggtcaaggactacttccacgatctgtactgagcgggctggcaaggcgcatagnnnnnnn

SEQ ID NO: 276294 - DNA, 365 bp, Homo sapiens; identical to SEQ ID NO: 276229
  misc_feature: GYAE6OF02IIVTD.35.55.E11.1.454.CMB.1.raw
  modified_base (359)..(365): a, c, t, g, unknown or other
  misc_feature (359)..(365): n is a, c, g, or t

SEQ ID NO: 276295 - DNA, 363 bp, Homo sapiens
  misc_feature: GYAE6OF02JCVU5.35.55.E11.1.454.CMB.1.raw
  modified_base (354)..(363): a, c, t, g, unknown or other
  misc_feature (354)..(363): n is a, c, g, or t
tcagtacagatcgtcacgaccggtgctcgatttagcactcgcacgttgggttgggtctttgtctcggccgacaagtccatcaataccgcctacctccagtttgaatacctggaggcctccgacactgccatttattattgtgtgagacgctcatcctctgggtacgactggaggagcgcttttgacatctggggccaagggacaacagtcaccgtctcttccgcctccaccaagggcccatcggtcttccccctggcaccctcctccaagagcacctctgggggcacagtggcctggctgcctggtcaaggctacttccacgatctgtactgagcggctggcaaggcgcatagnnnnnnnnnn

SEQ ID NO: 276296 - DNA, 361 bp, Homo sapiens
  misc_feature: GYAE6OF02FU053.35.55.E11.1.454.CMB.1.raw
  modified_base (358)..(361): a, c, t, g, unknown or other
  misc_feature (358)..(361): n is a, c, g, or t
tcagtacagatcgtcacgaccggtgctcgatttagcactcgcacgttgggtttgggtctttgtctcggccgacaagtccatcaataccgcctacctccagtttgaatacctggaggcctccgacactgccatttattattgtgtgagacgctcatcctctgggtacgactggaggagcgcttttgacatctggggccaagggacaacagtcaccgtctcttccgcctccaccaagggcccatcggtcttccccctggcaccctcctccaagagcacctctgggggcacagcggccctgggctgcctggtcaaggctacttccacgatctgtactgagcgggctggcaaggcgcatagnnnn

SEQ ID NO: 276297 - DNA, 360 bp, Homo sapiens
  misc_feature: GYAE6OF02IVDCD.35.55.E11.1.454.CMB.1.raw
  modified_base (349)..(349): a, c, t, g, unknown or other
  misc_feature (349)..(349): n is a, c, g, or t
  modified_base (355)..(360): a, c, t, g, unknown or other
  misc_feature (355)..(360): n is a, c, g, or t
tcagtacagatcgtcacgaccggtgctcgatttagcactcgcacgttgggtttgggtctttgtctcggccgacaagtccatcaataccgcctacctccagtttgaatacctggaggcctccgacactgccatttattattgtgtgagacgctcatcctctgggtacgactggaggagcgcttttgacatctggggccaagggacaacagtcaccgtctcttccgcctccaccaagggcccatcggtctccccctggcaccctcctccaagagcacctctgggggcacagcggccctgggctgcctggtcaaggctacttcacgatctgtactgagcggctggcaaggcncatagnnnnnn

SEQ ID NO: 276298 - DNA, 362 bp, Homo sapiens
  misc_feature: GYAE6OF02IF7TK.35.55.E11.1.454.CMB.1.raw
  modified_base (269)..(269): a, c, t, g, unknown or other
  misc_feature (269)..(269): n is a, c, g, or t
  modified_base (355)..(362): a, c, t, g, unknown or other
  misc_feature (355)..(362): n is a, c, g, or t
tcagtacagatcgtcacgaccggtgctcgatttagcactcgcacgttgggttgggtctttgtctcggccgacaagtccatcaataccgcctacctccagtttgaatacctggaggcctccgacactgccatttattattgtgtgagacgctcatcctctgggtacgactggaggagcgcttttgacatctggggccaagggacaacagtcaccgtctcttccgcctccaccaaggcccatcggtcttccccctggcaccctctccaagngcacctctgggggcacagcggcctgggctgcctggtcaaggactacttccacgatctgtactgagcgggctggcaaggcgcatagnnnnnnnn

SEQ ID NO: 276299 - DNA, 363 bp, Homo sapiens
  misc_feature: GYAE6OF02FF28X.35.55.E11.1.454.CMB.1.raw
  modified_base (357)..(363): a, c, t, g, unknown or other
  misc_feature (357)..(363): n is a, c, g, or t
tcagtacagatcgtcacgaccggtgctcgatttagcactcgcacgttgggtcgggtctttgtctcggccgacaagtccatcaataccgcctacctccagtttgaatacctggaggcctccgacactgccatttattattgtgtgagacgctcatcctctgggtacgactggaggagcgcttttgacatctggggccaagggacaacagtcaccgtctcttccgcctccaccaagggcccatcggtcttcccctggcaccctcctccaagagcacctctgggggcacagcggccctgggctgcctggtcaaggactacttccacgatctgtactgagcgggctggcaaggcgcatagnnnnnnn

SEQ ID NO: 276300 - DNA, 356 bp, Homo sapiens
  misc_feature: GYAE6OF02JBQ6A.35.55.E11.1.454.CMB.1.raw
  modified_base (328)..(328): a, c, t, g, unknown or other
  misc_feature (328)..(328): n is a, c, g, or t
  modified_base (348)..(356): a, c, t, g, unknown or other
  misc_feature (348)..(356): n is a, c, g, or t
tcagtacagatcgtcacgaccggtgctcgatttagcactcgcacgttgggttgggtctttgtctcggccgacaagtccatcaataccgcctacctccagtttgaatacctggaggcctccgacactgccatttattattgtgtgagacgctcatcctctgggtacgactggaggagcgcttttgacatctggggccaagggacaacagtcaccgtctcttcgcctcaccaaggccatcgtctcccctgcacctcctcaagagcacctctgggggcacagcggcccctgggctgcctggtcaaggactacttccacgatctgtactgancgggctggcaagcgcatagnnnnnnnnn

SEQ ID NO: 276301 - DNA, 364 bp, Homo sapiens
  misc_feature: GYAE6OF02HB7X6.35.55.E11.1.454.CMB.1.raw
  modified_base (359)..(364): a, c, t, g, unknown or other
  misc_feature (359)..(364): n is a, c, g, or t
tcagtacagatcgtcacgaccggtgctcgatttagcactcgcacgttgggtttgggtctttgtctcggccgacaagtccatcaataccgcctacctccagtttgaatacctggaggcctccgacactgccatttattattgtgtgagacgctcatcctctgggtacgactggaggagcgcttttgacatctggggccaagggacaacagtcaccgtctcttccgcctccaccaaaggcccatcggtcttccccctggcaccctcctccaagagcacctctgggggcacagcggccctgggctgcctggtcaaggactacttccacgatctgtactgagcgggctggcaaggcgcatagnnnnnn

SEQ ID NO: 276302 - DNA, 362 bp, Homo sapiens
  misc_feature: GYAE6OF02GQTY4.35.55.E11.1.454.CMB.1.raw
  modified_base (358)..(362): a, c, t, g, unknown or other
  misc_feature (358)..(362): n is a, c, g, or t
tcagtacagatcgtcacgaccggtgctcgatttagcactcgcacgttgggtttgggtctttgtctcggccgacaagtccatcaataccgcctacctccagtttgaatacctggaggcctccgacactgccatttattattgtgtgagacgctcatcctctgggtacgactggaggagcgcttttgacatctggggccaagggacaacagtcaccgtctcttccgcctccaccaagggcccatcggtcttccccctggcaccctcctccaagagcacctctgggggcacagcggccctgggctgcctggtcaaggctacttccacgatctgtactgagcgggctggcaaggcgcatagnnnnn

SEQ ID NO: 276303 - DNA, 363 bp, Homo sapiens; identical to SEQ ID NO: 276275
  misc_feature: GYAE6OF02GKYDK.35.55.E11.1.454.CMB.1.raw
  modified_base (359)..(363): a, c, t, g, unknown or other
  misc_feature (359)..(363): n is a, c, g, or t

SEQ ID NO: 276304 - DNA, 367 bp, Homo sapiens
  misc_feature: GYAE6OF02JD2SN.35.55.E11.1.454.CMB.1.raw
  modified_base (340)..(340): a, c, t, g, unknown or other
  misc_feature (340)..(340): n is a, c, g, or t
  modified_base (358)..(367): a, c, t, g, unknown or other
  misc_feature (358)..(367): n is a, c, g, or t
tcagtacagatcgtcacgaccggtgctcgatttagcactcgcacgttgggttgggtctttgtctcggccgacaagtccatcaataccgcctacctccagtttgaatacctggaggcctccgacactgccatttattattgtgtgagacgctcatcctctgggtacgactggaggagcgcttttgacatctggggccaagggcaacagtcaccgtctcttccgcctccaccaagggcccatcggtcttccccctggcaccctcctccaagacgcacctctgggggcacagcgccctgggctgcctggtcaaggctacttccacgatctgtactgagcgggntggcaaggcgcataggcnnnnnnnnnn

SEQ ID NO: 276305 - DNA, 368 bp, Homo sapiens
  misc_feature: GYAE6OF02GMP27.35.55.E11.1.454.CMB.1.raw
  modified_base (355)..(355): a, c, t, g, unknown or other
  misc_feature (355)..(355): n is a, c, g, or t
  modified_base (362)..(368): a, c, t, g, unknown or other
  misc_feature (362)..(368): n is a, c, g, or t
tcagtacagatcgtcacgaccggtgctcgatttagcactcgcacgttgggttgggtctttgtctcggccgacaagtccatcaataccgcctacctccagtttgaatacctggaggcctccgacactgccatttattattgtgtgagacgctcatcctctgggtacgactggaggagcgctttgacatcgtggggcaagggacaacagtcaccgtctcttccgcctacccaccaacgggcccagtccggtccttccccctggccacccctcctccaagagcacctctggggcacagcgcctggctgcctggcaaggctacttccacgatctagtactcgagcgggctggcaaggcncgatagnnnnnnn

SEQ ID NO: 276306 - DNA, 368 bp, Homo sapiens
  misc_feature: GYAE6OF02GJ3SA.35.55.E11.1.454.CMB.1.raw
  modified_base (358)..(368): a, c, t, g, unknown or other
  misc_feature (358)..(368): n is a, c, g, or t
tcagtacagatcgtcacgaccggtgctcgatttagcactcgcacgttgggttgggtctttgtctcggccgacaagtccatcaataccgcctacctccagtttgaatacctggaggcctccgacactgccatttattattgtgtgagacgctcatcctctgggtacgactggaggagcgcttttgacatctggggccaagggacaacagtcaccgtctcttccgcctccaccaagggcccatcggtcttccccctggcaccctcctccaagagcacctctgggggcacagcggccctgggctgcctggtcaaggactacttccacgatctgtactgagcgggctggcaaggcgcatagnnnnnnnnnnn

SEQ ID NO: 276307 - DNA, 364 bp, Homo sapiens
  misc_feature: GYAE6OF02FP2LQ.35.55.E11.1.454.CMB.1.raw
  modified_base (357)..(364): a, c, t, g, unknown or other
  misc_feature (357)..(364): n is a, c, g, or t
tcagtacagatcgtcacgaccggtgctcgatttagcactcgcacgttgggtttgggtctttgtctcggccgacaagtccatcaataccgcctacctccagtttgaatacctggaggcctccgacactgccatttattattgtgtgagacgctcatcctctgggtacgactggaggagcgcttttgacatctggggccaagggacaacagtcaccgtctcttccgcctccaccaaggcccatcggtcttccccctggcaccctcctccaagagcacctctgggggcacagcggccctgggctgcctggtcaaggctacttccacgatctgtactgagcgggctggcaaggcgcatagnnnnnnnn

SEQ ID NO: 276308 - DNA, 363 bp, Homo sapiens
  misc_feature: GYAE6OF02GNXIF.35.55.E11.1.454.CMB.1.raw
  modified_base (357)..(363): a, c, t, g, unknown or other
  misc_feature (357)..(363): n is a, c, g, or t
tcagtacagatcgtcacgaccggtgctcgatttagcactcgcacgttgggttgggtctttgtctcggccgacaagtccatcaataccgcctacctccagtttgaatacctggaggcctccgacactgccatttattattgtgtgagacgctcatcctctgggtacgactggaggagcgcttttgacatctggggccaagggacaacagtcaccgtctcttccgcctccaccaagggcccatcggtcttccccctggcaccctcctccaagagcacctctgggggcacagcggccctgggctgcctggtcaaggactacttccacgatctgtactgagcgggctggcaggcgcatagnnnnnnn

SEQ ID NO: 276309 - DNA, 661 bp, Homo sapiens
  misc_feature: GYAE6OF02II0EK.35.55.E11.1.454.CMB.1.raw
  modified_base (271)..(271): a, c, t, g, unknown or other
  misc_feature (271)..(271): n is a, c, g, or t
  modified_base (373)..(373): a, c, t, g, unknown or other
  misc_feature (373)..(373): n is a, c, g, or t
  modified_base (386)..(386): a, c, t, g, unknown or other
  misc_feature (386)..(386): n is a, c, g, or t
  modified_base (398)..(398): a, c, t, g, unknown or other
  misc_feature (398)..(398): n is a, c, g, or t
tcagtacagatcgtcacgaccggtgctcgatttagcactcgcacgttggggtttgggtctttgtctcggccgacaagtccatcaataccgcctacctccagtttgaatacctgaggcctccgacactgccatttacttatgtgtgagtacgctcatcctctgggtacgactggaggagcgctttgacatctgggccaagggcaacagtcacgtctcttccgctccaccagacccatcggtctccccgtgccacctctaccagacgcacctntcggggtacacgagcggccctggactgcctggtcaaacgggcctacgttccacgactctgtacgtgagccggggtcctggaccaaggtccgactaagtaggntacgagtcgatancgtgtcactacngaactcactaacgcgacacttagacgactttagggtccagggttaacccgaacttagggttacctaacggggccgtttaaaacggtcgttaaccgtaacgttacgtaaacgggtaccgtacggtaaacgtcgtaccgttaaccgtagtaccgtacgtaccgggtaacttacggtacccggttacgtaaccgttaaccggtagtaaccggtaccgttaaccgtaccggtaccgttaaacgaccgtaccgtaccgtaccgtaccg

SEQ ID NO: 276310 - DNA, 391 bp, Homo sapiens
  misc_feature: GYAE6OF02GHLH2.35.55.E11.1.454.CMB.1.raw
  modified_base (353)..(353): a, c, t, g, unknown or other
  misc_feature (353)..(353): n is a, c, g, or t
  modified_base (359)..(391): a, c, t, g, unknown or other
  misc_feature (359)..(391): n is a, c, g, or t
tcagtacagatcgtcacgaccggtgctcgatttagcactcgcacgttgggtttgggtctttgtctcggccgacaagtccatcaataccgcctacctccagtttgaatacctggaggcctccgacactgccatttattattgtgtgagacgctcatcctctgggtacgactggaggagcgcttttgacatctggggccaagggacaacagtcaccgtctcttccgcctccaccaagggcccatcggtcttccccctggcaccctcctccaagagcacctctgggggccacagcggcccctgggctgcctggtcaaggctactccacgatctgtactgagcgggctggcaaggcncatagnnnnnnnnnnnnnnnnnnnnnnnnnnnnnnnnn

SEQ ID NO: 276311 - DNA, 431 bp, Homo sapiens
  misc_feature: GYAE6OF02IIDIS.35.55.E11.1.454.CMB.1.raw
  modified_base (381)..(381): a, c, t, g, unknown or other
  misc_feature (381)..(381): n is a, c, g, or t
  modified_base (383)..(431): a, c, t, g, unknown or other
  misc_feature (383)..(431): n is a, c, g, or t
tcagtacagatcgtcacgaccggtgctcgatttagcactcgcacgttgggtttgggtctttgtcgtcggccgacaagtccatcaataccgcctacctccagtttgaatacctggaggcctccgacactgccatttattattatgtgagacgctcatcctctgggtacgactggaggagcgcttttgacatctggggccaaggggacaacagtcaccgtctcttccgcctccaccaaggcccatcggtcttccccctggcaccctcctccaagacgcacctcgtgggggcacgagccggccctgggctcgccgtcggtacgaaggaccttaccttccacgattctagtactggaggcgggtctcggacgaggcgactatagncnnnnnnnnnnnnnnnnnnnnnnnnnnnnnnnnnnnnnnnnnnnnnnnnn

SEQ ID NO: 276312 - DNA, 376 bp, Homo sapiens
  misc_feature: GYAE6OF02JM8YO.35.55.E11.1.454.CMB.1.raw
  modified_base (271)..(271): a, c, t, g, unknown or other
  misc_feature (271)..(271): n is a, c, g, or t
  modified_base (296)..(296): a, c, t, g, unknown or other
  misc_feature (296)..(296): n is a, c, g, or t
  modified_base (344)..(344): a, c, t, g, unknown or other
  misc_feature (344)..(344): n is a, c, g, or t
  modified_base (349)..(349): a, c, t, g, unknown or other
  misc_feature (349)..(349): n is a, c, g, or t
  modified_base (351)..(354): a, c, t, g, unknown or other
  misc_feature (351)..(354): n is a, c, g, or t
  modified_base (356)..(376): a, c, t, g, unknown or other
  misc_feature (356)..(376): n is a, c, g, or t
tcagtacagatcgtcacgaccggtgctcgatttagcactcgcacgttgggtttgggtacagacttcactctcaccatcagtcgactggagtctgaggatttttgcgtagtagttatttagttcgtgtacgacgtagtggttaacggttacttcctacctaactttacgttccgaccgggaacgggtaaccttaggttaggatactaaggacggtacgtaacgttgggcgttgacgaccaactcttcgttcgttcttacacttcccgtcccnctatcgtaacgatctgtacgtacgnggacgggtcggtgtacggaacggtacggtcccattaaagccggtacgntacgntnnnngnnnnnnnnnnnnnnnnnnnnn

SEQ ID NO: 276313 - DNA, 732 bp, Homo sapiens
  misc_feature: GYAE6OF02G1N08.35.55.E11.1.454.CMB.1.raw
tcagtacagatcgtcacgaccggtgctcgatttagcactcgcacgttgggtttgggggtctttgtcgtcggccgacaagtccatcgaataccgcctacctccagtttcgaagtacctggaggcctccgacactgccattatattgtgtgagacgctcagtcctctgggtacgacgtcggtaggagcgtcttttcgacatcgtggggtccaacggggtacaacgagtcaccgtctcttccgcctccaccaacgggcccagtccggtccttacccccgtggccaccccgtcctaccgtaacggacggtaccgtaacccttcggttcggggggtcctaccgtaacggcccggtacccccgttacggggccgttacgggacccgtccggggtaccccaaacgggtaccttaacgttttaccccgaacggtacgttccgttacggttaaccgttcggtaacgggtcccgggggtaccttacgggggtaaccggtaacggggccggtacgtaacgttacggtcgtcgactctagcgtacgcgtacactacgtcccgtcgtcgtacgacgtcgtacgtcgtcgtcgtcgtcgcgtacgtacgagtcgtcgtagtacgtacgtcgtacgtcgtctcgtacgtcgtcgtcgtacgtacgtacgtacgtacgtcgtcgtacgtcgtacggtcggtacgtcgtacgtcgtacgtacgtacgacgtacgacgtacgtacgtccg

SEQ ID NO: 276314 - DNA, 382 bp, Homo sapiens
  misc_feature: GYAE6OF02HW2CL.35.55.E11.1.454.CMB.1.raw
  modified_base (358)..(358): a, c, t, g, unknown or other
  misc_feature (358)..(358): n is a, c, g, or t
  modified_base (364)..(365): a, c, t, g, unknown or other
  misc_feature (364)..(365): n is a, c, g, or t
  modified_base (367)..(382): a, c, t, g, unknown or other
  misc_feature (367)..(382): n is a, c, g, or t
tcagtacagatcgtcacgaccggtgctcgatttagcactcgcacgttgggtttgggtctttgtctcggccgacaagtccatcaataccgcctacctccagtttgaatacctggaggcctccgacactgccatttattattgtgtgagacgctcatcctctgggtacgactggaggagcgcttttgacatctggggccaagggacaacagtcaccgtctcttccgcctccaccaacgggcccatcggtcttccccctggcaccctcctccaagagccacctcgtcgggggcacgagccggccctgggctgcctggtcaaggactaccttccagatctgtactgagcgggctggcaggcncatagnngnnnnnnnnnnnnnnnn

SEQ ID NO: 276315 - DNA, 378 bp, Homo sapiens
  misc_feature: GYAE6OF02GBR9D.35.55.E11.1.454.CMB.1.raw
  modified_base (367)..(378): a, c, t, g, unknown or other
  misc_feature (367)..(378): n is a, c, g, or t
tcagtacagatcgtcacgaccggtgctcgatttagcactcgcacgttgggttgggtctttgtctcggccgacaagtccatcaataccgcctacctccagtttgaatacctggaggcctccgacactgccatttattattgtgtgagacgctcatcctctgggtacgactggaggagcgcttttgacatctggggccaagggacaacagtcaccgtctcttccgcctccaccaagggcccatcggtccttccccctggccaccctcctccaagacgccacctcgtgggggcacgagccggccctgggctgccgtggtcaaggactacttccacgatctgtactgagcgggctggcaaggcgacatagnnnnnnnnnnnn

SEQ ID NO: 276316 - DNA, 358 bp, Homo sapiens
  misc_feature: GYAE6OF02GLAPT.35.55.E11.1.454.CMB.1.raw
  modified_base (357)..(358): a, c, t, g, unknown or other
  misc_feature (357)..(358): n is a, c, g, or t
tcagtacagatcgtcacgaccggtgctcgatttagcactcgcacgttgggtttgggtctttgtctcggccgacaagtccatcaataccgcctacctccagtttgaatacctggaggcctccgacactgccatttattattgtgtgagacgctcatcctctgggtacgactggaggagcgcttttgacatctggggccaaagggacaacagtcaccgtctcttccgcctccaccaaggcccatcggtcttccccctggcaccctcctccaagagcacctctgggggcacagcggccctgggctgcctggtcaaggactacttccacgatctgtactgagcggctggcaagcgcatagnn

SEQ ID NO: 276317 - DNA, 367 bp, Homo sapiens
  misc_feature: GYAE6OF02FHEPP.35.55.E11.1.454.CMB.1.raw
  modified_base (287)..(287): a, c, t, g, unknown or other
  misc_feature (287)..(287): n is a, c, g, or t
  modified_base (357)..(367): a, c, t, g, unknown or other
  misc_feature (357)..(367): n is a, c, g, or t
tcagtacagatcgtcacgaccggtgctcgatttagcactcgcacgttgggttggggtctttgtctcggccgacaagtccatcaataccgcctacctccagtttgaatacctggaggcctccgacactgccattattattgtgtgagacgctcatcctctgggtacgactggaggagcgcttttgacatctggggccaagggacaacagtcaccgtctcttccgcctccaccagggcccatcggtcttcccctggccaccctcctccaagagcacctctgggggcacngcggcccctgggctgccctgtcaggactacttccacgatctgtactgagcgggctggcaaggcgcatagnnnnnnnnnnn

SEQ ID NO: 276318 - DNA, 372 bp, Homo sapiens
  misc_feature: GYAE6OF02ISEGV.35.55.E11.1.454.CMB.1.raw
  modified_base (212)..(212): a, c, t, g, unknown or other
  misc_feature (212)..(212): n is a, c, g, or t
  modified_base (366)..(372): a, c, t, g, unknown or other
  misc_feature (366)..(372): n is a, c, g, or t
tcagtacagatcgtcacgaccggtgctcgatttagcactcgcacgttgggtttgggtctttgtctcggccgacaagtccatcaataccgcctacctccagtttgaatacctggaggcctccgacactgccatttattattgtgtgagacgctcatcctcgtgggtacgactggaggagcgtcttttgacatcgtggggccaagggacccaanagtcaccgtctcttccgcctccaccaaggcccatcggtccttcccctggccaccctcctccaagcgccacctcgtgggggcacacgcggccctgggctgcctggtcaaggactacttccacgatctgtactgagcgggctggcaaggcgcatgnnnnnnn

SEQ ID NO: 276319 - DNA, 437 bp, Homo sapiens
  misc_feature: GYAE6OF02JETZ1.35.55.E11.1.454.CMB.1.raw
  modified_base (269)..(269): a, c, t, g, unknown or other
  misc_feature (269)..(269): n is a, c, g, or t
  modified_base (284)..(284): a, c, t, g, unknown or other
  misc_feature (284)..(284): n is a, c, g, or t
  modified_base (388)..(388): a, c, t, g, unknown or other
  misc_feature (388)..(388): n is a, c, g, or t
  modified_base (390)..(390): a, c, t, g, unknown or other
  misc_feature (390)..(390): n is a, c, g, or t
  modified_base (392)..(396): a, c, t, g, unknown or other
  misc_feature (392)..(396): n is a, c, g, or t
  modified_base (398)..(437): a, c, t, g, unknown or other
  misc_feature (398)..(437): n is a, c, g, or t
tcagtacagatcgtcacgaccggtgctcgatttagcactcgcacgttgggtttggggtctttgtctcggccgacaagtccatcaataccgcctacctccagtttgaatacctggaggcctccgacactgccatttattatgtgtgagacgctcatcctctgggtacgactggaggagcgtcttttgacatcgtggggccaagggacaacagtcctaccgtctcttcccgcctccaccaacgggcccaatccggtccttccccctggccnccctcctccaagacncacctcgtgggggccacgagccggccctgggctcgcctggtcaacggactagtccacgaactctcgtaccgtggacggtcgggctcgggactaaggctcatagnancnnnnncnnnnnnnnnnnnnnnnnnnnnnnnnnnnnnnnnnnnnnnn

SEQ ID NO: 276320 - DNA, 355 bp, Homo sapiens
  misc_feature: GYAE6OF02GB0QF.35.55.E11.1.454.CMB.1.raw
  modified_base (266)..(266): a, c, t, g, unknown or other
  misc_feature (266)..(266): n is a, c, g, or t
  modified_base (289)..(289): a, c, t, g, unknown or other
  misc_feature (289)..(289): n is a, c, g, or t
  modified_base (321)..(321): a, c, t, g, unknown or other
  misc_feature (321)..(321): n is a, c, g, or t
  modified_base (346)..(346): a, c, t, g, unknown or other
  misc_feature (346)..(346): n is a, c, g, or t
  modified_base (349)..(355): a, c, t, g, unknown or other
  misc_feature (349)..(355): n is a, c, g, or t
tcagtacagatcgtcacgaccggtgctcgatttagcactcgcacgttgggtttgggtctttgtctcggccgacaagtccatcaataccgcctacctccagtttgaatacctggaggcctccgacactgccatttattattgtgtgagacgctcatcctctgggtacgactggaggagcgcttttgacatctggggccaaagggcaacagtcaccgtctcttccgcctccaccaaggccatcggtcttcccctgcaccctcctcaanagcacctctggggcacagcgccnggctgcctggtcaaggactacttccacgatcngtactgagcggctggcaaggcgcanagnnnnnnn

SEQ ID NO: 276321 - DNA, 397 bp, Homo sapiens
  misc_feature: GYAE6OF02JAIXU.35.55.E11.1.454.CMB.1.raw
  modified_base (369)..(397): a, c, t, g, unknown or other
  misc_feature (369)..(397): n is a, c, g, or t
tcagtacagatcgtcacgaccggtgctcgatttagcactcgcacgttgggttgggtctttgtctcggccgacaagtccatcaataccgcctacctccagtttgaatacctggaggcctccgacactgccatttattattgtgtgagacgctcatcctctgggtacgactgggaggagcgctttttgacatcgtggggccaagggacaacagtcaccgtctcttccgcctccaccaggcccatcggtctcccctgcaccctcctccagagccacctctgggggcacagtcggccctgggctcgcctggtcaaggctaccttccacgatctcgtactgacggtcgggctggcgaacgggcgccataggacnnnnnnnnnnnnnnnnnnnnnnnnnnnnn

SEQ ID NO: 276322 - DNA, 725 bp, Homo sapiens
  misc_feature: GYAE6OF02HTBT2.35.55.E11.1.454.CMB.1.raw
  modified_base (222)..(222): a, c, t, g, unknown or other
  misc_feature (222)..(222): n is a, c, g, or t
  modified_base (289)..(289): a, c, t, g, unknown or other
  misc_feature (289)..(289): n is a, c, g, or t
  modified_base (562)..(562): a, c, t, g, unknown or other
  misc_feature (562)..(562): n is a, c, g, or t
  modified_base (568)..(568): a, c, t, g, unknown or other
  misc_feature (568)..(568): n is a, c, g, or t
  modified_base (575)..(575): a, c, t, g, unknown or other
  misc_feature (575)..(575): n is a, c, g, or t
  modified_base (577)..(577): a, c, t, g, unknown or other
  misc_feature (577)..(577): n is a, c, g, or t
  modified_base (580)..(580): a, c, t, g, unknown or other
  misc_feature (580)..(580): n is a, c, g, or t
  modified_base (600)..(600): a, c, t, g, unknown or other
  misc_feature (600)..(600): n is a, c, g, or t
  modified_base (616)..(616): a, c, t, g, unknown or other
  misc_feature (616)..(616): n is a, c, g, or t
  modified_base (626)..(626): a, c, t, g, unknown or other
  misc_feature (626)..(626): n is a, c, g, or t
  modified_base (631)..(631): a, c, t, g, unknown or other
  misc_feature (631)..(631): n is a, c, g, or t
  modified_base (633)..(633): a, c, t, g, unknown or other
  misc_feature (633)..(633): n is a, c, g, or t
tcagtacagatcgtcacgaccggtgctcgatttagcactcgcacgttgggttgggtctttaggtctacggccgacaagtccatcaataccgctacctcagtttgaactacctggaggcctccgacacgtcgccattttattattggtaggtggtagaccgtcctcaactccgttcgtaggggtaaccaaccttagggacggacgtccgtctttttcgaaccngttccggtaggggaccgaaacggggaacgaaacctaacggtccgaaccggttccttcccgttacccncccggttacccaaaccgtaacgggccctagttccggtcccttacccccgtggacctaccccttccctaccgaaggtccgtacctacccgtcggtacggggaccaaccggacgtccggtcccgtagggcctaaccgggtccgtacgggtaaccgtaacgggtaaccttaccggttaacccgaaccgggttacttaccgtaggttaccgagggaaccggtccgggccgttagggaccccgaaaggccggaacgttacgacgagcacgacacgttnacgganaccgtananacncgagtagacgcacagacacngcgctcacgtagtacncgtagacacngacancncagacgacgtactacgtactactctacgacagtacgtacgtacggtacgacgtacggacgacgtcgagtacgacgtacgtacgtcgtctacg

SEQ ID NO: 276323 - DNA, 452 bp, Homo sapiens
  misc_feature: GYAE6OF02GHLW4.35.55.E11.1.454.CMB.1.raw
  modified_base (406)..(406): a, c, t, g, unknown or other
  misc_feature (406)..(406): n is a, c, g, or t
  modified_base (410)..(452): a, c, t, g, unknown or other
  misc_feature (410)..(452): n is a, c, g, or t
tcagtacagatcgtcacgaccggtgctcgatttagcactcgcacgttgggttgggtctttgtctcggccgacaagtccatcaataccgcctacctccagtttgaatacctggaggcctccgacactgccatttattattgtgtgagacgctcatcctctgggtacgactggaggagcgtcttttgacatcgtggggccaaggggacaacagtcaccgtctcttccgcctccaccgaacgggcccatccgtccttcccctgccaccctcctcaacgcgcacctcgtcggggcacgacgccggcccgtggcgtcgcctgggtaccaacgggacctacctccctacgactccgtagtaccgtggagggcccgggtacggtgggacctaacgggccgaccgtaagtagcngcgnnnnnnnnnnnnnnnnnnnnnnnnnnnnnnnnnnnnnnnnnnn

SEQ ID NO: 276324 - DNA, 651 bp, Homo sapiens
  misc_feature: GYAE6OF02IQ9JB.35.55.E11.1.454.CMB.1.raw
  modified_base (473)..(473): a, c, t, g, unknown or other
  misc_feature (473)..(473): n is a, c, g, or t
  modified_base (484)..(484): a, c, t, g, unknown or other
  misc_feature (484)..(484): n is a, c, g, or t
  modified_base (490)..(490): a, c, t, g, unknown or other
  misc_feature (490)..(490): n is a, c, g, or t
  modified_base (495)..(495): a, c, t, g, unknown or other
  misc_feature (495)..(495): n is a, c, g, or t
  modified_base (510)..(510): a, c, t, g, unknown or other
  misc_feature (510)..(510): n is a, c, g, or t
  modified_base (514)..(514): a, c, t, g, unknown or other
  misc_feature (514)..(514): n is a, c, g, or t
  modified_base (558)..(558): a, c, t, g, unknown or other
  misc_feature (558)..(558): n is a, c, g, or t
tcagtacagatcgtcacgaccggtgctcgatttagcactcgcacgttgggtttgggtctttgtcgtcggcgacaagtccatcaataccgcctacctccagtttgaatacctggaggcctcgacactgccatttattacttatcgtgagacgctcgatcctcgtgggtacgactggaggagcgtcttttgactactcgtcggggccgaagggtacaacgtaggtccaccggtctccttccgcctccaccgaacgggcccacgttccggttcccttacccccgtcgggccctacccctccctaccaacgtacgtccaccttcgtacgggggccacgtacgccggtcccgtcgggctacgccgtcggtaccgaaacggtacttaccgtacccgtacgtacttcgtacgttacggtcggtaacgggtccgggtcggttacggacggtaaccgggccggtaacggtaactgacgtctntacgctcactncgtacntacgntcgatccatcgctgncgcncgacgacgcgtacgtacgtatctctactcgtatcgtactacgtntacgtcgacgtacgtcgtcgtacgacgtccgccgtacgtcggtcgtactcggtacgtacgtacgtcggcggtaccgtacgacgactaccgtcg

SEQ ID NO: 276325 - DNA, 403 bp, Homo sapiens
  misc_feature: GYAE6OF02HX9L0.35.55.E11.1.454.CMB.1.raw
  modified_base (390)..(403): a, c, t, g, unknown or other
  misc_feature (390)..(403): n is a, c, g, or t
tcagtacagatcgtcacgaccggtgctcgatttagcactcgcacgttgggtttgggtctttgtctcggccgacaagtccatcaataccgcctacctccagtttgaatacctggaggcctccgacactgccatttattattgtgtgagacgctcatcctcgtgggtacgacgtggaggagcgtctttttgacatcgtggggaccaagggacaacagtcaccgtctctccgcctccaaccgacgggcccagtccggtccttcccccctggcctacccctcctaccaagacgccacctccggtgggggccacgacggccggtccccgtgggctcgccgtggacgaaggactacttccgagatctgtactgcggcggcgtggacgagcgcatgnnnnnnnnnnnnnn

SEQ ID NO: 276326 - DNA, 401 bp, Homo sapiens
  misc_feature: GYAE6OF02GDZEO.35.55.E11.1.454.CMB.1.raw
  modified_base (265)..(265): a, c, t, g, unknown or other
  misc_feature (265)..(265): n is a, c, g, or t
  modified_base (328)..(328): a, c, t, g, unknown or other
  misc_feature (328)..(328): n is a, c, g, or t
  modified_base (334)..(334): a, c, t, g, unknown or other
  misc_feature (334)..(334): n is a, c, g, or t
  modified_base (358)..(362): a, c, t, g, unknown or other
  misc_feature (358)..(362): n is a, c, g, or t
  modified_base (364)..(366): a, c, t, g, unknown or other
  misc_feature (364)..(366): n is a, c, g, or t
  modified_base (368)..(401): a, c, t, g, unknown or other
  misc_feature (368)..(401): n is a, c, g, or t
tcagtacagatcgtcacgaccggtgctcgatttagcactcgcacgttgggtttgggtctttgtctcggccgacaagtccatcaataccgcctacctccagtttgaatacctggaggcctccgacactgccatttattattgtgtgagacgctcatcctctgggtacgactggaggagcgcttttgacatcgtggggccaagggacaacagtcaccgtctcttccgctccacaggcccatcgtctcccctgcaccctcctccaagngcacctcgtggggcacgagcggcccgtggctgccgtggtacaaggactacttccacggtatcngtacgnagcgggctggacaaggcgcatagnnnnngnnntnnnnnnnnnnnnnnnnnnnnnnnnnnnnnnnnnn

SEQ ID NO: 276327 - DNA, 181 bp, Homo sapiens
  misc_feature: GYAE6OF01C4L52.34.45.E01.1.454.CMB.1.raw
  modified_base (155)..(181): a, c, t, g, unknown or other
  misc_feature (155)..(181): n is a, c, g, or t
tcagtacacgtgatcacgaccggtgctcgatttagtgagtcagtaagggaaagggaccgaagggtggaaatcaaacgaactgtggctgcaccatctgtcttcatcttcccgccatctgaatcacgtgtactgagcgggctggcaaggcgcatagnnnnnnnnnnnnnnnnnnnnnnnnnnn

SEQ ID NO: 276328 - DNA, 154 bp, Homo sapiens
  misc_feature: GYAE6OF01EUPEW.34.45.E01.1.454.CMB.1.raw
  modified_base (153)..(154): a, c, t, g, unknown or other
  misc_feature (153)..(154): n is a, c, g, or t
tcagtacacgtgatcacgaccggtgctcgatttagtgagtcagtaagggaaagggaccaaggtggaaatcaaacgaactgtggctgcaccatctgtcttcatcttcccgccatctgaatcacgtgtactgagcgggctggcaaggcgcatagnn

SEQ ID NO: 276329 - DNA, 168 bp, Homo sapiens
  misc_feature: GYAE6OF02GEOOL.34.45.E01.1.454.CMB.1.raw
  modified_base (152)..(168): a, c, t, g, unknown or other
  misc_feature (152)..(168): n is a, c, g, or t
tcagtacacgtgatcacgaccggtgctcgatttagtgagtcagtaagggaaagggaccaaggtggaatcaaacgaactgtggctgcaccatctgtcttcatcttcccgccatctgaatcacgtgtactgagcgggctggcaaggcgcatagnnnnnnnnnnnnnnnnn

SEQ ID NO: 276330 - DNA, 617 bp, Homo sapiens
  misc_feature: GYAE6OF01D2DMV.26.49.E05.1.454.CMB.1.raw
tcagagactatactcacgaccggtgctcgatttagagcgactagcaacacacaaagggggcagcacataacaaccacattcctcctctaaagaagcccctgggagcacagctcatcaccatggactggacctggaggttcctctttgtggtggcagcagctacaggtgtccagtcccaggtgcagctggtgcagtctggggctgaggtgaagaaggctgggtcctcggtgaaggtctcctgcaagtcttctggaggcaccttcagcagttatggtatcaacgtgggtgcgacgacggccccgtggacgaagggctagaagtggagtgggaggatcgacgttccgtagttttcggcacgagcgagactacgacacgagtaacgttccgaggcagtacgtctacgacgttaccggacggtaacgaagtacggacgacgacacgacgacgtacgagtaggacgtcgtaggacgaccgacggccgtaggagtactacggtaggaacgggaccgtaccgggtaccggttaggttaacgtttaggttaggttcgggacgggtaacgggaacggggtacggggacggttaggggtaccgttaagggtaaccggtttaaaccggg

SEQ ID NO: 276331 - DNA, 969 bp, Homo sapiens
  misc_feature: GYAE6OF01A2CKB.26.49.E05.1.454.CMB.1.raw
  modified_base (250)..(250): a, c, t, g, unknown or other
  misc_feature (250)..(250): n is a, c, g, or t
tcagagactatactcacgaccggtgctcgatttagagcgactagcaacacacgaaaggggcagcacataacaaccacattcctcctactaaacgaacgccccgtggagcacagctacatcaccagtcggacgtacggaccgttggtacggtttccttcgttttggtgggtggacacgacgtacgtaccgtaacgacggttcggtacccgtacgtcccgaagggttcggagacgtcggttcgggcgacggnggttccgggtggggtcgttaggggaaggttagggaagggaaccggttccgggtagggggttccccgtaacggggttacggtaaccgggttccttaccgtcggtaacgttacgtttccggttcggtacgggaccggttaccgtaccgttacgacgttacttaaggtttagttacggtacgttaccgtaacgggtttcggggtacccgtaccggacccggtacccggtaacccggtaagggtaccggttaaacgggttcgtaaacgggtaacgggttaggggaagggggttacggggtaaacggacctttacccggtaaccgttttttaccgggttacgttttacggggaactaacccggtaaaggttcccgaaaacggttaccttaccggggaaacctaacgggttaaaccgaacggttaaccgggaacgggaaccggtacgttaaccggttaccggttaaccgggtaacgttaacccggggaacccggttaaacgtaccggtaacggaacccgaaccgggaactaccgggaacgtacgtacgggagtacgggtaccgacgggttacgaaccgtaggaaccggttgaacgggtagtaaccggacgggaacggtaccgggtaacgtccggttaccggttaagtttaaccggtttagggtacggacgggttacgggacgggttagggacgcggggttaggacccgggttcgtaggttaccgg

SEQ ID NO: 276332 - DNA, 646 bp, Homo sapiens
  misc_feature: GYAE6OF02IBN3A.26.49.E05.1.454.CMB.1.raw
tcagagactatactcacgaccggtgctcgatttagagcgactagcaacacacaaagggggcagcacataacaaccacattcctcctctaaagaagcccctgggagcacagctcatcaccatggactggacctggaggttcctctttgtggtggcagcagctacaggtgtccagtcccaggtgcagctggtgcagtctggggctgaggtgaagaaggctgggtcctcggtgaaggtctcctgcaagtcttctggaggcaccttcagcagttatggtatctaacgtgggtgcgacacgggcccctggacgaagggtcttagaagtggagtggggaggatcgatcccgttaggtttggcacgagacagactacgacaacgagtaacgttccgagggcaaggacgtacgtcgacgttaccgacggtaacgaacgtcgacgagacacgacgcgttaacagtagggacgtcgtagacggtaccgacggcccgttaggaacgtacgttacggtacgggaacgggtaaccgtaccggggtaccggtttaggttaacgtttttaaggttcgggtacggtaccgggaaggggtaacgggggtacggggtaccgggttacggggggttaccttacgggggaaaccctttaaccgggg

SEQ ID NO: 276333 - DNA, 555 bp, Homo sapiens
  misc_feature: GYAE6OF02HWPLN.26.49.E05.1.454.CMB.1.raw
  modified_base (254)..(254): a, c, t, g, unknown or other
  misc_feature (254)..(254): n is a, c, g, or t
  modified_base (452)..(452): a, c, t, g, unknown or other
  misc_feature (452)..(452): n is a, c, g, or t
tcagagactatactcacgaccggtgctcgatttagagcgactagcaacacacaaagggggcagcacataacaaccacattcctcctctaaagaagcccctgggagcacagctcatcaccatggactggacctggaggttcctctttgtggtggcagcagctacaggtgtccagtcccaggtgcagctggtgcagtctggggctgaggtgaagaggctgggtcctcggtgaaggtctcctgcaagtcttcgtggnggcaccttcagcagttatggtatcaacgtgggtgcgacacggcccgtggacaaggcttagaagtggagtggggaggagtctagttcccgttaaggttttcggcacgagacaagacctacgacaacgagtaacgttaccgagggcagacgtctacgtacttaccggcggaacgtaacgcggacgagacacgagcgtacngtaggacgtgtgagcacgccgtaggagtatcgaggacggtacgacggtccgtaggtaatttagttgtgacgaggagggaggcgtagggcgttacgacgtaacg

SEQ ID NO: 276334 - DNA, 569 bp, Homo sapiens
  misc_feature: GYAE6OF01DAVJT.19.53.E09.1.454.CMB.1.raw
  modified_base (353)..(353): a, c, t, g, unknown or other
  misc_feature (353)..(353): n is a, c, g, or t
tcagtactctcgtgcacgaccggtgctcgatttagagagagtgtgttgggtttgggaggcttggtacagcctggcaggtccctgagactctcctgtgcagcctctggattcacctttgatgattatgccatgcactgggtccggcaagctccagggaagggcctggagtgggtctcaggtattagttggaatagtgctagtatagcctatgcggactctgtgaagggccgattcaccatctccagagacaacgccaagaactccctgtatctgcaaatgaacagtctgagagctgaggacacggccttgtattactgtgcaaggaggtatagcagctactggtaacgactacnggggccagggaaccctggtccaccgtctcctcagcctccaccaacgggcccatccggtccttccccctggccgtccctgcctccgaggacgccacctcccgagacgccacgacgccggcccgtggggcctcggcccgttcgggtaccaaacgggtacccttacccgttccccgaacggaacggtaacgttactggaacggccggggtcgtacgggg

SEQ ID NO: 276335 - DNA, 335 bp, Homo sapiens
  misc_feature: GYAE6OF01CCARA.19.53.E09.1.454.CMB.1.raw
  modified_base (335)..(335): a, c, t, g, unknown or other
  misc_feature (335)..(335): n is a, c, g, or t
tcagtactctcgtgcacgaccggtgctcgatttagagagagtgtgttgggtttgggtgccgaagttgctggagggcacggtcaccacgctgctgagggagtagagtcctgaggacacggccttgtattactgtgcaaggaggtatagcagctactggtacgactactggggccagggaaccctggtcaccgtctcctcagcctccaccaagggcccatcggtcttccccctggcgccctgctccaggagcacctccgagagcacagcggccctgggctgcctggtcaaggactacttcccacgagagtactgagcgggctggcaaggcgcatagn

SEQ ID NO: 276336 - DNA, 522 bp, Homo sapiens
  misc_feature: GYAE6OF01BP5JU.19.53.E09.1.454.CMB.1.raw
  modified_base (403)..(403): a, c, t, g, unknown or other
  misc_feature (403)..(403): n is a, c, g, or t
tcagtactctcgtgcacgaccggtgctcgatttagagagagtgtgttgggtttggggggagaggagccccagccctgagattcccaggtgtttccattcagtgatcagcactgaacacagaggactcaccatggagttgagactgagctggattttcctttggctattttaaaaggtgtccagtgtgaagtgcagctggtggagtctgggggaggcttggtacagcctggcaggtccctgagactctcctgtgcagcctctggattcacctttgatgattatgccatgcactgggtccgcaagctccgagggagggcctgggagtgggtctcgaggttattaggttggaatagtgctagtatagcctatgcggactctgtgaagggccattcacatctcaganacaacgccaagactccctgtactctgacaaatgaactagtctagagagctggaggacacgggcctttgtatttacgtggtacgacgaaaggggtaggtaataggctaaggtcttaacgg

SEQ ID NO: 276337 - DNA, 507 bp, Homo sapiens
  misc_feature: GYAE6OF01D92JW.19.53.E09.1.454.CMB.1.raw
  modified_base (410)..(410): a, c, t, g, unknown or other
  misc_feature (410)..(410): n is a, c, g, or t
  modified_base (484)..(484): a, c, t, g, unknown or other
  misc_feature (484)..(484): n is a, c, g, or t
  modified_base (496)..(496): a, c, t, g, unknown or other
  misc_feature (496)..(496): n is a, c, g, or t
tcagtactctcgtgcacgaccggtgctcgatttagagagagtgtgttggctctgggagaggagccccagccctgagattcccaggtgtttccattcagtgatcagcactgaacacagaggactcaccatggagttgagactgagctggattttccttttggctattttaaaaggtgtccagtgtgaagtgcagctggtggagtcgtgggggagcttggtacagcctggcaggtccctgagactctcctgtgcagcctctggattcacctttgatgattatgccatgcacgtgggtccgcaagctccgagggaaggcctgggagtgggtctcgaggttattttagaggtgggacgacattcgacggagactccagtggagggccgattccaccatctacagagtactttcncagaacactactgtctctacaatgaacagctggacggcgaggacacggcctctattagttgtgtgagtgttagnggacgtagtggngtggtgagtag

SEQ ID NO: 276338 - DNA, 337 bp, Homo sapiens
  misc_feature: GYAE6OF01CXPKO.19.53.E09.1.454.CMB.1.raw
  modified_base (334)..(337): a, c, t, g, unknown or other
  misc_feature (334)..(337): n is a, c, g, or t
tcagtactctcgtgcacgaccggtgctcgatttagagagagtgtgttgggtttgggtgccgaagttgctggagggcacggtcaccacgctgctgagggagtagagtcctgaggacacggccttgtattactgtgcaaggaggtatagcagctactggtacgactactggggccagggaaccctggtcaccgtctcctcagcctccaccaagggcccatcggtcttccccctggcgccctgctccaggagcacctccgagagcacagcggccctgggctgcctggtcaaggactactcccacgagagtactgagcgggctggcaaggcgcatagnnnn

SEQ ID NO: 276339 - DNA, 454 bp, Homo sapiens
  misc_feature: GYAE6OF01DPW6W.19.53.E09.1.454.CMB.1.raw
  modified_base (420)..(420): a, c, t, g, unknown or other
  misc_feature (420)..(420): n is a, c, g, or t
  modified_base (422)..(422): a, c, t, g, unknown or other
  misc_feature (422)..(422): n is a, c, g, or t
  modified_base (424)..(454): a, c, t, g, unknown or other
  misc_feature (424)..(454): n is a, c, g, or t
tcagtactctcgtgcacgaccggtgctcgatttagagagagtgtgttgggtctcaggtattagttggaatagtgctagtatagcctatgcggactctgtgaagggccgattcaccatctccagagacaacgccaaagaactccctgtatctgcaaaatgaacagtctgagagctgaggacacggccttgtattactgtgcaaaggaggtatagcagctactggtacgactacgtggggaccaggggacccctggtccaccgtctcctcagcctccaccaagggcccatcggtcttccccctggccgcccctgctccaggacgcaccctccgagagcacagccggcctgggctcgccgtggtcaaggacctaccttcccaacgacgagtacgtgagccgggctcggcaaggcgacagtagnangnnnnnnnnnnnnnnnnnnnnnnnnnnnnnnn

SEQ ID NO: 276340 - DNA, 340 bp, Homo sapiens
  misc_feature: GYAE6OF01C2I5X.19.53.E09.1.454.CMB.1.raw
  modified_base (336)..(340): a, c, t, g, unknown or other
  misc_feature (336)..(340): n is a, c, g, or t
tcagtactctcgtgcacgaccggtgctcgatttagagagagtgtgttgggtttgggtgccgaagttgctggagggcacggtcaccacgctgctgagggagtagagtcctgaggacacggccttgtattactgtgcaaggaggtatagcagctactggtacgactactggggccagggaaccctggtcaccgtctcctcagcctccaccaagggcccatcggtcttccccctggccgccctgctccaggagcacctccgagagcacagcggccctgggctgcctggtcaaggactacttcccacgagagtactgagcgggctggcaaggcgcatagnnnnn

SEQ ID NO: 276341 - DNA, 903 bp, Homo sapiens
  misc_feature: GYAE6OF01B438Y.19.53.E09.1.454.CMB.1.raw
  modified_base (296)..(296): a, c, t, g, unknown or other
  misc_feature (296)..(296): n is a, c, g, or t
tcagtactctcgtgcacgaccggtgctcgatttagagagagtgtgttgggggtttgggaggcgttgggtacagcctggcagggtccctgacgacctctccgtcgtggcagcctctggtacttccacccttttgactcgattagtgccagtgcgacctgggtccgcacgctccgagggaacggcctggacgtcgggtctcgtagggttacttagttgggaatagtgactagtactagcctatgcgactcgagtacgaacggcgattcacctagtactacagacgaccacgccgaaanaaccctcccgtagtacctacgtacgaaccaaaccgtagaacctacgttacctagtaacgtagtaccttaggaacggtactaaccggtccgtttacgttaacgtttacggttcgtacgtaccgtaagggtacgttactacggacctaacggtacttaacgtcgggtaaccgtaaccgtaaccgggttccggggaccctaaacggggtaacccccttgggtaccctacccggttcccgttacccgtaccgtaaccggtccccttaacccggaaaccccggtaaccggggacccctaacggtttccgggtttaacccctttaccccggtacggtccccgtaccccgtcggtacccgttaccgaacgggtaaccgccccgtaacccggttacccggaagggtacccggacccggtaaccggaaccgggtccccgggtacccgggttacgggggacccgttaccggggtaccccggttaccggggttaacccggtaaaacccgggtacccccgttttaaccccgttaccccgggaaacccggttaaccgggtaaccccggtttaacggtccgggtaaacccggggtccccggggttacggttaaaccccggg

SEQ ID NO: 276342 - DNA, 336 bp, Homo sapiens
  misc_feature: GYAE6OF01DTECM.19.53.E09.1.454.CMB.1.raw
  modified_base (311)..(311): a, c, t, g, unknown or other
  misc_feature (311)..(311): n is a, c, g, or t
  modified_base (335)..(336): a, c, t, g, unknown or other
  misc_feature (335)..(336): n is a, c, g, or t
tcagtactctcgtgcacgaccggtgctcgatttagagagagtgtgttgggtttgggtgccgaagttgctggagggcacggtcaccacgctgctgagggagtagagtcctgaggacacggccttgtattactgtgcaaaggaggtatagcagctactggtacgactactggggccagggaaccctggtcaccgtctcctcagcctccaccaagggcccatcggtcttcccctggtgccctgctccaggagcacctccgagagcacagcggccctgggctgcctggtcaaggactacttcccacgagagtacngagcgggctggcaaggcgcatagnn

SEQ ID NO: 276343 - DNA, 713 bp, Homo sapiens
  misc_feature: GYAE6OF01CCBAD.19.53.E09.1.454.CMB.1.raw
tcagtactctcgtgcacgaccggtgctcgatttagagagagtgtgttggctctgggagaggagccccagccctgagattcccaggtgtttccattcagtgatcagcactgaacacagaggactcaccatggagttgagactgagctggattttcctttggctattttaaaaggtgtccagtgtgaagtgcagctgggtggaggtcgtgggggagcttgggtacagccgtggcacggtccctgacgactctccgtgtcgcacgcctctggattcacctttgatgtattatgccagtcgcacgtcgggtcccggacaacgccgtaccgaaggggggaacgggccgtagggtacggttcggggtaccttcggtaagggttatttagggttaggaattaggtgacgttaagtacgtacgtccgtaagttcggacggtaccttcgttagggaggaacggggcctaattccgaaccctattcccgtaccgaaggtaacgaacccgaaacccgacctaaacgaacccttccccgtaagttactccgttacggaaaccttaaatacggtaaacctggtttacccagggaaaggtaccggtacggtaccgggaacgggaacccggtttaacccgggtacccttttaaggttaacgtttaccggttgggtaaccggtaacgggttaaagggggtaagttaattaccggggacgtaaacccggg

SEQ ID NO: 276344 - DNA, 575 bp, Homo sapiens
  misc_feature: GYAE6OF01CG6M0.19.53.E09.1.454.CMB.1.raw
  modified_base (293)..(293): a, c, t, g, unknown or other
  misc_feature (293)..(293): n is a, c, g, or t
  modified_base (312)..(312): a, c, t, g, unknown or other
  misc_feature (312)..(312): n is a, c, g, or t
tcagtactctcgtgcacgaccggtgctcgatttagagagagtgtgttgggtttggggagctctgggagaggagccccagccctgagattcccaggtgtttccattcagtgatcagcactgaacacagaggactcaccatggagttgagactgagctggattttccttttggctattttaaaaggtgtccagtgtgaagtgcagctggtggagtcgtggggggagcttggtacagcctggcaggtccctggagactctcctgtgcagcctctggacttcacctttgatgattangccatgcacgtgggtccgnaagctccgagggaaggcctgggagtgggtctcgaggtattagtggaatagtgctagtatagctatcgcggtactcgtggtaggaagggccctattccacctatcctaccaaggacgaaccaaccgaccaaacgaacctcccgtagtacttcgtacgtacaaagttcgaaactacggtctaggaaggagtaccgtgggaacggaccgtaccgggtccgtttagtaactttaccgtggtacgacgaaggggtagttaagtaacgg

SEQ ID NO: 276345 - DNA, 396 bp, Homo sapiens
  misc_feature: GYAE6OF01CZF80.19.53.E09.1.454.CMB.1.raw
  modified_base (390)..(390): a, c, t, g, unknown or other
  misc_feature (390)..(390): n is a, c, g, or t
  modified_base (393)..(396): a, c, t, g, unknown or other
  misc_feature (393)..(396): n is a, c, g, or t
tcagtactctcgtgcacgaccggtgctcgatttagagagagtgtgttgggtctcaggtattagttggaatagtgctagtatagcctatgcggactctgtgaagggccgattcaccatctccagagacaacgccaagaactccctgtatctgcaaatgaacagtctgagagctgaggacacggccttgtattactgtgcaaggaggtatagcagctactggtacgactactggggccagggaaccctggtcaccgtctctcagcctccaccaagggcccatcggtcttcccctggcgccctgctccaggagcacctccgagagcacagcgccctgggctgcctggtcaaggctactcccacgagagtactgagcgggctggcaaggcgcanagnnnn

SEQ ID NO: 276346 - DNA, 567 bp, Homo sapiens
  misc_feature: GYAE6OF01BJFMQ.19.53.E09.1.454.CMB.1.raw
  modified_base (258)..(258): a, c, t, g, unknown or other
  misc_feature (258)..(258): n is a, c, g, or t
  modified_base (487)..(487): a, c, t, g, unknown or other
  misc_feature (487)..(487): n is a, c, g, or t
  modified_base (561)..(561): a, c, t, g, unknown or other
  misc_feature (561)..(561): n is a, c, g, or t
tcagtactctcgtgcacgaccggtgctcgatttagagagagtgtgttggctctgggagaggagccccagccctgagattcccaggtgtttccattcagtgatcagcactgaacacagaggactcaccatggagttgagactgagctggattttcctttggcttattttaaaaggtgtccagtgtgaagtgcagctggtggagtcgtgggggagcttggtacagcctggcaggtccctgagactctcctgtgcagcctntggattcacctttgatgattatgccatgcacgtgggtccgcaagcctccgaagggacgggcctgggagtggtctcgaggtattaggttaggaattaggtgacttagtatagctagtcggcggtactcgtaggtaggaacggggcctattacccacctacttccctaccgaagtaacgaaccaaccgacccaaagtaaccctccctagtaactcgtagacaaatgaaacngtacagacgagtcgtaggaacggtacgacggtaccttagttaacttctaggtcgacgaaagggtaggtataggntaacgg

SEQ ID NO: 276347 - DNA, 685 bp, Homo sapiens
  misc_feature: GYAE6OF01BVDUG.19.53.E09.1.454.CMB.1.raw
  modified_base (294)..(294): a, c, t, g, unknown or other
  misc_feature (294)..(294): n is a, c, g, or t
tcagtactctcgtgcacgaccggtgctcgatttagagagagtgtgttggctctgggagaggagccccagccctgagattcccaggtgtttccattcagtgatcagcactgaacacagaggactcaccatggagttgagactgagctggtattttccttttggcttaattttaaaaggtgtccagtgtgaagtgcagctggtggagtcgtgggggagtcgttggtacagccgtggcacggtccctgacgactcctccgtgtcgcagcctgtggtacttcacctttgatgtattancgccatcgcctacgtcgggtcccgacaacggcctaccggaaggggaacgggtccgtagggtacgggttcgggtacctacggtaagggtttaagtttaagggtaggtaaattagggtcgtacgttaagtagtacgtccgttaagtcggtaccggtactcggttaggtacgggtaacgggtcccttaattccccgaaccgtacttacccgtacccgaagaacgtaacccaaaccgaacccgtaaacgtaaccctacccgttagtacctacgtaacgaactaaagtacggaacttacggtacgtaaggaggtacgacgtagggaaaccggtaccgtaccggttcttaggttacttacgtggtacgacggtaagggtagtaactaggtctaacgg

SEQ ID NO: 276348 - DNA, 563 bp, Homo sapiens
  misc_feature: GYAE6OF01DZUEZ.19.53.E09.1.454.CMB.1.raw
tcagtactctcgtgcacgaccggtgctcgatttagagagagtgtgttgggtttgggaggcttggtacagcctggcaggtccctgagactctcctgtgcagcctctggattcacctttgatgattatgccatgcactgggtccggcaagctccagggaaggcctggagtgggtctcaggtattagttggaatagtgctagtatagcctatgcggactctgtgaagggccattcaccatctccagagacaacgccaaagaactccctgtatctgcaaatgaacagtctgagagctgaggacacggcctttgtattactgtgacaaggaggtatagcagctacgtggtaacactacgtcggggccagggaaccctgggtcaccgtctcctcacgcctccaaccaacggcccagtccgtccttcccccgtggcccgccctcgcctccgacggacgccacctccgagacgccacacggcccggcccgtgggcctcgccgtaggtccgaaggtaccttacccgttaccccgaacggacggtacgttacgtaggacggcgggctacgggg

SEQ ID NO: 276349 - DNA, 642 bp, Homo sapiens
  misc_feature: GYAE6OF01DANDQ.19.53.E09.1.454.CMB.1.raw
  modified_base (235)..(235): a, c, t, g, unknown or other
  misc_feature (235)..(235): n is a, c, g, or t
  modified_base (294)..(294): a, c, t, g, unknown or other
  misc_feature (294)..(294): n is a, c, g, or t
tcagtactctcgtgcacgaccggtgctcgatttagagagagtgtgttgggtttggggagctctgggagaggagccccagccctgagattcccaggtgtttccattcagtgatcagcactgaacacagaggactcaccatggagttgagactgagctggtattttccttttggcttatttaaaagtgtccagtgtgaagtgcagctggtggagtcgtggggggaggcttggtaacnggcctggcaggtccctgagactctcctgtgcagcctctggacttcactttgatgattangcctatgcacgtcgggtccgcaagcctacgagggaacgggcctggaggtggtctcgtaaggttattaggttggaaatggtgactagttaatacgccgttatcggacggtactcgttggtagggaacgggtacccggtaatttccgaaacccgtattcccgtaccgtaacggaacgaacccaaaccgggtacccaaaacggtaacccttaacccgttgtaactccgttaggaaccaaaagttacgaaacgtacggttccgaggtaacgaccggtagtacgggaaaccggtacgtaccgggtcctttaggtaacttacgtaggtacgtacggaaagggtgtaagtaacgg

SEQ ID NO: 276350 - DNA, 623 bp, Homo sapiens
  misc_feature: GYAE6OF01BEMVU.19.53.E09.1.454.CMB.1.raw
tcagtactctcgtgcacgaccggtgctcgatttagagagagtgtgttgggtttgggggggagaggagccccagccctgagattcccaggtgtttccattcagtgatcagcactgaacacagaggactcaccatggagttgagactgagctggtattttccttttggctattttaaaaggtgtccagtgtgaagtgcagctggtggagtcgtgggggagcttggtacagcctggcacggtccctgagactctcctgtgcagcctctggattcacctttgatgattatcgccatcgcacgttggggtcccggacaacggcctccggaaggggaacgggccgtgggaggtcgggtctcgaggttattaggtaggaatgtgcttaagtatacgtacctagtggccggtacttcgtggtacggaacgggcctattccaaccgtatccgtaccgaagacgaaccaaccggaccaaacgtaccctcccgtagttactcgtagaacaaacgtcgaaacgtagttcgtagaggtacgtcgtaggaacggaccgtacggtccgtttagttaacttacggtggtacgaacggtaaagggtacggttaacaaggacgtaggtccgttaaaccggg

SEQ ID NO: 276351 - DNA, 666 bp, Homo sapiens
  misc_feature: GYAE6OF01CHKO4.19.53.E09.1.454.CMB.1.raw
  modified_base (584)..(584): a, c, t, g, unknown or other
  misc_feature (584)..(584): n is a, c, g, or t
tcagtactctcgtgcacgaccggtgctcgatttagagagagtgtgttggctctgggagaggagccccagccctgagattcccaggtgtttccattcagtgatcagcactgaacacagaggactcaccatggagttgagactgagctggtattttccgttttggtacttaattttaaaaggtgtccagtgtagaagtgcagcgtgggtggaggtcggtgggggagcgttggtacagccgtggcgacggtcctgagctctccgtgtcgcacgtcctgtggtactttaccgtaccgttttgattaggtaattagtcgcctagtcgccgtacggtcgggtcccggacaacggtccgtacccggaaggggacgggtccgtagggacggtcgggttctacggtaggttaagtttaggtaggtaagtggtatacgttagtagtacgtacgtagtcggcggtacgttcggtaggtacggaacggaccgttattcccgaaccgtactaccgtacgaacgacgaacccaacggaccaaaccgtcctaccgtagttacctacgtaacgtataaaccgtacgtaacgcgtacgtanacggtaacgacggtacggtacggaacgtccggttactttagtacgttcggagttagaccggtaagtacggtatagcgtacgg

SEQ ID NO: 276352 - DNA, 660 bp, Homo sapiens
  misc_feature: GYAE6OF01BA49V.19.53.E09.1.454.CMB.1.raw
tcagtactctcgtgcacgaccggtgctcgatttagagagagtgtgttgggtttgggggggagaggacgccccagccctgagattcccaggtgtttccattcagtgatcagcactgaacacagaggactcaccatggagttgagactgagctggtatttttccttttggcttaatttttaaaaggtgtccagtgtgaagtgcagctggtggagtcgtgggggagcttggtacagcctggcacggtccctgagacctctcctgtcgcacgcctcgtggtacttcctaccgtttgatgtatttatcgacctatcgaccgtacggttcggggtccggacgaacgccgtaccggaagggggaacgggcccgttagggacggttcgggtcctacgtaagggtttaactttagggttaggtaaagttaggtagtacgttaagttagtacgtccttaagtcggacggtacttcgtgggtaggaacgggtcctattccacctatccgtacaagacgaaccgaacgaccgaagtaacccttccgtagtactcgtagaacctaaagtccgaacgtacgtctaggaacgacgcgtaggacgaccgtacggttcctttaggttaacttacgtggtacgacgtaaagggtagttacaggcctaggtcttaacgg

SEQ ID NO: 276353 - DNA, 936 bp, Homo sapiens
  misc_feature: GYAE6OF01D02AH.19.53.E09.1.454.CMB.1.raw
tcagtactctcgtgcacgaccggtgctcgatttagagagagtgtgttgggtttgggggggagaagagccccagccctgagattcccaggtgtttccattcagtgatcagcactgaacacagaggactcaccatggagttgagactgagctggtattttcctttggctaattttaaaaggtgtccagtgtgaagtgcagcgtggtggagtcgtgggggagcttggtacagcctggcaggtccctgacgacctctcctgtgccagccctcgtggacttcctaccgtttgacttgtaattagtcgacctagttcggaccgtacggtttcgggggtacccggacgtaaacgggtccgttacccgggaacgggggtaaacggggtccccgttagggggtacggttcgggggttaccttaccgggtaagggtttaacggttttaagggttagggtaaaagttacgggttacgttacgttaaaggttaacgtaacgtacccgttaaggtcggtaccgggtaaccgttcggttagggtaacgggtaaacggggtccccttaacgtttaccccgaaacccgttacgttaccccgttaaaccggaaacgggtaaaccggaaaccccgtaaaaaccccgggaaccccgttaaaaaccggtaacccccgtttaccccgtttaaacggttaccttttacccgtaacggtaaacccgtaaaaacggttaaccgggaaaccttaaccgggttttaccgaaacgggtaaacggtaccgggtaccggtaaccgggggaaaccggtaccggtaaaccccggggttttacgttttaacgggttaaactttttaccggttaacgggacgggttaaaaccccggtaaaagggggtttaaacgggttacgttaaacccgggtaccggttaaccgggtaacccggttttaaacccgggg

SEQ ID NO: 276354 - DNA, 609 bp, Homo sapiens
  misc_feature: GYAE6OF01EMPI9.19.53.E09.1.454.CMB.1.raw
tcagtactctcgtgcacgaccggtgctcgatttagagagagtgtgttgggtttgggaggcttggtacagcctggcacggtccctgagactctcctgtgcagcctctggattcacctttgatgattatgccatgcactgggtccggcaagctccaggggaagggcctggagtgggtctcaggttattagttggaatagtgctagtatagcctatgcggactctgtgaaggccattcaccatctccagacgacaacgccaaagaacctccctgtatctgacaaatgaacagtctagagagctaggacggacacgggtcctttagtactttacgtgtcgacaaagggagtaatagcagtcctaactcggtaacacgtacgtggggcccaagggaaccctggtaccaccgtctccgtcacgcctaccacgaaccggccctacgtcccggtcccttcccccgtcggacccgtcccgtcgcccgtaccgacggcgacccacccgtacccgagtacgccacgacggaccggccccgtgggcctcgcccgtcggtaccgaacggtacccttaccgtacccgacggacgtacggtacgaggtacggcggtccgtcggg

SEQ ID NO: 276355 - DNA, 685 bp, Homo sapiens
  misc_feature: GYAE6OF01DWVAL.19.53.E09.1.454.CMB.1.raw
  modified_base (317)..(317): a, c, t, g, unknown or other
  misc_feature (317)..(317): n is a, c, g, or t
tcagtactctcgtgcacgaccggtgctcgatttagagagagtgtgttggctctgggagaggagccccagccctgagattcccaggtgtttccattcagtgatcagcactgaacacagaggactcaccatggagttgagactgagctggtatttttcctttggcttaattttaaaaggtgtccagtgtgaagtgcagctggtggagtcgtgggggagcttggtacagcctggcaggtccctgacgactctcctgtgcagcctctggtactttcaccttttgattgtattatgcctatcgcacggtcggggtcccgganaacggcctaccggaaggggaacgggtccgtgggacggttcggggtcctacggtaaggtttagttaggttaggaaattaggtgtacttaagttactacggtccttaagtcggaccgggtacttcgtaggtacggaacggggtccgtaactttacccaaccgtacttcccgtaccgaacggaacgtaaaccgaaacccgacccaaacggtaacccttaccctagtaacttccgttaacgaactaaagtacgtaaacgtagttacgtacggaagacgtacgtacgggaaacggtaccgtaccgggttacctttaaggttactttaccgtaggttacggtaacgtaaagggtaggttaagtacgcgtaacgg

SEQ ID NO: 276356 - DNA, 590 bp, Homo sapiens
  misc_feature: GYAE6OF01EVHKR.19.53.E09.1.454.CMB.1.raw
  modified_base (331)..(331): a, c, t, g, unknown or other
  misc_feature (331)..(331): n is a, c, g, or t
tcagtactctcgtgcacgaccggtgctcgatttagagagagtgtgttgggtttgggaggcttggtacagcctggcaggtccctgagactctcctgtgcagcctctggattcaccttttgatgattatgccatgcactgggtccggcaagctccgaggggaagggcctggagtgggtctcaggtattagttggaatagtgctagtatagcctatgcggactctgtgaagggccattcaccatctccagagacaacgccaaagacctcctgtatctgacaaatgaacagtctgagagctgaggacacggtcttgtattactgtgacgaaaggngtaatagacaggactacgtggtaacgactacgtcggggaccagggaaccctggtaccaccgttctccctcacgtccctaccaccgaacggcccagttccggtcccttccccgtggcccgcccctgccctaccgaggacgccctaccgtccgagacgaccacgacggcccggcccgtggggcctcggcccgttagggtaccaacgggtacccttaccgttccccgaacggactacggtaccgaggcggtcgggctacggg

SEQ ID NO: 276357 - DNA, 649 bp, Homo sapiens
  misc_feature: GYAE6OF01CPMNK.19.53.E09.1.454.CMB.1.raw
  modified_base (520)..(520): a, c, t, g, unknown or other
  misc_feature (520)..(520): n is a, c, g, or t
tcagtactctcgtgcacgaccggtgctcgatttagagagagtgtgttggggtttgggggggagaggagccccagccctgagattcccaggtgtttccattcagtgatcagcactgaacacagaggactcaccatggagttgagactgagctggtatttttcctttggcttaattttaaaaggtgtccagtgtgaagtgcagctggtggagtcgtgggggagcttggtacagcctggcgacggtccctgagacctctcctgtgcacgtccctctggacttctacctttgatgtattatgcctatgacctcgtcgggtccggacaacggcctaccggaaggggaacgggccgtgggaggtgggttctacggtaggttagttaggttaggtaaataggtgtacgttaagtagtaacgcctagtcggcgtactcgtggtacggacgggcctatccactatacctaccgaagtacgaaccgaaaccgaccctaaacggtaacccttcccgttagtactaccgtanaactaaagtacgaacgtagtcaaggagtacgtacgtacggaacggtaacccgcgggttacctttagtaacgttacgtggtaacggtaaggaagggttacggtaactaccgggactcggtacttaacggg

SEQ ID NO: 276358 - DNA, 674 bp, Homo sapiens
  misc_feature: GYAE6OF01CNVDA.19.53.E09.1.454.CMB.1.raw
tcagtactctcgtgcacgaccggtgctcgatttagagagagtgtgttgggtttgggggggagaggagccccagccctgagattcccaggtgtttccattcagtgatcagcactgaacacagaggactcaccatggagttgagactgagctggtattttccttttggctattttaaaaggtgtccagtgtgaagtgcagctggtggagtcgtgggggagcttggtacagcctggcaggtccctgagactctcctgtcgcacgtccctcgtggtaactttccgtaaccctttttggaactttggtaattttaatcggtccccaagttcggccgtaacggttcgggggtccccggacgtaaaccggtccgtacccggaacgggggtaaccggggtcccgttaggggtagggttcggggtcctacggtagggttaactttagggttaggtaaagttaggtgtacgttaagtatagtacctaagtcggcggtactcgtggtaggaacgggccgtacttaccaccgtactcctacagaacgaaccaacgaccaaacgacctcccctagtactcgtacgaacaaagtagaactagtactagagagtcgtaggacgaccgcggtaccgttgttattacgttggtagacgtaagggtacgtaagtagactcgtacgttaccgg

SEQ ID NO: 276359 - DNA, 337 bp, Homo sapiens
  misc_feature: GYAE6OF01B2DJH.19.53.E09.1.454.CMB.1.raw
  modified_base (227)..(227): a, c, t, g, unknown or other
  misc_feature (227)..(227): n is a, c, g, or t
  modified_base (231)..(231): a, c, t, g, unknown or other
  misc_feature (231)..(231): n is a, c, g, or t
  modified_base (243)..(243): a, c, t, g, unknown or other
  misc_feature (243)..(243): n is a, c, g, or t
  modified_base (328)..(337): a, c, t, g, unknown or other
  misc_feature (328)..(337): n is a, c, g, or t
tcagtactctcgtgcacgaccggtgctcgatttagagagagtgtgttgggtttgggtgccgaagttgctggagggcacggtcaccacgctgctgagggagtagagtcctgaggacacggccttgtattactgtgcaaggagtatagcagctactggtacgactactggggccagggaaccctggtcaccgtctcctcagcctccaccaaggcccatcgtcttccccnggcncctgctccagancacctcgagagcacagcggccctgggctgcctggtcaaggactacttcccagagagtactgacgcgggctggcaaggcgcatagnnnnnnnnnn

SEQ ID NO: 276360 - DNA, 736 bp, Homo sapiens
  misc_feature: GYAE6OF01EINCP.19.53.E09.1.454.CMB.1.raw
tcagtactctcgtgcacgaccggtgctcgatttagagagagtgtgttggctctgggagaggagccccagccctgagattcccaggtgtttccattcagtgatcagcactgaacacagaggactcaccatggagttgagactgagctggtatttttccttttggcttaattttaaaaggtgtccagtgtgaagtgcagcgtggtggagtcggtgggggagtcgttggtacagcctggccgacggtccctgacgtacttcctccgtggtcgccgacgtcctcgtggtactttcctaccgttttgacttgtaattacgtcgacctagtcggaccgtaccggttcggggtacccgacgaaacggtccgttaccggaagggggaacgggtccgtaggggtacggttcgggttccttaacggtaaggtttaagtttagggtttaggaaacgttaggtcgtacgttaagttacgtacgtacctagtcggaccggtacttcgtggtacgggaacgggtacctaacgttcccgaacctacgtaccgtaccgaagaaccgaaccgaaaccgtaccgaaacgtaacccttacccgttagtaacgtcgtaacgaacgtaaagtacgtaaactacgtacgtaggaacggacgtcgtacggaacgggtaccgtccgggttacctttaggttaacgttacggtaggtaacggtaacggtaaaggggttagttaagtaccggagtaaccggg

SEQ ID NO: 276361 - DNA, 613 bp, Homo sapiens
  misc_feature: GYAE6OF01DX993.19.53.E09.1.454.CMB.1.raw
  modified_base (264)..(264): a, c, t, g, unknown or other
  misc_feature (264)..(264): n is a, c, g, or t
tcagtactctcgtgcacgaccggtgctcgatttagagagagtgtgttgggtttggggggggagaggagccccagccctgagattcccaggtgtttccattcagtgatcagcactgaacacagaggactcaccatggagttgagactgagctggtattttccttttggctattttaaaaggtgtccagtgtgaagtgcagctggtggagtcgtgggggagcttggtacagcctggcaggtccctgagactctcctgtgcagcctntggattcacctttgactgattatgccatgctacgtggggtccgcaaggctaccgaggggaacggcctagggtagtcgggtctcgaggttattaggttggaatgtgcgtaagtatacgcctagtcggacggtacttcgtaggtaggaacgggtccgtattccacctatccgtaccaaggacgacaaccgaccaaacgaacctccctagtactcgtagaactaaatgaactagtaccgtaggaagcgcgtaggaacggaccgtaccgggtacctttaggttaacttacgttcggtacggaacggtaaacggggtaggtttaacaagggccgtaaggtccgtttaaaccggg

SEQ ID NO: 276362 - DNA, 578 bp, Homo sapiens
  misc_feature: GYAE6OF01CR7RS.19.53.E09.1.454.CMB.1.raw
  modified_base (175)..(175): a, c, t, g, unknown or other
  misc_feature (175)..(175): n is a, c, g, or t
  modified_base (288)..(288): a, c, t, g, unknown or other
  misc_feature (288)..(288): n is a, c, g, or t
  modified_base (328)..(328): a, c, t, g, unknown or other
  misc_feature (328)..(328): n is a, c, g, or t
tcagtactctcgtgcacgaccggtgctcgatttagagagagtgtgttgggtttgggaggcttggtacagcctggcaggtccctgagactctcctgtgcagcctctggattcaccttttgatgattatgccatgcactgggtccgcaagctccgagggaaggcctggagtggtctnaggtattagttggaatagtgctagtatagcctatgcggactctgtagaagggccattcaccatctcagagacaacgcaagaactcctgtatctgacaaatgaacagtctgagngctgaggacacggcttagtattactgtgacaaggagttanagcagctacgtggtaacgactacggtcggggaccaacgggtaaccctgggtacacccgtctcctcgacgccctaccaaccgaacggccctagtccggtccctccccgtgcccgtccctgcctcgaggcaccacccgtcgaagcgaccacgacggccggcccgtggcctcgccgtagggtaccaaagggtacccttaacccggttcccgaacggacgtacgttaacgtgggaacggcgggtccgtaacggg

SEQ ID NO: 276363 - DNA, 619 bp, Homo sapiens
  misc_feature: GYAE6OF01EF0MV.19.53.E09.1.454.CMB.1.raw
tcagtactctcgtgcacgaccggtgctcgatttagagagagtgtgttgggtttggggagctctgggagaggagccccagccctgagattcccaggtgtttccattcagtgatcagcactgaacacagaggactcaccatggagttttggctgacctgggttttccttgctgcaatttcaggaggtgtccagtgtgaggtgcaactgggtggagacgtgggcggaggcttggtccaggccgtgggcggtctcgtgagactgtcctgtcgaaccctcgtggggtctccgtcagcagcgactgtattgccgtcgggtccgccaggctcgagggagaggccggagtgggtcgcgtaggttattttagtagggtggacgacgtattcgtacgggacgacgtcagtgggagggtccgtattcaccagtcctaccgagtacgtacttttcacgaacgaactacgtacttcgtaccttctttacaaagtcgaaaccgtacgtaccgtagggtacggggaccgacgggaccgaccgggcccgttactaagtttagttggttacggtgtaaggttaggtttagacgggtcggtaagttcgggacgttagggtacggacgtaggtaaccg

SEQ ID NO: 276364 - DNA, 762 bp, Homo sapiens
  misc_feature: GYAE6OF01CV300.19.53.E09.1.454.CMB.1.raw
  modified_base (266)..(266): a, c, t, g, unknown or other
  misc_feature (266)..(266): n is a, c, g, or t
tcagtactctcgtgcacgaccggtgctcgatttagagagagtgtgttgggtttggggggggagaggagccccagccctgagattcccaggtgtttccattcagtgatcagcactgaacacagaggactcaccatggagttgagactgagctggtattttccttttggcttaattttaaaaggtgtccagtgtgaagtgcagctggtggagtcgtgggggagcttggtacagcctggcaggtccctgacgctctcctgtgcagcctntggattcacctttgatgattatgccatgacctagtcgggtccgcaacgtccgtacgaaggggacggtccgtagggaggtcgggtcctagtaggttagtttaggttagggtaaacgttaggtagtcgttaaaggttacttaacgcctttaaagtcggacggttaccgttcgtcgggtaacggggaacgggtcccggtaatttcccgaaccctagttacccgtacccgaaaggtaccggaaccgaaacccggtaccgtaaaaccgtaaacccttaccccgttagttaaccttaccgttaacggaaacctaaaagttaccggtaaaactacggttacggttaacggaaggtaccggaacggttacggaaccgggtacccgggtaaccggtttacccgttaacggttaacgttttaacggtacggtttacgggaaacggttaaagggggtaacggttaaacggttaacggaccgtaaagggttacccgtttaaaccgggg

SEQ ID NO: 276365 - DNA, 743 bp, Homo sapiens
  misc_feature: GYAE6OF01ENL2O.19.53.E09.1.454.CMB.1.raw
  modified_base (699)..(699): a, c, t, g, unknown or other
  misc_feature (699)..(699): n is a, c, g, or t
tcagtactctcgtgcacgaccggtgctcgatttagagagagtgtgttgggtttggggggagaggagccccagccctgagattcccaggtgtttccattcagtgatcagcactgaacacagaggactcaccatggagttgagactgagctggtatttttcctttggacttaattttaaaaggtgtccagtgtgaagtgcagcgtgggtggaggtcggtgggggagtcgttggtacaggcccgtgggctacgggttcccctaggacgtaccttccgtccgtgtcgccacgtcccttcgtggtactttcctaccttttgattgtaactttatcgacctagttcgaccgtacggttcggggtacccggacgtaacggtcccgtaccgggaagggggtaaccgggtccgttaggggtacggttcggggtacctacggtaagggtttaagtttagggttaggaagttaggtgtacttaaggtatacggtaccttagtcggtacggtacttggtagggttacggaaccgggtaccctagtttacccgaaccgttaactccgtaaccgaaggtaaacgacccgaaaccgaccgaaacgtaacccttcccgtaagtactcgtaacgaaacgtaaagtcgaaacgtagttacgaggtacgaggtcctagggaaccgacccgtacggttaccgtttagtaactttacggngtaagaacgtaaagggtacgaattacgcgtaagtccgttaacgg

SEQ ID NO: 276366 - DNA, 712 bp, Homo sapiens
  misc_feature: GYAE6OF01DB6EW.19.53.E09.1.454.CMB.1.raw
  modified_base (180)..(180): a, c, t, g, unknown or other
  misc_feature (180)..(180): n is a, c, g, or t
  modified_base (298)..(298): a, c, t, g, unknown or other
  misc_feature (298)..(298): n is a, c, g, or t
tcagtactctcgtgcacgaccggtgctcgatttagagagagtgtgttgggtttggggggagaggagccccagccctgagattcccaggtgtttccattcagtgatcagcactgaacacagaggactcaccatggagttgagactgagctggtattttccttttggctaattttaaaaggngtccagtgtgaagtgcagcgtggtggagtcgtggggggagtcgttggtacagtccctgggccacggtccctgacgtactctcctgtgcagcctcgtgatttccacctttgatgattancgccagtgacctacgtggggtaccgacgaaacgccgtaccggaaggggaacgggtccttaggggagttcggggtctacggtaaggtttatttaagggtacggtaaattaggttgaccgtttaaggtacttacgggtccttaagtcggtacgtaactcgttgggaacggtacgggcccgtaattaccgaacctaagttcctaacgaaacgtaccggaaacctaaacccggacccaaaacgtacccgttcccgttagtaaccttcgtacgtaaaccaaaagttaccggaaactcggtacttacggaagtacggaccgttaggaaccgggactaccggggttccctttaggttaactttacggtagacggtaacgtaaaagggtacggtaaactaggacaaccggttgtaaaccggg

SEQ ID NO: 276367 - DNA, 787 bp, Homo sapiens
  misc_feature: GYAE6OF01CP55N.19.53.E09.1.454.CMB.1.raw
  modified_base (118)..(118): a, c, t, g, unknown or other
  misc_feature (118)..(118): n is a, c, g, or t
  modified_base (377)..(377): a, c, t, g, unknown or other
  misc_feature (377)..(377): n is a, c, g, or t
tcagtactctcgtgcacgaccggtgctcgatttagagagagtgtgttgggtttgggaggcttggtacagcctggcaggtccctgagactctcctgtgaaccctcgtggggtctccgtnagcagcgactgtattgccgtgggtccgccaggcctccgagggaagaggccggaggtgggtcgcgtaggttatttttagaggtggacgacattcgacggagactccagtggacgggccgtattcaacctatcctaccagtacgtactttttcacaacgaacactactgtccttacttacaaattgaaacagcccgtaggacggggaccaggtaaccaccggtcccgtacttatttagttggtagtgaagttagttttagngggacgtagtcggcgtagggtaggtacgagtaccttcggacgggtacgggggaccaaccggggtaaccctcgggtaacccgtcccgttaccgtccgtaccgacccgtaccccgtacccgaaccgggacccggtacccgtacggttcccccggttccccttcccccggttcgggccccgtcccgtccggtcccgtacccgtaccgggacctcccgacccggttaccggaacgtaccggaccaacccggaccggtcccggggtaccccggtgggtccccgtacggccccgggttacggtaaccggaaccggtacccgttaacccggtacccccgtaaggtaacggtaaccgttaccgggaggtaccgggcccgggtcggtaccggaacgggacggtacccgagaaggtggac

SEQ ID NO: 276368 - DNA, 677 bp, Homo sapiens
  misc_feature: GYAE6OF01CZ1XU.19.53.E09.1.454.CMB.1.raw
tcagtactctcgtgcacgaccggtgctcgatttagagagagtgtgttggctctgggagaggagccccagccctgagattcccaggtgtttccattcagtgatcagcactgaacacagaggactcaccatggagttgagactgagctggtattttcctttggcttattttaaaaggtgtccagtgtgaagtgcagctggtggagtcgtgggggagcttggtacagcctggcaggtccctgagactctcctgtcgcagcctctggtattcacctttgatgatttatgcctatgcctacgtcgggtacccggcaaggcctaccgaaggggaacgggccgtgggtacggtgggtcctgtaaggttatttaggttaggaattagtgctaagtatacgacctagtgaccggtactcgtaggtacggaacgggccgtaagtttccccaaccgtacgttaccctacccgaagtaacgaaacccgaaacccggaacccgtaaacggtaaccccttccccgttagttaactccgttagaaccctaaaagtcgaaaccgtaacgttcgtaggtaacggtaacgtcggtaggaacggtacccgtaacccggtcgttttaggttaaactttaccggttggtaacggtaacccggtaaaggggttaggttaaacgtggtacgtaaaccggg

SEQ ID NO: 276369 - DNA, 832 bp, Homo sapiens
  misc_feature: GYAE6OF01EA69U.19.53.E09.1.454.CMB.1.raw
tcagtactctcgtgcacgaccggtgctcgatttagagagagtgtgttgggtttgggaggcttggtacagcctggcaggtccctgagactctcctgtgcagcctctggattccaccttttgatgattatgccatgcacgtgggtccggcaagctccgagggaagggccgtggagtggtctcgaggtattaggttggaatagtgctagtatagcctatggcggactcgtggtagaacgggcctattccacctactcctccgaaggacgaaccaaccgaccaaaacgtaacccttcccgtagttactcgtagaactaaagtacggaactacgtcgtaggaacggaacggcgtagggaacggaccgtaccggttcctttagtaactttacgtgtcgaacgaagggtagtactaggacgagtacctacggtacggtaaccgtaacgtcggggtacggggcccggaacgggtaaccccgttcgggtaccctaccccgtacctaccccgttacgaccccgttaccccaaccccggtaaacccgggaacccgggtaccccttaccggtttcccccggtttccccccgttccccccggtgggtccccccgtccccgttccggacccgttaccgggaaccgggcgtacccccgtaccggtaacccgggacgaccggtacctaaccgggcccgggccccgggtcccggtcgggtcccgtcccgggttacccggttacgggtaacccgaaccggtttaaccccttcccggttaaacccccgaaggggttaaccggtaaccgtttacggacggggtacccgggtccggggtacgaaccccggggg

SEQ ID NO: 276370 - DNA, 657 bp, Homo sapiens
  misc_feature: GYAE6OF01B18U3.19.53.E09.1.454.CMB.1.raw
tcagtactctcgtgcacgaccggtgctcgatttagagagagtgtgttggggtttggggggagaggagccccagccctgagattcccaggtgtttccattcagtgatcagcactgaacacagaggactcaccatggagttgagactgagctggtattttccttttggctattttaaaaggtgtccagtgtgaagtgcagctggtggagtcgtgggggagcttggtacagcctggcacgggtccctggacgactctcctgtgcagcctgtggtacttccacctttgatgatttatcgcctaagtcgccgtacgttcggggtcccggacgaacgccgtaccggagggggaacgggccgttagggaggttcgggtctacggtaagggtttagtttaaggttagggaaagttaggtcgtacgttaaggtaacgtacgtccgtaagtcggaccggtacttcgtgggtacggaacgggtcctaagttccgaacctactccgtacaaggaacaaccgaacgcccaaacgtaccttcccgtagttactctagactaaatcgaactgtactaggagacgtcgtaaggacggtaccgtacggttccgttagttacgttacgtggtacgaacggtaagggtaggttacacggtctaacgtccgtaacgg

SEQ ID NO: 276371 - DNA, 745 bp, Homo sapiens
  misc_feature: GYAE6OF01ANMGA.19.53.E09.1.454.CMB.1.raw
tcagtactctcgtgcacgaccggtgctcgatttagagagagtgtgttggctctgggagaggagccccagccctgagattcccaggtgtttccattcagtgatcagcactgaacacagaggactcaccatggagttgagactgagctggtattttccttttggcttattttaaaaggtgtccagtgtgaagtgcagctggtggagtcgtgggggagcttggtacagcctggcaggtccctgagactctcctgtgcagcctgtgattcacctttgatgtattatcgcctatcgcgtacgtcggggtaccggcaagtccgtaccggaaggggaacgggtccgtgggacggttcggggtcctacgtaaggggtttaactttaggttacggaaatttaggtggtaccgttaaggttaacttacggtacccttagttcgggtaccggtaaccttcggttaggtagggaaaccgggggtccctaactttacccgaacccgttacgttccccgttacccgaaacgggaaccggtaaacccgaaaaccccggacccgtaaaaccggtaaaccccttccccgttaaggttaacttcccgtaacggaacctaaaagttccggaaaactacggttacggtaggaaccggagtcggtaacgggaaccggtaacccgtaccgggttcccgttttaggtaaccgtttacggttaggtaccggaacggtaaacgggtaagggttactagggaccgtaacgg

SEQ ID NO: 276372 - DNA, 343 bp, Homo sapiens
  misc_feature: GYAE6OF01ANRRL.19.53.E09.1.454.CMB.1.raw
  modified_base (336)..(343): a, c, t, g, unknown or other
  misc_feature (336)..(343): n is a, c, g, or t
tcagtactctcgtgcacgaccggtgctcgatttagagagagtgtgttgggtttgggtgccgaagttgctggagggcacggtcaccacgctgctgagggagtagagtcctgaggacacggccttgtattactgtgcaaggaggtatagcagctactggtacgactactggggccagggaaccctggtcaccgtctcctcagcctccaccaagggcccatcggtcttccccctggccgccctgctccaggagcacctccgagagcacagcggccctgggctgcctggtcaaggactacttcccacgagagtactgagcgggctggcaaggcgcatagnnnnnnnn

SEQ ID NO: 276373 - DNA, 712 bp, Homo sapiens
  misc_feature: GYAE6OF01E1LS6.19.53.E09.1.454.CMB.1.raw
tcagtactctcgtgcacgaccggtgctcgatttagagagagtgtgttggctctgggagaggagccccagccctgagattcccaggtgtttccattcagtgatcagcactgaacacagaggactcaccatggagttgagactgagctggtattttcctttggctaattttaaaaggtgtccagtgtgaagtgcagctggtggagtcgtgggggagtcgttggtacagcctggcacggtcctgacgactctcctgtgcagcctcgtggtacttcctactttgatgtattatcgcctagtcgccgtacggttcggggtcccggacgaaacggtccgttacccgggaagggggaacgggtcccggttaggggacgggtttcgggtccgttacggtaagggtttaagtttagggttagggtaacttaggttgtacgttaagtacgtacggtcctagtcgggaccgtacgttcgtagggttacgggaacgggtcccgtaattacccgaaccctacttacccgtaccgaaggtaacgaaacccgaacccgtaaccgaaaccgtacccttcccgttaagtacttaccgtagaaaccgtaaagttacgaaacctggttacgtaaggacgtaggtacctacggggaaacgtccggtaccggttcctttaaggttacgttcgtaggttacgtacggtaaaggttaggtacgtagcgtaaacgg

SEQ ID NO: 276374 - DNA, 808 bp, Homo sapiens
  misc_feature: GYAE6OF01APIXW.19.53.E09.1.454.CMB.1.raw
  modified_base (344)..(344): a, c, t, g, unknown or other
  misc_feature (344)..(344): n is a, c, g, or t
  modified_base (787)..(787): a, c, t, g, unknown or other
  misc_feature (787)..(787): n is a, c, g, or t
tcagtactctcgtgcacgaccggtgctcgatttagagagagtgtgttgggtttgggagaggagccccagccctgagattcccaggtgtttccattcagtgatcagcactgaacacagaggactcaccatggagttgagactgagcgtgtatttcctttggctatttaaaggtgtccagtgtgaagtgcagctggtggagtcgtgggggagcttggtacagcctggcaggtccctggacgtcctcgtccgtggtcgcctaggcccttgtggtactttcctaaccgtttttggattcggtaattttacgtcggaccctagttcggacctacggttcggggacccgngaacggtccgtacccggaaggggggaaccggtccggttaggggtacgggttcggggttacctacggtaagggtttaagttttagggtaacgggtaaattcggtacgtaccgttaaggttaacgttacggtacccttaggtcggaccgggttaacttcgggttagggaacggggtaaaccggggtacccttaacgtttccccaaacccgttacgtttaccccgtaaccggaaacgggaaccgaaacccgaaacccggttaacccgaaaaccggtttaaaccccgttccccgtttaggttaaaccttccggttaacgaaaccttaaaaggttcgaaaacgttaccggttcctaagggacggtacgtcggtaagggaaccggtccgtaaccggttctttaagggttaccttaggttacggaggtaacgaaaggggttcaaggttancggtacgtaccgttaacgggg

SEQ ID NO: 276375 - DNA, 765 bp, Homo sapiens
  misc_feature: GYAE6OF01CEL8P.19.53.E09.1.454.CMB.1.raw
  modified_base (321)..(321): a, c, t, g, unknown or other
  misc_feature (321)..(321): n is a, c, g, or t
tcagtactctcgtgcacgaccggtgctcgatttagagagagtgtgttggggtttgggggggagaggagccccagccctgagattcccaggtgtttccattcagtgatcagcactgaacacagaggactcaccagtggagttgagactgagctggtatttttccttttggcttaattttaaaaggtgtcctagtgtgaagtgcagcgtgggtggagtcggtggggggagtcgttggtacagccgtggcacggtccctggacgtaccttctccgtggtcgcacgtcctgtggtactttcctaacctttgaattgaacttttancggtaccattcggacctacggttccggggtcccgacgaacggtccgtacccggaagggggtaacgggtccgtaggggtaaggttcggggttacctacggtaagggtttagttttaagggttagggaaagtttaggttaggtacgtttaaagtaagttaacggcctttaagtcgggtaccgttacgttcggttagggtaacggaacggggtccttaacgttaccaactactcccgtaacgagaacgaacccgaacgtaccaaacgtacccgtccttagtaaccttcgagtaactaaacgttacgaaacgttaggtactacgggaaagtacggtactaacgggaacggtacccggttaacggttccgtttaaggttacgttaacgtcgggtaacgaacggtaaagggtacgtaaagtaggtacccgtaacggttcgttaaccgggg

SEQ ID NO: 276376 - DNA, 711 bp, Homo sapiens
  misc_feature: GYAE6OF01A5BPX.19.53.E09.1.454.CMB.1.raw
  modified_base (304)..(304): a, c, t, g, unknown or other
  misc_feature (304)..(304): n is a, c, g, or t
tcagtactctcgtgcacgaccggtgctcgatttagagagagtgtgttgggtttgggggggagaggagccccagccctgagattcccaggtgtttccattcagtgatcagcactgaacacagaggactcaccatggagttgagactgagcttggtatttttccgtttggcttaattttaaaaggtgtccagtgtgaagtgcagcgtgggtggaggtccgggggaggtcgttaggtacagccgtggcacggtcctgacgctctctgtcgcacgtcctcgtgtacttcctactttgattagtattancgacctagtcgactacggtcgggtaccgacgtaacggtccgtaccgggaaggggtaacgggtccgtaggggtacggttcgggttacctacggtaagggtttaagtttaggtaggtaaattggtgtacgttaagtagtacgtacctagcggtacggtacttcggtaggtacggaaccgggtctacgttaccaacgtactaccgtaacgaacgtaacgaaccgaaccgactaaaccgaccttccgttataactcgaacgtaactaaagtaccgtaacgtacgttacgagtaacggtcgtacgtacgggaacgtaccggttacgtttaccgttaggttaacttaggtagggtacgaaacggtaagggtaacgttacgaacgtagtacgttaaccgtacgggttaaccggg

SEQ ID NO: 276377 - DNA, 627 bp, Homo sapiens
  misc_feature: GYAE6OF01AFH8L.19.53.E09.1.454.CMB.1.raw
  modified_base (591)..(591): a, c, t, g, unknown or other
  misc_feature (591)..(591): n is a, c, g, or t
tcagtactctcgtgcacgaccggtgctcgatttagagagagtgtgttggggtttgggggggagaggagccccagccctgagattcccaggtgtttccattcagtgatcagcactgaacacagaggactcaccatggagttgagactgagctggtattttccttttggcttaattttaaaaggtgtccagtgtgaagtgcagctggtggagtcgtgggggagtcttggtacagcctggcacggtccctgacgacctctccgtgtgccagtcctcgtggtacttccgtaccgttttgattgtattatcgacctagtcggccgtaccggtcggggtcccgacgaacggccgtaccggaagggggacgggtccgtggggtacggttcgggtctacggtaggttatttagggtagtaattaggtgtacgttaaggtatacgtctagtcggcggtactgtagtaggacggtcctactcacctatccacaagacaccaacgaccaaacgtcctccgagtactctacgaactaatacgtaacgtgtacgtaggacgtacgacgtagggacgaaccgtccggttccgttagttacttagngtacgagtaagggtcgtaatgacgacgtcgtacggg

SEQ ID NO: 276378 - DNA, 907 bp, Homo sapiens
  misc_feature: GYAE6OF01EFOL5.19.53.E09.1.454.CMB.1.raw
  modified_base (266)..(266): a, c, t, g, unknown or other
  misc_feature (266)..(266): n is a, c, g, or t
tcagtactctcgtgcacgaccggtgctcgatttagagagagtgtgttgggtttgggggggagaggagccccagccctgagattcccaggtgtttccattcagtgatcagcactgaacacagaggactcaccatggagttgagactgagcttggtatttttccttttggcttaattttaaaaggtgtccagtgtgaagtgcagctggtggagtcgtgggggagtcttggtacagcctggcacggtccctgacgactcctccgtgtcncagtcctctgttattcctacctttgattgtaattacgtcgacctagtcgaccgtacggttccgggggtacccgacgtaaaccggtccgtacccgggaaaggggtaacggggtcccgtggggtaacgggttcggggtacgttaccggtaaaggtttagtttaagggtttaagggaaagttaaggttggtaacctttaagggttaacgttaacggtacccttaaggttcggtaccgggtaacctttcgggttaacgggtacgggggtaaaccggggttacccgttaaaccgtttaaccccgaaaccccgtttaaccgtttacccggttaacccccggtaaacgggtaaaaccccgggaaaacccgtaaaacccccgggtaaccccccggtaaaaaccgggttaaaacccccccttttaccccggtttaaggttaaacccccgtttccggttaaacggtaaaccctaaaaaccggttaacgtaaaacccgggttaagttaacccggttaagaacggtacggtacggtacgggtaaaccgggtacccgtaccgggtttacccgtttaggttaactttaccggtacggttacggtaacggaaagggttacggttaaacgaggtaacctaggtaccgttaaaccggg

SEQ ID NO: 276379 - DNA, 800 bp, Homo sapiens
  misc_feature: GYAE6OF01EK1A4.19.53.E09.1.454.CMB.1.raw
tcagtactctcgtgcacgaccggtgctcgatttagagagagtgtgttggctctgggagaggagccccagccctgagattcccaggtgtttccattcagtgatcagcactgaacacagaggactcaccatggagttgagactgagctggtattttccttttggctattttaaaaggtgtccagtgtgaagtgcagcgtggtggagtcgtgggggaggtcgttggtacaggcctggcaggtccctgacgactctcctgtgcagcctctggtacttctacctttgatgtattatcgacctatgctacgtcgggtcccggacaacggtctaccggaggggaacgggtcccgtagggtaggttggggtcctacggtaagggtttagttacgggttagggtaaagtttaggtaggtaccgtttaaggttaacgtaacggtcccttaaaggttcgggtacccggggttaacttcggttaggggttaggaaacgggggcccgttactttacccgaaccctattcccgtaacccgaaggaaaccggtaaccgaaaccccggtaaccccgtaaaacgtaaacccctttcccccgttaaggttaaccttcccgttaaggaacccttaaaaagtaaccggtaaaccgtacgtttaccgtagggtaaacggaacggttaccgttaaggggaaaccggtacccggttaaacccgggttcccgtttttaaggttaaccgtttaaaccggtttggtaaccgggtaaaccggttaaaacggggggtaaggtttaaaccgtacggaacgttaaccggg

SEQ ID NO: 276380 - DNA, 264 bp, Homo sapiens
  misc_feature: GYAE6OF01C858W.19.53.E09.1.454.CMB.1.raw
  modified_base (258)..(264): a, c, t, g, unknown or other
  misc_feature (258)..(264): n is a, c, g, or t
tcagtactctcgtgcacgaccggtgctcgatttagagagagtgtgttgggtttgggacagatttcactctcaccatcagcagcctgcaggctgaagatgtggcagttttattactgtcagcaatactatagtactccgctcactttcggcggaggaccaaggtggagatacaaacgactgtggctgccaccatctgtcttcatcctcccgccatctagacacgagtagtacgtggagcggctaggcaaggcgcatagnnnnnnn

SEQ ID NO: 276381 - DNA, 455 bp, Homo sapiens
  misc_feature: GYAE6OF01AJRDR.19.53.E09.1.454.CMB.1.raw
  modified_base (444)..(455): a, c, t, g, unknown or other
  misc_feature (444)..(455): n is a, c, g, or t
tcagtactctcgtgcacgaccggtgctcgatttagagagagtgtgttgggtctcaggtattagttggaatagtgctagtatagcctatgcggactctgtgaagggccgattcaccatctccagagacaacgccaagaactccctgtatctgcaaatgaacagtctgagagctgaggacacggccttgtattactgtgcaaggaggtatagcagctactggtacgactacgtggggccagggaacccctggtccaccgtctcctcagccctccaccaagggcccatccggtccttccccccgtggccgccctgctccgaggacgcaccctccgagacgcacacggccggccctggggcctggccctggtccgaaaggaccttaccttccccaggacgagttacgtggacggccggggactcgggacaacgggtccgacgagtagnnnnnnnnnnnn

SEQ ID NO: 276382 - DNA, 482 bp, Homo sapiens
  misc_feature: GYAE6OF01AU11S.19.53.E09.1.454.CMB.1.raw
  modified_base (328)..(328): a, c, t, g, unknown or other
  misc_feature (328)..(328): n is a, c, g, or t
  modified_base (462)..(482): a, c, t, g, unknown or other
  misc_feature (462)..(482): n is a, c, g, or t
tcagtactctcgtgcacgaccggtgctcgatttagagagagtgtgttgggtctcaggtattagttggaatagtgctagtatagcctatgcggactctgtgaagggccgattcaccatctccagagacaattccaagaacacagtggatctgcaaatgaacagcctgagagctggggacacggctgtgtattactgtgcgagagcggctggcaactacatccattacggttggacgtcgtggggccaagggaccacggtcatcgtctcccagccctccaccaaggccccatccggtccttcccccgtggccgcccctgcctccgaggcnccaccgtccgagacgcacgacggccgtcccgtgggctcgccgtcgggtaccgaacgggtacccttaaccgttaccccgaacggacgtaacgtacgtgggacggccgggcgtcggacgaacggcgacaagtacgnnnnnnnnnnnnnnnnnnnnn

SEQ ID NO: 276383 - DNA, 812 bp, Homo sapiens
  misc_feature: GYAE6OF01B0N35.19.53.E09.1.454.CMB.1.raw
  modified_base (218)..(218): a, c, t, g, unknown or other
  misc_feature (218)..(218): n is a, c, g, or t
tcagtactctcgtgcacgaccggtgctcgatttagagagagtgtggttgggtttagggggggagaggagccccagccctgagattcccaggtgtttccattcagtgatcagcactgaacacagaggactcgaccagtggagttgagactgagcttggtatttttcctttggctattttaaaaggtgtcagtgtgaagtgcagcgtgggtggagttcgngggggagcgttggtacacgccgtggctacggtcccctggacgacctctccgtgtcgctagcctctaggtactttcctacctttgattgtattagtcgcccattcggaccgtacggttccggggacccggtacgaaacggtccgtacggacggggaacggtcccgtaggggtacgttcgggttaccgttagtaaggggtttacttttaaggtacgggttaaaagttacggttcggtaccgtttaaagttaacgtacgtaccccgtttaaaggtccggtacggttaaacctttcgaacgggttacggaacggggtaaccctagttaccccgaacttaacccgtacttacccggaacgtaacgaacccgaaaccggtaaccgtaaaccggtaaccccttacccgttaacggttaacttaacccggtgtaaaccgttaaaagtcggaaacgtacgggtttaccgacggtaagtacggtaccggtaggaaaacgggcccgtaaacccgggttccgtttaaggtaacgtttacggtacggttacggaaacggtaacggggttaaagtagtaacgcggtttaacgaccggtttaaaccggg

SEQ ID NO: 276384 - DNA, 626 bp, Homo sapiens
  misc_feature: GYAE6OF01EVHU9.19.53.E09.1.454.CMB.1.raw
tcagtactctcgtgcacgaccggtgctcgatttagagagagtgtgttggctctggggagaggagcccccagccctgagattcccaggtgtttccattcagtgatcagcactgaacacagaggactcaccatggagttgagactgagctggtatttttccttttggcttaattttaaaaggtgtccagtgtgaagtgcagctgggtggagtcgtggggggagcgttggtacagcctggcaggtccctgagactctcctgtgcacgcctgtggtattccactttgattgattatgccatgcacgtgggtccgcaagctcgagggagctggagtggctgaggttataggttaggaatagtgactagtatacgctagtcggcggtactgtggtacggaacgggtccgtaattacccgaaccagttccgtaacccgaagaacgtaaccaaacccgacctaaaacgaccccttcccgtaggttaactaccgtagaaacctaaagtaccgaaactaacgtcgtaaggaagtacggtccgttagggaaacggtacccgtaccggttaccgtttagttaactttaccgtaggttacgaaccggtaaaagggggtagtttaagacggcgtaacggg

SEQ ID NO: 276385 - DNA, 558 bp, Homo sapiens
  misc_feature: GYAE6OF01AMWNW.19.53.E09.1.454.CMB.1.raw
  modified_base (302)..(302): a, c, t, g, unknown or other
  misc_feature (302)..(302): n is a, c, g, or t
  modified_base (455)..(455): a, c, t, g, unknown or other
  misc_feature (455)..(455): n is a, c, g, or t
  modified_base (460)..(460): a, c, t, g, unknown or other
  misc_feature (460)..(460): n is a, c, g, or t
  modified_base (468)..(468): a, c, t, g, unknown or other
  misc_feature (468)..(468): n is a, c, g, or t
  modified_base (475)..(475): a, c, t, g, unknown or other
  misc_feature (475)..(475): n is a, c, g, or t
  modified_base (554)..(554): a, c, t, g, unknown or other
  misc_feature (554)..(554): n is a, c, g, or t
tcagtactctcgtgcacgaccggtgctcgatttagagagagtgtgttgggtttgggaggcttggtacagcctggcaggtccctgagactctcctgtgcagcctctggattcaccttttgatgattatgccatgcactgggtccggcaagctccgaggggaagggcctgggagtgggtctcgaggttattaggttggaatagtgctagtatagcctatgcggactctgtggaacgggcctattccaccatcctaccagacgaacaaccgcaaacgaacctccctgtatctgacaaatgaaacngtctgagagctgaggacacggtccttagtattacgtgtagacgaaaggtaggtaatagcagtctacgtggtaacgacgtacgcggggactaacgggaccctggtccaccgtctctcacgtcctaccacgacggtccacgtccgtccctcccgngcccncctcgccncgacgcnccgaccgcgagccgacgacacggccgccgtcgctcgcgtcgtacgaacgtctacctcgagagtacgcgaggacgtcggngcgg

SEQ ID NO: 276386 - DNA, 870 bp, Homo sapiens
  misc_feature: GYAE6OF01DP4D8.19.53.E09.1.454.CMB.1.raw
  modified_base (316)..(316): a, c, t, g, unknown or other
  misc_feature (316)..(316): n is a, c, g, or t
tcagtactctcgtgcacgaccggtgctcgatttagagagagtgtgttgggtttgggggggagaggagccccagccctgagattcccaggtgtttccattcagtgatcagcactgaacacagaggactcaccatggagttgagactgagctggtattttccttttggcttaattttaaaaggtgtccagtgtgaagtgcagcgtggtggaggtcgtgggggagtcgttggtacagccgttggcacgggtccctggacgtaccttctccgtgtgctacgtcctcgtggtacttcctaaccttttgattcgtatttacncgtacctagtcgtaccgtacggttcgggggtacccggaccgaaacggtccgttaccgggaaggggggtaaaccggggtcccggttaggggtaacgggttcggggtcccttaaggttaaggggtttaacgttttaaggggtttacgggtaaaagtttacggttcggtaacctttaaagggttaacttacggtacccctttaaggtcgggtaccgggttaaacttcgggttagggtaacggggtaaaccggggtacccgttaacgttacccgtaaacccgttacttaaccgtacccgaaaggaaccgtaaacccgaaacccggaacccgtaaaaccgtaaccccgtttacccccgttaaggttaacccttaccgtaacgtaaaccctaaaacggtttaaccgaaaaccggttacgtttaccgttacggaaacggtacggtaccgggttaaacggaacgggtaaccgtacccgggttaccttttacggttaaactttacggtaggttaacggacgtaaagggtagttaacgtacggaactacggtcgttaaaccggg

SEQ ID NO: 276387 - DNA, 713 bp, Homo sapiens
  misc_feature: GYAE6OF01API8W.19.53.E09.1.454.CMB.1.raw
  modified_base (281)..(281): a, c, t, g, unknown or other
  misc_feature (281)..(281): n is a, c, g, or t
  modified_base (290)..(290): a, c, t, g, unknown or other
  misc_feature (290)..(290): n is a, c, g, or t
tcagtactctcgtgcacgaccggtgctcgatttagagagagtgtgttgggtttgggaggcttggtacagcctggcaggtccctgagactctcctgtgcagcctctggattcaccttttgatgattatgccatgcacgtgggtccggcaagctccagggaaggcctggagtgggtctcaggtattagttggaatagtgctagtatagcctatgcggactctgtgaaggccattcaccatctcagacacaacgccaaagacctcctgtatctgacaatgaacngtctagagngctaggaggaccacggtcctttagtattacgtggtcgacgaaagggtggtaactagccgtagtcttaacgtcgggtaaccacgtaccgggtcggggacctaacgggtaccctggtcccaccgtctcctcgacgcctaccgaccgacggccctacgttccggtcccttcccccgtggccccgtccccgtacgtcccgtacccgaacgggtaccgtaccccgtaacccgtacccggtaacggacccggtaccgaacccgggaccgggtccccggggtcccccggttacggggccctttcccgggtaccccggttacgggttacccgtaaacccggggttaccctttaaccccggtaaccccgaaccggttaacgggtaaaccggttacccggagggaacccggggtccgggacggtaacccgggg

SEQ ID NO: 276388 - DNA, 769 bp, Homo sapiens
  misc_feature: GYAE6OF01EPZ8O.19.53.E09.1.454.CMB.1.raw
tcagtactctcgtgcacgaccggtgctcgatttagagagagtgtgttggggtttggggggggagaggagccccagccctgagattcccaggttgtttccattcagtgatcagcactgaacacagaggactcaccagtggagttgagactgagtcttggttattttttccgttttggtactttaaagtttttaaaaagggtcgttaccgtaggttggtaggtaaggtgacaggtcgttggggtgggaggttcgggtgggggggtaggtcgtttgggtaacacggtccgttgggccgtacgggtccccgtaggacgtacctcttccgtggtcgcacgtcctcgtggtactttctacgtttgattgtattatcgacctagtcggtaccgtaccggtcgggggtacccgacgtaaccggtccggtaccggggaaggggtaacggggtccggtagggtacgggttcgggtacgtacgggtaagggtttaagtttagggttaacggtaagttaggtagtacgttaagtagtacgtacgtagtcggcgtacgttcggtaggtacgggtaaccggtcctatcccaacgtctaccgtacgaaggtaaccgaaccgaaccgactaaacgtaccttccgtatacgtactagaactaacgtacgaaacgtgtacgaggaacgtcgacggaaggtaccggtactaccgggtttccttaaggtattacggtggtaccggaaaggaagggttatacccgaggaaccttacgggtgttaacgggg

SEQ ID NO: 276389 - DNA, 901 bp, Homo sapiens
  misc_feature: GYAE6OF01BUPTY.19.53.E09.1.454.CMB.1.raw
tcagtactctcgtgcacgaccggtgctcgatttagagagagtgtgttgggtttggggggagaggagccccagccctgagacttcccaggtgtttccattcagtgactcagcactgaacacagaggactcaccatggaagttgagactgagcgtggtatttttccttttggacttaagtttttaaaaggtgtaccgtaggtgtgtaagtgcagctggtggagtcgtagggggagcttggtacagcctggcgacggtccctagagactcgtccgtgtcgacacgtccttcgtacggtacttcctaccgtttggattagtattagtcggacctagtcgaccgtacggttcggggtaccgacgtaacgtccgtaccgggaaggggaaccggtccggtagggtacggttcgggttaccgttacggtaacggttttagtttaacgggttagggtaaagttaacggttacgtacgtttaagggttaacttaccggttaccgttagttacgggtaccgggtaacgtttccgttagggtaacgggtaaccgggttacccgttaacgtttaccccgacccgttaacgttaccccgtaaccggaaaggtaaaccggaaccccgtaaacccgggtaacccaaaccggttaaccccgttcccgttaaggttaacccgttacgtacggaaactaaacggtaaccgaaacgttacggttacgttaacgggaaccggttaacggtccggttaaaccggaaccgggtaacccgttaacccggggtttacccgttttaagggttaaccggttttaaaccggtcgggtttaaaccgggaaacgggttaaaacggggtttacgggttaaacgttaacccgggaacgttaaacccgggtttacccgtttaaaaccccggggg

SEQ ID NO: 276390 - DNA, 742 bp, Homo sapiens
  misc_feature: GYAE6OF01AWFKM.19.53.E09.1.454.CMB.1.raw
  modified_base (432)..(432): a, c, t, g, unknown or other
  misc_feature (432)..(432): n is a, c, g, or t
tcagtactctcgtgcacgaccggtgctcgatttagagagagtgtgttgggtttgggggggagaggagccccagccctgagattcccaggtgtttccattcagtgatcagcactgaacacagaggactcaccatggagttgagactgagctggtatttttcctttggcttaattttaaaaggtgtccgagtgtgaagtgcagcgtggtggagtcgtgggggagtcgttggtacagtccgtggcctacggtccctaggacgtacctctccgtgtcgcacgtcctcgtaggtacttcctacctttggattagtattatcgaccctagtcgacgtacggtcgggtcccgagtaacggtccgtacggaaggggaacggtccgtagggtacggttcgggtctacggtaagggttatttaacgggtagtaagttaggtntacgttaagtacgtacgtaccttaagtcggaccgttactggtacggtcggaacggtcccttaagttcccaacctatacccgtacaaacggaaccgaacccgaaaccgtaaccgaaacttaccccgttcccgttaagtaccgtaagtaacccgaaagttaacgtaacgaacgttaccggttaggaacgacgtacgtcggtaagggtacccgtaccggtaccggttaactttagttaccgttaacgtgggtaaaccgtagggttaaacgggtactaaggtaacccgacggttaagttaccccggttaaaggg

SEQ ID NO: 276391 - DNA, 537 bp, Homo sapiens
  misc_feature: GYAE6OF01DAJHW.19.53.E09.1.454.CMB.1.raw
  modified_base (479)..(479): a, c, t, g, unknown or other
  misc_feature (479)..(479): n is a, c, g, or t
  modified_base (481)..(537): a, c, t, g, unknown or other
  misc_feature (481)..(537): n is a, c, g, or t
tcagtactctcgtgcacgaccggtgctcgatttagagagagtgtgttgggtttgggtgccgaagttgctggagggcacggtcaccacgctgctggagggagtagagtcctgaggacacggcctttgtattactgtgcaagggaggtatagcagctacgtggtacgactacgtggggaccagggaaccctggtccacccgtctcctcacgccctacccaaccgaacgggcccagttcccgggttcccttccccccgtgggcccgtccctgcctaccgaagggcgcctacccgtccggagacgaccaaccgcgggcccgggccccgttgggggcctacgggtcccgttacggggtaacctaaacggggtaccctttaaccccggttccccggaaacggagggtaaccggttaccgtggggaaccggggtccggggtaccgtacgggggaacccggaaacgggcccgaacgtaagtaggcgngnnnnnnnnnnnnnnnnnnnnnnnnnnnnnnnnnnnnnnnnnnnnnnnnnnnnnnnnn

SEQ ID NO: 276392 - DNA, 513 bp, Homo sapiens
  misc_feature: GYAE6OF01EKITH.19.53.E09.1.454.CMB.1.raw
  modified_base (489)..(513): a, c, t, g, unknown or other
  misc_feature (489)..(513): n is a, c, g, or t
tcagtactctcgtgcacgaccggtgctcgatttagagagagtgtgttgggtctcaggtattagttggaatagtgctagtatagcctatgcggactctgtgaagggccgattcaccatctccagagacaacgccaagaactccctgtatctgcaaatgaacagtctgagagctgaggacacggtccttgttattactgtgacgaagggaggtataggcagctacgtaggtacgtacctacggtcggggccgacggggacccctggtccaccgtcctccctcaccgccctacccaaccgaacggccctagttcccggttcccttccccccgtggcccgtccccgtcgccgtccgaggacgccctacccgtccgagacgaccaacgcggccggtcccgtgggcctcggccgtcggtacaacgggtaccttaccgttcccgaacgacgacgtacgtgacgggacgggcgtcggacgaacggcgacgtatacgnnnnnnnnnnnnnnnnnnnnnnnnn

SEQ ID NO: 276393 - DNA, 773 bp, Homo sapiens
  misc_feature: GYAE6OF01CHCY0.19.53.E09.1.454.CMB.1.raw
  modified_base (576)..(576): a, c, t, g, unknown or other
  misc_feature (576)..(576): n is a, c, g, or t
  modified_base (628)..(628): a, c, t, g, unknown or other
  misc_feature (628)..(628): n is a, c, g, or t
  modified_base (662)..(662): a, c, t, g, unknown or other
  misc_feature (662)..(662): n is a, c, g, or t
  modified_base (749)..(749): a, c, t, g, unknown or other
  misc_feature (749)..(749): n is a, c, g, or t
tcagtactctcgtgcacgaccggtgctcgatttagagagagtgtgttgggtttgggagaggacgccccagccctgagattcccaggttgtttccattcagtgatcagcactgaacacagaggactcacagtggagttgagactggagtcttggttactttttccgttttaggtactttaagtttttaaagggtcgttaccgaggttgtaggtaagtgcaggtcgttgggtaggaggtcgggtaggggggacgtcgttaggtacgacggtccgtgggccgtacggtcccgaggacgtaccttccgtccgtggtcgaccgacgtcccgttagttacggtactttaccttacgttttaggaagtttagttaaactttacgtccgtaccgtagtccggtaccgtacgggttccgggtacccgacgaacggtccggtaacgggacggggtacggtcggtaggtacgggtcggttaccgtaggtagttagttaggtagtagtgtagtagtagtatcgtactagcggtacgtacgtcggtacggtacggacggtacttactaccgactacgtcgaaccgtaanaaccgtaccgaaaccgtaacctaaccggtcccttacgttagaactaccgtanaaaccgaacttaaggaccgttgtacggacaaggnggttaccggacgggtaaacgtccgggttaaacctttcgttaaacgttagttacggggtaaaccgggtaacggttaaggaacggttanaacggtcccgtaagtccggtacgg

SEQ ID NO: 276394 - DNA, 933 bp, Homo sapiens
  misc_feature: GYAE6OF01AKZXF.19.53.E09.1.454.CMB.1.raw
tcagtactctcgtgcacgaccggtgctcgatttagagagagtgtgttggctctgggagaggagccccagccctgagattcccaggtgtttccattcagtgatcagcactgaacacagaggactcaccagtggagttgagactgagcgttggtactttttccgttttggtacctttaagtttttaaaaaggtcggtacccgtaagttggttaggtaaacgtgtaccaggtcgtgggtaggtacggtcggttggggggacggtcgtttagggtaccacgtcccgtggccgtacggtccccttaggagtaccttccttccgttcgtggccacggtcccgttccgtaggtactttacctaccgttttagacgttaggttaaacctttgttacccggacctacggttcggtcccgttaccgggtttaaccggggtccccgggtaaccgtaaacgggttccccgttaaccccgggaagggggggtaaccggggtccccgttaagggggtcggttaccggggttaccgttaccggttaaggggtttaacgttttaggggtaacggttaacggttaaggttacggttaacgttaaacggttaagttaccggtacccgttttaaggtccgggtaaccgggttaaccgttttccggtaacgggtttaacgggggaaaccggggtccccgtttacgtttaaccccgaaacccgttaccgttaccgtaacccggaagggtaaacccgaaccgtaaaacccggtcccgaaacggttaaccccttccgttaacgggttaactttccccgaaggttaaaccaacgggtaaactaaccgtacggtttgacggaacggttacgggctaacgggaacgtcccggtaaaccggtttccgtaagttacgtaccgttaggaccggtataacgggtaaagtcgtaggaccgtacg

SEQ ID NO: 276395 - DNA, 894 bp, Homo sapiens
  misc_feature: GYAE6OF01EL46S.19.53.E09.1.454.CMB.1.raw
tcagtactctcgtgcacgaccggtgctcgatttagagagagtgtgttgggtttgggggggagaggagccccagccctgagattcccaggtgtttccattcagtgatcagcactgaacacagaggactcaccagtggagttgagactgagcgttggttacttttttccgttttggtactttaaagtttttaaaaaggtcgttaccgtaaggttggtaggtaagttggcgtaggtcgttgggttgggaggttcgggtggggggacggtcgtttagggtacacggtccgtggccgtacggtcccctaggaccgtaccttccttccgtggtcgccgtacgtcccgttcgttaggttacctttccttaccgtttgtaagttgttaatttacgtcgtacctagtcggaccgtacgggttcgggggtacccgacgaaccggtcccggtacggggaacggggtaaccgggccggttagggtacgggttcgggtaccttacgggttaaggttttaagtttaagggttaaggtaagttacgggtagttaacgttaaggttacgtaacgttcccgtaggttccgggtccgttaccgttacggttacgggaacggggtaacgggtccccttaagtacccccaaccgttactacccgaaccgtaagggaaacccaacccgtaaccgaacccgttaaacgtaccccgtttctaggtttaacctccgtaacgaaacgtaacgtaccggtaaacttcgggttaaccgaggaacggtaggtccggtaacgggaaaccgggtcccggtaacccggttttacgtttacgtttaaagtcggtttaggggaaccgtaaacgggttaaaggggttactaagtacccgggtacaaacccggtttcggttaaccgggg

SEQ ID NO: 276396 - DNA, 878 bp, Homo sapiens
  misc_feature: GYAE6OF01CD4HX.19.53.E09.1.454.CMB.1.raw
  modified_base (724)..(724): a, c, t, g, unknown or other
  misc_feature (724)..(724): n is a, c, g, or t
tcagtactctcgtgcacgaccggtgctcgatttagagagagtgtggttgggtttgggggggagaggacgccccagccctgagattcccaggtgtttccattcagtgatcagcactgaacacagaggactcacagtggagttgagactgagcgttggtacttttttccgttttggtacttaagttttttaaaaaggtcgttaccgaaggttggtaggtaaaggttggacccgaggtcggttggggttagggacggttcgggtgggggggaacggttcggtttacgggtacgtacggtcccgttgggccgtaccgggttaccccgtagaccgtaccttccgtccgttcggtacgccgtacgtccgttcgtacggttactttacctaccgtttaaggtacttagttaagtttacgtcgtaccgtagttcgtccggtacggttccggggaccccgtagaaccgtccggaaccggaacgggggacgtacccggtggtagggtcggttacgtacgtaagggtttagttacggtaaggtaaagttcgtacgtacggttaatacgtacgtaccgtagtcggtaccgtacgttcggttacggaacggagggtacccttacgtacccctacgtacgtacgaccgtaaagacccgtaaaccgaacgtaaacccgtaaccgtaaccctccggttaactactacgtagtaacctaaacgtacggaacttaccgggtntaagggtaccgtacgtaaggtacgggtaacccggtaccgttaaacgggtttccgtttaaactttagggttaaccgtacgggttaaacccggaaaaggtaacgggttacgggttaaactaaccggtcgtaaccgggtttaaacccgttaacgggg

SEQ ID NO: 276397 - DNA, 765 bp, Homo sapiens
  misc_feature: GYAE6OF01BS8PI.19.53.E09.1.454.CMB.1.raw
tcagtactctcgtgcacgaccggtgctcgatttagagagagtgtgttgggtttggggggagaggagccccagccctgagattcccaggtgttccattcagtgatcagcactgaacacagaggactcaccatggagttgagactgagctggtactttttccgttttggcttaagttttaaaaggtgtaccagtgtgaagtgcagcgtggtggagtcgtagggggagtcttggtacacgtccgtggcgacggtcccgtgacgtaccttccgtccgtggtcgcacggtccctcgtcggtattacctacctttgattcgtaattagtcggccaagttcgacgtaccgtcggggtacccgtacgaacgtccgtacccggaaggggtaaccgggtccggtagggtacggttcggggtacccttacggttaagggtttaacgtttaagggttaggtaaaagttcggtacgtaacgttaacggtaacgtaacggtcccgttaaggtcggtaccggtaacccttgggtaggtaaccgggaaggtaccccgttaagtcccgtaaccctaacgtccgtaacccgaaggtaaccgaacctaaaccgacccgtaaacgttaacccctccgttagttaactccgtaagtaaccctaaaggtacgtaaaaccgtgtaccgtaaggacgtacggcgtaacggacgtacccggaccgttaccgttaggttactacggtgaacggaacgtagggtacgtagacgtaccgtgtaaccgttacgg

SEQ ID NO: 276398 - DNA, 724 bp, Homo sapiens
  misc_feature: GYAE6OF01CA4N1.19.53.E09.1.454.CMB.1.raw
  modified_base (459)..(459): a, c, t, g, unknown or other
  misc_feature (459)..(459): n is a, c, g, or t
tcagtactctcgtgcacgaccggtgctcgatttagagagagtgtggttggggtttgggggggagaggacgccccagccctgagacttcccaggtgtttccattcagtgatcagcactgaacacagaggactcaccagtggagtgagactgagtcttggttatttttcctttggtacttaagttttaaaggtgtacctagtgtagaagtgcagcgtgggtggcggtcggtgggggagtcgttgggtacaggccgtggccgtacggtccctaggacgtcctccgtccgtgtcgccacgtcctcgtggtacttccgtactttgagttgtattacgcgtacctagtcgtaccgtacgggttcggggtaccggtacgaacggtaccgtaccgggtaaaggggtacgggtcgtagggtgtcgggtacgtacgttaggttagttaggtagagtagtagtgtaagtntagtactacgtcggtacgtcgttgtagggtacggtaacgtccgtactacctacctctacctcgaaagaccgaaccgaacccgaaccgtaacttacccgttcctagtaaccttcgaacgtaaccgtaaaggtacgaactttacggagtaacggacgtacgtacgggtaacgtaaccggcccgtaacggttacctttaggttacgttaggtacggtacggaaaggtagggtaactaacggtagtaccgttagggtaccgttaacggg

SEQ ID NO: 276399 - DNA, 919 bp, Homo sapiens
  misc_feature: GYAE6OF01CEGAW.19.53.E09.1.454.CMB.1.raw
tcagtactctcgtgcacgaccggtgctcgatttagagagagtgtgttgggtttgggagaggagccccagccctgagattcccaggtgtttccattcagtgatcagcactgaacacagaggactcaccatggagttgagactgagctggtatttttccttttggcttaattttaaagggtgtccagtgtgaagtgcagctggtggagtcgtgggggagtcgttggtacaggccgttggcgtacgggtcccctggacgtaccttccgtcccgtgtcgcctacgtcccttcgtggtactttccaccttttagattggtaatttagcgaccctagtcggacctaccggttcggggtacccgactaacggtcccgttaccggaagggggaacggtcccgtaggggtacggttcgggtaccttacggtaaggttttaacgtttaagggttacgggtaaagttaggtaggtaaccgtttaaggttaacttaacgggtaccgtttaaaggtccggtacccgggtaacctttcgggttagggttaacgggtaaaccgggttaccccgttaacgtttaacccccgtaaaccccggttaacttaccccgggttaaacccgaaacgggttaaacccggtaaaaccccgtaaaaccccgggtaacccccgtaaaaacggttaaccccccctttaccccggtttaacgtttaacccgttaaccggttaacccggaaaccgttaaaaaccgttaccgtaaaaaccggttaccggttaggttaaaccggtaaacgggtaccgtaaccggtaagggtaaacccgggtacccggtaaaacccggtttccgttttaagggtttacttaaacggttcggtaagtaaaccgggtaaagggtaacggttacgaggtaaccgtacgttaacgttaacccggg

SEQ ID NO: 276400 - DNA, 533 bp, Homo sapiens
  misc_feature: GYAE6OF01AGMXT.19.53.E09.1.454.CMB.1.raw
  modified_base (469)..(470): a, c, t, g, unknown or other
  misc_feature (469)..(470): n is a, c, g, or t
  modified_base (472)..(472): a, c, t, g, unknown or other
  misc_feature (472)..(472): n is a, c, g, or t
  modified_base (474)..(533): a, c, t, g, unknown or other
  misc_feature (474)..(533): n is a, c, g, or t
tcagtactctcgtgcacgaccggtgctcgatttagagagagtgtgttgggtttgggtgccgaagttgctggagggcacggtcaccacgctgctgagggatagagtcctgaggacacggccttgtattactgtgcaaagggaggtatagcagctactggtacgactacgtggggccagggaaccctggtcaccgtctcctcacgccctccaaccgaacggggccccagtccggtccttccccccgtgggcccgcccctgccctccgagggacgcccacccgtccggaagtacgcctaagtaccggcccggtcccggtcggggtccttccggtcccggttacgggtaaccgaaaaccggttaccccttaccccgttaccccggaaacggtaacggtaacggtttaccggtacgggaccggggtaccggggtaccggtacgggaaccggaaccgggccgacgtaagtacggnngngnnnnnnnnnnnnnnnnnnnnnnnnnnnnnnnnnnnnnnnnnnnnnnnnnnnnnnnnnnnn

SEQ ID NO: 276401 - DNA, 695 bp, Homo sapiens
  misc_feature: GYAE6OF01A48KY.19.53.E09.1.454.CMB.1.raw
tcagtactctcgtgcacgaccggtgctcgatttagagagagtgtgttgggtttgggggggtgaggagccccagccctgagattcccaggtgtttccattcagtgatcagcactgaacacagaggactcaccatggagttgagactgagcttggtatttttcctttggcttaagttttaaaaggtgtccagtgtgaagtgcagcgtggtggagtcggtgggggagtcgttggacaggccgtggcgacggtccctgacgaccttcgtccgtgtcgcacgtcccttcgtggtacttcctacttttgaattagtaattagtcgtacctagtcgaccgtacggtccgggtaccggacgtaacgtccgtaccggtaaggggacggtccggtagggtacgggtcgggttccgtacgtagggttaacgtttagggttagtaacggttaggtacgtacgttaagttagttacgtaccgtagtacggccgtactcgtagggtacggacgggtaccttacgtaccgactacgtccgaaccgagaacgacccgaacgacgaaccgtacccgtccgtagtactcgtagaactaagtcgaacgtagtaccaggaaggtcgacgtacgaccgtacgtaccggttcgttagttagtacgtcggtagtaaccgtaagggtacttaggtaacgcgtaccggtcgttaaacggg

SEQ ID NO: 276402 - DNA, 538 bp, Homo sapiens
  misc_feature: GYAE6OF01EBNT0.19.53.E09.1.454.CMB.1.raw
  modified_base (455)..(455): a, c, t, g, unknown or other
  misc_feature (455)..(455): n is a, c, g, or t
tcagtactctcgtgcacgaccggtgctcgatttagagagagtgtgttggctctgggagaggagccccagccctgagattcccaggtgtttccattcagtgatcagcactgaacacagaggactcacatggagttgagactgagctggtattttccttttggcttaattttaaaaggtgtccagtgtgaagtgcagctgggtggagtcgtgggggaggcttggtacgagcctggcaggtccctgagactctcctgtgcacgcctctggattcactttgatgattatcgcatgactcgtcgggtcgacacgtctacgagggacggtcgtgaagtggggtcttcaggggtattaagttggaatagttggctagtatagcctatgcggactctggtgaagggcccgaattcgaacccatcgtccaagacgacaaacggcccaagtaactcccctgtacnctagcaaatgaacagtactgagagacgtgaaggactacggtccttagtattactgtacgcgtaaaggaggtagtaagcgtaag

SEQ ID NO: 276403 - DNA, 785 bp, Homo sapiens
  misc_feature: GYAE6OF01EVYNZ.19.53.E09.1.454.CMB.1.raw
  modified_base (189)..(189): a, c, t, g, unknown or other
  misc_feature (189)..(189): n is a, c, g, or t
  modified_base (299)..(299): a, c, t, g, unknown or other
  misc_feature (299)..(299): n is a, c, g, or t
  modified_base (365)..(365): a, c, t, g, unknown or other
  misc_feature (365)..(365): n is a, c, g, or t
tcagtactctcgtgcacgaccggtgctcgatttagagagagtgtgttgggtttgggagaggagccccagcccccgagattcccaggttgtttccattcagtgatcagcactgaacacagaggactcaccatggagttgagacgtgagctggttatttttccgttttggactttaagtttttaaagggtnttccaggttgtagtaagtcgcgtagtcgttgggtggtacggttcgggtggggggacgtcgttaggtacgacgccgtacggcgacggtccctgacgtcctcctcgtgtcgnacgtcctgtgtacttcgtactttgattgtattacgtcgcctagtcgtcgtacggtccgggtccganaacgtccggtacggaacggggcgtcggtaggtaggtcggttacgtagttaacggtttagtttaaggtacgtaagtgggttacgtaacgttgttaacgaccgttcgttaaggcggtaccgtagttcggtacgggtacgggaccggtaccttacctacgacctacttacccgtaacggacgtaaccgaaccgtaaccgaacccggtaaacgtttaccctcccgttaagtcttaacgtaccgtaaacgttagaacccggttaacgtacgggtaccgtagtaccgggagttaaccggtcgggaaaccgttcccggtttacggaaccgttttttagaaacgggttttcgaaggtttaacgggaagggtttaaaccgttaggaccgtaacgttaaggcgttttaaaccgtacgggggttaaacccg

SEQ ID NO: 276404 - DNA, 714 bp, Homo sapiens
  misc_feature: GYAE6OF01ALC8H.19.53.E09.1.454.CMB.1.raw
  modified_base (629)..(629): a, c, t, g, unknown or other
  misc_feature (629)..(629): n is a, c, g, or t
tcagtactctcgtgcacgaccggtgctcgatttagagagagtgtgttgggtttggggggaggaggagccccagccctgagattcccaggttgtttccattcagtgatcagcactgaacacagaggactcaccagtggagttgagactgagcgttggtacttttttccgtttttggtactttaagtttttaaaaagggttcgttccgtaggtgtaggtaagttcgcaggtcgttgggtgggtaggtcggtgggggaggtcgtttaggtacacggccgtggacgaccggttccgtaggacgtcttccgtccgtgcgacacgtcccgttcgtagttacttccgtacgtttagattgtattacgtcaccgtagtcgtccggtacggttaccggggccgacgtaggtccctacgggaggggtacgtcggtagggtcgttacgggtctaggttaggttagttaggttaagaacgtgtagtacttacgtagacgtcgtggcgtacggttattacggtggtacggtaccggtctacgttaccacgtacgtcgaacgacggagaaccgactaaccgtacgtaacccgttccgtagtactcgtaagactaaagtcacgtagtctaggacgacgtaacgnggtaacgtccgtaccgttacgtttacgttagacggtcgtaggtaacggtaaggtacgttaacacggtactacggtacgttacggg

SEQ ID NO: 276405 - DNA, 833 bp, Homo sapiens
  misc_feature: GYAE6OF01BNKPJ.19.53.E09.1.454.CMB.1.raw
tcagtactctcgtgcacgaccggtgctcgatttagagagagtgtgttgggtttgggggagaggagccccagccctgagattcccgaggtgtttccattcagtgatcagcactgaacacagaggactcaccagtggagttgagactgagctggtacttttcctttggacttaagttttaaaggtgtccgaggtgtgaagtgcagcgtggtggaggtcggtgggggagtcgttaggtaccaggccgtggccgtacggtccccgtaggacgtccttcctccgtgtcgtcgaccgtccttcgtagggtaccttaccgtaccgttttagaacgttgttaacgtttagttccgacccgtaagtccggtaccgtaccgggttacggggttccccggacgtaaacggtccgttacgggaaggggacggtccgtagggtagggttcggtcgtacgtaggttaagtttaggtaaggtacttaaggtgacgttagttaactcgtacgttagtacggcgtaacgttcgtggtaacgggtacgggtaccgtaccgttaccgtacgtaccctaccgtaccgtaaaggtaaacccgaacgtaaccccgaacgtaaaccgtaacccctttacccgtaccgtttacgtaccgtacgtaaaccgtaaacgtaccggtaaaacgtcgttacgtacggaacgttacggaacccggtaaggacgggtaaaccccgttaccgggttacggttttaacgttaccggtttacgtttcgggaaacgggtaaaccgggttaaacgggtaaaggttagggtaaacctaccggttacccggggaactttaaaccccggggg

SEQ ID NO: 276406 - DNA, 901 bp, Homo sapiens
  misc_feature: GYAE6OF01EREFA.19.53.E09.1.454.CMB.1.raw
tcagtactctcgtgcacgaccggtgctcgatttagagagagtgtgttgggtttgggaggcttggtacagcctggcaggtccctgagactctcctgtgcagcctcgtggtacttcctaccttttgatgtatttatgccatcgacgtacggttcgggaccgacaacgtccgtaccggaaggggaacgggccgtagggtacggttcggtctacgtaggttaagtttagggtaggtaaattcggtagtacgttaagtacgtaccgtaccgttagtcggtaccggtacttcggtagggtacggaacgggtacctacttaccaaccgtactccgtaccgaaggaaccgaaccgaaccgaaccgaaaccgtaacccttccgtaaggttactaccgtaagaaacgtaaaactacggaaaccgttagttgaacggtaaggtaaccgtcggtaacggaaccggtaccgtaaccggttccgtttaacgtagtttaccgtaggtacggaaacgtaaggtaacggtacgtacgtcgaagttaccgtagtaccgggtaacgtcgtaaccgggttaccgggaaccgtaaccggtacccgtcgttacccgtacgtcctacccgtacgacgttacccgaccgaacggtaccgcccgttaccgtaccccggttccccttcccggtccgtcccgtcccgtacggtcccgtaacggtccgaccggtacccgtaccgtaccggaaacggtcccaccgttaccgggaccccggtacccgggtcggttaacccggtcggttaaaccccgccgggtttaaccggaaaacccgggtttccgaaaccccgtttcccgggtaaacccgaggtaaccggggtaaacttccgggtaacggggcgggttaaaccggccgggttaaaccggg

SEQ ID NO: 276407 - DNA, 830 bp, Homo sapiens
  misc_feature: GYAE6OF01AW821.19.53.E09.1.454.CMB.1.raw
tcagtactctcgtgcacgaccggtgctcgatttagagagagtgtgttgggtttgggggggagaggacgccccagccctgagattcccaggtgtttccattcagtgatcagcactgaacacagaggactcaccatggagttgagactgagcgttggttacttttttccgttttggtactttaagtttttaaaaggtcgttccgagttggtagaagtgacaggtcgtgggtggtacggtcggtaggggggaggtcgtttggtaaccgacggccgtgggaccgtacggttccccgtaggaacgtccttccgttccgttggtcgaccgacggtcccctttcgtacggtactttaccgttaaccgttttggaacttggttaactttacgttcgacctagttcggaccgtaccggttccggggtaccgaccgaacggtcccgtacgggacgggggaaccgggtccggtaggggtacggttacgggttacgtacggttaagggtttaagtttaaggggttagtaaaggtttaggtacgttaacgttaagttaacgttacgtacccgtttaggtcggaccgttacgttcgtaggggttaacggacgggttactacgttaccaccttactcctaacggaagaaccgtaaccgaaccgtaacgtaaaccgtaccgttcctaggttactcgtaagaacctaaagtccgaaatgtacgagacgtacggacgaggaaaccgggacccttacgggttacgttttggtaaactttacggtacggttacgaaagggttaacggtaacggttaacgtaagacccggttaggtaccggtttaaccggg

SEQ ID NO: 276408 - DNA, 977 bp, Homo sapiens
  misc_feature: GYAE6OF01D1FXL.19.53.E09.1.454.CMB.1.raw
tcagtactctcgtgcacgaccggtgctcgatttagagagagtgtgttggctctgggagaggacgccccagccctgagattcccaggtgtttccattcagtgatcagcactgaacacagaggactacaccatggagttgagactggacgtcttggtattttttccgttttggtactttaagtttttaaaaaagggttcgttcccgtaaggttgttaggaaaggttcggcgtaggtccggttagggtggggtaacggttccgggttgggggggtaacggttccggtttcggggttaaccgtaacggtcccggttcgggtaccggtaaccgggttcccccgttagaaccggtaccttccccgttcccgttcggttcgtcccgtaacggttccccgtttaccggttacgggtaaccttttacccgttaacccggtttttacgggtaattaccggttaatttttacggtaaccggtccgttaacggtccgttacggtaccccgggtcgggggttaccccggaacgtaccgggtaccggtaccgggaacgggggaacggtccggttaggggtaggttacgggtccgttacgtaagggtttagttaagttaggtaattagggtactacggttaagtacgttacgtacggtagtcgaccggttaacgttcgttagggtacgggaacggtaccgttacttacccgtaactcgttacccgttaacggacggaaacgaacccggaaaccgtaacccgttaaaccggtaaccctttacccgttaggtaaccctttaaccgtaacgtaaacggtaaacggttacgtaaacgttccggttaagcggtaaacggtcgttaaacgggaccggtaaccggttaaccgggtaaccgggttttaccctttaacgggtttaccgttaacgttacggtaaacgggttaacccgaaagggtttaaccgggttactaaacggggtaacccgttaaacggg

SEQ ID NO: 276409 - DNA, 686 bp, Homo sapiens
  misc_feature: GYAE6OF01AV7D7.19.53.E09.1.454.CMB.1.raw
  modified_base (340)..(340): a, c, t, g, unknown or other
  misc_feature (340)..(340): n is a, c, g, or t
  modified_base (453)..(453): a, c, t, g, unknown or other
  misc_feature (453)..(453): n is a, c, g, or t
  modified_base (673)..(673): a, c, t, g, unknown or other
  misc_feature (673)..(673): n is a, c, g, or t
tcagtactctcgtgcacgaccggtgctcgatttagagagagtgtgttggctctgggagaggacgccccagccctgagattcccaggtgtttccattcagtgatcagcactgaacacagagactcaccatggagttgagactgagtctggtactttttccgtttggtactttaagtttttaaaaggcgttaccgaggtgtagaagtcgacgagtcgtgggtggagtccggtagggggagcgtttggaccacggccgtggacctacgggtccctggaacgaccttccgtccgttagcgacacgtcctagtcggtacttcctacgtttgaattcgtatttacncggctacgtcgacgtaccggtcgggtacccgacaaggtccgtacgggtaaggggacggtcgtagggtagtcggtctagtagttagttaggtagaattgtgtactaagttacgngtacccgtaggcgtcggacttcggtaggtacggtaacggccgttacgtcccaacgtcgtacccgtacgacgaacgaaccaacccgacgtaaaccacccgttcgtacgtaccgtagaacaacaagtaacgaccgttaagtccgagaacgggtatccggtaaggaccggtaaccggtacgttcgttaacttacggttacgtcgtacgacggtaaggtacgtnacgtacgtaccgg

SEQ ID NO: 276410 - DNA, 1049 bp, Homo sapiens
  misc_feature: GYAE6OF01BG0NX.19.53.E09.1.454.CMB.1.raw
tcagtactctcgtgcacgaccggtgctcgatttagagagagtgtggttgggtttgggagaggagccccagccctgagacttcccgaggttgtttccattcagtgatcagcactagaacacgagaggacctccaccagtggagttagacgtacgtgacgtcgttggttacttttttccgtttggtactttaaggttttaaaggtcgtaccgtagtggtagaagtcgacgacgtcgtgggtacggtaggttccgggtagggggtacggtcgtttacgggtaacgaccgggtccgtcgggtaccgtacccgggtttacccgtacggtaaccgttaccctttcccgtcccggttagggtccgtacccgtaccggtcccgttcgtttaccggttaaccttttaccggtttaccgtttaggtaacttaggttaacttttcggaccgttaccttacggtacggtacccggtaccgggtttacccggggtaccccggaaacgtaccgggtaccccgggtaaccggggtaaacgggggtaccggggtacccggttaaggggttaccggggtttaccgggttaaccggttaaccgggttaagggtttttaacggttttaaaaggggttaaccggttaaaacgggtttaggttcccgggttttaaaacgttacgggtttaaacccgttaaccggggttagtttacccgggttaaccggggtacccggttttaacgttacgggttaaccggggttaaccggggtaaccgggttacccgtaccgtttaaccccgtaacccgttacccgttaaccggttacgaaaccggtaacccgaaccgtaacccggtaaacccgttaaaccgttacccgttaccgttacgtttaacccgttagtaacggtaaccgtaaggtaccgtaacgtaccgttacgtaggaccgtacgggtagttacggaaccggttacgtaaccggtttaccgttacggttaaccgtttaggtaccggtaggtaaccggtagggtaaacgttacggacgttaccggtaagtcccgggttaaacgg

SEQ ID NO: 276411 - DNA, 429 bp, Homo sapiens
  misc_feature: GYAE6OF01B3LWN.19.53.E09.1.454.CMB.1.raw
  modified_base (158)..(158): a, c, t, g, unknown or other
  misc_feature (158)..(158): n is a, c, g, or t
  modified_base (241)..(241): a, c, t, g, unknown or other
  misc_feature (241)..(241): n is a, c, g, or t
  modified_base (384)..(429): a, c, t, g, unknown or other
  misc_feature (384)..(429): n is a, c, g, or t
tcagtactctcgtgcacgaccggtgctcgatttagagagagtgtgttgggtttgggtgccgaagttgctggagggcacggtcaccacgctgctggagggagtagagtcctgaggacacggccttgtattactgtgcaagggaggtatagcagctacgnggtacactacgtggggccagggaccctggtccaccgtctcctcagcctccgaaccgaagggcccagtccggtccttcccccgngggccgccctgcctccgaggacgcaccctcggagacgcaacgcggccggccctggggccttggcctgggtacaaaggtacctaccgtccccaggacgtagtactggacgccggggctcgggactaacggccgacagtaggcannnnnnnnnnnnnnnnnnnnnnnnnnnnnnnnnnnnnnnnnnnnnn

SEQ ID NO: 276412 - DNA, 256 bp, Homo sapiens
  misc_feature: GYAE6OF02GYFES.19.53.E09.1.454.CMB.1.raw
  modified_base (250)..(256): a, c, t, g, unknown or other
  misc_feature (250)..(256): n is a, c, g, or t
tcagtactctcgtgcacgaccggtgctcgatttagagagagtgtgttgggtttgggacagatttcactctcaccatcagcagcctgcaggctgaagatgtggcagtttattactgtcagcaatactatagtactccgctcactttcggcggagggaccaaggtggagatcaaacgactgtggctgcaccatctgtcttcatcttcccgcatctgacacgagagtactgagcggctggcaaggcgcatagnnnnnnn

SEQ ID NO: 276413 - DNA, 338 bp, Homo sapiens
  misc_feature: GYAE6OF02H1HFU.19.53.E09.1.454.CMB.1.raw
  modified_base (334)..(338): a, c, t, g, unknown or other
  misc_feature (334)..(338): n is a, c, g, or t
tcagtactctcgtgcacgaccggtgctcgatttagagagagtgtgttgggtttgggtgccgaagttgctggagggcacggtcaccacgctgctgagggagtagagtcctgaggacacggccttgtattactgtgcaaggaggtatagcagctactggtacgactactggggccagggaaccctggtcaccgtctcctcagcctccaccaagggcccatcggtcttcccctggcgccctgctccaggagcacctccgagagcacagcggccctgggctgcctggtcaaggactacttcccacgagagtactgagcgggctggcaaggcgcatagnnnnn

SEQ ID NO: 276414 - DNA, 403 bp, Homo sapiens
  misc_feature: GYAE6OF02F46NU.19.53.E09.1.454.CMB.1.raw
  modified_base (398)..(403): a, c, t, g, unknown or other
  misc_feature (398)..(403): n is a, c, g, or t
tcagtactctcgtgcacgaccggtgctcgatttagagagagtgtgttgggtctcaggtattagttggaatagtgctagtatagcctatgcggactctgtgaagggccgattcaccatctccagagacaacgccaagaactccctgtatctgcaaatgaacagtctgagagctgaggacacggccttgtattactgtgcaaggaggtatagcagctactggtacgactactggggccaggggaaccctggtcaccgtctcctcagcctccaccaagggcccatcggtcttcccctggcgccctgctccaggagcacctccgagagcacagcggccctgggctgcctggtcaaggactacttcccacgagagtactgagcgggctggcaaggcgcatagnnnnnn

SEQ ID NO: 276415 - DNA, 543 bp, Homo sapiens
  misc_feature: GYAE6OF02IRTNE.19.53.E09.1.454.CMB.1.raw
tcagtactctcgtgcacgaccggtgctcgatttagagagagtgtgttgggtttgggaggcttggtacagcctggcaggtccctgagactctcctgtgcagcctctggattcacctttgatgattatgccatgcactgggtccggcaagctccagggaagggcctggagtgggtctcaggtattagttggaatagtgctagtatagcctatgcggactctgtgaagggccgattcaccatctccagagacaacgccaaagaactccctgtatctgacaaaatgaaacagtctgagagctgaggacacggccttgtattactgtgcaaaggaggtatagcagctactggtacgactacgtggggccagggaaccctgggtcaccgtctcctcacgcctccaccaacgggcccagtccggtccttccccgtggccgccctgcctccaggacgccacctccgagacgcacacgccggcccgtgggcctcgccgtggtcaacggacctaccttcccaacgacgacgtacgtggacggccgggctcggg

SEQ ID NO: 276416 - DNA, 338 bp, Homo sapiens
  misc_feature: GYAE6OF02IQZSW.19.53.E09.1.454.CMB.1.raw
  modified_base (334)..(338): a, c, t, g, unknown or other
  misc_feature (334)..(338): n is a, c, g, or t
tcagtactctcgtgcacgaccggtgctcgatttagagagagtgtgttgggtttgggtgccgaagttgctggagggcacggtcaccacgctgctgagggagtagagtcctgaggacacggccttgtattactgtgcaaggaggtatagcagctactggtacgactactggggccagggaaccctggtcaccgtctcctcagcctctaccaagggcccatcggtcttcccctggccgccctgctccaggagcacctccgagagcacagcggccctgggctgcctggtcaaggctacttcccacgagagtactgagcgggctggcaaggcgcatagnnnnn

SEQ ID NO: 276417 - DNA, 750 bp, Homo sapiens
  misc_feature: GYAE6OF02FX4KX.19.53.E09.1.454.CMB.1.raw
  modified_base (232)..(232): a, c, t, g, unknown or other
  misc_feature (232)..(232): n is a, c, g, or t
tcagtactctcgtgcacgaccggtgctcgatttagagagagtgtgttagggtttggggggaggaggagccccagccctgagattcccaggtcgtttccatttcagttgatcagcactgaacacagaggactcaccgatggagtttgagactcgagcgtcgagtttccttacggcgtactttaaaggttgtccagtggtgaagtggccagctggtaggagtctagggggacgnttcggtacagtccttggcaggtcccagaagactctcctgtcgtcacgcctctaggaacttcgaacctttgacttcgaatttatctccaatttgcgactgggttcccggaccgaaggtccgtccaggggaacggccttggagtcgggtctcggaggtattaggtggaactaggtgtacctaggttactacgacctatcggacggtacctcgtcggtagaacgggtcccggtattaccgaaaccgtaattccggttccgaaacggtaaacggttaaccttaaaccggaccgtaaaacggtaacccttaccccgttaaggtttaacctttaccgttaggtaacctaaaaccgttcggaaaaccgttaccggtttccgggttaacgggaaacgtaacggtccgttagggaacggtaccgtaacccgggttaacgtttacggttaaccgtttaacggtcgttaaccggtaccgtaaagggttacggttagttaacgggtacctacggttacgtttaaccccgg

SEQ ID NO: 276418 - DNA, 562 bp, Homo sapiens
  misc_feature: GYAE6OF02GLVJE.19.53.E09.1.454.CMB.1.raw
tcagtactctcgtgcacgaccggtgctcgatttagagagagtgtgttggctctgggagaggagccccagccctgagattcccaggtgtttccattcagtgatcagcactgaacacagaggactcaccatggagttgagactgagctggattttccttttggctattttaaaaggtgtccagtgtgaagtgcagctggtggagtctgggggagcttggtacagcctggcaggtccctgagactctcctgtgcagcctctggattcacctttgatgattatgccatgcacgtgggtccgcaagctcgaggggaggccgtggagtgggtctcgaggtattaggtggaataggtgctagtatacgcctagtcgcgtactcgtggtaggacgggcgtattaccactactcctaccagacgaaccgaaccgaccaaacgaacctccctagtactactgaacaagtacgaacgtagtcgtagaagagacgtaggacggtaccgcggtacctttaggtaacgttacgttgtacgtacggtaaacgggtaggtaacgtacggacgtaacgg

SEQ ID NO: 276419 - DNA, 336 bp, Homo sapiens
  misc_feature: GYAE6OF02F6ZG9.19.53.E09.1.454.CMB.1.raw
  modified_base (334)..(336): a, c, t, g, unknown or other
  misc_feature (334)..(336): n is a, c, g, or t
tcagtactctcgtgcacgaccggtgctcgatttagagagagtgtgttgggtttgggtgccgaagttgctggagggcacggtcaccacgctgctgagggagtagagtcctgaggacacggccttgtattactgtgcaaggaggtatagcagctactggtacgactactggggccagggaaccctggtcaccgtctcctcagcctccaccaagggcccatcggtcttcccctggcgccctgctccaggagcacctccgagagcacagcggccctgggctgcctggtcaaggactacttcccacgagagtactgagcgggctggcaaggcgcatagnnn

SEQ ID NO: 276420 - DNA, 337 bp, Homo sapiens
  misc_feature: GYAE6OF02F4JI0.19.53.E09.1.454.CMB.1.raw
  modified_base (336)..(337): a, c, t, g, unknown or other
  misc_feature (336)..(337): n is a, c, g, or t
tcagtactctcgtgcacgaccggtgctcgatttagagagagtgtgttgggtttgggtgccgaagttgctggagggcacggtcaccacgctgctgagggagtagagtcctgaggacacggccttgtattactgtgcaaggaggtatagcagctactggtacgactactggggccagggaaccctggtcaccgtctcctcagcctccaccaagggcccatcggtcttccccctggcgccctgctccaggagcacctccgagagcacagcggccctgggctgcctggtcaaggactacttccccacgagagtactgagcgggctggcaaggcgcatagnn

SEQ ID NO: 276421 - DNA, 254 bp, Homo sapiens
  misc_feature: GYAE6OF02IGFB2.19.53.E09.1.454.CMB.1.raw
  modified_base (253)..(254): a, c, t, g, unknown or other
  misc_feature (253)..(254): n is a, c, g, or t
tcagtactctcgtgcacgaccggtgctcgatttagagagagtgtgttgggtttgggacagatttcactctcaccatcagcagcctgcaggctgaagatgtggcagtttattactgtcagcaatactatagtactccgctcactttcggcggagggaccaaggtggagatcaaacgaactgtggctgcaccatctgtcttcatcttcccgccatctgacacgagagtactgagcgggctggcaaggcgcatagnn

SEQ ID NO: 276422 - DNA, 548 bp, Homo sapiens
  misc_feature: GYAE6OF02GWZBC.19.53.E09.1.454.CMB.1.raw
tcagtactctcgtgcacgaccggtgctcgatttagagagagtgtgttgggtttgggaggcttggtacagcctggcaggtccctgagactctcctgtgcagcctctggattcacctttgatgattatgccatgcactgggtccggcaagctccagggaagggcctggagtgggtctcaggtattagttggaatagtgctagtatagcctatgcggactctgtgaagggccgattcaccatctccagagacaacgccaagaactccctgtatctgcaaatgaacagtctgagagctgaggacacggccttgtattactgtgcaaggaggtatagcagctactggtacgactacgtggggccagggaaccctgggtccaccgtctcctcacgcctccacccaacgggcccagtccggtccttcccccgtggccgccctgcctccacggcgccacctccgagacgccacacgccggcccgtgggcctcgccctgggtccaaggtacctaccgttacccacgacgtacgtaccgtggacggccgggcgtcggg

SEQ ID NO: 276423 - DNA, 588 bp, Homo sapiens
  misc_feature: GYAE6OF02HEKRD.19.53.E09.1.454.CMB.1.raw
  modified_base (290)..(290): a, c, t, g, unknown or other
  misc_feature (290)..(290): n is a, c, g, or t
  modified_base (328)..(328): a, c, t, g, unknown or other
  misc_feature (328)..(328): n is a, c, g, or t
tcagtactctcgtgcacgaccggtgctcgatttagagagagtgtgttgggtttgggaggcttggtacagcctggcaggtccctgagactctcctgtgcagcctctggattcacctttgatgattatgccatgcactgggtccggcaagctccagggaaggcctggagtgggtctcaggtattagttggaatagtgctagtatagcctatgcggactctgtgaagggccgattcaccatctccagagacaacgccaaagaacctccctgtatctgacaaatgaaacagtcngagagctggaggacacggcttgtattactgtgcaaggngtatagcagctatggtacactacgtggggccagggaaccctggtccaccgtctcctcacgccctccaaccgaacgggcccacgttccggtcccttcccccgtggcccgtccctgcctccgacggacgccacccgtccgacgacgccacacggcccgcccgtgggcctcggccgttacggtaccgaaacggtaccttaacccgttaccccgaacggtaacggtaacggttaaccgtcggaacgggtccgggacgtaccggg

SEQ ID NO: 276424 - DNA, 692 bp, Homo sapiens
  misc_feature: GYAE6OF02F8IH7.19.53.E09.1.454.CMB.1.raw
tcagtactctcgtgcacgaccggtgctcgatttagagagagtgtgttgggtttgggaggcttggtacagcctggccaggtcccctggagtactcgtccttgtgtcgagcctctggattcaacctttgatgattatgccatgtcgactgggtccggcaagcttccagggagggcctggtaagtgggtctcaggtattagttggaatagtgctagtatagcctagtgcggtactctgtcgaaggggcccgattcaccatcctccagagacaacgccaagaactcctgttatctgcaaatgaacagtctgaggcgctggacgaccacggtccttaggtacttacgtgttgactaaggaggttaactagcgagacgtaactggtaacgtactacgtggggaccaacgggtacccgtgggtaccgaccgttcctcccgtacgacgtccctaccgaacccgtaacgggacccctaagttcccggtaccctttacccccgtaggcccgtcccgttaccggtccctacccgacggaccgtccgaacccgttccggaacgtacggaccgacgaaccggtcccgggacccgttacggggcccttacgggtcccgtttacggggtaaccgtaaacggtaaccttaaccgttacccgaacggtaacgtacggtaccgtaggtaccgggacgggtcgtaaccggg

SEQ ID NO: 276425 - DNA, 338 bp, Homo sapiens
  misc_feature: GYAE6OF02H5CZV.19.53.E09.1.454.CMB.1.raw
  modified_base (336)..(338): a, c, t, g, unknown or other
  misc_feature (336)..(338): n is a, c, g, or t
tcagtactctcgtgcacgaccggtgctcgatttagagagagtgtgttgggtttgggtgccgaagttgctggagggcacggtcaccacgctgctgagggagtagagtcctgaggacacggccttgtattactgtgcaaggaggtatagcagctactggtacgactactggggccagggaaccctggtcaccgtctcctcagcctccaccaagggcccatcggtcttccccctggcgcccctgctccaggagcacctccgagagcacagcggccctgggctgcctggtcaaggactacttcccacgagagtactgagcgggctggcaaggcgcatagnnn

SEQ ID NO: 276426 - DNA, 564 bp, Homo sapiens
  misc_feature: GYAE6OF02HG45C.19.53.E09.1.454.CMB.1.raw
tcagtactctcgtgcacgaccggtgctcgatttagagagagtgtgttgggtttgggaggcttggtacagcctggcaggtccctgagactctcctgtgcagcctctggattcacctttgatgattatgccatgcactgggtccggcaagctccagggaaggcctggagtgggtctcaggtattagttggaatagtgctagtatagcctatgcggactctgtgaagggccgattcaccatctccagagacaacgccaagaactccctgtatctgacaaatgaacagtctgagagctgaggacacggccttgtattactgtgacaaggaggtatagcagctacgtggtaacgactacgtcggggaccagggaaccctgggtccaccgtcctcctcacgcctaccaccgaacgggcccacgtccggtcccttccccgtggccgccctcgcctccgacggcgccacccgtccgacgacgccaacgacggccggcccgtgggcctcgccgtcggtacgaacggtactaccttcccgagtacgtacgtaccgtggacggcgggcgtacggg

SEQ ID NO: 276427 - DNA, 547 bp, Homo sapiens
  misc_feature: GYAE6OF02F1WOK.19.53.E09.1.454.CMB.1.raw
  modified_base (398)..(398): a, c, t, g, unknown or other
  misc_feature (398)..(398): n is a, c, g, or t
tcagtactctcgtgcacgaccggtgctcgatttagagagagtgtgttggggtttgggggggagaggagccccagccctcgagattccctacggtggtttcctacttctagtgatcagcactgaacaacagaggactcaccaatggaggttgtagactgagctggtagtttttcctttttggtcgtattttaaaaaggttagtccagtgtgaagtgcagctggtggagtctgggggaggcttggtacagcctggcaggtccctgagactctcctgtgcagcctctggattcacctttgatgattatgccatgcactgggtccggcaagctccagggaagggcctggagtggggtctcaggtattagttgggaatgtgctagtatagcctatgcggactntgtgagggcgattcaccatctccagagacaacgaccagaactccctgtatctcgcaaatgaacagtctgagagcgtgagggacaaccggtcctttacgtattaaccgttgtgaccgaaggtaagggtaactaggacacggtctaaccgg

SEQ ID NO: 276428 - DNA, 592 bp, Homo sapiens
  misc_feature: GYAE6OF02JFSSQ.19.53.E09.1.454.CMB.1.raw
  modified_base (304)..(304): a, c, t, g, unknown or other
  misc_feature (304)..(304): n is a, c, g, or t
tcagtactctcgtgcacgaccggtgctcgatttagagagagtgtgttgggtttgggggggagaggagccccagccctgagattcccaggtgtttccattcagtgatcagcactgaacacagaggactcaccatggagttgagactgagctggattttcctttggctattttaaaaggtgtccagtgtgaagtgcagctggtggagtcgtgggggaggcttgggtacagcctggcaggtccctgagactctcctgtgcagcctctggattcacctttgatgattatgccatgcacgtgggtccgnaagctccgagggacgggcctggagtggggtctgaggtattaggtggaatgtgcttagtatagcctagtcggcggtacttcgtggtggaacgggccgtaattccaccattcctaccgaagacgaaccaacgaccaaacgaacctccctagtaactcgtagactaaactgaaacctagtcctaggaagtacggacgtaggaacggaccgtacgggtacccttaggttaactttacgtcgtacggtacgaaaggggtacggttaacgttaggaccgtacgtccttaacggg

SEQ ID NO: 276429 - DNA, 339 bp, Homo sapiens
  misc_feature: GYAE6OF02F68ZA.19.53.E09.1.454.CMB.1.raw
  modified_base (335)..(339): a, c, t, g, unknown or other
  misc_feature (335)..(339): n is a, c, g, or t
tcagtactctcgtgcacgaccggtgctcgatttagagagagtgtgttgggtttgggtgccgaagttgctggagggcacggtcaccacgctgctgagggagtagagtcctgaggacacggccttgtattactgtgcaaggaggtatagcagctactggtacgactactggggccagggaaccctggtcaccgtctcctcagcctccaccaagggcccatcggtcttccccctggcgccctgctccaggagcacctccgagagcacagcggccctgggctgcctggtcaaggactacttcccacgagagtactgagcgggctggcaaggcgcatagnnnnn

SEQ ID NO: 276430 - DNA, 552 bp, Homo sapiens
  misc_feature: GYAE6OF02HL8MC.19.53.E09.1.454.CMB.1.raw
tcagtactctcgtgcacgaccggtgctcgatttagagagagtgtgttgggtttgggaggcttggtacagcctggcaggtccctgagactctcctgtgcagcctctggattcacctttgatgattatgccatgcactgggtccggcaagctccagggaagggcctggagtgggtctcaggtattagttggaatagtgctagtatagcctatgcggactctgtgaagggccgattcaccatctccagagacaacgccaagaactccctgtatctgcaaatgaacagtctgagagctgaggacacggccttgtattactgtgcaaggaggtatagcagctactggtacgactacgtggggccagggaaccctggtccaccgtctcctcacgcctccaccgaacggcccatccggtccttcccccgtcggcccgcccgtcgcctccgaggacgccacccgtccgacgacgcacgacgccggcccgtgggcctgccgttcggtcgaacggtacctaccgttcccgacgacgtacgtacgtggacggcgggctacggg

SEQ ID NO: 276431 - DNA, 869 bp, Homo sapiens
  misc_feature: GYAE6OF02JAOP2.19.53.E09.1.454.CMB.1.raw
tcagtactctcgtgcacgaccggtgctcgatttagagagagtgtgttgggtttggggggagaggagccccagccctgagattcccaggtgtttccattcagtgatcagcactgaacacagaggactcaccatggagttgagactgagctggtattttcctttggcttaattttaaaaggtgtccagtgtgtaagtgcagcgtggtggagtcggtggggggagtcgttaggtacgacggtccgtgggaccgtacgggttccccgtaggacgtaccttccgttccgtggtcgaccgacgtcccgttcgtagggtactttcctaccgttttgaattgtaattagtgaccctaatcggactacggttcggggtcccgactaaacggtccgttaccgggaaagggggtaaccgggtcccgttagggggaacgggttcggggttccttacgggtaagggtttaacggttttaaggggttagggtaaaacgttagggttccggtaacgttaaaaggttacgtaaacgggtcccttaaggttcgggaacccgggtttaacccttgggtttacggggaaacggggtaaacccggggtcccggtttaaaactttccccgtaaacccgtacgttacccggtaacccgaaagggaaacccggaaacccgtaaaaccccggaacccgttaaaaacggtaacccccgttcccggttaaagttacctaaccggtaacgtaaaccgtaaaagttacccggtaaagttaaccggttacgtaacggaacggtaacgtccgtagggaacggacccgtaccgggttctttaaggttaccttaggtcggtacgaaggaaggttaggtacgacggcacgtacgttaacggg

SEQ ID NO: 276432 - DNA, 559 bp, Homo sapiens
  misc_feature: GYAE6OF02HROGG.19.53.E09.1.454.CMB.1.raw
  modified_base (283)..(283): a, c, t, g, unknown or other
  misc_feature (283)..(283): n is a, c, g, or t
  modified_base (472)..(472): a, c, t, g, unknown or other
  misc_feature (472)..(472): n is a, c, g, or t
  modified_base (539)..(539): a, c, t, g, unknown or other
  misc_feature (539)..(539): n is a, c, g, or t
tcagtactctcgtgcacgaccggtgctcgatttagagagagtgtgttgggtttggggggagaggagccccagccctgagattcccaggtgtttccattcagtgatcagcactgaacacagaggactcaccatggagttgagactgagctggattttccttttggctattttaaaaggtgtccagtgtgaagtgcagctggtggagtcgtgggggagcttggtacagcctggcaggtccctgagactctcctgtgcagcctctggattcacctttgatgattangccatgcacgtgggtccgcaagctccgaggggacggcctgggagtgggtctcgaggttattagttaggaatagtgacttagtactagcctaatggccggtacttcgtggtggaacgggtccgtattcacctatcctccagacgacaacgccaaagaacccttccctagtactccagaccaaatgaaacngtctagagagcgtagacgacgtacggtccgttagtacttacgtgttacgacgtaaagggaggttaanacggacgacgtacttaacgg

SEQ ID NO: 276433 - DNA, 256 bp, Homo sapiens
  misc_feature: GYAE6OF02FU0QN.19.53.E09.1.454.CMB.1.raw
  modified_base (244)..(244): a, c, t, g, unknown or other
  misc_feature (244)..(244): n is a, c, g, or t
  modified_base (249)..(256): a, c, t, g, unknown or other
  misc_feature (249)..(256): n is a, c, g, or t
tcagtactctcgtgcacgaccggtgctcgatttagagagagtgtgttgggtttgggacagatttcactctcaccatcagcagcctgcaggctgaagatgtggcagtttattactgtcagcaatactatagtactccgctcactttcggcggagggaccaaggtggagatcaaacgactgtggctgcaccatctgtcttcatcttcccgcatctgacacgagagtactgagcggctggcaaggcnatagnnnnnnnn

SEQ ID NO: 276434 - DNA, 337 bp, Homo sapiens; identical to SEQ ID NO: 276420
  misc_feature: GYAE6OF02F2SCM.19.53.E09.1.454.CMB.1.raw
  modified_base (336)..(337): a, c, t, g, unknown or other
  misc_feature (336)..(337): n is a, c, g, or t

SEQ ID NO: 276435 - DNA, 538 bp, Homo sapiens
  misc_feature: GYAE6OF02F1SFI.19.53.E09.1.454.CMB.1.raw
tcagtactctcgtgcacgaccggtgctcgatttagagagagtgtgttggctctgggagaggagccccagccctgagattcccaggtgtttccattcagtgatcagcactgaacacagaggactcaccatggagttgagactgagctggattttccttttggctattttaaaaggtgtccagtgtgaagtgcagctggtggagtctgggggagcttggtacagcctggcagggtccctgagactctcctgtgcagcctctggattcacctttgatgattatgccatgcacgtgggtccgcaagctacgaggggaggtctggagtggtctcgaggtattagtggaatagtgctagtatagcctatgcgactcgtgtgaagggccgtattcaccatcctccgagacgacacgccaaagacctccctagtactctagactaaatgaactgtcctaggagagtactagagggaccgtaccgggtccctttaggtaactttacgtggtacggaccgtaaaggggagttaacgtagcgtaaccgg

SEQ ID NO: 276436 - DNA, 522 bp, Homo sapiens
  misc_feature: GYAE6OF02GQTSO.19.53.E09.1.454.CMB.1.raw
  modified_base (370)..(370): a, c, t, g, unknown or other
  misc_feature (370)..(370): n is a, c, g, or t
tcagtactctcgtgcacgaccggtgctcgatttagagagagtgtgttgggtttggggggagaggagccccagccctgagattcccaggtgtttccattcagtgatcagcactgaacacagaggactcaccatggagttgagactgagctggattttccttttggctattttaaaaggtgtccagtgtgaagtgcagctggtggagtctgggggagcttggtacagcctggcaggtccctgagactctcctgtgcagcctctggattcacctttgatgattatgccatgcacgtgggtccggcaagcctccgagggaagggcctggagtgggtctcgaggtattagttggaatagtgctagtatagcctangcggactctgtgaagggccattcaccatctccagagacaacgccaaagactcctgtactcgtgacaaatgaacagtctgagagctgaggacacgggtcctttgtaacttacgtgttacgacgaagggaggttaataggctaggtcttaacgg

SEQ ID NO: 276437 - DNA, 305 bp, Homo sapiens
  misc_feature: GYAE6OF02GEZJU.19.53.E09.1.454.CMB.1.raw
  modified_base (254)..(254): a, c, t, g, unknown or other
  misc_feature (254)..(254): n is a, c, g, or t
  modified_base (257)..(305): a, c, t, g, unknown or other
  misc_feature (257)..(305): n is a, c, g, or t
tcagtactctcgtgcacgaccggtgctcgatttagagagagtgtgttggggtttgggacagatttcactctcaccgatcagcagcctgcaggctgaagatgtggcagtttattactgtcagcaatactatagtactccgctcactttcggcgagggaccaaggtggagatcaaacgaactgtggctgcaccatctgtcttcatcttcccgcatctgacacgagagtacttgagcggctggcaaggcgcaatagntcnnnnnnnnnnnnnnnnnnnnnnnnnnnnnnnnnnnnnnnnnnnnnnnnn

SEQ ID NO: 276438 - DNA, 689 bp, Homo sapiens
  misc_feature: GYAE6OF02G75DD.19.53.E09.1.454.CMB.1.raw
tcagtactctcgtgcacgaccggtgctcgatttagagagagtgtgttggctctgggagaggagccccagccctgagattcccaggtgtttccattcagtgatcagcactgaacacagaggactcaccatggagttgagactgagctggtattttcctttggcttaattttaaaaggtgtccagtgtgaagtgcagctggtggagtcgtgggggagtcgttggtacagcctggcaggtccctgagactctcctgtgcagcctctggacttccacctttgatgtattatcgcctatcgctacgtgggtccgcaagtcctacggaggggacggccgtgggagtgggtctcgtaggttattaggtaggaataggtgtacgtaagttatacgtccttagtcggaccggtactcgtagggtacggaaacgggtcccgtaagttaccgaaccgtacttacccgtaccgtaaggaaccgaacccgaaacccggtaacccgaaaacggtaaccccttacccgtacggttaacttccgtacgtaacctaaaagttccgtaaacgtacggtttaccgtaggaacgtaagccggttaggaacgggtacccggtaaccgggttccgtttaacggttaacgtttaccgttagggtaccggtacgggtaaaggggtaacggttaaggttacggacggttaacgg

SEQ ID NO: 276439 - DNA, 736 bp, Homo sapiens
  misc_feature: GYAE6OF02IDI01.19.53.E09.1.454.CMB.1.raw
  modified_base (263)..(263): a, c, t, g, unknown or other
  misc_feature (263)..(263): n is a, c, g, or t
tcagtactctcgtgcacgaccggtgctcgatttagagagagtgtgttgggtttgggggggagaggagccccagccctgagattcccaggtgtttccattcagtgatcagcactgaacacagaggactcaccatggagttgagactgagctggattttccttttggctattttaaaaggtgtccagtgtgaagtgcagctggtggagtcgtgggggaggcttggtacagcctggcaggtccctgagactctcctgtgcagcctntggtattcacctttgatgtattatgccattcgactacgttcgggggtacccggcaacggtcctaccggaagggggaaacgggtcccgtaggggtacggttgggggtccttacggaagggtttaatttagggttagggtaaattaggttgtaccttaaggttaacgttacggtacccttaagttcgggacccgggttaactttccggttagggttacgggaaacggggtcccgtaactttacccgaacccgtaactttcccgtacccgaaggaaccgtaaaccgaaaacccggtaccctaaaacggtaaacccttcccccgttagtaactacctaggaacctaaaaagttcgaaaaccgtaggttaccttaggaacggtacggaccgttaggaacggacgtaaccggtccgtttaggttaacttacgtggttacgacgtaagggtaggtactaacggactacgtccgttaacgg

SEQ ID NO: 276440 - DNA, 577 bp, Homo sapiens
  misc_feature: GYAE6OF02F44OG.19.53.E09.1.454.CMB.1.raw
  modified_base (414)..(414): a, c, t, g, unknown or other
  misc_feature (414)..(414): n is a, c, g, or t
tcagtactctcgtgcacgaccggtgctcgatttagagagagtgtgttgggtttgggagaggagccccagccctgagattcccaggtgtttccattcagtgatcagcactgaacacagaggactcaccatggagttgagactgagctggattttccttttggctattttaaagggtgtccagtgtgaagtgcagctggtggagtcgtggggggagcttggtacagcctggcaggtccctgagactctcctgtgccagcctcgtggattcctacctttgatgattatgccatgcacgtgggtcccggacaacggcctaccggaggggaacgggtcctagggagtggggtctcgaggttattaggtgaatggtgactagtatagccttatggcgtactgtgtagagggctattcacntctacgagacgacaacgaccaagacctcccgtatactcgtacgaactaaagtgaaacctagtaccgttaggaacgtagccgtaggacggtacgaccggtccgtttagttaactttacgtggtacgagtaagggtagtaacgtacggactacggtacttaacgg

SEQ ID NO: 276441 - DNA, 649 bp, Homo sapiens
  misc_feature: GYAE6OF02HTJ8R.19.53.E09.1.454.CMB.1.raw
  modified_base (395)..(395): a, c, t, g, unknown or other
  misc_feature (395)..(395): n is a, c, g, or t
  modified_base (464)..(464): a, c, t, g, unknown or other
  misc_feature (464)..(464): n is a, c, g, or t
tcagtactctcgtgcacgaccggtgctcgatttagagagagtgtgttggctctgggagaggagcccacgccctgagattcccaggtgtttccattcagtgatcagcactgaacacagaggactcaccatggagttgagactgagctggattttccttttggcttattttaaaaggtgtccagtgtgaagtgcagctggtggaggtcgtgggggaggcttgggtacagcgtggcgaggtccctgagactctcctgtgcagctctggtattcactttgatgattatcgacatgcacgtcgggtccgcaagtctaccgaaggggaacggccgttggaggtgggtctacgaggttaataggttaggaaattggtgtacgttagtaattcgccgttaagnggtaccggtacttgtcggttagggaaacgggggtccgtattaccgtaaccacggttacctacccggaanaacggaaaccgaaacgacccaaaacggaaaccctcccctaggttaactaccgttacacgtaaaacgttagaaactcgttactaggaacgtaacgcgtacgggaggtaaccgaccggttacgttacgttaacgtttaaccgtggttacggaccgtaaagggttaaggtaagttacgaccgttaagg

SEQ ID NO: 276442 - DNA, 719 bp, Homo sapiens
  misc_feature: GYAE6OF02GZDTV.19.53.E09.1.454.CMB.1.raw
  modified_base (343)..(343): a, c, t, g, unknown or other
  misc_feature (343)..(343): n is a, c, g, or t
  modified_base (631)..(631): a, c, t, g, unknown or other
  misc_feature (631)..(631): n is a, c, g, or t
  modified_base (684)..(684): a, c, t, g, unknown or other
  misc_feature (684)..(684): n is a, c, g, or t
tcagtactctcgtgcacgaccggtgctcgatttagagagagtgtgttgggtttgggggggagaggagccccagccctgagattcccaggtgtttccattcagtgatcagcactgaacacagaggactcaccatggagttgagactgagctggtattttcctttggcttaattttaaaggtgtccagtgtagaagtgcagctgggtggagtcggtgggggagtcgttggtacagccgtggcgacggtccctgacgtactccgtcctgtcgcacgcctcgtggtattcctacttttgattggtaattatcgacctaagtcgacctacggttcggggtaccccganaacggtccgtaccggaaggggggtaacgggtccgtaggggtacgggttgggttacctggtaaggtttaagtttagggttaggtaaacttagggtcgtacgttaaggttaactacggtaccttaagtcggaccggtacttacgttgggacggaacgggtcctaacttccgaacagttccaaccgaagtaaccgaacaaacgtacccgaaacgtaccttcccgtagtaactcgagaacctaaagtccgaaacgtcgtagaacgtggacgtacgtagggaaccgggtaccncgggtttacctttagttaacggttcctagggttaccgaacggtaaaggggttnttaacggacggaacgttcggaaccgtttaacgggg

SEQ ID NO: 276443 - DNA, 567 bp, Homo sapiens
  misc_feature: GYAE6OF02IRQ9U.19.53.E09.1.454.CMB.1.raw
  modified_base (288)..(288): a, c, t, g, unknown or other
  misc_feature (288)..(288): n is a, c, g, or t
  modified_base (329)..(329): a, c, t, g, unknown or other
  misc_feature (329)..(329): n is a, c, g, or t
  modified_base (375)..(375): a, c, t, g, unknown or other
  misc_feature (375)..(375): n is a, c, g, or t
  modified_base (443)..(443): a, c, t, g, unknown or other
  misc_feature (443)..(443): n is a, c, g, or t
tcagtactctcgtgcacgaccggtgctcgatttagagagagtgtgttggggtttggggggggagaggagccccagccctgagattcccaggtgtttccattcagtgatcagcactgaacacagaggactcaccatggagttgagactgagctggtattttccttttggctattttaaaaggtgtccagtgtgaagtgcagctggtggagtcgtgggggaggcttggtacagcctggcaggtccctgagactctcctgtgcagcctctggattcacctttgatgattangccatgcacgtgggtccggcaagctcgagggacggcctggngtgggtctcgaggttattagttggaatagtgctagtatagtcctangcggtactcgtgtaggaacgggccattccacctatctacagagaccaacgcaaagacctccctgtacnctagaactaatcgaaactagtactgaaggacacgtaggaacggacctaccgggtacctttaggttaactttacgtgtacggacgtaaagggtggttaactaaggaccgtacggtccgttaacgg

SEQ ID NO: 276444 - DNA, 782 bp, Homo sapiens
  misc_feature: GYAE6OF02HX4Y8.19.53.E09.1.454.CMB.1.raw
tcagtactctcgtgcacgaccggtgctcgatttagagagagtgtgttgggtttgggaggcttggtacagcctggcaggtccctgagactctcctgtgcagcctctggattcacctttgatgattatgccatgcacgtgggtccggcaagctccgaaggggaacgggcctggagtgggtctcgaggtattaggtggaatagtgtctagtatagcctagtggacggacttcgtggtaggaacgggccgtattccaacctatcctccaaggaacggaaccaaaccggaccaaaacggtaaccttccccgtgttaactcctagaacaaaagttcgaaactagtctaggaagagctaggagacctacggtcctttgtaacttacgtggtacgacgaaagggtaggtaacgtagacgagtacttaacgtcgggtaacaaccgttacggtcgggggaccgaacggggtaaccctgggttacccacccgttcctccgtacgacgtcccctacccgacgtaaccgggcccctacgttcccggttccctttcccccggcgggtccctcccgtccgaccgtacccgaacgggacgtacccgaacccgttcccggaaacggaccgaacccggaaccggcccgggtacccggtaccccgggtccgggtaccgtacccggtcccggttacgggtaacccggaaaccgggtccctttaaaccccgttcccccggaaacgggtaaccgtaaccgggttaaccgtacgggtaaccgggtcccggggtacggtaccgggg

SEQ ID NO: 276445 - DNA, 626 bp, Homo sapiens
  misc_feature: GYAE6OF02F9ASK.19.53.E09.1.454.CMB.1.raw
tcagtactctcgtgcacgaccggtgctcgatttagagagagtgtgttggctctgggagaggagccccagccctgagattcccaggtgtttccattcagtgatcagcactgaacacagaggactcaccatggagttgagactgagctggtatttttccttttggcttaattttaaaggtgtccagtgtgaagtgcagctggtggagtcgtgggggagtcttggtacagcctggcaggtccctgagacctctcctgtcgcagcctctggtactttcctacctttgattgtattatcgcctatcgctacggttgggtcccggacaacggtccgtaccggaagggggaacgggtcccgtaggggtaggttcggggtcttacggtaagggttagtttaggtaggtaattaggtgtacgttaagtagtacgtccttagtcggcgtactcgtggtaggaacgggtccctagttacaacgtacttccgtaccgaagaacgaaccgaaccgaccgaaacgtacctcccgtagtactctacgactaaagtcgaactgtctaggacgacgtacgagacggaccgtacggtacttagtaacttacgtaggagacgtaagggtagtagtacgagtaacg

SEQ ID NO: 276446 - DNA, 633 bp, Homo sapiens
  misc_feature: GYAE6OF02HV1VP.19.53.E09.1.454.CMB.1.raw
tcagtactctcgtgcacgaccggtgctcgatttagagagagtgtgttggctctgggagaggagccccagccctgagattcccaggtgtttccattcagtgatcagcactgaacacagaggactcaccatggagttgagactgagctggatttttcctttggcttattttaaaaggtgtccagtgtgaagtgcagctgggtggagtcgtgggggagcttgggtacagcctggcaggtccctgagactctcctgtgcagcctcgtggtattccacctttgatgattatcgccatgcacgtcgggccgcaagcctcgaggggaacgggcctgggagtcgggtctcgtagggttatttaggttaggaagttagtggtacttaaggtatacgccttagtacggcggtaacttcgtgtagggtaacgggcccgtaattccgaacctacttccgtacccaaggaacgaaccaacccggacctaaaacgaacccttcccgtagtactcgtacggacaaaagttcgaaactagttacgtagaagtaacgcttagggaccggtaaccgaccgggttcctttaaggtaactttaaccggttggacggtaaccggaaagggttaggtacgtacggacgttaacgg

SEQ ID NO: 276447 - DNA, 568 bp, Homo sapiens
  misc_feature: GYAE6OF02FZTF2.19.53.E09.1.454.CMB.1.raw
  modified_base (424)..(424): a, c, t, g, unknown or other
  misc_feature (424)..(424): n is a, c, g, or t
tcagtactctcgtgcacgaccggtgctcgatttagagagagtgtgttgggtttgggaggcttggtacagcctggcaggtccctgagactctcctgtgcagcctctggattcacctttgatgattatgccatgcactgggtccggcaagctccagggaaggcctggagtgggtctcaggtattagttggaatagtgctagtatagcctatgcggactctgtgaagggccattcaccatctcagagacaacgccaagactccctgtatctgacaaatgaacagtctgagagctgaggacacggcttgtattactgtgacaagggagtatagcagctactggtacactacgtcggggccaacgggaccctggtaccaccgtctcctcacgcctaccaccgacggcccacgtccggtccttcccccgnggccctcccgtcgcctccgacggcgccaccgtccgacgacgccacgacgccggtcccgtgggccttcgccgttcgggaactaacggtaccttacccgttacccgaacggtacgtacggttaccgtggaccggtcggcgtacggg

SEQ ID NO: 276448 - DNA, 579 bp, Homo sapiens
  misc_feature: GYAE6OF02G5P3W.19.53.E09.1.454.CMB.1.raw
  modified_base (372)..(372): a, c, t, g, unknown or other
  misc_feature (372)..(372): n is a, c, g, or t
tcagtactctcgtgcacgaccggtgctcgatttagagagagtgtgttgggtttgggggggagaggagccccagccctgagattcccaggtgtttccattcagtgatcagcactgaacacagaggactcaccatggagttgagactgagctggattttccttttggctattttaaaaggtgtccagtgtgaagtgcagctggtggagtcgtgggggaggcttggtacagcctggcaggtccctgagactctcctgtgcagcctctggacttcactttgatgattatgccatgcacgtcgggtccgacaacgcctccgaggggacggcctgggaggtgggtctcgaagggttatttaggttaggaaattgtcgnttaagtatagacctaaaggcggtactcgtaggtaggaacgggccctattccacctattccctacgagacgaaccaacgaccaaagaaccttccctagtactcgtagacaaagtcgaactgtcgagagacgcgtaggacgtaccacgggttcttaggttattacgtgtacgacgtaagggtagttacacgacgacgtcctaagtcggg

SEQ ID NO: 276449 - DNA, 589 bp, Homo sapiens
  misc_feature: GYAE6OF02I8IMS.19.53.E09.1.454.CMB.1.raw
  modified_base (240)..(240): a, c, t, g, unknown or other
  misc_feature (240)..(240): n is a, c, g, or t
tcagtactctcgtgcacgaccggtgctcgatttagagagagtgtgttgggctctggggagaggagccccagccctgagattcccaggtgtttccattcagtgatcagcactgaacacagaggactcaccatggagttgagactgagctggattttcctttggctatttaaaggtgtccagtgtgaagtgcagctggtggagtcgtggggggaggcttgggtacaggcctggcaggtcccngagactctcctgtgcacgcctcgtggattccacctttgatgtattatgccatgcacgtggggtccgcaagcctccgaggggacgggccgtgggagtgggtctgtagggtattaggttaggaattaggtgtacgtaagtatacggtcctaagtcggcggtactcgtggtacgggaacgggcccgtattcccacctagttccctaccagggaacaccgaacgcccaaagtaaccctccctaggtacctcgtacgaactaaatcgaactagttcaggagtagcgtaggacggacgtaccggtctttagtattacggtgttacgcgtaaaggggcgttaagacggtcgtaacg

SEQ ID NO: 276450 - DNA, 588 bp, Homo sapiens
  misc_feature: GYAE6OF02GLADG.19.53.E09.1.454.CMB.1.raw
tcagtactctcgtgcacgaccggtgctcgatttagagagagtgtgttgggtttggggggggagaggagccccagccctgagattcccaggtgtttccattcagtgatcagcactgaacacagaggactcaccatggagttgagactgagctggattttccttttggctattttaaaaggtgtccagtgtgaagtgcagctggtggagtcgtgggggagcttggtacagcctggcaggtccctgagactctcctgtgcagcctctggattcacctttgatgattatgccatgcacgtgggtccgcaagctccgaggggacggcctgggagtgggtctcgaggttattaggttaggaatgtgactagtatagcctagtgcgtactcgtggtggaacgggcctattccacctatcctaccaagacgaaccaacgaccaaacgtaccctccctagtactcgtagactaaagtcgaaactagttactaggaagacgtcgtaggacgggtaccgaccgggtcctttaaggttaactttacgtaggttcggaacggtaaagggtacggttaagtacggcgtacggtcttaacggg

SEQ ID NO: 276451 - DNA, 641 bp, Homo sapiens
  misc_feature: GYAE6OF02JOZYO.19.53.E09.1.454.CMB.1.raw
  modified_base (318)..(318): a, c, t, g, unknown or other
  misc_feature (318)..(318): n is a, c, g, or t
  modified_base (365)..(365): a, c, t, g, unknown or other
  misc_feature (365)..(365): n is a, c, g, or t
tcagtactctcgtgcacgaccggtgctcgatttagagagagtgtgttgggtttggggggagaggagccccagccctgagattcccaggtgtttccattcagtgatcagcactgaacacagaggactcaccatggagttgagactgagctggatttttcctttggcttattttaaaggtgtccagtgtgaagtgcagctggtggagtcgtgggggagcttggtacagcctggcaggtccctgacgactctccgtgtgccagtccttcgtggactttccaccttttgatgtaattatcgacctatgacacgtgggtccgnaacgctccgagggaggctggagtggtctcgagtattagtagaatagngatagtatagctagtggcggtactacgtggtaggaaacggggtcctaagtttccgaacctacttaccgtaccgaaacggaacgtaccaaacgtcccgaaaacggtaacccttcccgttagtaacttcggtacaaccgtaaaagtcgaaacctacgggttcagggaaacggtacgccgtaggaacggtacccaacgggttccttaaggttaactttaaccgtggtacgtaaacggtaaggggtagttacgtaaggaccgtaagggtacccttaacgg

SEQ ID NO: 276452 - DNA, 611 bp, Homo sapiens
  misc_feature: GYAE6OF02J1T6C.19.53.E09.1.454.CMB.1.raw
tcagtactctcgtgcacgaccggtgctcgatttagagagagtgtgttgggtttggggagctctgggagaggagccccagccctgagattcccaggtgtttccattcagtgatcagcactgaacacagaggactcaccatggagttgagactgagctggattttcctttggctattttaaaaggtgtccagtgtgaagtgcagctgggtggagtctgggggagcttggtacagcctggcaggtccctgagactctcctgtcgcagcctcgtggacttcaccgtttgatgattacgtgccagttgcacgttcgggtccggacaagcctaccggaggggaacggggtccctggggacggttcgggttcctacgtagggttatttaggttcgggaaattaggttcgacgttagtaacgtagccttaagtcggacggtctcgtgtagggacgggtctacgttccaccgattcctcgaagacgtaaccgaacgcctaacgaccttccctagtacttcgtacgataaacgtcgaaacgtacgtcgtagacggagtccgtaggaacgtacgcgtaccgtttagtaacgttacgttgacgtagaacggttaggtaagtcg

SEQ ID NO: 276453 - DNA, 636 bp, Homo sapiens
  misc_feature: GYAE6OF02JAO8C.19.53.E09.1.454.CMB.1.raw
  modified_base (562)..(562): a, c, t, g, unknown or other
  misc_feature (562)..(562): n is a, c, g, or t
tcagtactctcgtgcacgaccggtgctcgatttagagagagtgtgttggctctgggagaggagccccagccctgagattcccaggtgtttccattcagtgatcagcactgaacacagaggactcaccatggagttgagactgagctggatttttccttttggcttattttaaaaggtgtccagtgtgaagtgcagctgggtggagtcgtgggggagtcttgggtacagcctggcaggtccctgacgactctcctgtgcagcctctaggacttcctacctttgattgtattatcgcctatcgacctacggttcggggtcccgacaacggtcctacccggaagggggaacgggtccgtagggggaggttcggggtcctacgtaaggggttaatttagggttacggggaaattaggttgtacttaaggtactagtccctagtcggacggtacttcgtggtacggaacgggtccgtattccaaccgtacttcctaccgaggaacgaaccaaccgtaccaaacgaccttcctagtactcgacgacaaagtacgaactagtctagganagtcgagacggacgtccgggtcctttaggtacttacgtaggtacggacgtaagggtaggtaatacggctaacgg

SEQ ID NO: 276454 - DNA, 656 bp, Homo sapiens
  misc_feature: GYAE6OF02I4YG1.19.53.E09.1.454.CMB.1.raw
  modified_base (239)..(239): a, c, t, g, unknown or other
  misc_feature (239)..(239): n is a, c, g, or t
  modified_base (385)..(385): a, c, t, g, unknown or other
  misc_feature (385)..(385): n is a, c, g, or t
tcagtactctcgtgcacgaccggtgctcgatttagagagagtgtgttggctctgggagaggagccccagccctgagattcccaggtgtttccattcagtgatcagcactgaacacagaggactcaccatggagttgagactgagctggattttccttttggctattttaaaaggtgtccagtgtgaagtgcagctggtggagtcgtgggggagcttgggtacaggcctggcaggtcccngagactctcctgtgcacgcctacgtggattccaccttttggattgattatggccagtgcacgtggggccggcaacggcctaccgaggggaacgggcctggaggtgggtctacgaggttatttagttacgggaaatttgggtacgtnttaaggtatacggtcctagtcggcggtacttacgtggtacggaacgggcccgtagttacccacgtactccgttacaacggtcgaaaccgaaccgacccgaaacgtaacccttccccgtagttactaccgtaggaacctaaacgtacgaaacctacgttccgtagaagggaccgacgttaggaacggacccgtacggggttacccttttaggtaacgttaccgttgggtaaccgacggtaaaggggtaggttaacgtagtacccgtaacggg

SEQ ID NO: 276455 - DNA, 743 bp, Homo sapiens
  misc_feature: GYAE6OF02HB7NP.19.53.E09.1.454.CMB.1.raw
  modified_base (726)..(726): a, c, t, g, unknown or other
  misc_feature (726)..(726): n is a, c, g, or t
tcagtactctcgtgcacgaccggtgctcgatttagagagagtgtgttgggtttgggggggagaggagccccagccctgagattcccaggtgtttccattcagtgatcagcactgaacacagaggactcaccatggagttgagactgagctggtatttttcctttggcttaattttaaaaggtgtccagtgtgaagtgcagctggtggagtcgtgggggagtcttggtacagccgtggcacggtccctgacgtacctctcctgtcgcacgccttctggtactttcctaccttttgattgtaatttactgcctatcgcctacggttcggggtcccggacaaacggtccgtaccggaagggggaacgggcccgtaggggtacggttcggggtactacggtaagggtttaacgtttagggttagggtaaattaggttagtacgttaagttaattacgtccgttaagtcggaccggtaaccttcgtagggtacgggaaccggggtaccgttaacgtttcccaaaccctacttaccctaccgaaggaaaccggaaccaaaacccggtaacccgtaaaacggtaaccccttacccttaaggttaaccttaccgttacgaaacgttaaaagtaccgaaaacgttcgtacgtagaaacggtacggtcgtaagggaaccggtacaccgggtttaccttaggttaacttacggtgtacgacggtaaggtacggtaanacggacagtactaacgg

SEQ ID NO: 276456 - DNA, 677 bp, Homo sapiens
  misc_feature: GYAE6OF02F61FH.19.53.E09.1.454.CMB.1.raw
  modified_base (260)..(260): a, c, t, g, unknown or other
  misc_feature (260)..(260): n is a, c, g, or t
tcagtactctcgtgcacgaccggtgctcgatttagagagagtgtgttggggtttgggggggagaggagccccagccctgagattcccaggtgtttccattcagtgatcagcactgaacacagaggactcaccatggagttgagactgagcgtggtattttcctttaggctattttaaaaggtgtccagtgtgaagtgcagctggtggagtcgtgggggaggcttggtacagcctggcaggtccctgagactctcctggtncagcctcgtggattcacctttgatgaattatgccatggcaacggtcgggtccggacaagcctaccgaggggaacgggcccgtgggagttggggtcctacgaggtttaagttaggttaggaattacggtgtacgtaagttacgtaagccgttaatggccggtaacttcgtacgtagggtaaacggggtcccaagtttacccaaccctaatccgtaaccctaaagggaaccgacctaaaacgggcccaaaacgttaaacccgttccccgtagtaacttccgagtaaaccaaagtaccgaacctagttaccgaaggagtaccgcgtaagagggtacaccgggttcttaagttacttaacgttcggtaagtaacggtaaacggggtagtttaagtacggacccgaagttacgttaaccggg

SEQ ID NO: 276457 - DNA, 558 bp, Homo sapiens
  misc_feature: GYAE6OF02HQS5B.19.53.E09.1.454.CMB.1.raw
  modified_base (405)..(405): a, c, t, g, unknown or other
  misc_feature (405)..(405): n is a, c, g, or t
tcagtactctcgtgcacgaccggtgctcgatttagagagagtgtgttgggtttggggagctctgggagaggagccccagccctgagattcccaggtgtttccattcagtgatcagcactgaacacagaggactcaccatggagttgagactgagctggattttcctttggctattttaaaaggtgtccagtgtgaagtgcagctggtggagtcgtgggggaggcttggtacagcctggcaggtccctgagactctcctgtgcagcctctggattcacctttgatgattatcgccatgcacgtggggtccgcaagcctaccgagggaacggcctgggagtgggtctcgaggttattaggttaggaattaggtgacttagtatacggcctagtcggcgtactctggngaacggggcctattcaccatcgtacagacgaccacgaccaaagaccctcctagtatcgagactaaatcgaaactagtctagacgtagcgttaggaacggaccgacggtcctttagtacgtttacctggtcggaacgaaggggtagtataacgg

SEQ ID NO: 276458 - DNA, 446 bp, Homo sapiens
  misc_feature: GYAE6OF02ILDFJ.19.53.E09.1.454.CMB.1.raw
  modified_base (426)..(426): a, c, t, g, unknown or other
  misc_feature (426)..(426): n is a, c, g, or t
  modified_base (431)..(446): a, c, t, g, unknown or other
  misc_feature (431)..(446): n is a, c, g, or t
tcagtactctcgtgcacgaccggtgctcgatttagagagagtgtgttgggtctcaggtattagttggaatagtgctagtatagcctatgcggactctgtgaagggccgattcaccatctccagagacaacgccaagaactccctgtatctgcaaatgaacagtctgagagctgaggacacggccttgtattactgtgcaagggaggtatagcagctactggtacgactacgtggggccagggaaccctggtccaccgtctcctcacgcctccaccaacgggccccagtccggtccttcccccgtggcccgcccctcgcctcccgaggacgccacccgtccgagacgcacacggccggccgtgggctcgcctggtacgaaggtacctactcccacgagacgtactgaggcggcgtggacgaaggcgnatagnnnnnnnnnnnnnnnn

SEQ ID NO: 276459 - DNA, 535 bp, Homo sapiens
  misc_feature: GYAE6OF02GXMXK.19.53.E09.1.454.CMB.1.raw
  modified_base (361)..(361): a, c, t, g, unknown or other
  misc_feature (361)..(361): n is a, c, g, or t
  modified_base (482)..(482): a, c, t, g, unknown or other
  misc_feature (482)..(482): n is a, c, g, or t
tcagtactctcgtgcacgaccggtgctcgatttagagagagtgtgttggctctgggagaggagccccagccctgagattcccaggtgtttccattcagtgatcagcactgaacacagaggactcaccatggagttgagactgagctggattttcctttggctattttaaaaggtgtccagtgtgaagtgcagctggtggagtcgtggggggaggcttgggtacagcctggcaggtccctgagactctcctgtgcagcctctggattcacctttgatgattatcgccatcgctacgtggggtccgcaacgcctaccgaggggaggcctgggagtgggtctcgaggttattaggtggaattgngtactagtatacgcctagtcggacggtactcgtggtaggaacgggccgtattccacctatcaccgagacgacaaccgccaagacctcctgtatcagactaatacgaacacgtctagagcgntgagacgcggtcttaggtacttacgtgtagacgtaaggtacgtatacgatacg

SEQ ID NO: 276460 - DNA, 741 bp, Homo sapiens
  misc_feature: GYAE6OF02HQ8V7.19.53.E09.1.454.CMB.1.raw
tcagtactctcgtgcacgaccggtgctcgatttagagagagtgtgttggctctgggagaggagccccagccctgagattcccaggtgtttccattcagtgatcagcactgaacacagaggactcaccatggagttgagactgagctggtatttttccttttggcttattttaaaaggtgtccagtgtgaagtgcagctggtggagtcgtgggggagcgttggtacagcctggcacggtccctgacgacctctcctgtcgcagcctctggtacttcctacctttgattgtattatcgaccatcgccgtacggttcgggtcccggacgaacggccgtccgaagggggtaacgggccgttaggggacggttcggggtctacggtaagggttagtttaggttagggtaagttaggtagtacgttaaggttaagtacggtaccttaggtcgggaccgggtaccttcggttagggtacgggtaaccgggtccgtaactttcccaaaccttcttcccgtaccgaagtaacccggaaaccgtaacccgaacccgtaaaacgtaaccccttcccgttagttaaccttaccgttacggaaactaaaacgttacggaaacttaccgggttactaggaaacggtccgacgttacgggaaaccggtacccgtaccggggtttccctttaaggttaacgtttaccgtgggttaacgaacggtaaagggttaacggtaacgtaggaaccgtaacgg

SEQ ID NO: 276461 - DNA, 657 bp, Homo sapiens
  misc_feature: GYAE6OF02IFTKT.19.53.E09.1.454.CMB.1.raw
  modified_base (254)..(254): a, c, t, g, unknown or other
  misc_feature (254)..(254): n is a, c, g, or t
  modified_base (341)..(341): a, c, t, g, unknown or other
  misc_feature (341)..(341): n is a, c, g, or t
tcagtactctcgtgcacgaccggtgctcgatttagagagagtgtgttgggtttgggaggcttggtacagcctggcaggtccctgagactctcctgtgcagcctctggattcaccttttgatgattatgccatgcactgggtccggcaagctccaggggaagggcctggagtgggtctcgaggttattagttggaatagtgctagtatagcctatgcggactctggtgaacgggcctattccaccatctccaganacaacgccaaacgaactccctagtactctgacaaatgaaacagtctagagagtctggaacggacacggtcctttgttacttactggngacgaaaggtaggtatacgactacgtcttaacgtagggtaaccgaacgttacgggtacggggacccgtaacggggtaacccctggtaccctaccgttcctcctaccacgtccctaccaccgaacggtccctacgtcccggttcccttaccccgttcggcccgtcccgtcgtccgtaccgtaacggacgacccgtacccgtccgaagcgaccgacgacggacccggccgtagggcctcgtccgtacggtacgaaccggtaccttacccgttacccgaacggtacggtacgttacggcggtacgggccggtgtacggg

SEQ ID NO: 276462 - DNA, 791 bp, Homo sapiens
  misc_feature: GYAE6OF02HAFY7.19.53.E09.1.454.CMB.1.raw
  modified_base (203)..(203): a, c, t, g, unknown or other
  misc_feature (203)..(203): n is a, c, g, or t
tcagtactctcgtgcacgaccggtgctcgatttagagagagtgtgttggctctgggagaggagccccagccctgagattcccaggtgtttccattcagtgatcagcactgaacacagaggactcaccatggagttgagactgagctggtatttttccttttggcttaattttaaaaggtgtccagtgtgaagtgcagctgggnggagtcgtgggggagcttggtacagcctggcacggtccctgagctctcctgtgcacgccttcgtggtacttctaccgttttgatgtattagtcgcccagttcggcctacggttcggggtacccggacgtaaacggtccgtaccgaggggggaacggggtcccgtaggggaacgggttcggggtccttacggtaaggggtttaacgtttaaggggtttaggggtaaaactttagggttacggtaccgtttaaagggttaacggttaacggtcccgtttaaaggttacggggtaccccgggttaactttcccggttagggggttaacgggaaaaccggggggtccccgttaaccgtttacccgaacctaccgttacccgttacccgaaagtaaccgggaaacccaaaacccggacccaaaagggtaaccccttccccggttaagttaaccttaccggtaacggtaaaccgtaaataaccggtaacgtacgttacgacggtaagacgtggtacggaacggaccgtaacggttctttagtaacgttcgttcggaggaacggttagggaacggttagttacggtattaccggg

SEQ ID NO: 276463 - DNA, 903 bp, Homo sapiens
  misc_feature: GYAE6OF02IYD7L.19.53.E09.1.454.CMB.1.raw
tcagtactctcgtgcacgaccggtgctcgatttagagagagtgtgttgggtttggggggagaggagccccagccctgagattcccaggtgtttccattcagtgatcagcactgaacacagaggactcaccatggagttgagactgagctggattttcctttggcttatttaaaaggtgtccagtgtgaagtgcagctggtggagtcgtgggggagtcttggtacagccgtggactacggtccctgacgtacctctccgtgtgcagcctcgtggattccacctttgatgtaattgtcgacctagtgtaccgcgttcggggtcccgactaacggccgtaccgaagggggtaaccgggcccgttagggacggttcggggtccgttacggggtttattaagggtttagggaaagttaggtcgtaaccggtttaggttaaacgttacggtcccttaaggtcgggtaccgggtaaccgtttcgggttagggtaacggggaaaccggggtcccggtttaacttacccgtaaaccccgtacgtttaccgtacccggtaaaggtaacggaaacccgtaaaccggtaacccgtaaaaaccggttaacccgttacccccgttaaggtttaaacccgttccgtaaacggtaaccgtaaaaaacgttacccgggtaaaaccgttaaccgggttaccgttaacgggaaattaaacccggggtactttaaaccgggggaaccgggttaacccggtaacccgggtttaccccgttttaaggggttaacccgttttaaacccgggttacgggttaccggtaaaccccggttaaaacgggggttaaccgggtttaacggttaaacccgggaacccgtttaacccggggttaccccgttttaaagggttaaacccccggggg

SEQ ID NO: 276464 - DNA, 720 bp, Homo sapiens
  misc_feature: GYAE6OF02GV4GZ.19.53.E09.1.454.CMB.1.raw
  modified_base (215)..(215): a, c, t, g, unknown or other
  misc_feature (215)..(215): n is a, c, g, or t
  modified_base (351)..(351): a, c, t, g, unknown or other
  misc_feature (351)..(351): n is a, c, g, or t
tcagtactctcgtgcacgaccggtgctcgatttagagagagtgtgttgggtttgggaggcttggtacagcctggcaggtccctgagactctcctgtgcagcctctggattcacctttgatgattatgccatgcactgggtccgcaagctccgagggaaggcctggagtgggtctcaggtattagtggaatagtgctagtatagcctatgcgactntgtagaaggcctattcaccatctccagacgacaacgcaaagacctcctgtatctgacaaatcgaaacagtctagaagagtactaggacggacgacggtcctttagtaacttagtgtggacaaggtaggtatacganagtctacgtgggtaacctaacgtacgtaggggaccctaagggtaaccctcggtactacccggtctaccctacgacgtacccctaccaaccgaaacggggtcccacggttacccggttccctttaccccccggtcggtacccgtcccccgtacggtacccgttacccgaaacgggtaccgtacccgaaccccgttacccgggaaggaaccggtacccgaaccggtaaccggcccgggttaccccggtaggggtccctacgggttaccccgttaggggttaaccgaaaacgggttaccccttaacccggttacccgaacggttaacggtaaccggtaacgttagggaacgggtccggggtacgtaaccggg

SEQ ID NO: 276465 - DNA, 564 bp, Homo sapiens
  misc_feature: GYAE6OF02H1YC4.19.53.E09.1.454.CMB.1.raw
  modified_base (441)..(441): a, c, t, g, unknown or other
  misc_feature (441)..(441): n is a, c, g, or t
  modified_base (484)..(484): a, c, t, g, unknown or other
  misc_feature (484)..(484): n is a, c, g, or t
tcagtactctcgtgcacgaccggtgctcgatttagagagagtgtgttgggtttgggaggcttggtacagcctggcaggtccctgagactctcctgtgcagcctctggattcaccttttgatgattatgccatgcactgggtccggcaagctccaggggaaggcctggagtgggtctcaggtattagttggaatagtgctagtatagcctatgcggactctgtgaagggccgattccacatctccagagacaacgccaaagaacctccctgatctgcaaatgaaacagtctgagagctgaggacacggtccttagtattactgtgacaagggagtatagcagtctagtaggtacgactacgtcggggaccacggggtaaccctgggtccaccgtctcctcacgtcctaccgaccgaacggcccacgtccggtccttccccgnggccgcccgtcgcctccgacggcgccacccgtcgagacgcacncggccggcccgtgggctcgccgtggtcgaacggtcctaccgtacccgagtacgacgttacgtaggacggtcggctacggg

SEQ ID NO: 276466 - DNA, 754 bp, Homo sapiens
  misc_feature: GYAE6OF02JCRR1.19.53.E09.1.454.CMB.1.raw
  modified_base (382)..(382): a, c, t, g, unknown or other
  misc_feature (382)..(382): n is a, c, g, or t
tcagtactctcgtgcacgaccggtgctcgatttagagagagtgtgttgggtttgggaggcttggtacagcctggcaggtccctgagactctcctgtgcagcctctggattccacctttgatgattatgccatgcactgggtccggcaagctccgaggggaaggcctggagtgggtctcaggtattagttggaatagtgctagtatagcctatgcggactctgtgaacgggccattccaccatcctacagacgaccaacgaccaaagtacctccctagtactcgtagactaaatacgaacacttcggggggaaacggtacgcgtaggaaccgaccgtaccgttcgtttagtaacttacgtggtacggagaagggtacgttaanacggactacgtacttaacggtacggtaaccgacgttacggggtccgggaacccggtaaccgggtacccgtaccggttaccgtacccgttcccgtacctaccgtaccgtaccccgtaacccgaaccggtaccggtaccctacgttccccggttccccctttcccggcggtcccccgtcccgtcgtacccgtacggaccggtaccgacccgtacccggtaccgacgacccgaaccgaccgaccggggtacccggtccggtcgggtaccgtccggtacccggtacggtaaacccgtaaaccttaacccgttacccgttaaccggaacggtacggttaccgtccgggtaacgggaccgggtccgggtacgtacggg

SEQ ID NO: 276467 - DNA, 628 bp, Homo sapiens
  misc_feature: GYAE6OF02H8HJN.19.53.E09.1.454.CMB.1.raw
  modified_base (278)..(278): a, c, t, g, unknown or other
  misc_feature (278)..(278): n is a, c, g, or t
  modified_base (323)..(323): a, c, t, g, unknown or other
  misc_feature (323)..(323): n is a, c, g, or t
  modified_base (388)..(388): a, c, t, g, unknown or other
  misc_feature (388)..(388): n is a, c, g, or t
tcagtactctcgtgcacgaccggtgctcgatttagagagagtgtgttggggtttgggggggagaggagccccagccctgagattcccaggtgtttccattcagtgatcagcactgaacacagaggactcaccatggagttgagactgagctggtactttttccgttttggcttaattttaaaaggtgtccagtgtgaagtgcagctgggtggagtcgtaggggggagcgttggtaacaggccgtgggacagggtccctggagctctctgtgcagcctnggtatctactttgatgattatcgccatcgctacgtcgggtccganaagcctccgaggggaacggcctgggacgtgggtcctgtaaggtattaggtgaaatgtgatagtanacgtctatggacgtatcgtggtacgaacgggcaattcacgtactctaccgaagacgaccaaacgccgaaagtacctccctagtaactctgaaacctaaagttcgaaaccagttccgtagaacggagtaccgtaacggaacggaccgttaccgggttacccgtttaaggtaaccttttacggtcggttaacgaggtaaacgggtcggttaaagttaacgacgtaaggttccttaaccgggg

SEQ ID NO: 276468 - DNA, 559 bp, Homo sapiens
  misc_feature: GYAE6OF02GSOBJ.19.53.E09.1.454.CMB.1.raw
  modified_base (454)..(454): a, c, t, g, unknown or other
  misc_feature (454)..(454): n is a, c, g, or t
  modified_base (552)..(552): a, c, t, g, unknown or other
  misc_feature (552)..(552): n is a, c, g, or t
tcagtactctcgtgcacgaccggtgctcgatttagagagagtgtgttgggtttgggggggagaggagccccagccctgagattcccaggtgtttccattcagtgatcagcactgaacacagaggactcaccatggagttgagactgagctggattttccttttggctattttaaaaggtgtccagtgtgaagtgcagctggtggagtctgggggagcttggtacagcctgggcaggtccctgagactctcctgtgcagcctctggattcacctttgatgattatgccatgcacgtgggtccggcaagcctccgaggggaacgggccgtgggaggtggggtctcgaggtattaggttggaattagtgactagtatagcctagtcggcggtactcgtgtgaagggccattcacctatctaccagacgacaacgacaacgaacctcctagtactacnactaaatacgaactagtctagagacggctaggacggacgaccggtcgttagtaactttactggtacgacgtaagggtacggtaagttacgatacggtntaaccgg

SEQ ID NO: 276469 - DNA, 693 bp, Homo sapiens
  misc_feature: GYAE6OF02GQPER.19.53.E09.1.454.CMB.1.raw
  modified_base (285)..(285): a, c, t, g, unknown or other
  misc_feature (285)..(285): n is a, c, g, or t
tcagtactctcgtgcacgaccggtgctcgatttagagagagtgtgttgggtttggggagctctgggagaggagccccagccctgagattcccaggtgtttccattcagtgatcagcactgaacacagaggactcaccatggagttgagactgagctggtatttttccgttttggcttaattttaaaaggtgtccagtgtgaagtgcagctggtggagtcgtggggggagtcgttggtacaggcctggcaggtccctggacgactctcctgtgcacgtcctctggnttcctacctttgattgtatttatcgcctaagttcggactaccggtcggggtcccggactaacgtccctaccgggaagggggaacgggtcccgtagggacgggttcgggtcctacggtaaggttagtttagggtttaggtaaagttggtacgtagttaaagttagtacggtcctttaagtcgggccggtacttcgtaggtacgggaaacgggcccttaattcccaaccgtacttccgtaccgaagaacgtaaccaacccggaccaaagtaaccccttcctacggttaactccgtagaactaaagtacgaaactgtaccgaggacgtaggtacgtacgggaacggtaccgtaccgggttccttaaggttacttacgtggtacgaaaccggtagggttaacgtaggtaacg

SEQ ID NO: 276470 - DNA, 765 bp, Homo sapiens
  misc_feature: GYAE6OF02H2BL2.19.53.E09.1.454.CMB.1.raw
  modified_base (179)..(179): a, c, t, g, unknown or other
  misc_feature (179)..(179): n is a, c, g, or t
tcagtactctcgtgcacgaccggtgctcgatttagagagagtgtgttgggtttgggaggcttggtacagcctggcaggtccctgagactctcctgtgcagcctctggattcacctttgatgattatgccatgcacgtgggtccggcaagctccaaggggaagggcctggagtgggtctnaggtattagttggaatagtgctagtatagcctatgcggactctgtgaacgggccattcacatctccagagacaacgccaaagaacctccctgtatctgacaaatgaaacagtctagagagctaggaggaccgacggtcctttaggtattacgttggtacgacgtaaaagggtacggtaattagggacctaacggtaccttaacgttagggttaaacccgaaaccgtttacgggtaccgggggacccgaacggggggtaaaccccctgggtaccccgtaacccggttccctaccccgtacaaccggtcccctacccgaaacccggaaacgggggtcccccaacgttccccgggttacccgtttccccccgtacgggcccgttccccgttacggtccctacccggaagggccgacccgtaaccccgtaccggtaacgacggtacccaaccgtaacgggacccggtcccgtacgggggcccttcggtacccgttcggggtaaccgtaaaccgggtaccttaaccccgttaccccaacgggtaacggtacggttaaccgtacgggaacgggtcccgggtacggtaacggg

SEQ ID NO: 276471 - DNA, 718 bp, Homo sapiens
  misc_feature: GYAE6OF02HMYB9.19.53.E09.1.454.CMB.1.raw
tcagtactctcgtgcacgaccggtgctcgatttagagagagtgtgttgggtttggggggggagaggagccccagccctgagattcccaggtgtttccattcagtgatcagcactgaacacagaggactcaccatggagttgagactgagctggtattttccttttggctaattttaaaaggtgtccagtgtgaagtgcagctgggtggagtcgtgggggaggtcttggtacagcctgggcacggtccctgacgctcctcctggtgcacgcctctggtacttcctaccttttgattgtaatttatcgccaagttcgccgtacggttcggggtcccggcaaacggtccctaccggaagggggaacgggccgttaggggacgggttcggggttctcggtaagggttagtttaggttagggtaaagttaggtggtacgttaaggtaactacggtccttaagtcggtaccggtacgtttcgtggtaacgggacggggacccgtaattaccaacccgtacttccgtaacccgaaggaaccgaaaccgaaccggtaaccctaaaccggtaaacccttccccgttaaggttactaccgttacgaaacgtaaaagtccggaaaacttacggtcgtagaacggtacgtcgtacggaacggaccgtacggttacccgttagttaacgttacgtggtacgaggaaggtagtagtagtacgagtctaacgg

SEQ ID NO: 276472 - DNA, 808 bp, Homo sapiens
  misc_feature: GYAE6OF02IX7AU.19.53.E09.1.454.CMB.1.raw
tcagtactctcgtgcacgaccggtgctcgatttagagagagtgtgttgggtttgggggggagaggagccccagccctgagagttcccaggtgtttccattcagtgatcagcactgaacacagaggactcaccatggagttgagactgaggctggattttcctttggctattttaaaggtgtccagtgtgaagtgcagtcgtggtggagtcgtgggggagcttggtacagcctaggcacggtccctgagtactcgtaccgtgtagccaagtcctacgtggactttccgtacccttttaggacgtagtacttaacgtacggccctaagttcgacctaccggtcggggttccccgacgtaaacgtcccgttacccgaagggggtaaaccggggtccttacggggaagggttcggggttccctacggaaggggtttatttacgggttaggaaagttggtagtcgttaaggttactacgtacgtagtcggaccggttactgtacggtacgggtaaacgggtaccgtaacgttacccgaacccgttaacgtcccgttaacccgtaagggaacccggttaaaccaaacccggttaccccaaaaacggttaacccccttcccgttaaagtactttacccgtacgtaaacgtaaacgttacgtaaacccttaaggtaccttaacgggtaacggaccggttaccgtaagggtaccggtacgaccggtttaccgttgtttaaaccgttccggtaagtaaggttaaccggaaggggttaaggtaaccgttaacgggacgtaccgggtactttaacccggg

SEQ ID NO: 276473 - DNA, 592 bp, Homo sapiens
  misc_feature: GYAE6OF02IPJ0H.19.53.E09.1.454.CMB.1.raw
tcagtactctcgtgcacgaccggtgctcgatttagagagagtgtgttgggtttgggggggagaggagccccagccctgagattcccaggtgtttccattcagtgatcagcactgaacacagaggactcaccatggagttgagactgagctggattttccttttggctattttaaaaggtgtccagtgtgaagtgcagctggtggagtctgggggagcttggtacagcctggcaggtccctgagactctcctgtgcagcctctggattcacctttgatgattatgccatgcacgtcgggtccgcaagctccgagggaggcctgggagtgggtctcgaggtattaggtgaatagtgctagtatacgcctatcggcggtacttcgtggtaggaacggggtccgtagttccacctaattccgtaccaaggacgaacgaaaccgacccaaacggtaacccttcccgtagtaactccgtagaccaaagtcgaaactaggttctagaggtacgcgtaggaggaccacggtccgttaggttaacttacgtagttacggacgtaagggtaacgggttataacggacgtacgacgttaacgg

SEQ ID NO: 276474 - DNA, 774 bp, Homo sapiens
  misc_feature: GYAE6OF02IXEV1.19.53.E09.1.454.CMB.1.raw
  modified_base (226)..(226): a, c, t, g, unknown or other
  misc_feature (226)..(226): n is a, c, g, or t
tcagtactctcgtgcacgaccggtgctcgatttagagagagtgtgttgggtttgggggggagaggagccccagccctgagattcccaggtgtttccattcagtgatcagcactgaacacagaggactcaccatggagttgagactgagctggattttcctttggcttaattttaaaaggtgtccagtgtgaagtgcagctggtggagtcgtgggggagcttggacngccgtggcacggtccctgagactctcctgtcgcacgccttcgtggatttccgaccttttggacttggtaatttagcgtacccagttcgaccgtacgttcggggtaccggactaaggtccgtaccggaagggggtaacgggtcccgttagggtacggttcgggggttaccttacggtaagggtttaagtttacgggttaacgggtaaacgttacgggttacgtacgtttaaagttacggttaacgttacccgtttaagtcgggtaccgggttaacctttcggtagggtacggtaaacggggtacccgttaagtttacctaacccgtacgttccgtaacccgaaggtaaaccgacccgtaaacccggtaaccgaaacgtaaacccttcccgttagttaacgtccgtacgtaacctaaagtacgaaacgtacgttacgtaggaacgtacgtacgtacggtaacggacgtaccggttaccgtttacgttacttacgtcggtacgtaacggtaacgggttaggtacgtacggacgttacggtacgttaaccgg

SEQ ID NO: 276475 - DNA, 328 bp, Homo sapiens
  misc_feature: GYAE6OF02GE1CL.19.53.E09.1.454.CMB.1.raw
  modified_base (174)..(174): a, c, t, g, unknown or other
  misc_feature (174)..(174): n is a, c, g, or t
  modified_base (232)..(232): a, c, t, g, unknown or other
  misc_feature (232)..(232): n is a, c, g, or t
  modified_base (259)..(259): a, c, t, g, unknown or other
  misc_feature (259)..(259): n is a, c, g, or t
  modified_base (267)..(267): a, c, t, g, unknown or other
  misc_feature (267)..(267): n is a, c, g, or t
  modified_base (270)..(270): a, c, t, g, unknown or other
  misc_feature (270)..(270): n is a, c, g, or t
  modified_base (272)..(272): a, c, t, g, unknown or other
  misc_feature (272)..(272): n is a, c, g, or t
  modified_base (274)..(275): a, c, t, g, unknown or other
  misc_feature (274)..(275): n is a, c, g, or t
  modified_base (282)..(282): a, c, t, g, unknown or other
  misc_feature (282)..(282): n is a, c, g, or t
  modified_base (284)..(328): a, c, t, g, unknown or other
  misc_feature (284)..(328): n is a, c, g, or t
tcagtactctcgtgcacgaccggtgctcgattttagagagagtgtgttgggtttggggacagactttcacctctcaccatcagcagcctgcaggctgaagatgtggcagttttattactgtcagcaagtactatagtactccgtctctactttcggcggagggaccaaggtganatcaaacgactgtggctgcaccagtctgtcttcagttccttcccgcatctgacacganagtacctgagtcggctggaccaaggcnctaagtanctnancnngctgagngnnnnnnnnnnnnnnnnnnnnnnnnnnnnnnnnnnnnnnnnnnnnn

SEQ ID NO: 276476 - DNA, 778 bp, Homo sapiens
  misc_feature: GYAE6OF02HCHLJ.19.53.E09.1.454.CMB.1.raw
  modified_base (257)..(257): a, c, t, g, unknown or other
  misc_feature (257)..(257): n is a, c, g, or t
tcagtactctcgtgcacgaccggtgctcgatttagagagagtgtgttgggtttggggagctctgggagaggagccccagccctgagattcccaggtgtttccattcagtgatcagcactgaacacagaggactcaccatggagttgagactgagctggtatttttcctttggcttaattttaaaaggtgtccagtgtgaagtgcagcgtgggtggagtcgtggggggagtcgttggtacagccgtggcacggtcccngacgctctcgtgtcgcacgtcctgtggtacttctactttggatgtattatcgacctagtcgcgtacggtcgggtccgactacgtccgtacgggaggggaacgggccgtgggtacggtcgggttcctacggttagggttaacgtttaagggttacggtaaagttaggtcgtaacgttaaggtaacgtacgtaccgttaggtccggtaccggtaccgttggtaggtacggggtaaccggggtaccttacggttacccaacccgttacgttacccgtaacgaaacggtaacccggaaaccgaacccgtaaccgaaaccgttaacccgttcccgttaaggttaccttacggttaacgaaactaaacgtcgtaaacgttaacggttaccgtaagggtaacggtagtaccgggtaacgggtaccgggtaaacccggttaccggttaccgttttaacggtttaaccgtttacgggttacgggtaaaccgggttaagggtaaacgggggttacgttaacggaacccggg

SEQ ID NO: 276477 - DNA, 652 bp, Homo sapiens
  misc_feature: GYAE6OF02GZOIC.19.53.E09.1.454.CMB.1.raw
  modified_base (648)..(648): a, c, t, g, unknown or other
  misc_feature (648)..(648): n is a, c, g, or t
tcagtactctcgtgcacgaccggtgctcgatttagagagagtgtgttgggtttggggagctctgggagaggagccccagccctgagattcccaggtgtttccattcagtgatcagcactgaacacagaggactcaccatggagttgagactgagctggtatttttccttttggcttattttaaaaggtgtccagtgtgaagtgcagctggtggagtcgtgggggagcttggtacagcctggcaggtccctgagactctcctgtgcagcctctggtacttctacctttgaattgtaatttacgcgcctagtcggcctacggtcggggtccggacaacgtccgtacccggaggggaacggtccgtgggacgggttcgggtctacggtaggtttagtttacggttaggaaacgttggtgtacgtttaaggtaagtacggtccttaagtcgggaccggtacttccgtggtacggacggggtacctattccgaacctactcctacgtaagaacgaaccaaccgaccaaacgtaacctccctagtactacgtagactaagtagaaacagtacgtacgagtacgtacgtaggaaccgggactaaccgggttctttaacgttaacgttcgtaggtcgaacggtaaggtacggttanacgg

SEQ ID NO: 276478 - DNA, 703 bp, Homo sapiens
  misc_feature: GYAE6OF02GL88Z.19.53.E09.1.454.CMB.1.raw
  modified_base (207)..(207): a, c, t, g, unknown or other
  misc_feature (207)..(207): n is a, c, g, or t
  modified_base (266)..(266): a, c, t, g, unknown or other
  misc_feature (266)..(266): n is a, c, g, or t
  modified_base (287)..(287): a, c, t, g, unknown or other
  misc_feature (287)..(287): n is a, c, g, or t
tcagtactctcgtgcacgaccggtgctcgatttagagagagtgtgttgggtttggggagctctgggagaggagccccagccctgagattcccaggtgtttccattcagtgatcagcactgaacacagaggactcaccatggagttgagactgagctggattttcctttggctatttaaaaggtgtccagtgtgaagtgcagctgggngagtctgggggagcttggtacagcctggcaggtccctggagactctcctgtgcagcctntggattcactttgatgattancgccatcgctacgtcgggccgacaagcctaccgaggggtaacgggccttagggacggttcgggtcctacgtagggttacgttaggtttaggaaacgttaggtcgacttacggttaatacggtaccctaagtgggaccggtaacgtttcgtagggtttaccggaaacgggggttcccgtaacgtttcccgaacccgtagttaccccgtaccgtaaacgggtaacgaaacccttaaaccgggacctaaaacgggtaaacccgtccccgttagggtaaccttaccggtaccgaactaaacgttcgaaaaccgtcggttagtacggacggagtccgttaggaacgggtaaccctaaccggggttccttacggttaacttacgtcgggttaccgacgttaaacggggtagttacgtaacgg

SEQ ID NO: 276479 - DNA, 828 bp, Homo sapiens
  misc_feature: GYAE6OF02GZB40.19.53.E09.1.454.CMB.1.raw
  modified_base (266)..(266): a, c, t, g, unknown or other
  misc_feature (266)..(266): n is a, c, g, or t
tcagtactctcgtgcacgaccggtgctcgatttagagagagtgtgttgggtttgggggggagaggagccccagccctgagattcccaggtgtttccattcagtgatcagcactgaacacagaggactcaccatggagttgagactgagctggtatttttccttttggcttattttaaaaggtgtccagtgtgaagtgcagctggtgagtcgtgggggagtcttggtacagcctggcaggtccctgagacctctcctgtgcagcctntggtattctacctttgatgtattatgcctagtgacgacgtcggggtccgacgaacgccgtaccggaaggggaacggtcccgtagggtacggttcggggtccttacggtaagggtttaagtttagggttaacgggtaaagttaggttacgtaccgttaaagttaacgttaacggtacccttaggtaccggtaccggggtacctttaccgggttaggggttaacggggtaaacccgggtacccggttaaacgtttacccgtaacccgttaaccgttacccgttaacccgaaagggtaaacccgaaacccgtaaaacccggtaaccccgtaaaaccggttaaaccccttttaccccgttttaaacttacccgtaaccggtaaacccgtaaaaagttaccggaaaaccgtacggttaccgttaggaaacgtacgtacgttaacgggaacgggtacccgtacgggttaccgttttacggttaaacgtttaccggttacggtaacggtaacggtaaaggggttacgttaacggtacgaaccgtacggttaccgttacggttaaccggg

SEQ ID NO: 276480 - DNA, 731 bp, Homo sapiens
  misc_feature: GYAE6OF02IZ0YC.19.53.E09.1.454.CMB.1.raw
  modified_base (701)..(701): a, c, t, g, unknown or other
  misc_feature (701)..(701): n is a, c, g, or t
tcagtactctcgtgcacgaccggtgctcgatttagagagagtgtgttggctctgggagaggagccccagccctgagattcccaggtgtttccattcagtgatcagcactgaacacagaggactcaccatggagttgagactgagctggtatttttcctttggcttaattttaaaaggtgtccagtgtagaagtgcagctggtggagtcgtgggggagtcttggtacagcctggcgacggtccctggacgtacctctccgtgtcgcgactcctcgtaggtacttcgtaccgtttgattcgtaatttagtcgtacctagtcgtccgtacggtcgggggtcccgaacgaacggtccgtaaccggaacggggaaacgggtcccgtaggggtacggttcggggtcctaggttaaacgggttaagttttagggttaacggtaagtttaacggtacgtaacgttaagtaacgttacgtacccgttaagtccgggtacggtaccttacgtaggttaaccggaaaggggtcccgtaacgttacaacccgtactaccgtaccccgaaaggaacccgtaaaccgaaacccgaccctaaaacgtaacccgtttaccccttagtaactcgttaaggaacctaaagtgtaaacagttacgagtacgacgtagtcgaacggtaccgtccgggttattacgttaagtagttcggtanaacggtaagggtagttaagtcgaaccgtag

SEQ ID NO: 276481 - DNA, 666 bp, Homo sapiens
  misc_feature: GYAE6OF02JE0JE.19.53.E09.1.454.CMB.1.raw
tcagtactctcgtgcacgaccggtgctcgatttagagagagtgtgttgggtttgggggggagaggagccccagccctgagattcccaggtgtttccattcagtgatcagcactgaacacagaggactcaccatggagttgagactgagctggtatttttccttttggcttaatttttaaaaggtgtccagtgtgaagtgcagctggtggagtcgtgggggagcttgggtacagcctggcaggtccctgagctctcctgtgcagcctcgtggtacttccaccgttttgattgatttatcgccattcgactacgtcggggtcccgactaagccgtaccggaagggggaacggccgtagggacggttggggtcctagtaagggttaactttagggttaggaaacgttggtgtacgttaagtagtacgccttagtcggcggtactcgtggtaggtaacggggccctaacttccgaaccctattccgtacccgaagtacgaaaccgaaccgtacccaaacggttaaccctcccgtaattactcgtaagaccaaattcggaaacctaggtccgtagacgacgacgtagacggaccgtcggaccttttggtaacctttacgtaggtacgaacggtaaggtacggttaactacgggtacctaggtccttaacgg

SEQ ID NO: 276482 - DNA, 664 bp, Homo sapiens
  misc_feature: GYAE6OF02JCS66.19.53.E09.1.454.CMB.1.raw
  modified_base (286)..(286): a, c, t, g, unknown or other
  misc_feature (286)..(286): n is a, c, g, or t
  modified_base (290)..(290): a, c, t, g, unknown or other
  misc_feature (290)..(290): n is a, c, g, or t
tcagtactctcgtgcacgaccggtgctcgatttagagagagtgtgttgggtttgggaggcttggtacagcctggcaggtccctgagactctcctgtgcagcctctggattcacctttgatgattatgccatgcactgggtccggcaagctccagggaaggcctggagtgggtctcaggtattagttggaatagtgctagtatagcctatgcggactctgtgaaggccgattcaccatctccagacgacaacgccaagactccctgtatctgacaatgaaccagtcngagngctggaggacaccggcctttgtacttacgtgtcgacgaaaggaggtaatacggtcaagtccttaacgttcggtaaccgtaaccgttacggtagggggacccaacggggaaaccccttgggtaccctacccggtcctccctacgacgtccccgtaccgaacccgaacgggccctacgtccggttacccttcccccgtcggtcccgtccccgttccgtccgtcccgtacgggtaccgaccgtacccgtacccggtaggaaccgcctaaccgaccggtccggcccgttacgggccgttccggccggtaccgggtacgaaaccggtctaacccgttccccgaaggtacgacggtacgtcggacggtccggcgtacggg

SEQ ID NO: 276483 - DNA, 475 bp, Homo sapiens
  misc_feature: GYAE6OF02G8FZK.19.53.E09.1.454.CMB.1.raw
  modified_base (244)..(244): a, c, t, g, unknown or other
  misc_feature (244)..(244): n is a, c, g, or t
  modified_base (260)..(260): a, c, t, g, unknown or other
  misc_feature (260)..(260): n is a, c, g, or t
  modified_base (410)..(411): a, c, t, g, unknown or other
  misc_feature (410)..(411): n is a, c, g, or t
  modified_base (415)..(475): a, c, t, g, unknown or other
  misc_feature (415)..(475): n is a, c, g, or t
tcagtactctcgtgcacgaccggtgctcgatttagagagagtgtgttgggtttggggtgccgaagttgctggagggcacggtcaccacgctgctgagggagtagagtcctgaggacacggccttgtattactgtgcaaggaggtatagcagctactggtacgactacgtggggccaggggaacccctggtcaccgtctcctcagccctccaccgaacgggcccatcggtccttccccctggccnccctgcctccgaggcncacctccgagacgcacacggccggcccctggggcctcgcccttgggtacaaacggggtacctaccgttaccccgacgaagtacggtacgtggacgggccggggtaccgtggggacgaacggggtcccggactaacgttaggctgcacgtnnacgnnnnnnnnnnnnnnnnnnnnnnnnnnnnnnnnnnnnnnnnnnnnnnnnnnnnnnnnnnnnn

SEQ ID NO: 276484 - DNA, 631 bp, Homo sapiens
  misc_feature: GYAE6OF02GQ5RG.19.53.E09.1.454.CMB.1.raw
  modified_base (247)..(247): a, c, t, g, unknown or other
  misc_feature (247)..(247): n is a, c, g, or t
  modified_base (295)..(295): a, c, t, g, unknown or other
  misc_feature (295)..(295): n is a, c, g, or t
  modified_base (567)..(567): a, c, t, g, unknown or other
  misc_feature (567)..(567): n is a, c, g, or t
tcagtactctcgtgcacgaccggtgctcgatttagagagagtgtgttgggtttgggaggcttggtacagcctggcaggtccctgagactctcctgtgcagcctctggattcacctttgatgattatgccatgccacgtgggtcccggcaagctccaggggagggcctggagtgggtctcgaggtattaggttggaatagtgctagtatagcctatgcgactctgtgaacgggcctattcaccatccnccagacgacaacgccaaagaacctcctagtatctgactaaatgaaacngtcctgaagcgactggacgacgtaccggctttagtaacttcttaggcgtacgaagggtattaagtaagctaaggccttaagtcggtaaccacgttacggtcggggaccaacgggtaaccctgggtacccaccgttctccctacgacgcccctaccgaacccggaacggaccctaacgttcccggtccctttacccccggtggtccccgtaccctcgaccctccgacggccgaccacccgtccgagaccgcaacgcggcccgtccgcgtccgngtcccgtggcgaacgtacctaccgttacccgagaacgtcgtagtcggacggtccggacgtcggg

SEQ ID NO: 276485 - DNA, 886 bp, Homo sapiens
  misc_feature: GYAE6OF02IDZK3.19.53.E09.1.454.CMB.1.raw
tcagtactctcgtgcacgaccggtgctcgatttagagagagtgtgttgggtttggggggggagaggagccccagccctgagattcccaggtgtttccattcagtgatcagcactgaacacagaggactcaccatggagttgagactgagctggtactttttccttttggcttaagttttaaaaggtgtccagtgtgaagtgcagcgtggtggagtcgtgggggagtcttggtacagccgtgggcgtacggtccctaggacgtacttcctccgtggtcgcgacggtcccttcgttaggtactttaccgttaccgtttttagaacgttaggtaaattttacgtcggtacccttaagttccgggtaccccgtaaccggggttccgggggggttaccccgggaaaccgtaaaccgggtacccggttaaccccggggaaggggggggtaaaccgggtcccgggttagggggttacgggttacggggggttaccttaccgggtaaagggggttttaacgtttaaggggtttacgggtaaagttaacggtaggtacgttaagtacgtaacgtacctaggttacggccggtaacgtttggtcgggtaagggaaccgggtactaccttacgaccctaactaccgtaaccgaaggaaccgaaaccgtaaccgaaaccgtaaaccgttaaccccttaccgtaacggttactacgtaaccgtaaacgtaaaacgttcggaaaacgttacggtactaaagggacggtaaccggacggtaacgggtaaccggtaaccgggtaccccggttttcgtttaaggtttaaccgttaacgggtgttaaccggaacgggttaagggtaagggttaacgacggtaaccgaccggtacgtttaacggg

SEQ ID NO: 276486 - DNA, 461 bp, Homo sapiens
  misc_feature: GYAE6OF02I0JGL.19.53.E09.1.454.CMB.1.raw
  modified_base (257)..(257): a, c, t, g, unknown or other
  misc_feature (257)..(257): n is a, c, g, or t
  modified_base (396)..(396): a, c, t, g, unknown or other
  misc_feature (396)..(396): n is a, c, g, or t
  modified_base (398)..(398): a, c, t, g, unknown or other
  misc_feature (398)..(398): n is a, c, g, or t
  modified_base (404)..(404): a, c, t, g, unknown or other
  misc_feature (404)..(404): n is a, c, g, or t
  modified_base (407)..(461): a, c, t, g, unknown or other
  misc_feature (407)..(461): n is a, c, g, or t
tcagtactctcgtgcacgaccggtgctcgatttagagagagtgtgttgggtttgggtgccgaagttgctggagggcacggtcaccacgctgctgagggaatagagtcctgaggacacggccttgtattactgtgcaaggaggtatagcagctactggtacgactacgtggggccagggaaccctggtcaccgtctcctcagcctccaccaagggcccatccggtccttccccctggccgcccttgcctccgaggacnccacctccggagacgaccacgaggcccggcccgtggggccttcggaccccgttgggtaccgaaacgggtacttaccgttaccccgaagtagacgttactggcggacggggcgtggaccgaagggccacgaactaggctncngcagtnacnnnnnnnnnnnnnnnnnnnnnnnnnnnnnnnnnnnnnnnnnnnnnnnnnnnnnnn

SEQ ID NO: 276487 - DNA, 611 bp, Homo sapiens
  misc_feature: GYAE6OF02ILQU9.19.53.E09.1.454.CMB.1.raw
  modified_base (189)..(189): a, c, t, g, unknown or other
  misc_feature (189)..(189): n is a, c, g, or t
  modified_base (239)..(239): a, c, t, g, unknown or other
  misc_feature (239)..(239): n is a, c, g, or t
tcagtactctcgtgcacgaccggtgctcgatttagagagagtgtgttgggtttggggagctctgggagaggagccccagccctgagattcccaggtgtttccattcagtgatcagcactgaacacagaggactcaccatggagttgagactgagctggtatttttccttttggcttaattttaaaaggngtccagtgtagaagtgcagcgtggtggagtcgtgggggagcgtttggacngccgtggcaggtccctgagctctcctgtgcaggcctcgtggacttctaccttagtatgtattactgctactcgctacgtggtccgcgtaacgtctccgaagggaacggccgtagtaggtggtacgtcgtaggtgttaaaaaagtggaagtacgtagtcgtagtagtacgtcgtatagtacgacgtcgtgtacgtaagggaccgtacgttacgacctagtctacgaacgagaacgaacgaaccgtaacgaaccgtaccgtactaactccgtacgacaaacgttacgaactacgtacgtacgagacgagtaggtaacgaccgaccggtacgttacgtagttacctcggtagtaccggtaaaggtagtagtacgg

SEQ ID NO: 276488 - DNA, 701 bp, Homo sapiens
  misc_feature: GYAE6OF02I9Q9F.19.53.E09.1.454.CMB.1.raw
  modified_base (678)..(678): a, c, t, g, unknown or other
  misc_feature (678)..(678): n is a, c, g, or t
tcagtactctcgtgcacgaccggtgctcgatttagagagagtgtgttgggtttgggggggagaggagccccagcccctgagattcccaggtgtttccattcagtgatcagcactgaacacagaggactcaccatggagttgagactgagctggtatttttccttttggcttaattttaaaaggtgtccagtgtagaagtgcagtcgtgggtggagtcggtgggggagtcgttggtacagcctggcacggtcccctgaacgtaccttctccgtgtcgcagtccctcgtaggtacttcctaacctttgattgtaattagtcgacctagtcgacctacggttcgggtacccgacgaacgtcccgtacgggaagggggtaccgggtaccgtagggtacgggttcggggtctaaccgtaaggtttaagtttaacgggttaggtaaacgttggtacgtagttaagtaatacgtaccttaagtcggaccgtacttcgtacgggtacggaacggtccgtaactaccgactacgtcaccgagaacgtaacaaccgacaacgtacccttcctagtacctagtacgaactaaacgtacgaactacgtacgaagtcgaacgtagtacggacgaccggtaccgtttacgtaggttaacctttagtcggtaacgaggtaacggtaaggttanaacggtctaacggtcgttaacgg

SEQ ID NO: 276489 - DNA, 712 bp, Homo sapiens
  misc_feature: GYAE6OF02JNX2B.19.53.E09.1.454.CMB.1.raw
  modified_base (209)..(209): a, c, t, g, unknown or other
  misc_feature (209)..(209): n is a, c, g, or t
  modified_base (448)..(448): a, c, t, g, unknown or other
  misc_feature (448)..(448): n is a, c, g, or t
  modified_base (615)..(615): a, c, t, g, unknown or other
  misc_feature (615)..(615): n is a, c, g, or t
  modified_base (695)..(695): a, c, t, g, unknown or other
  misc_feature (695)..(695): n is a, c, g, or t
tcagtactctcgtgcacgaccggtgctcgatttagagagagtgtgttgggtttgggggggagaggagccccagccctgagattcccaggtgtttccattcagtgatcagcactgaacacagaggactcacatggagtgagactgagctggattttctttggctattttaaaggtgtcagtgtgaagtgcagctggtggagtctgggggngcttggacagcctggcaggtcctgacgactctcctgtcgcagccttcaggattcacctttgattgagtttatggacctagtcggaccgacgttcggggtcccggacgaaacggtccgtaccggaagggggtaacgggcccgtagggtacgttcgggggtactccgtaagggtatttacggtgggtaaatcggttaggcgttaagtacgttacggcccttaaggtcggacggtaaccttntgggtaacggtaaacggggtcccgtatttacccggaaacccttgtaccgttcccgaaaggaccgaaccgaaaccgtaccgtaaaacggtaaccctcccgttaggttaaaccttgttaacgaaccctaaaagttcggaaacctaagggttcctaagggtacggaaacnccggtttagaacggaccgtacggttcttacggtaagttttagtaccggttagaccgtaagggtaccgggttataacccgngtaaccggtctaacggg

SEQ ID NO: 276490 - DNA, 931 bp, Homo sapiens
  misc_feature: GYAE6OF02HS5HW.19.53.E09.1.454.CMB.1.raw
tcagtactctcgtgcacgaccggtgctcgatttagagagagtgtgttgggtttggggggagaggagccccagcccctgagattcccaggtgtttccattcagtgagtcagcactgaacacagaggactcaccgatggagttgagactgagctggtacttttccgtttggacttaattttaaaggtgtaccagttgtagaagtgcgagtcgtaggtggacggttccggtgggggagtcgtttcggtacgacgtccgttaggccgtacggtcccgttggacgtaccgttcgtccgtgtcgtcacgtccttcgtacggtacttaccgtaccgtttgtaacgttgtaatttacgttacggaccccttagttaccggtaccgtacggttaccggggtcccgaaccggtaaccgtcccttaccgggaaggggtaacccggtacggtacgggtacggttacggttaccgtacgttaacggtttaacgttttacgggttaacggtaacggttaacggtcgttaaacgtttaggttaaaccgtaccgttaaccgtaacggttaccggaccggttaaccgtttcggtacgggtaacggtaaacccgggtccgttaaaccgtttcccgaaacccgttacgttaccgtaaccgaacgggttaacgaacccgttaaacccgacgtaaaaccgtccccgttaacccgttagtaaccgttactaaccgggtaaaccgttaacgtaccgggtaaacccttagtttaccccggagtaaaccggttcgaaccggtttaccgtaacccgggaacccgtttcccggttaacgtttttaacgggttaaaccccggtttacgttacccggggttaaggaacccggttaaacggggtttaacgtacccggttaacccggtaggttaacccccggttcgttttaaaacccggggg

SEQ ID NO: 276491 - DNA, 826 bp, Homo sapiens
  misc_feature: GYAE6OF02FH90O.19.53.E09.1.454.CMB.1.raw
tcagtactctcgtgcacgaccggtgctcgatttagagagagtgtgttgggtttgggggggagaggagccccagccctgagattcccaggtgttccattcagtgatcagcactgaacacagaggactcaccatggagttgagactgagctggattttccgtttggcttaattttaaaggcgtccagtgtgaagtgcagctggtcggagtcgtgggggagccttagggtaccaggtcctgggacctagggtcccctggacgtaccttctacctgtcgcgagtcctccgtggaactttccgaacctttttggaacttggtaatttacgtcggacccctaattcggaccgtaacgttcgggggtaccccgtaacaaacggtccgttaccggaaacgggggaagggtcccgttaggggtacggttcgggggtaccttacggaaggtttaactttaggggttacggaaaagttcggtttacggaccgttaaaaggtttctaaaccggtccctttaaagtggggaacccgttaacgtttccggttaggtaaccgggtaaacgggcccgttaacgttaccaaccccgtaacgtttaccgtacccgaagtaaccggtaaccgaaaccggtaacccgtaaaaccgttaaccttcccggtaacgttacgttaccgtaacggtaaccaaacggttcgtaaaccgtacggtcgttaaaggacgtacggaccgttacggaacggtacgtaccgggttacttacggttaacgttaccgttcggtacggtaaccgtaagggtacgtttaacggaccgttaacggtaccgtacgttaaccggg

SEQ ID NO: 276492 - DNA, 367 bp, Homo sapiens
  misc_feature: GYAE6OF02GDPRD.19.53.E09.1.454.CMB.1.raw
  modified_base (271)..(271): a, c, t, g, unknown or other
  misc_feature (271)..(271): n is a, c, g, or t
  modified_base (342)..(342): a, c, t, g, unknown or other
  misc_feature (342)..(342): n is a, c, g, or t
  modified_base (350)..(367): a, c, t, g, unknown or other
  misc_feature (350)..(367): n is a, c, g, or t
tcagtactctcgtgcacgaccggtgctcgatttagagagagtgtgttgggtttgggtgccgaagttgctggagggcacggtcaccacgctgctgagggagtagagtcctgaggacacggccttgtattactgtgcaaggaggtatagcagctactggtacgactactggggccagggaaccctggtcaccgtctcctcagcctccaccaaggccccatccggtccttccccctggccgccctgcctcccaggacgcacctccgagagcacngccggcctgggctgcctggtacaaggactacctcccaagagagtaccgtggagcgggctgggacaagggcncgtatagnnnnnnnnnnnnnnnnnn

SEQ ID NO: 276493 - DNA, 804 bp, Homo sapiens
  misc_feature: GYAE6OF02G9M20.19.53.E09.1.454.CMB.1.raw
  modified_base (260)..(260): a, c, t, g, unknown or other
  misc_feature (260)..(260): n is a, c, g, or t
  modified_base (491)..(491): a, c, t, g, unknown or other
  misc_feature (491)..(491): n is a, c, g, or t
tcagtactctcgtgcacgaccggtgctcgatttagagagagtgtgttgggtttggggagctcgtgggagaggacgccccagccctgagacttcccgaggtgtttccattcagtgactcagcactgaacacagaggactcaccagtggagttgagactgagcgtggtatttttccgtttggactttaagttttaaaggtcgtacctaggtgtagaagtgcgagtcgtgggtggagtcggtgggggtacgtcgttaggtacncggtccgtggacgtacggtccctagacgtactcgtccgtgacgcacgtccgttgtcggtaacttcgtaccttttggacttggtaactttcgacgtcctaagtcgtaccgtacggtttcgggaccgtaacgtaccggtacgttaccgggaaggggtaacccggggtcgtaaggggtcggttccggttataaccgggttaaggttaggttagggtaggtaacgttaccgggtntaggtttaaacgtagttacccggtacgtttaggacggtacgtaccgttagggtcgggtaacggtaaccgggtacccgttacgtaaccgtaccggttactaccggttacgaaacggtaaccgaaccgtaacccggaaccgtaaacgtacccgtcccgttaaggtacccgttacgtaaccggtaacaaacggtttaccggaaaccgtacgtacgttacggaccgggttactaaccgggccggtaaacggtcccggtaccggttaaccgtttacgttaagtccggtgtaaccggacgtaaagggttcgattacggg

SEQ ID NO: 276494 - DNA, 767 bp, Homo sapiens
  misc_feature: GYAE6OF02FHM00.19.53.E09.1.454.CMB.1.raw
  modified_base (295)..(295): a, c, t, g, unknown or other
  misc_feature (295)..(295): n is a, c, g, or t
  modified_base (311)..(311): a, c, t, g, unknown or other
  misc_feature (311)..(311): n is a, c, g, or t
tcagtactctcgtgcacgaccggtgctcgatttagagagagtgtgttgggtttgggggggagaggagccccagccctgagattcccaggtgtttccattcagtgatcagcactgaacacagaggactcaccatggagttgagactgagctggatttttcctttggcttaatttaaaaggtgtccagtgtagaagtgcagctggtggagtcgtgggggagcgttggtacaggcctggcacggtccctggacgactcctccgtgtacgctacggcctcgtggacttcaccttttagntgtattatcgcagtcnccgtacgtcgggtccgcaacgcctaccggagggaacgggccgtagggacggttggggtctacggtaggttacttagggtacgggaattaggtcggtaacgtacgtaagtacgtccgttaaggtccggtacggacttcggtaggtacgggtaacgggcctaacgtcccgtaactcgtaccgtacgtaacggaacgaaccgaaccgtaaccgaaacgttaacccctacccgttagttaaccttaccggacgtaaccgtaaaagtaccgaaaaccgttcggtaaccgttaacgggaaccgtacgggaccggttaacggggaaccgggttaacccggtaccgggttacccgttttaacgggttaaaccgtttaccggttaacggtaccggtaaaccgggttaaacggggttaaggtaaacgggttaaccgaccggtttaacgggtacccgtttaacgggg

SEQ ID NO: 276495 - DNA, 753 bp, Homo sapiens
  misc_feature: GYAE6OF02HA1NG.19.53.E09.1.454.CMB.1.raw
  modified_base (245)..(245): a, c, t, g, unknown or other
  misc_feature (245)..(245): n is a, c, g, or t
tcagtactctcgtgcacgaccggtgctcgatttagagagagtgtgttgggtttgggggggaggaggagccccagccctgagattcccaggtgtttccattcagtgatcagcactagaacacagaggacctcaccagtggagttgagactggagcgtggtattttcctttagggacttaattttaaaaggtgtaccagtagtagaagtgcagcgtggtggagtcgtaggggaggtccttaggaacngtccgtggcgtaacggtccgtagaacgtcgttccgtccgtgtagcctacggtcccttggtacggtattaccgtaaccttgggaaacttggttaaatttacgacggtaacttacgacgtaccggtaacgtttccgggtacgaacgttcgaccgttaacgggaacggggtaacggtaccgtaggttaagggtcggtctaaccggtaggttacgttaacggttaagggaaatccgttagggtaactagttagaccgtacttacgtagggttaccgaccttggttaacgtaagggtaaccggtcggtaacggttaaccaaccgtacttaccgaacggttaacgaacgaaaccgaacgtaaccggtaaactacctacccgtagttaacgtccgtaagaaactaacgtaacgaaccgttagacgttaagagacgacgtagaacggaccgtaacgtctaagttactaccgtgtaacgagttaagggaccaggtacgtaacgacgtagtaaaccgg

SEQ ID NO: 276496 - DNA, 415 bp, Homo sapiens
  misc_feature: GYAE6OF02JBUA5.19.53.E09.1.454.CMB.1.raw
  modified_base (378)..(378): a, c, t, g, unknown or other
  misc_feature (378)..(378): n is a, c, g, or t
  modified_base (389)..(389): a, c, t, g, unknown or other
  misc_feature (389)..(389): n is a, c, g, or t
  modified_base (396)..(415): a, c, t, g, unknown or other
  misc_feature (396)..(415): n is a, c, g, or t
tcagtactctcgtgcacgaccggtgctcgatttagagagagtgtgttgggtctcaggtattagttggaatagtgctagtatagcctatgcggactctgtgaagggccgattcaccatctccagagacaacgccaagaaactccctgtatctgcaaatgaacagtctgagagctgaggacacggccttgtattactgtgcaaggaggtatagcagctactggtacgactactgggccagggaaccctggtcaccgtctcctcagcctccaccaagggcccatcgtctccccctggcgaccctgctccaggagcacctccgagacgcacagccggacctggctcgctgtcaagactactcccacgagagtactgagcggntggacaaggcncagtagnnnnnnnnnnnnnnnnnnnn

SEQ ID NO: 276497 - DNA, 817 bp, Homo sapiens
  misc_feature: GYAE6OF02JMZLH.19.53.E09.1.454.CMB.1.raw
tcagtactctcgtgcacgaccggtgctcgatttagagagagtgtgttggctctgggagaggagccccagccctgagattcccaggtgtttccattcagtgatcagcactgaacacagaggactcaccatggagttgagactgagctggattttcctttggcttaattttaaaggtgtccagtgtagaagtgcagctggtggagtcggtggggaggcttaggtacagccgtagggcacgggttcccctggacgtacctccgttccgtggtacgctacggcccttcgttgggtactttccgtacttttacgggattacgtaagtttacgttccgacccgtagttccgggacctaccggggttcgggggtaccccggacgttaaccgggacccgttacccggggaacgggggtaacgggtccccgttaggggtacgggttcggtacggtaccgtaaggggttaacttttacgggtaggtaaagtaggttacggtacttaggttaaacgtacggtaccgttaggtaccgggtacggttaccgttacggttacggtaacgggaaccgggtcccgtaacgtttacccgtaacctacgttccgtaacccgaaggacggtaaacccgtaacccgacccgtaaaccgtaacccgttacccgttacgttaaccgttacgtaccgtaactaaacgtaaccgtaacgtacggttacctacggtaacgtacggaccgttacggaacggttacccggaccggttacgttacgttaacgttacgttacggacggttaacggaagggttacggtaacggtagaccggtaacgg

SEQ ID NO: 276498 - DNA, 782 bp, Homo sapiens
  misc_feature: GYAE6OF02GC2QN.19.53.E09.1.454.CMB.1.raw
tcagtactctcgtgcacgaccggtgctcgatttagagagagtgtgttgggtttggggggagaggagccccagccctgagattcccaggtgtttccattcagtgatcagcactgaacacagaggactcaccatggagttgagactgagctggtattttcctttggcttaattttaaaggtgtccagtgtgaagtgcagctggtggagtcgtgggggagcgttggtacagccgtggctacggtccctgacgtaccttccgtcctggtcgacgacgtcctcgtcggtattcccgtaccgttttggattgtaattatccggcctaagtcggaccgtacggttcggggtacccgtacgtaacggcccgttaaccgggaagggggtaaccgggtcccgtaggggtaaccgggtttcggggtacccttcggtaaggtttaacgttttagggttaacgggtaaagttacgggttaggtaacccgttagggttaacttaccggtaacccgttaaggttcgggacccgttaccgttcgtacggggtacggtaacggggtacccggtacttaccgaacccgttacgtacccttaccggaaggaccgaaacccgaaaccgtaaacccgaaacgttacccgttacccctgttaccgttctaacggaccctaaagttaccgaacgttacgtacgtagacgtacgaccgttggaaccgttacggaccggttactttacgggttaattacggttgtaccgtaggtaaccggtaggtactaggactagtcccttaacgg

SEQ ID NO: 276499 - DNA, 756 bp, Homo sapiens
  misc_feature: GYAE6OF02GT7QQ.19.53.E09.1.454.CMB.1.raw
tcagtactctcgtgcacgaccggtgctcgatttagagagagtgtgttgggtttggggggagaggagccccagccctgagattcccaggtgttccattcagtgatcagcactgaacacagaggactcaccatggagttgagacgtgagctggtatttttccgttttggcttaagttttaaaaggtgtaccagtgtagaagtgcagcgtggtggagtcggtgggggagtcgttggtacacgtccgtgggccgtacggtcccctaggacgtaccttccgttccgtgtcgcacgtcctcgtggtacttcctaccgtttgacttaggtacttagacggtacctagtccgtccgtacggtccgggtaccggacgtaacgtccgtaccgggaaggggtaaccggtccgtagggtacgggtcggtacgtacggtagtttagttaggttacggtaagttagtcgtacgtagttacgtacgtaccgtagtcggtacgtacgtacgtaggtacggaacgggtcctacgttaccacgtactccgtaacgaggtaacccaacgtaaccgaacccgtaaacgtacccgttacccgtaagttacctacgaacgtaaaccaaagttaacccgtaacgtagttaccgttaggaacgtcgttaacgacgggtacgacccggttacgttacgtttaacggttaacgttaccgtgggtaacgtaaccggtaaggttacggtaacgtacggtaccggttaagttaccggttaaccgg

SEQ ID NO: 276500 - DNA, 718 bp, Homo sapiens
  misc_feature: GYAE6OF02IVMC8.19.53.E09.1.454.CMB.1.raw
  modified_base (220)..(220): a, c, t, g, unknown or other
  misc_feature (220)..(220): n is a, c, g, or t
  modified_base (411)..(411): a, c, t, g, unknown or other
  misc_feature (411)..(411): n is a, c, g, or t
  modified_base (477)..(477): a, c, t, g, unknown or other
  misc_feature (477)..(477): n is a, c, g, or t
  modified_base (528)..(528): a, c, t, g, unknown or other
  misc_feature (528)..(528): n is a, c, g, or t
  modified_base (589)..(589): a, c, t, g, unknown or other
  misc_feature (589)..(589): n is a, c, g, or t
  modified_base (593)..(593): a, c, t, g, unknown or other
  misc_feature (593)..(593): n is a, c, g, or t
  modified_base (599)..(599): a, c, t, g, unknown or other
  misc_feature (599)..(599): n is a, c, g, or t
  modified_base (606)..(606): a, c, t, g, unknown or other
  misc_feature (606)..(606): n is a, c, g, or t
  modified_base (614)..(614): a, c, t, g, unknown or other
  misc_feature (614)..(614): n is a, c, g, or t
tcagtactctcgtgcacgaccggtgctcgatttagagagagtgtgttgggtttgggaggcttggtacagcctggcaggtccctgagactctcctgtgcagcctctggattcacctttgatgattatgccatgccacgtcggggtccggacaagcctaccgaaggggacgggcctgggaggtgggtctagaggttattaggttaggaatagtgactagtanagcctatgaccggtatctgtaggaacgggtcctattaccaacctacgtcctaccaaggaacgtaacaaaccgccgaaaagtaccccttccctaggtaataccgtagtaacaaaatgaactaaggttcctaaggacggagtaccgtaggaacggaaaccgacccggttccttttaagtactttacgtgggtnaaacggtaaagggaacgtttaagagtcaacggttacgtaactggggttaaaccgaccgttaacggngggggaaccccgtaaacggggtacccttgggaccccgtcgttcccgtaccncgtaccgccctaaccgaacgaccggaccctacgtccgtcccttcccgaggaccctcccgtnaccncgagcnccgaccncgacgacncgacgcggacccggtccgtggacgtcgtaccgtccggtaacgtaaccggttacctaaccgttaccgaacgacgtacggtaccgaggtccggacgggtgtacggg

SEQ ID NO: 276501 - DNA, 790 bp, Homo sapiens
  misc_feature: GYAE6OF02IJQ6L.19.53.E09.1.454.CMB.1.raw
tcagtactctcgtgacacgaccggtgctcgatttagagagagtgtgttggggtttgggggggagaggagccccgagccctgagattcccaggtgtttccattcagtgatcagcactgaacacagaggactcaccatggagttgagactgagctggtattttcctttggcttaattttaaaaggtgtctagtgtgaagtgcagctggtaggagtcgtgggggacgtcgttggtacagcccgtggacctaggtcccgtagacggaccttcctccggtaggtcgacagccttgtggtacttcctactttgattgacttatgacctagtcgctaccggtcgggtaccgcgtaacgtccgcggaagggggacgtacggtgggaacggttgggactggtaaacgggtttgttaacgggttaggtaaacggtacgttgttaaccggttaagtacgtaacggttaccttaggttaccgacggggtaccttttcgggtaaggtaacggtacgggtacccggttatttaacccgaaccgttacgttaccgtaaaccgacggaacgaaaccgaacccggtaacgtaaaccgtaaccgtacccttacgtaacgtccgtaaagaaacccttaaaggtaaaccgtaaacgtaacggttacgtaacggtaacggaacgtcccgggtaagaaaccgggtacgtaaccggttaccgttttaacggttaaacttcggttacgggtaacgtaacgggttaaacgggtaccggttaagaaccggtaccggtaagtacccggttaaacggg

SEQ ID NO: 276502 - DNA, 816 bp, Homo sapiens
  misc_feature: GYAE6OF02H8JN3.19.53.E09.1.454.CMB.1.raw
  modified_base (236)..(236): a, c, t, g, unknown or other
  misc_feature (236)..(236): n is a, c, g, or t
tcagtactctcgtgcacgaccggtgctcgatttagagagagtgtgttgggtttggggggagaggagccccagccctgagattcccaggtgtttccattcagtgatcagcactgaacacagaggactcaccatggagttgagactgagctggtatttttccttttggtacttagtttttaaaaggtgtacctagtgtgaagtgcagctggtggagtcgtgggggaggtcttggtacngcctggcacggtccctgacgtactctccgtgtcgcacgtccttcgtggtactttcctaccgttttgattcggtaatttagtccgtccctaagtccggacctaaccggtttcgggggtacccgacaaaccggtccgtacccgggaaggggggtaaccgggttcccggttagggacgggttacggggttcccttacggtaagggtttaagtttaagggttaacggtaaagtttaacgtcgggttaaccgttaagttaaagttaccggtacttacgttacggccggtaactttccggttagtacggggaaacgggtcccgttaacttaccaacccgttaacgtcctaacccgaggtaaccgaaccgtaaaccgacccgtaaacgtaacccttccccgtagttaacgtaccgtacgtaaaaccgtaaagtacccgaacgttaacgtacctacgggtacggaccgttacgtacgggacggaccgttacccggttccggtttaacgtttaacttccggttaaggttacgtaaccggttaaagggttccggtaagtaacggtacgtaacccgggtacttaaccgggg

SEQ ID NO: 276503 - DNA, 799 bp, Homo sapiens
  misc_feature: GYAE6OF02GN809.19.53.E09.1.454.CMB.1.raw
  modified_base (121)..(121): a, c, t, g, unknown or other
  misc_feature (121)..(121): n is a, c, g, or t
tcagtactctcgtgcacgaccggtgctcgatttagagagagtgtgttgggtttgggggagaggagccccagccctgagattcccaggtgtttccattcagtgagtcagcactgaacacagngactcaccagtggagttgagacgtgagctggttattttccgttttagtacgttaacgttttaaacggtgttaccgtagtagtgtaacgtgtcgagtcgtggtaggaggtcggtgggggagtcgtaggtacgacgtccgtaggtccgtacggtcccgtagacgtaccttcctaccgtggtactccgtacgtcccgtacgtccggttactttaccgtaccgtttagaagtttacggtaactttacgtccgtaaccttacgtaccggtaccgtaaccgggttccgggtacccgaccgtaccggtacccgttaacccgggaaggggtaccgggtacccggtagggtaacggtttcgggtaccgttaggtaaggttagttaacggtaggtaactggtactcgtaagtactcgtagtcgtacgtcgtacgtagtaggtacggtaacggtcgtacgttacgacctacgtaccgtaacgagaccgtaacgaaccgtaaccgtaaccgtaacccgttccgtaacgttacgtacgtaacgtaactaaacgtacgtaacgtacgtaccgtagtacggtaacgtccgtaacgaccggtaccgttaccggttcgttaacgttaacgttacggtacgttacggtaaccggtacggtaacggtacgtaccggtacgtaccgttagtaacccgg

SEQ ID NO: 276504 - DNA, 689 bp, Homo sapiens
  misc_feature: GYAE6OF02GQNNH.19.53.E09.1.454.CMB.1.raw
  modified_base (291)..(291): a, c, t, g, unknown or other
  misc_feature (291)..(291): n is a, c, g, or t
tcagtactctcgtgcacgaccggtgctcgatttagagagagtgtgttggctctgggagaggagccccagccctgagattcccaggtgtttccattcagtgatcagcactgaacacagaggactcaccatggagttgagactgagctggattttcctttggctattttaaaaggtgtccagtgtgaagtgcagctggtggagtcgtgggggagcttggtacagccgtggcaggtccctggacgactctcctgtgcagccttcgtaggtacttccaccgtttgattgatttancgaccagtcgacctacggtcggggtccgactaacggccgtaccgaagggggtacgggtccgtagggaggttcgggtcctacgagggttagtttaggtaggtaataggtagtcgtaagtagtacgaccttaggtcggacccggtacttcgtaggtacgggtaaaccggggtccctaaacgttcccgaacctagttacccgaccaaacggtaaacgaacccgtaaaccggaaccctaaaccgtaccccgttaccgttaaggtactacgtacgaacgtaacgttaagaacgttacgtcgtagaacgtacgacgtaggacggtaccgtaccggttactttacgtaaccgttacgtggttaccggaacggttaaagggacggttaacttaccggagtaaccgg

SEQ ID NO: 276505 - DNA, 702 bp, Homo sapiens
  misc_feature: GYAE6OF02JPAV6.19.53.E09.1.454.CMB.1.raw
  modified_base (175)..(175): a, c, t, g, unknown or other
  misc_feature (175)..(175): n is a, c, g, or t
  modified_base (610)..(610): a, c, t, g, unknown or other
  misc_feature (610)..(610): n is a, c, g, or t
tcagtactctcgtgcacgaccggtgctcgatttagagagagtgtgttgggtttgggagaggagcccacgcctgagattcccaggtgtttccattcagtgatcagcactgaacacagaggactcaccatggagttgagactgagctggtattttcctttggcttagttttaagggngtccagtgtacgagtgctagcgtggtggacgttcgtagggggacgcgtttaggtacacggccgttggacgtacgggtacccttggacgtaccttccgttcgtggttacgcgacgtccgttacgtggtacttcgtacctttgatggtattacgtcgacctatcgtcctacgtcgggtaccgactaacggccgttaccggaggggtaaccgggtccggtgggtaacgggttcggggtactacggtaggttacttaggggttacgtaaagttggtacggtacttaaggtagttacgtaccgttaggcgtaccggtacgtacgtggtaggacgggccgttatccgactacgtcctacgagaacgtacgacgtaacgacgtaaacctcctaggtacctacgtcgaataacgactaacgtactgtaagaacgcgtaccggngtaacccgcggtaacgtccgtttaggttaacgtttacgagggtccgtaagacgggttactaacggttacgaccggtaggtaccttaaccggg

SEQ ID NO: 276506 - DNA, 675 bp, Homo sapiens
  misc_feature: GYAE6OF02JI3FD.19.53.E09.1.454.CMB.1.raw
  modified_base (436)..(436): a, c, t, g, unknown or other
  misc_feature (436)..(436): n is a, c, g, or t
  modified_base (483)..(483): a, c, t, g, unknown or other
  misc_feature (483)..(483): n is a, c, g, or t
  modified_base (511)..(511): a, c, t, g, unknown or other
  misc_feature (511)..(511): n is a, c, g, or t
tcagtactctcgtgcacgaccggtgctcgatttagagagagtgtgttgggtttgggtgccgaagttgctggagggcacggtcaccacgctgctgagggagtagaagtcctgaggacacggcctttgtattactgtgcaaggaggtatagcagctacgtggtacactacgtggggccagggaaccctggtccaccgtctcctacgacgcctccaaccgaacgggcccattccggtccttcccccgtggcccgtccctggtcctccgagggacgccaacccgttcgacgacgccaacgacggccggtaccccgtgggcctcggtccttcggggtacaaacgggacttaacccgttccccgaacggtaacggacggtttcgacggacgggtacgggccgttgggaacccgtaaaggggcccgtaccgtaagttaacggntaacggctagcctaaggcgtcttaaggctcaagtgccgaacgtggcnacgcgtgtacgacgacgagacacgtacngtacgtcgtacgacgtacgtagtcgtacgtacgtacgtaacgacgtacggtacgtaccgtacgtaccgtaacgtacgtacgacgttacgacgtacgtacgtcacgtacgtacgtacgtacgtacgacgtacgtacgcgtacgtacgacgtacgtacgtacgtcg

SEQ ID NO: 276507 - DNA, 1083 bp, Homo sapiens
  misc_feature: GYAE6OF02GPNEA.19.53.E09.1.454.CMB.1.raw
  modified_base (519)..(519): a, c, t, g, unknown or other
  misc_feature (519)..(519): n is a, c, g, or t
tcagtactctcgtgcacgaccggtgctcgatttagagagagtgtgttgggtttgggagcttggtacagcctggcaggtccctgagactctcctgtcgcagcctctggattcaacctttgatgattatgcatgccacgtgggcgcaagctccgaagggaggcctagggagtgggtacctcgaggttattaggttaggaataggtcgacttaacggtactacgaccttatcggaccggtaacttcttaggtacggaacgggacccgtagtttaccaaccgtaagttaccctaccgaacggtaacggaaaacccaaaccggtaacccgtaaacggttaaaccccttaccccggtaagtttacttaaccgacgtaaaccgtaaaacgtacgaaaaccgtacgttacgaaccggtaaacggtacgtacggttaacggaaacggggaacctaaccggggttacctttttaaaggttaacctttaccgggtagttacggaaaaccggttaaagggaccggtttaanacggtacccgttaaagacttttacgggaacccgggttaacgtaaaccgtaaccggggtccggggaaaccctttacccggggtaaaaccggtttcgtaccccgtaaacccggttccgttaacccggtaacctacccggttacccctaacccccggtaaaaccggtacccggggaccctttaaaccccgggtacccgggtttccccccgtttaaccccggggttaccggtaccccggtttaccccgtaacgggttaacccccttaccggaaaaccggtaccccgggttaaccccgttaacccggggtaaacccgggtaaaaccggttccccgttaacccggggtaaaccccgaaacccggggttcccggttaaccccccgggtttaccggggtaacgtttaccccggggttacccgggtttaaacccggggttaaaaccccgtttaaccggggttaaaaccccctttaacccgttaacccccgggtaaaaggttaaacccgggtttaacccggggttaaccttccggggggtaaaaccgggtccccggttaccggggttaacccgg

SEQ ID NO: 276508 - DNA, 509 bp, Homo sapiens
  misc_feature: GYAE6OF01EIAZ5.16.9.A09.1.454.CMB.1.raw
tcagtgtactactccacgaccggtgctcgatttagcgagacgcgcaggggctgggcctcaggaagcagcatcggaggtgcctcagccatggcatggatccctctcttcctcggcgtccttgcttactgcacaggatccgtggcctcctatgagttgactcagcttccctcagtgtccgtgtccccgggacagacagccagcatcacctgctctggagataacctgggaagtaaatttactttctggtatcagcggaagccaggccagtccctgttttggtcatctataaagataggaatcggcctcagacatccctgagcgattctctggctccagctctggaaacacagccactctgaccatcaccgggacccagactatgatgaagctgactattactgtcaggcgtgggacagcgcactggtggtttcggcggagggaccaagcgtgaccgtccgtcggtcgcgcccaaggctcgcccctcggtcactctcgttcccgccctcccg

SEQ ID NO: 276509 - DNA, 518 bp, Homo sapiens
  misc_feature: GYAE6OF01BBNAT.16.9.A09.1.454.CMB.1.raw
tcagtgtactactccacgaccggtgctcgatttagcgagacgcgcaggggctgggcctcaggaagcagcatcggaggtgcctcagccatggcatggatccctctcttcctcggcgtccttgcttactgcacaggatccgtggcctcctatgagttgactcagcttccctcagtgtccgtgtccccgggacagacagccagcatcacctgctctggagataacctgggaagtaaatttactttctggtatcagcggaagccaggccagtccctgttttggtcatctataaagataggaatcggccctcagacatccctgagcgattctctggctccagctctggaaacacagccactctgaccatccaccgggacccagactatgatgaagctagactattactgtcaggcgtgggacagcggcacgtggtggtttcggcggagggaccagctcgaccgtccgtcggtcgcgcccaaggcctcgccccctcggtccactcctccgttcccgccctcccg

SEQ ID NO: 276510 - DNA, 518 bp, Homo sapiens
  misc_feature: GYAE6OF01D65CH.16.9.A09.1.454.CMB.1.raw
tcagtgtactactccacgaccggtgctcgatttagcgagacgcgcaggggctgggcctcaggaagcagcatcggaggtgcctcagccatggcatggatccctctcttcctcggcgtccttgcttactgcacaggatccgtggcctcctatgagttgactcagcttccctcagtgtccgtgtcccccgggacagacagccagcatcacctgctctggagataacctgggaataaatttactttctggtatcagcggaagccaggccagtccctgttttggtcatctataaagataggaatcggccctcagacatccctgagcgattctctggctccagctctggaaacacagccactctgaccatccaccgggacccagactatggatgaagctagactattactgtcaggcgtgggacagcggcactgtgggtttcggcggagggaccagctcgaccgtcctcggtcgacgcccgaaggcctcgccccctcggtccactcctcgttcccgccctcccg

SEQ ID NO: 276511 - DNA, 530 bp, Homo sapiens
  misc_feature: GYAE6OF01CS3MY.16.9.A09.1.454.CMB.1.raw
  modified_base (400)..(400): a, c, t, g, unknown or other
  misc_feature (400)..(400): n is a, c, g, or t
  modified_base (403)..(403): a, c, t, g, unknown or other
  misc_feature (403)..(403): n is a, c, g, or t
  modified_base (470)..(470): a, c, t, g, unknown or other
  misc_feature (470)..(470): n is a, c, g, or t
  modified_base (479)..(479): a, c, t, g, unknown or other
  misc_feature (479)..(479): n is a, c, g, or t
  modified_base (494)..(494): a, c, t, g, unknown or other
  misc_feature (494)..(494): n is a, c, g, or t
  modified_base (520)..(520): a, c, t, g, unknown or other
  misc_feature (520)..(520): n is a, c, g, or t
tcagtgtactactccacgaccggtgctcgatttagcgagacgcgcagggggagagaggggcccagccctgggattttcaggtgttttcatttggtgatcaggactgaacagagagaactcaccatggagtttgggctgagcgtggtcttttcttaggtggctaattttaaaaggtgtccagtgtgaggtgcagttggtggactctgggggagacctgataccgccgtgggggtccctgagactctcctgtacagcctctggattcacctttaggagccatgccatgagctgggtccgccaggctccgaggggaagggggctgggagtgggtctcgtactatactgctagtggtaatcatgcatactatgcagactcgtagaacggtccgtcacctcaccnganacaattccaagaacacgctctatctgctaattgaccagcctgagcgccgagacacgcatgtattacngtaactaancggcgggtgcccggngccggtacctcgattgtttgatttgngggcagggac

SEQ ID NO: 276512 - DNA, 506 bp, Homo sapiens
  misc_feature: GYAE6OF01B0SF7.16.9.A09.1.454.CMB.1.raw
  modified_base (242)..(242): a, c, t, g, unknown or other
  misc_feature (242)..(242): n is a, c, g, or t
  modified_base (461)..(461): a, c, t, g, unknown or other
  misc_feature (461)..(461): n is a, c, g, or t
  modified_base (498)..(498): a, c, t, g, unknown or other
  misc_feature (498)..(498): n is a, c, g, or t
tcagtgtactactccacgaccggtgctcgatttagcgagacgcgcaggggctgggcctcaggaagcagcatcggaggtgcctcagccatggcatggatccctctcttcctcggcgtccttgcttactgcacaggatccgtggcctcctatgagttgactcagctaccctcagtgtccgtgtccccgggacagacagccagcatcacctgctctggagataacctgggaataatttactttcnggtatcagcggaagccaggccagtcccctgttttggtcatctataaagataggaatcggccctcagacatccctgagcgattctctggctccagctctggaaacacagccactctgaccatcaccgggacccagactatggatgaagctgactattactgtcaggcgtggacagcggcacgtgtggtttcggcggaggacagctgaccgtcctcggtcncgcccaggcctcgcccctcggtccactctcgttcccnccctcccg

SEQ ID NO: 276513 - DNA, 548 bp, Homo sapiens
  misc_feature: GYAE6OF01B075M.16.9.A09.1.454.CMB.1.raw
  modified_base (520)..(520): a, c, t, g, unknown or other
  misc_feature (520)..(520): n is a, c, g, or t
tcagtgtactactccacgaccggtgctcgatttagcgagacgcgcagggggagagaggggcccagccctgggattttcaggtgttttcatttggtgatcaggactgaacagagagaactcaccatggagtttgggctgagctggctttttcttgtggctattttaaaaggtgtccagtgtgaggtgcagttggtggactctgggggagacctgataccgcctggggggtccctgagactctcctgtacagcctctggattcacctttaggagccatgccatgagctgggtccgccaggcctccgagggaaggggctggagtgggtctctactattactgctagtggtaatcatgcatactatgcagactcgtgaacgggccgttcaccttcaccagagacaattccaagacacgctctatctgctaattcgaccagcctgacgcgccgaggacacggccatgtatactgtactaatcggcgggtcggccgcgggcccggtccgtcggtattcgggttttnacgttttcggcggggaccaaggggtaac

SEQ ID NO: 276514 - DNA, 547 bp, Homo sapiens
  misc_feature: GYAE6OF01D1ZX9.16.9.A09.1.454.CMB.1.raw
  modified_base (502)..(502): a, c, t, g, unknown or other
  misc_feature (502)..(502): n is a, c, g, or t
tcagtgtactactccacgaccggtgctcgatttagcgagacgcgcaggggctgggcctcaggaagcagcatcggaggtgcctcagccatggcatggatccctctcttcctcggcgtccttgcttactgcacaggatccgtggcctcctatgagttgactcagcttccctcagtgtccgtgtccccgggacagacagccagcatcacctgctctggagataaccgtgggaaattaaatttactttctggtatcagcggaagccaggccagtccctgtttggtcatctataaagataggaatcggccctcagacatccctgagcgattctctggctccagctcgtaggaaacacacgccactctgaccatccaccggaccagactatgatagaagctagactattactgtcgaggcgtggacgagcggctacgttggttcgggttttcggcgggtacgggaccgaagcgtacggtacccgtccgtcggtcgacgcccaggtccnccgtcccccgtcggtccaccgtccttccgtcccctcccgtacccg

SEQ ID NO: 276515 - DNA, 567 bp, Homo sapiens
  misc_feature: GYAE6OF01EDH2X.16.9.A09.1.454.CMB.1.raw
tcagtgtactactccacgaccggtgctcgatttagcgagacgcgcagggggagagaggggcccagccctgggattttcaggtgttttcatttggtgatcaggactgaacagagagaactcaccatggagtttgggctgagcgtggcgttttctgtggctattttaaaaggtgtccagtgtgaggtgcagttggtggactctgggggagacctgataccgcctggggggtccctgagactctcctgtacagcctctggattcacctttaggagccatgccatgagctgggtccgccaggctccgaggggaaggggctgggaggtgggtctcgtactattactgctagtggtaatcatgcatactatgcagactccgtgaacgggccgttcaccttcaccagagacaagttccaagaacacgctctatctgacaattgaccagcctgagcgccgaggacacggccattgtattactagtactaaagtcggaccgggtcggcccgacgggcccggtacccgtcgggtatttcggggttttgaacgttttcggcggggccaagggggtaac

SEQ ID NO: 276516 - DNA, 562 bp, Homo sapiens
  misc_feature: GYAE6OF01DQBE3.16.9.A09.1.454.CMB.1.raw
  modified_base (293)..(293): a, c, t, g, unknown or other
  misc_feature (293)..(293): n is a, c, g, or t
tcagtgtactactccacgaccggtgctcgatttagcgagacgcgcagggggagagaggggcccagccctgggattttcaggtgttttcatttggtgatcaggactgaacagagagaactcaccatggagtttgggctgagctggctttttcttgtggctattttaaaaggtgtccagtgtgaggtgcagttggtggactctgggggagacctgataccgcctggggggtccctgagactctcctgtacagcctctggattcacctttaggagccatgccatgagctgggtccnccaggctccgaggggaaggggctggagtgggtctctactattactgctagtggtaatcatgcatactatgcagactcgtgaacgggccgttcaccttcaccagacgaacaacttaccaagaacacgctactatctgctaattcgaccagctgacgcgccgaggacaccggcatgtattactagtaacctaaagcggcgggtcgggcccgcgggcccggtacccgtcggtattcgggttttgacgtttcgtcggggccgaaggggtaacc

SEQ ID NO: 276517 - DNA, 561 bp, Homo sapiens
  misc_feature: GYAE6OF01CL3VO.16.9.A09.1.454.CMB.1.raw
tcagtgtactactccacgaccggtgctcgatttagcgagacgcgcagggggagagaggggcccagccctgggattttcaggtgttttcatttgttgatcaggactgaacagagagaactcaccatggagtttgggctgagctggctttttcttgtggctattttaaaaggtgtccagtgtgaggtgcagttggtggactcgtgggggagacctgataccgccgtggggggtccctgagactctcctgtacagcctctggattcacctttaggagccatgccatgagctgggtccgccaggctccgagggaaggggctggagtgggtctctactattactgctagtggtaatcatgcatactatgcagactcgtgagggccgttcaccttcaccagacgacaattccaagaacacgctctatctgctaattcgacagcctgacgcgccgaggaccacggcatgtacttactagtactaaagtccggacgggtggcccggcgggcccggtaccgtcgggtattcgggttttacgtagtttcgcgggggtccgaaaggggtacg

SEQ ID NO: 276518 - DNA, 633 bp, Homo sapiens
  misc_feature: GYAE6OF01EG7R2.16.9.A09.1.454.CMB.1.raw
  modified_base (299)..(299): a, c, t, g, unknown or other
  misc_feature (299)..(299): n is a, c, g, or t
  modified_base (593)..(593): a, c, t, g, unknown or other
  misc_feature (593)..(593): n is a, c, g, or t
tcagtgtactactccacgaccggtgctcgatttagcgagacgcgcagggggagagaggggcccagccctgggattttcaggtgttttcatttggtgatcaggactgaacagagagaactcaccatggagtttgggctgagcgtggtcgttttctaggtggctaattttaaaggtgtccagtgtgaggtgcagttggtggactcgtgggggagacctgataccgccgtgggggtccctgagactctcctgtacagcctctggattcacctttaggagccatgccatgagcgtcgggtccncgaggcctaccgaggggaaggggctgggaggtgggtctcgtactatactgctagtggtaatcatgactatactatgcagactcgtagaacgggtccgttacaccttcaccagacgactaacttaccaagaaccacgtacctctaactctgtacctaattcgaccacgtcctagacgccgaccgacggaccacgggtaccattcgtaacttactagtaaacttaacgtccgggaccgggttcgggcccgggtccgggtaccccgggttaccgtcggggtactttacggggttttntaacggttttccgggacgggggtacctaaagggggtaacc

SEQ ID NO: 276519 - DNA, 571 bp, Homo sapiens
  misc_feature: GYAE6OF01EINMM.16.9.A09.1.454.CMB.1.raw
  modified_base (294)..(294): a, c, t, g, unknown or other
  misc_feature (294)..(294): n is a, c, g, or t
tcagtgtactactccacgaccggtgctcgatttagcgagacgcgcagggggagagaggggcccagccctgggattttcaggtgttttcatttggtgatcaggactgaacagagagaactcaccatggagtttgggctgagctggctttttcttgtggctattttaaaaggtgtccagtgtgaggtgcagttggtggactctgggggagacctgataccgcctggggggtccctgagactctcctgtacagcctctggattcacctttaggagccatgccatgagctggggtccnccaggctccgagggaaggggctgggagtggggtctcacttattagtggtagtggtagtactacatactacgcagacctccgtgaagggccggttcaccatctccagagacaatcccaagaacacgctgtatctagacaaatgaacggcctgagagcgaggacacggcgtatatactgtcgcccgagggtagtttactatgatagttacgtggttaactaaaaagggtcttaactttagacgttacgtacggggaccaacgggtacccgtggtacccg

SEQ ID NO: 276520 - DNA, 629 bp, Homo sapiens
  misc_feature: GYAE6OF01EKM0E.16.9.A09.1.454.CMB.1.raw
  modified_base (170)..(170): a, c, t, g, unknown or other
  misc_feature (170)..(170): n is a, c, g, or t
  modified_base (191)..(191): a, c, t, g, unknown or other
  misc_feature (191)..(191): n is a, c, g, or t
  modified_base (347)..(347): a, c, t, g, unknown or other
  misc_feature (347)..(347): n is a, c, g, or t
tcagtgtactactccacgaccggtgctcgatttagcgagacgcgcaggggctgggcctcaggaagcagcatcggaggtgcctcagccatggcatggatccctctcttcctcggcgtccttgcttactgcacaggatccgtggcctcctatgagttgactcagcttccctnagtgtccgtgtcccccggganagacagccagcatcacctgctctggagataacctgggaaagttaaattttactttctggtatcagcggaagccaggccacgttccctgttttggtcatctaataaagataggaatccggccctcagacatcccctgagcgattctctggctccganctcgtacggaaacacgacgcctactccgtacgaacccacgtaccgaaccccgggaacccaacggtactaagtaggatacgaacgtactagtaacttacttacgtcgtacgaggtcggtacggacgaggccgcgtacggttggttcggggtttcgggacgggtaacgggaccgaaggtccgtacggtacccggttccgtccggtaccgaccggacccgtacggcccgtcccgtcccccgtcggttaccctacgttccgtttccgtttccccgcccgttcccgg

SEQ ID NO: 276521 - DNA, 659 bp, Homo sapiens
  misc_feature: GYAE6OF01B44P3.16.9.A09.1.454.CMB.1.raw
  modified_base (190)..(190): a, c, t, g, unknown or other
  misc_feature (190)..(190): n is a, c, g, or t
  modified_base (217)..(217): a, c, t, g, unknown or other
  misc_feature (217)..(217): n is a, c, g, or t
tcagtgtactactccacgaccggtgctcgatttagcgagacgcgcaggggctgggcctcaggaagcagcatcggaggtgcctcagccatggcatggatccctctcttcctcggcgtccttgcttactgcacaggatccgtggcctcctatgagttgactcagcttccctcagtgtccgtgtccccggganagacagccagcatcacctgctctgganataaccgtgggaaattaatttactttctaggtatcagcggaagccaggccacgttcccttgttttcggtcatactaataaagataggaactccggccctacagactactcccgtagacgtcgtaacttcgtcgtcggccttccgagtcctacgtaggaaacccacgaccgcctactcctacgacccacgtaccgacccgggaacccacgtaacgtagtacggaagtagaacgtactacgtacttacttacgtcgtacgaggtcggtacggacgacggcggtactacggttggttcgggttttacgggacgggtacgggtaaccgacggtaccgttcggacccgttccgtaccggtaccgaccggacccgtaacggtcccgtacccggacccccgttcggtaccctacccgttccgttccccgttccccgtccccgttacccg

SEQ ID NO: 276522 - DNA, 649 bp, Homo sapiens
  misc_feature: GYAE6OF01DF4C2.16.9.A09.1.454.CMB.1.raw
tcagtgtactactccacgaccggtgctcgatttagcgagacgcgcagggggagagaggggcccagccctgggattttcaggtgttttcatttggtgatcaggactgaacagagagaactcaccatggagtttgggctgagctggcttttcttgtggctattttaaaaggtgtccagtgtgaggtgcagttggtggactctgggggagacctgataccgcctggggggtccctgagactctcctgtacagcctctggattcacctttaggagccatgccatgagctgggtccgccaggctccgaggggaaggggctgggaggtgggtctctacgtattactgctaggtggtaatcatgctatactatgcagactccgtagacgggccggttcaccttcaccagacgacaattccaagaacacgctactatctgactaattcgaaccagtccctggacggtccggaccccggaagggacccgaacccgggtccaacgtttacggttaacttttaacgtacggtttaaaacctaaacgtcccgggtacggggttccggggccccggtcccgggggaccccgggtttaaccgtccgggtaagtttcggggttttacgtacgttttcggtacgggggaccgtaagggggtaacc

SEQ ID NO: 276523 - DNA, 616 bp, Homo sapiens
  misc_feature: GYAE6OF01DEK6N.16.9.A09.1.454.CMB.1.raw
  modified_base (342)..(342): a, c, t, g, unknown or other
  misc_feature (342)..(342): n is a, c, g, or t
  modified_base (353)..(353): a, c, t, g, unknown or other
  misc_feature (353)..(353): n is a, c, g, or t
  modified_base (377)..(377): a, c, t, g, unknown or other
  misc_feature (377)..(377): n is a, c, g, or t
  modified_base (491)..(491): a, c, t, g, unknown or other
  misc_feature (491)..(491): n is a, c, g, or t
tcagtgtactactccacgaccggtgctcgatttagcgagacgcgcagggggagagaggggcccagccctgggattttcaggtgttttcatttggtgatcaggactgaacagagagaactcaccatggagtttgggctgagcgtggtcttttcttgtggctaattttaaaaggtgtccagtgtgaggtgcagttggtggactcgtgggggagacctgataccgccgtgggggtccctgagactctcctgtacacgcctcgtggacttcctaccgtttaggacgtccatcgccatgagctcggggtccgccaggcctccgagggaaggggctggagtgggtctntacgtattacngctagtggtaatcatgcagtactntgcaagactccggaggaacgggtcccggttacaacccgttcaacccgaagacggaacaacttaccgaaagaaccgacgacctactatctagctaattcggacctacgccgtagngaccgcgacggacaccggccaatgtaacttacgacgttaactaaacgtcggtacgggtcggcccgcgggcccggtaccgtcggtacgttcggtttggtacttaggtccgggcgtaacggtaacgg

SEQ ID NO: 276524 - DNA, 586 bp, Homo sapiens
  misc_feature: GYAE6OF01CR92I.16.9.A09.1.454.CMB.1.raw
  modified_base (248)..(248): a, c, t, g, unknown or other
  misc_feature (248)..(248): n is a, c, g, or t
  modified_base (283)..(283): a, c, t, g, unknown or other
  misc_feature (283)..(283): n is a, c, g, or t
  modified_base (313)..(313): a, c, t, g, unknown or other
  misc_feature (313)..(313): n is a, c, g, or t
  modified_base (456)..(456): a, c, t, g, unknown or other
  misc_feature (456)..(456): n is a, c, g, or t
tcagtgtactactccacgaccggtgctcgatttagcgagacgcgcagggggagagaggggcccagccctgggattttcaggtgttttcatttggtgatcaggactgaacagagagaactcaccatggagtttgggctgagcgtgcgtttctagtggctaatttaaaggtgtcagtgtgagtgcagtggtggactcgtggggagacctgataccgccgtgggggtcctgagactctcctgtacagcctntggattcacttaggagcatgcatgagcgtggtccncaggctcgagggaagggctggagtggtctntactatactgactagtaggtaatgatgacaatactagtgacacgtactccgtaggaacgggtccggtttacaacccttcgaaccaaggacaacaaacttccgaaagaaacactctactaactctaagcctaaattcgaacccngcctagacgccgaacgacgacgtaccggctagtctaacttacgtagtaactagccgggcgggtacggccggtccggaccggttacgtggtacgttggtttacgacgttcgggacgggtaacgaagggtac

SEQ ID NO: 276525 - DNA, 791 bp, Homo sapiens
  misc_feature: GYAE6OF01CP760.16.9.A09.1.454.CMB.1.raw
  modified_base (191)..(191): a, c, t, g, unknown or other
  misc_feature (191)..(191): n is a, c, g, or t
tcagtgtactactccacgaccggtgctcgatttagcgagacgcgcaggggctgggcctcaggaagcagcatcggaggtgcctcagccatggcatggatccctctcttcctcggcgtccttgcttactgcacaggatccgtggcctcctatgagttgactcagcttccctcagtgtccgtgtcccccggganagacagccagcatcacctgctctggagataaccgtgggtaaattaaatttactttctggtatcagcggaagccaggccacgtcccctgttttggtcatctaataaagataggactcggcctcagacactccctgacgcgtattctcgtcggcctccgagtccgttaccgtacggaaaaccaccgtaacgtacccctacttaccgtacgaacctaccgtacccggaaccccgggaccccgaacgtaacccgttaacgtacggaacgtaacggaaacgtcgttaacgtaacctttacgttaacgttacggtaccgacgggtccggtacgggaaccgacgggtacccgggtccgtaaccgggtttcgggtttacggggttttaccggggaccggggtaaccggggtaacccgtaacggggtcccgttaaccccgggtacccggttaccccgggtacccgggttacccggacccgggtacccccggtaaacgggtcccccggttaacccccggtccccccccggtttaccgggtaccccgttaccccggttaccccgtttacccccggtttccccccccgaccccggttttaacccccccgggg

SEQ ID NO: 276526 - DNA, 606 bp, Homo sapiens
  misc_feature: GYAE6OF01E2A85.16.9.A09.1.454.CMB.1.raw
  modified_base (190)..(190): a, c, t, g, unknown or other
  misc_feature (190)..(190): n is a, c, g, or t
  modified_base (357)..(357): a, c, t, g, unknown or other
  misc_feature (357)..(357): n is a, c, g, or t
  modified_base (437)..(437): a, c, t, g, unknown or other
  misc_feature (437)..(437): n is a, c, g, or t
tcagtgtactactccacgaccggtgctcgatttagcgagacgcgcaggggctgggcctcaggaagcagcatcggaggtgcctcagccatggcatggatccctctcttcctcggcgtccttgcttactgcacaggatccgtggcctcctatgagttgactcagcttccctcagtgtccgtgtccccggganagacagccagcatcacctgctctggagataaccgtgggaaattaaattttactttctggtatcagcggaagccaggccacgtcccttgttttggtcatctataaagatagaatccggcctcagacactccctgagcgtattctctcggctccagctactaggaaacncacgccactctcgaccatccgacccgggaccagtactagtggatagaacgctagactattactcgtcgaggcgtgggacnggacggctacgttggttcgggtttccgggacgggtaacgggaccaaggtccgtacggaccccggttccgtaccgggtaccgaccggtaccccgaacgggtcccgtcccggtccccccgttcgggtaccctaccgttcccgttcccgttcccccctccccgttaccccgg

SEQ ID NO: 276527 - DNA, 680 bp, Homo sapiens
  misc_feature: GYAE6OF01CO7Q7.16.9.A09.1.454.CMB.1.raw
  modified_base (192)..(192): a, c, t, g, unknown or other
  misc_feature (192)..(192): n is a, c, g, or t
  modified_base (218)..(218): a, c, t, g, unknown or other
  misc_feature (218)..(218): n is a, c, g, or t
  modified_base (245)..(245): a, c, t, g, unknown or other
  misc_feature (245)..(245): n is a, c, g, or t
tcagtgtactactccacgaccggtgctcgatttagcgagacgcgcaggggctgggcctcaggaagcagcatcggaggtgcctcagccatggcatggatccctctcttcctcggcgtccttgcttactgcacaggatccgtggcctctatgagttgactcagccttccctcagtcgtccgtcgtccccggganagacagccagcatcactgctctgganataaccgtgggaattaaatttctttcnggtaatcagacggaacgcaggccacgttccctggttttcgctatctaataaagattaaggaatccggccctgagacactccctgacgcgtattctcgtcggtctccgagtcctacgtagaaaccacgacgacctaactcctacggaccactacccggacccggaacccacgtaaccgtagtaggtaagtacgtaacgtacttacgtacttaacttacgtagttaccggagggtacggtacgggaaccacggggaccgtacgttaacggttcgggtttacggggtttccgggaaccggggtaacgggtaaccacgggtccgtaccggtacccggtcccgttacggtacccgaccggtaccccggaaggtccccgtaccccggtcccccgttacggtaccctaccgttcccgtcccgttcccctccccgttacccgg

SEQ ID NO: 276528 - DNA, 633 bp, Homo sapiens
  misc_feature: GYAE6OF01C48O2.16.9.A09.1.454.CMB.1.raw
  modified_base (191)..(191): a, c, t, g, unknown or other
  misc_feature (191)..(191): n is a, c, g, or t
tcagtgtactactccacgaccggtgctcgatttagcgagacgcgcaggggctgggcctcaggaagcagcatcggaggtgcctcagccatggcatggatccctctcttcctcggcgtccttgcttactgcacaggatccgtggcctcctatgagttgactcagcttccctcagtgtccgtgtcccccggganagacagccagcatcacctgctctggagataaccgtagggaaagttaaatttacttctggtatacagcggaagccaggcctagtcccttgtttcggtcatctaataaagataaggatcggcctcagacactccctgacgcgattctcgtcggctccgagtctacgtacggaaactacacgacccactctacgaccactcgacccggaccagactatagagtagaagtctagtacttatacgtgtacgaggtcggtagggacacggcggccgtacgttcgggtttacgggttttccgggacgggtaacgggaaccgtacggtaccgtcggtaccccggttccgtaccggtaccgtaccggaccccgaacgggtacccgtcccggtccccccgtaccggtccctacccttccgttaccccgttcccccgtaccccgttaccccgg

SEQ ID NO: 276529 - DNA, 667 bp, Homo sapiens
  misc_feature: GYAE6OF01A7D1X.16.9.A09.1.454.CMB.1.raw
  modified_base (192)..(192): a, c, t, g, unknown or other
  misc_feature (192)..(192): n is a, c, g, or t
  modified_base (219)..(219): a, c, t, g, unknown or other
  misc_feature (219)..(219): n is a, c, g, or t
  modified_base (246)..(246): a, c, t, g, unknown or other
  misc_feature (246)..(246): n is a, c, g, or t
  modified_base (260)..(260): a, c, t, g, unknown or other
  misc_feature (260)..(260): n is a, c, g, or t
  modified_base (309)..(309): a, c, t, g, unknown or other
  misc_feature (309)..(309): n is a, c, g, or t
tcagtgtactactccacgaccggtgctcgatttagcgagacgcgcaggggctgggcctcaggaagcagcatcggaggtgcctcagccatggcatggatccctctcttcctcggcgtccttgcttactgcacaggatccgtggcctcctatgagttgactcagccttccctcagtgtccgtgtcccccggganagacagccagcatcacctgctctgganataacctgggaattaaattttacttcnggtatcagcggaanccaggccagtccctgttttggcatctaataaagataggaatcggccctnagactactccctgagccgtattcctacgtggctccgagtcctcgtaggaaaccacgacgacccactttcacgaccacgtccgaacccgggacccagtacctagtacggattacgaaggtaccttaggtaactacgttaacctggttccaagggtccggtagggactacgggtcggacctaacgttcggttacggggttttaccgggaccgggtaagggtaacccgaacggtccgttaccggtacccggttcccggttccggttaaccgaccggtacccggaaacggtccgttcccgtaacccccccgttcggtaccgtacccttcccggttacccttccccccggtcccttaccccgg

SEQ ID NO: 276530 - DNA, 752 bp, Homo sapiens
  misc_feature: GYAE6OF01CQ2BP.16.9.A09.1.454.CMB.1.raw
  modified_base (103)..(103): a, c, t, g, unknown or other
  misc_feature (103)..(103): n is a, c, g, or t
  modified_base (170)..(170): a, c, t, g, unknown or other
  misc_feature (170)..(170): n is a, c, g, or t
  modified_base (192)..(192): a, c, t, g, unknown or other
  misc_feature (192)..(192): n is a, c, g, or t
  modified_base (222)..(222): a, c, t, g, unknown or other
  misc_feature (222)..(222): n is a, c, g, or t
  modified_base (536)..(536): a, c, t, g, unknown or other
  misc_feature (536)..(536): n is a, c, g, or t
tcagtgtactactccacgaccggtgctcgatttagcgagacgcgcaggggctgggcctcaggaagcagcatcggaggtgcctcagccatggcatggatccctntcttcctcggcgtccttgcttactgcacaggatccgtggcctcctatgagttgactcagcttccctnagtcgtccgtcgtccccggganacgacagccagcatcacctgctacgtgganaactaaccgtgggtaaattaactttctttgtggtatcgaggacggaacgccaacggcctacgttcccgttgttttcggctattactaagtaaagtataggtaactccggtccctagaacgactacttaccctaggacgtccgtattcccgtcgtccggtaccttacccgaggtaccttccgtaacgggaaaccctacgaaccgtacctaacctctaacggtaacctacgacccgacccggggaaccctaaggtacttaacggtaggacttacggaacgtcgtaaccgtaacttacgtttaaccgcggtaaccgngggtacccggtaggaacgtcgggccggtaccgtacggtttcgggttacgggtttaccggggacgggtaacgggtaacctacgggtcccgttacggacccccggttccggtcccggtaccgtaacccgggtacccgaacgggtccccttccccgggacccccgttcgggtaccctacccggttccctttacccccgtccccgtccccgttaacccgg

SEQ ID NO: 276531 - DNA, 511 bp, Homo sapiens
  misc_feature: GYAE6OF01B4WQE.16.9.A09.1.454.CMB.1.raw
  modified_base (308)..(308): a, c, t, g, unknown or other
  misc_feature (308)..(308): n is a, c, g, or t
  modified_base (427)..(427): a, c, t, g, unknown or other
  misc_feature (427)..(427): n is a, c, g, or t
  modified_base (470)..(470): a, c, t, g, unknown or other
  misc_feature (470)..(470): n is a, c, g, or t
  modified_base (481)..(481): a, c, t, g, unknown or other
  misc_feature (481)..(481): n is a, c, g, or t
tcagtgtactactccacgaccggtgctcgatttagcgagacgcgcaggggctgggcctcaggaagcagcatcggaggtgcctcagccatggcatggatccctctcttcctcggcgtccttgcttactgcacaggatccgtggcctcctatgagttgactcagcttccctcagtgtccgtgtccccgggacagacagccagcatcacctgctctggagataacctgggaagttaaatttactttctggtatcagcggaagccaggccagtcccctgttttggtcatctataaagataggatcggccctnacgacatcccctgagcgattctctggctccagctctggaaacacagccactctgaccatccaccgggacccagactagtggatgaagctagacttatactgtcaggcgtggacagcgcncgtgtgggtttcggcggtacgggacagctgccgtccgtcggcncgccaaggccncgcccctcgtccactctcgtcccgcctccg

SEQ ID NO: 276532 - DNA, 708 bp, Homo sapiens
  misc_feature: GYAE6OF01EQB3Z.16.9.A09.1.454.CMB.1.raw
  modified_base (247)..(247): a, c, t, g, unknown or other
  misc_feature (247)..(247): n is a, c, g, or t
  modified_base (549)..(549): a, c, t, g, unknown or other
  misc_feature (549)..(549): n is a, c, g, or t
tcagtgtactactccacgaccggtgctcgatttagcgagacgcgcagggggagagaggggcccagccctgggattttcaggtgttttcatttggtgatcaggactgaacagagagaactcaccatggagttgggctgagcgtgtcgttttctgtggctaatttaaaaggtgtccagtgtgaggtgcagttggtggactgtggggagacctgataccgccgtgggggtccctgagactctcctgtacngcctctggacttcacctttaggactccagtcgccatgacgcgtcggggtccaccgacggcctccggaaggggaacgggggcgtgggtacggtcgggtccttcgtaacttagttacgtgtacttaaggtggtaaatcgtaatgtacctataactgtcgacacgtacctcggtaggtaaacggggtcccgtttactacccttccgaacccgaagaacgaacctaacttaccaaaggtaacccacccgtacttaccttaaacgtcctaggtaacctaattaccgacccgtacgcccttagggacncccgggaccggaaggacccgacggtaaccctagtttacgttaacttacgtacgttaactaacggtcgggtaccgggtcgggacccgtccgggacccggtttacgccggggttatttcgggtttactacgggtttacggtacgggaccgtacggtaacgg

SEQ ID NO: 276533 - DNA, 664 bp, Homo sapiens
  misc_feature: GYAE6OF01A267J.16.9.A09.1.454.CMB.1.raw
tcagtgtactactccacgaccggtgctcgatttagcgagacgcgcaggggctgggcctcaggaagcagcatcggaggtgcctcagccatggcatggatccctctcttcctcggcgtccttgcttactgcacaggatccgtggcctcctatgagttgactcagcttccctcagtgtccgtgtccccgggacagacagccagcatcacctgctctggagataaccgtgggaagttaaatttactttctggtatcagcggaagccaggccacgtccctgttttgctatctaataagataggaatccggcctacagacactccctgacgcgtatttctcgtggcctccgagtctacgtaggaaacctacgacgaccctactcctacggaaccctacgtacccgaaccccggggaacccaacgtaccgttaagtcgggtaactaggaaacgtcgtacgtaaccttaacttacgtgtacgtagggcggtacggacgacggcgacgtacgttgggttcgggtttacgggacgggtacgggaccacggtccgtaccggtacccgttccggtaccggtaccgaccggacccggtaacggtccccgtacccggtccccccgttcgggtaccctacccggttcccgttcccggttccccccgtcccgttacccgg

SEQ ID NO: 276534 - DNA, 675 bp, Homo sapiens
  misc_feature: GYAE6OF01BR7F3.16.9.A09.1.454.CMB.1.raw
  modified_base (170)..(170): a, c, t, g, unknown or other
  misc_feature (170)..(170): n is a, c, g, or t
  modified_base (191)..(191): a, c, t, g, unknown or other
  misc_feature (191)..(191): n is a, c, g, or t
  modified_base (218)..(218): a, c, t, g, unknown or other
  misc_feature (218)..(218): n is a, c, g, or t
  modified_base (246)..(246): a, c, t, g, unknown or other
  misc_feature (246)..(246): n is a, c, g, or t
  modified_base (322)..(322): a, c, t, g, unknown or other
  misc_feature (322)..(322): n is a, c, g, or t
  modified_base (339)..(339): a, c, t, g, unknown or other
  misc_feature (339)..(339): n is a, c, g, or t
tcagtgtactactccacgaccggtgctcgatttagcgagacgcgcaggggctgggcctcaggaagcagcatcggaggtgcctcagccatggcatggatccctctcttcctcggcgtccttgcttactgcacaggatccgtggcctcctatgagttgactcagcttccctnagtcgtccgtcgtccccgganagacagccagcatcacctgctctgganactaaccgtagggaattaaatttcttcnggtatcgagacggaagccaggccacgttccctggttttcgctagttactaataaagagtaaggaatccggccctanacgtacctaatccccgngacgtacgtacttccgtctggcctaccagtcttccgtaggaaacaccgacgaccctactctacggaacctacgtacccgacccgggaccctaacgtactaacgtacggactacggaagtccgttacgaccgtttaacgttacgttacggtacggacggtcgggtaggaccgacggccggtaacgtcgttcgggttacgggtttcgggaccgggtaacgggtaccgaacggtcgtaccggtaccggtcccgtacggtccgaacggtccccggaaggtccctacccgtcccccggttccgtacccgtcccttcttacccggttcccctaccccgtccg

SEQ ID NO: 276535 - DNA, 764 bp, Homo sapiens
  misc_feature: GYAE6OF01ADGRV.16.9.A09.1.454.CMB.1.raw
  modified_base (276)..(276): a, c, t, g, unknown or other
  misc_feature (276)..(276): n is a, c, g, or t
  modified_base (667)..(667): a, c, t, g, unknown or other
  misc_feature (667)..(667): n is a, c, g, or t
  modified_base (710)..(710): a, c, t, g, unknown or other
  misc_feature (710)..(710): n is a, c, g, or t
tcagtgtactactccacgaccggtgctcgatttagcgagacgcgcagggggagaggaggggcccagccctgggattttcaggtgttttcatttggtgatcaggactgaacagagagaactcaccatggagttggctgagctggtcttttctgtggtcttaatttaaaggtgtccagtgtggaggtgcgtaggttgggtggtacgtcggtgggggacaccgtgacgtacccggtccggtcgggggtccctaggacgtaccttccgtccgtagtaccncgtccttacgtaggtacttaccgtaccgtttaggaccgtacctagtaccggtacctaggtcggtaaccggtccggttaccggggtccccgaccggtacgggtacccgtaccgggaaggggggtacgggtccggtaggggtacggttccgggtactaccgttaacgttaggttacgggttagggtaggtcggtaccgtaacctagtacttacgttccgacgtaccggtaccgtccggtacgggtaccgggtccgttactccgtactaccgacgagaccgtaacctaccgtacgaaacgtaccgtgttagacctggacgaacggtacgtcgacctacgcgtacccggagacggacggtaccgacggacctacgacttagttacttacgtacgnggtaacgaacccgtagtaccgtcccgttaaccccaccggttanagtacgtacgtcgaaccttaatacgttcgtaccaaggttcttcggcgtaccggg

SEQ ID NO: 276536 - DNA, 764 bp, Homo sapiens
  misc_feature: GYAE6OF01EERAE.16.9.A09.1.454.CMB.1.raw
  modified_base (170)..(170): a, c, t, g, unknown or other
  misc_feature (170)..(170): n is a, c, g, or t
  modified_base (190)..(190): a, c, t, g, unknown or other
  misc_feature (190)..(190): n is a, c, g, or t
  modified_base (217)..(217): a, c, t, g, unknown or other
  misc_feature (217)..(217): n is a, c, g, or t
  modified_base (243)..(243): a, c, t, g, unknown or other
  misc_feature (243)..(243): n is a, c, g, or t
tcagtgtactactccacgaccggtgctcgatttagcgagacgcgcaggggctgggcctcaggaagcagcatcggaggtgcctcagccatggcatggatccctctcttcctcggcgtccttgcttactgcacaggatccgtggcctcctatgagttgactcagcttccctnagtgtccgtgtccccggganagacagccagcatcacctgctctgganataacctgggtaaattaatttctttntggtatcagcggaagccaggccagtccctgttttcgcatctataaagataggaatccggcctcagacactccctgagcgtattctctggctccagtctacgtaggaaaccacacgaccactcctacgaaccctacgtaccgaacccggggaacccaaggtaaccgtacgtagggaacttacggaacgtcgtaacggttaaccttaacgttttaaccgttaggtacccgttaaacgggccgggtttaacggggaaccgtacgggacccgggtacgtaaccggtttcggggtttaccggggttttttaccggggaaccgggggtaaccggggtaaacccgtaagggtaccccgttacggggtacccccggtttacccggtacggggttaccccgaaccggtaccccccgggaaacgggtccccgttacccccgggtacccccccggttacccgggttaccccgtaaacccgttttccccgtccccggggttttcccccccaaccccccgggtttaacccccgg

SEQ ID NO: 276537 - DNA, 684 bp, Homo sapiens
  misc_feature: GYAE6OF01A5U6W.16.9.A09.1.454.CMB.1.raw
  modified_base (191)..(191): a, c, t, g, unknown or other
  misc_feature (191)..(191): n is a, c, g, or t
  modified_base (218)..(218): a, c, t, g, unknown or other
  misc_feature (218)..(218): n is a, c, g, or t
tcagtgtactactccacgaccggtgctcgatttagcgagacgcgcaggggctgggcctcaggaagcagcatcggaggtgcctcagccatggcatggatccctctcttcctcggcgtccttgcttactgcacaggatccgtggcctcctatgagttgactcagcttccctcagtcgtccgtgtccccggganagacagccagcatcacctgctctgganataaccgtgggaaattaaactttactttctggttatcagcggaagccaggccagtccctgttttggcagtctaataagataggaatcggccctcagacatcccctagacgcgtattctctcggcctccgagtcctcgtacggaaacacgtacgccactcgtacgaacccatacccgaacccgggacccacgaccgtagtcggaagttacggaagtcctagtaaccttaagttacgtacgtcgtagggacgtcgggaacgacggcggctaacgttcggtttacggggttttccgggacgggtaacgggtaaccgtacggtaccgtacggtacccggttacccggtaccggttacccgaccggtaccccgtaaacgggtcccccgtaccggtaccccccccgtttacgggtaccccctaccggttccccgtttcccggttaaccccccggttccccgttaaccccggg

SEQ ID NO: 276538 - DNA, 695 bp, Homo sapiens
  misc_feature: GYAE6OF01A7PXR.16.9.A09.1.454.CMB.1.raw
  modified_base (190)..(190): a, c, t, g, unknown or other
  misc_feature (190)..(190): n is a, c, g, or t
tcagtgtactactccacgaccggtgctcgatttagcgagacgcgcaggggctgggcctcaggaagcagcatcggaggtgcctcagccatggcatggatccctctcttcctcggcgtccttgcttactgcacaggatccgtggcctcctatgagttgactcagcttccctcagtgtccgtgtccccggganagacagccagcatcactgctcgtggagataaccgtgggtaaattaaattttactttcgtggtactcaggcggaagccgaggcctacgttcccttggttttcggtctattactaagtaaagtagtaaggaacgtccggaccctacgaacgacctactccccgtgacgtcgtaactttcctcgtcggccttaccgacgtcttacgtaacggaaaccacgacgaccctaacttccgtacgaaccctacgtacccggaacccgggaacccgacgtaaccttaagtacggtaagtacggaagtccgtagtaaccttacgttacgtcggtacgtacgggtccggtagggacacgggcggtacgtcgttgggttcgggtttccgggacgggtacggaccgaacgtcgtacggtcccgtccggtaccggtaccgtaccggcccgaacggtcccgtacccggtcccccgttcgggtaccctaccgttcctcccgttacccctcccgttacccgg

SEQ ID NO: 276539 - DNA, 613 bp, Homo sapiens
  misc_feature: GYAE6OF01A02X4.16.9.A09.1.454.CMB.1.raw
  modified_base (520)..(520): a, c, t, g, unknown or other
  misc_feature (520)..(520): n is a, c, g, or t
tcagtgtactactccacgaccggtgctcgatttagcgagacgcgcagggggagagaggggcccagccctgggattttcaggtgttttcatttggtgatcaggactgaacagagagaactcaccatggagtttgggctgagctggctttttcttgtggctattttaaaggtgtccagtgtgaggtgcagttggtggactcgtgggggagacctgataccgccgtggggggtccctgagactctcctgtacagcctctggattcacctttaggagccatgccatgagctgggtccgccaggctccgaggggaggggcgtggagtgggtctctactattactgctagtgtaatcatgcatactatgacagactccggtaggaacgggtccggttaccaccttccaaccgagaacgtaacctaaacgttcccaaagtaacccacgtacctacgtatcctagactaaagttcgaccctagccctagacgccggaccgaggaccgaccgcctattcgttattaccngttaaactaagtccgggtcgggtcggcccgcgggtacccggtacgttccgggtattcgggttttcacgtttcggcggggaccgaaggggtacc

SEQ ID NO: 276540 - DNA, 602 bp, Homo sapiens
  misc_feature: GYAE6OF01ASOO3.16.9.A09.1.454.CMB.1.raw
  modified_base (355)..(355): a, c, t, g, unknown or other
  misc_feature (355)..(355): n is a, c, g, or t
tcagtgtactactccacgaccggtgctcgatttagcgagacgcgcagggggagagaggggcccagccctgggattttcaggtgttttcatttggtgatcaggactgaacagagagaactcaccatggagtttgggctgagctggctttttcttgtggctattttaaaggtgtccagtgtgaggtgcagttggtggactctgggggagacctgataccgccgtggggggtccctgagactctcctgtacagcctctggattcacctttaggacgccatgccatgagctggggtccgccaggcctccgaggggaaggggctgggagtgggtctctactattactgctagtggtaatnatgctatactatgcagactccgtggaacgggtcccgttcaccttcaccagacgacaattccaagaccacgtctctatctgactaatcgaccagcctgacgcgccggagaccacgggccagttcgtaacttacgtagttaactaacgtccgggacgggttcgggccccgtcgggaccccgggttaccgtcgggttactttcgggtttttcgacgttttccgggcgggggtacctaaacgggggtaacc

SEQ ID NO: 276541 - DNA, 944 bp, Homo sapiens
  misc_feature: GYAE6OF01DEWGA.16.9.A09.1.454.CMB.1.raw
tcagtgtactactccacgaccggtgctcgatttagcgagacgcgcagggggagagaggggcccagccctgggattttcaggtgttttcatttggtgatcaggactgaacagagagaactcaccatggagtttgggctgagctggctttttcttgtggctaattttaaaaggtgtccagtgtgaggtgcagttggtggactcgtgggggagacctgataccggccgtggggggtccctggagactcgtcctgtacagcctcgtggtattcaccgtttaggacgccatcgccatgagtcgtgggtcccgccgacggcgtcccgaaggggaacgggggccgtgggtacgggttcggggttccttaccgttaacttattaccgttaggtcgttaaggttaggtaaacgtctaagttcggacttaactaaccttaagtcgtaccgtaacggtaacccgttcccgggttaacgggtaaccggggggttacccggtttaccccgtaaaccccgttttacccaaacccgtaacgggtaaaacggtaaaccctaaaaccggtttaaaccccgaaaaccggtaaaacccgaaaccccggttacctttaacctttaaactttcccgttaaccgtaccttaaacgtttaccgaaaccccgttaccggtacccttagggacccgggacccgggaacccggtaaacggggaacccgtaacccggggacccgttaagttacgtttaaacgtttaccgtttaaaccggttaaaaccgtttaaaaacggccgggggttaacggggttcccggggccccggggtaccccgggggttaaccccccggggtttacccggttaacccggggtttacgggttttacggggttttttaccggttaacgggttttttacccggggaaccgggggggttaacccggtaaaacgggggttaaaaccccgg

SEQ ID NO: 276542 - DNA, 853 bp, Homo sapiens
  misc_feature: GYAE6OF01DO90Z.16.9.A09.1.454.CMB.1.raw
  modified_base (188)..(188): a, c, t, g, unknown or other
  misc_feature (188)..(188): n is a, c, g, or t
  modified_base (215)..(215): a, c, t, g, unknown or other
  misc_feature (215)..(215): n is a, c, g, or t
tcagtgtactactccacgaccggtgctcgatttagcgagacgcgcaggggagagaggggcccagccctgggattttcaggtgttttcatttggtgatcaggactgaacagagagaactcaccatggagttgggctgagctggtcttttttctgtggtacttaatttaaaggtcgtcagtgtagaggtngtagttggtgactcggtaggggacacngtacgtaccggtccggtcggggtcctagagtaccttcctacctaggtacctacgtccgtacttacggaccttttaccgaaccgtttacggaaccgtccgtacctacgtacccgaagtcgtcgggttcccgtccgggtaacccgggtcccgtacccgggacgggtaacccgggggaacgggtaggggggtaccgttgggggttaacggtttccggggttaaacctttcgttaaaccgttacgttaccgttggtacgttaaagtccggttaattcgactacgtaactacttacgacttacgaccgtacggtacggtaccgggtagtaaacccggtccgttcctaaccctacgaacccgaaagtacccgtaaactaaacccgttaaccgacgttaaccctacgttaacctacttacgtaacctacgttactaaacgtcccgtacgacgtaccgacggtaccgaccggaccgaacgtacccgtaggtaaccttacgttacgtaacttaacgtacggttaacgaccggttccggggaaccgggtcccggccggttaaccgggttacccggttcgtttaacgggttgttttaaccggttacgtacgggtttaaccggaccggggtaaacgtacggttaacccgg

SEQ ID NO: 276543 - DNA, 195 bp, Homo sapiens
  misc_feature: GYAE6OF01E1UEG.16.9.A09.1.454.CMB.1.raw
  modified_base (166)..(195): a, c, t, g, unknown or other
  misc_feature (166)..(195): n is a, c, g, or t
tcagtgtactactccacgaccggtgctcgatttagcgagacgcgcaggggggagagaggggcccagccctgggattttcaggtgttttcatttggtgatcaggactgaacagagagaactcaccatggagtttgggctgagcgggctggtcaaggcgcattaagcnnnnnnnnnnnnnnnnnnnnnnnnnnnnnn

SEQ ID NO: 276544 - DNA, 674 bp, Homo sapiens
  misc_feature: GYAE6OF01EN02I.16.9.A09.1.454.CMB.1.raw
  modified_base (171)..(171): a, c, t, g, unknown or other
  misc_feature (171)..(171): n is a, c, g, or t
  modified_base (207)..(207): a, c, t, g, unknown or other
  misc_feature (207)..(207): n is a, c, g, or t
  modified_base (256)..(256): a, c, t, g, unknown or other
  misc_feature (256)..(256): n is a, c, g, or t
  modified_base (274)..(274): a, c, t, g, unknown or other
  misc_feature (274)..(274): n is a, c, g, or t
  modified_base (308)..(308): a, c, t, g, unknown or other
  misc_feature (308)..(308): n is a, c, g, or t
  modified_base (326)..(326): a, c, t, g, unknown or other
  misc_feature (326)..(326): n is a, c, g, or t
tcagtgtactactccacgaccggtgctcgatttagcgagacgcgcagggggagagaggggcccagccctgggattttcaggtgttttcatttggtgatcaggactgaacagagagaactcaccatggagtttgggctgagcggtgtgtttctaggcgctaattttaaaggngtcagtgtgaggtgcagttggtggctcgtggggganactggatccggcgtcgggggtccctgagacttcacctgtacagccctgngaattctaccttaggacnccaatcggaccatgacgcgtgggcccagacggcncccgaaggggaagggggngtaggtaggtggtacgtactactattacgtacgtacgtagtagtatacacgtgtactactaactacgtacgacacgtaccgtacggtacggtacgggtaccgttaccgtaccgtacgaaccgaacgtaacgtaactaactaacaacgaacgtaactactactacgtactacgtactaacgtacgacacgacgacgacgacgaccgacgacgacgtacgtacgttacttacgttaacgtaacgtaacgtaacgtacggtacggtaccgggaccggtaccggtacccggtccggtacggttacgttacggtttacgttacggttacggtacgggtacggtaacggtaacg

SEQ ID NO: 276545 - DNA, 684 bp, Homo sapiens
  misc_feature: GYAE6OF01CR3RB.16.9.A09.1.454.CMB.1.raw
  modified_base (103)..(103): a, c, t, g, unknown or other
  misc_feature (103)..(103): n is a, c, g, or t
  modified_base (173)..(173): a, c, t, g, unknown or other
  misc_feature (173)..(173): n is a, c, g, or t
  modified_base (234)..(234): a, c, t, g, unknown or other
  misc_feature (234)..(234): n is a, c, g, or t
  modified_base (659)..(659): a, c, t, g, unknown or other
  misc_feature (659)..(659): n is a, c, g, or t
tcagtgtactactccacgaccggtgctcgatttagcgagacgcgcaggggctgggcctcaggaagcagcatcggaggtgcctcagccatggcatggatccctntcttcctcggcgtccttgccttatgcacaggactccgtggacctctatgagttgacttcagtccttcccnaggtcgtccgtcgtaccccgggaacgacaggcctagctatcgactgctcgtgatactacgnggtaaattaatttcttgaggtactcgagtcggatccgagcctacgtcccttggtttcgactatactaaagtaacgattagggaactcccggtacctacgacgtacctactacccgtagaccgtcgttaacgttcctacgtcggcctacgtagtcccgtacgtaacggaaacctcgacgtaccgtaacttcgacgaacctacgtaccgaacccggtacaagtaccgttgacgagtaacgaccgtatacggtaacttacgtacgtacgtacgtacgggtcggtacggacgttaccggcggttacctacggttgggtttacgggtcccgaggggaacctaccgacggttccgtaaccggtccgtaccgttcggacttacccggacccggttacgtcccgtcccgtaccccgttgtaccctacgttccncccccggttaccgtcccgttaccgg

SEQ ID NO: 276546 - DNA, 779 bp, Homo sapiens
  misc_feature: GYAE6OF01AGMYN.16.9.A09.1.454.CMB.1.raw
  modified_base (197)..(197): a, c, t, g, unknown or other
  misc_feature (197)..(197): n is a, c, g, or t
  modified_base (587)..(587): a, c, t, g, unknown or other
  misc_feature (587)..(587): n is a, c, g, or t
tcagtgtactactccacgaccggtgctcgatttagcgagacgcgcagggctgggcctcaggaagcagcatcggaggtgcctcagccatggcatggatccctctcttcctcggcgtccttgcttactgcacaggactccgtggcctcctatgagttgactcagtccttccctctagtcgtccgtcggtcccccggganacgacacgccagcactccaccgtgtcctcgtaggaacgtaacgttaaccggtagggtaaactttaaactttttacgtttacgtaggttaactcgtacggaccgggaaacgcccgacggtccccgtacgtttccccgtttaggttttcgacctaacttacgttaaagtaaacggtacggttaacggtaaccgttccccggtcccttaacgaacgtaccctaccgttcccgaaggtacgtccgttacttcgtaccggtcgtaccctaccgtacggtaccttaccgtaacggaaaccctcgaccgtaccctactcgtaaccgaccaccgtacccggaaccgggacctagtacgttaggacgtagtaaccgatcgtacggttaactaccggttntccggacggtacggtaccggtacggacgtaccggtccgtacgttacgggttacggttcgggtacggaacgggtacgaccgtacggtcctacccggtacgtcccggaacggccctaccgggacccgtacgtccccgtccccgttacccgtaccggttccctacctcccggttcccctccccggtccgttaccg

SEQ ID NO: 276547 - DNA, 733 bp, Homo sapiens
  misc_feature: GYAE6OF01DFHLN.16.9.A09.1.454.CMB.1.raw
  modified_base (283)..(283): a, c, t, g, unknown or other
  misc_feature (283)..(283): n is a, c, g, or t
tcagtgtactactccacgaccggtgctcgatttagcgagacgcgcagggggagagaggggcccagccctgggattttcaggtgttttcatttggtgatcaggactgaacagagagaactcaccatggagttgggctgagctggtctttttcttgtggcttaattttaaaggtgtccagtgtgaggtgcagctggttggagtcgtgggggagcttggccacaggccgtgggggtccctggagtacctctcctgtcgcagcctcgtggacttctacctttgaacngctatgaccatcgaccgtgggtcccgccgacggccgtaccggaaggggaacggggtccgtagggaagttcggggtctcgaagggtttacgttacgtggttgggttggttaactacctactagtaacctacgctaacgtaccgttccggtagggtaaccggggtcccggtttacgaaccctattcccgtaccgaagtaacgtaacctaattacccgaaacgaaacccactaaccttagtaacttccgttagaactaaatacgaaaccgagtacccgtaggaacggtacggacccggaaccgaacccggaccgggacctaagttaattacttaccgtagttacgacgaaacggaccgaacccgggtacttacggttaacgtccctaaaccccgtaacttaaccgtttaccgttttacgacctaccgggtcgggtacccggtaaaccccgggg

SEQ ID NO: 276548 - DNA, 777 bp, Homo sapiens
  misc_feature: GYAE6OF01CTAWT.16.9.A09.1.454.CMB.1.raw
  modified_base (215)..(215): a, c, t, g, unknown or other
  misc_feature (215)..(215): n is a, c, g, or t
  modified_base (261)..(261): a, c, t, g, unknown or other
  misc_feature (261)..(261): n is a, c, g, or t
  modified_base (266)..(266): a, c, t, g, unknown or other
  misc_feature (266)..(266): n is a, c, g, or t
  modified_base (287)..(287): a, c, t, g, unknown or other
  misc_feature (287)..(287): n is a, c, g, or t
tcagtgtactactccacgaccggtgctcgatttagcgagacgcgcagggggagagaggggcccagccctgggattttcaggtgttttcatttggtgatcaggactgaacagagagaactcaccatggagtttgggctgagcgtggtcttttcttggtggcttaattttaaaggtgtccagtgtgaggtgctaggttggtggactcggtggggganacctgactaccgccggttcgggggtccctgagtacctctcctgacngcctntggacttcctacgtttaggcnccagtcgccatgaggtcgtccgggtacccgccgacggtccgtaccggaaggggggtaacgggggtcgtaggggtacgggttcggggttccttaccgttaacgtttacgtttacgttacgtaccggtttaacgggttaggttaacttaccgaagtcggtaaccttaacttaaccgttagtacgtaccgtaacgtaccgttcccgggtaagggtaacccggggtcccggtttaaccctacccgtttaccgaaccggtaaacgttaaccgaacctaaacccgttaaccgtaaaacggaaccctacccggttacttacgtacgtccgtacgacttaacgtacgacccgtagcgtacggacgccggaccgacggaccaccgtctagttacttacgtactacgtaacgtacgtcgggccggtcggccgggtcccggtcggtacggttcggtagtttcgggttacgtacggttcgggacgggtaaccgaagggtacg

SEQ ID NO: 276549 - DNA, 803 bp, Homo sapiens
  misc_feature: GYAE6OF01E5KZ5.16.9.A09.1.454.CMB.1.raw
  modified_base (313)..(313): a, c, t, g, unknown or other
  misc_feature (313)..(313): n is a, c, g, or t
tcagtgtactactccacgaccggtgctcgatttagcgagacgcgcagggggagagaggggcccagccctgggattttcaggtgttttcatttggtgatcaggactgaacagagagaactcaccatggagttgggctgagctggtctttttcttgtggtcttaagttttaaaaggtgtccagtgtggaggtgcgaggttggtggacgtcgtgggggatacctaggacgtacccggtccggtcgggggtccctgacactcctcctgtaccacgccttcgtggtacttcctaccgttaggacgccatcgacctagnggacgtcggtcggtccgcgacggtcgtacggaggggagggtcgtggtaggtcggtactacgttaacttacgtacgtcgtacgttaggtagtaactcgtagtacgtacctaagttactacgagtaccgtacggtcccgttacgggtacgggtaacccgggttccccgttaacctacccttaccggaacgaacgaacccgtaaccgtaaacccgttaaccgaaaaccgtacccgtaccgtaccttaacgtaacttccgtaacgtaccttaaacggtacccgtaccgaccgtccggtaccggaccgacccgggaaccgaaccgggaccgtacccggtattacgttacggttaaacttaccggtaacgttaacggtaccgggtccgggtacgggacccgggtcccggtaccggggttacccggtccggtttagggttacggttttaacggttacggttacggttaccggggaacgggtaccgtaagggtacccg

SEQ ID NO: 276550 - DNA, 810 bp, Homo sapiens
  misc_feature: GYAE6OF01CXJXW.16.9.A09.1.454.CMB.1.raw
  modified_base (210)..(210): a, c, t, g, unknown or other
  misc_feature (210)..(210): n is a, c, g, or t
tcagtgtactactccacgaccggtgctcgatttagcgagacgcgcagggggagagaggggcccagccctgggattttcaggtgttttcatttggtgatcaggactgaacagagagaactcaccatggagtttgggctgagcgtgtcgtttcttaggtggctaattttaaaggtgtcagtgtgaggtgcagttggtggactcgtggggganaccgtgactccggccggtgggggtcctgagtctctcctgtacagctcgtgtattccacgtttaggactccagtgccagtgacgtcgttcgggccgaccgagggccctaccgggaaggggtaacgggggccttggggtaaggtcggggttccttaccgttaactttacgttaaccgtcggacgtttaaagggtcggttaaaacttcgaacgtttaaggccctaaagtttaaaccgttaagcggttaccaacggttaacccgttacccgggttaggggaaacgggtttccccgggtacttaacccgttacaaccggaacgtacgaaaccctaacgttaaaccccgaaggaaaccctaccgttacctacgttaactcgtaaccgtaagttaacgtaccggaaacctggtccccgtagacccgtaccgccggtaacggaccaccgggtactacttaggttacttaacgtcgttaaaacgtacggtacccgggttagggggaccgccccggggacccggtttacccggttccggtacgggttacgttttcgggtttacggttaccctttgggggtacccggggaaacggtaaacgggggtaaccg

SEQ ID NO: 276551 - DNA, 616 bp, Homo sapiens
  misc_feature: GYAE6OF01D0D7M.16.9.A09.1.454.CMB.1.raw
  modified_base (390)..(390): a, c, t, g, unknown or other
  misc_feature (390)..(390): n is a, c, g, or t
  modified_base (577)..(577): a, c, t, g, unknown or other
  misc_feature (577)..(577): n is a, c, g, or t
  modified_base (587)..(587): a, c, t, g, unknown or other
  misc_feature (587)..(587): n is a, c, g, or t
tcagtgtactactccacgaccggtgctcgatttagcgagacgcgcagggggagagaggggcccagccctgggattttcaggtgttttcatttggtgatcaggactgaacagagagaactcaccatggagtttgggctgagctggctttttcttgtggcttaattttaaaaggtgtccagtgtgaggtgcagttggtggactcgtgggggagacctgataccgccgtgggggtccctgagactctcctgtacagcctctggtacttccaccttaggacgccatcgcctatgacgtcgtgggtcccgaccgacggcctccgaggggaacggggcgtgggaggtgggtctctactattacgtgtctaaggtggtaatctaatgactagtactncgacacgacctcggtagacgggtccgttacaccttacacagagaactaactacgaacgaacacgcctatatctgactagtcacctgcctagcgaccggccgaggtaaccgaccgggcctagtacttaattacgtataaacgtaagtccgggacggtcggcccggtccgggaccggttcgtacgggtnttcgggtttnacggtttcggaacgggcgtaagggtaccg

SEQ ID NO: 276552 - DNA, 692 bp, Homo sapiens
  misc_feature: GYAE6OF01CEAAR.16.9.A09.1.454.CMB.1.raw
  modified_base (301)..(301): a, c, t, g, unknown or other
  misc_feature (301)..(301): n is a, c, g, or t
  modified_base (350)..(350): a, c, t, g, unknown or other
  misc_feature (350)..(350): n is a, c, g, or t
  modified_base (376)..(376): a, c, t, g, unknown or other
  misc_feature (376)..(376): n is a, c, g, or t
  modified_base (418)..(418): a, c, t, g, unknown or other
  misc_feature (418)..(418): n is a, c, g, or t
tcagtgtactactccacgaccggtgctcgatttagcgagacgcgcagggggagagaggggcccagccctgggattttcaggtgtttttcatttggtgatcaggactgaacagagagaactcaccatggagtttgggctgagctggctttttcttgtggctattttaaaaggtgtccagtgtgaggtgcagttggtggactcgtgggggagacctgataccgccgtggggggtccctgagactctcctgtacagcctcgtggacttcaccgtttaggacgccatgccatgagcgtgggtccnccgaggcctaccgaggggaggggctgggagtgggtctcgtactattacngtactagtaggtatcatgcatactangacagtactcgtggacgggtccgttacaccgttcaccgaganacctaacttaccgaaagaacctacgacctactaatctacgactaacgtcccgactacgcgtagaccggaccggaccggaacggacccgaccgggacctagttacgttaacttacctacggttaaaccttaaacggttccggggtaaccgggggtccgggccccggggtacccgggtaccccgggttaccggttaccggggttacggtttttcggggttttaccggttacggttttcccggggtaccgggggtaaccggtaaaggggttaacccg

SEQ ID NO: 276553 - DNA, 764 bp, Homo sapiens
  misc_feature: GYAE6OF01D1JXO.16.9.A09.1.454.CMB.1.raw
  modified_base (210)..(210): a, c, t, g, unknown or other
  misc_feature (210)..(210): n is a, c, g, or t
  modified_base (267)..(267): a, c, t, g, unknown or other
  misc_feature (267)..(267): n is a, c, g, or t
tcagtgtactactccacgaccggtgctcgatttagcgagacgcgcagggggagagaggggcccagccctgggattttcaggtgttttcatttggtgatcaggactgaacagagagaactcaccatggagtttggctgagcgtggtctttttctgtggcttaattttaaaaggtgtccagtgtgaggtgcagttggtggactcgtgggganacctgactaccgccggtcgggggtccctgagactctcctgtacacgcctcgtaggtnttaccgtaccgttttaggacgccaagtcgaccagtcggacgtcggtcgggtcccgccgaaggtcctaccgggaagggggaacggggcgttagggtacggtcggggttcctacgtacgtttaagttaccgtagtcgtaagggttagtaaacttccaagttcgaacctaatttaaccgttaagtcgtaaccgtaacgtaaccgtacccggttaaggggacccggggttacccggtttaccctaaaccccgttaccgaaaacccgaggtaaaccgtaaaccgttaaacctttaacccggaaacgtaaacccgtaacccgtcttaaccgttaatcccgtagtactacgtttaccgaccgaacgtcgtagaccggtacgaccgacgaccgtaccgactagttacgttataccgttaagtactaagccggtcggtcgggccggtccggtccggtacgtgggttagtttcggtttagtacgttcgggcgggaccgtaaggtacg

SEQ ID NO: 276554 - DNA, 829 bp, Homo sapiens
  misc_feature: GYAE6OF01AIUN2.16.9.A09.1.454.CMB.1.raw
  modified_base (168)..(168): a, c, t, g, unknown or other
  misc_feature (168)..(168): n is a, c, g, or t
  modified_base (188)..(188): a, c, t, g, unknown or other
  misc_feature (188)..(188): n is a, c, g, or t
  modified_base (250)..(250): a, c, t, g, unknown or other
  misc_feature (250)..(250): n is a, c, g, or t
tcagtgtactactccacgaccggtgctcgatttagcgagacgcgcaggggctgggcctcaggaagcagcatcggaggtgcctcagccatggcatggatccctctcttcctcggcgtccttgcttactgcacaggattccgtggcctcctatgattgactcagcttccnagttgtccgtgtcccggganagacagccagcactccgacctgctcgtgagactaaccgtagggtaaacttaattttactttntaggttactcgaagcggaatcccgaggcctacgttcccttggttttcgcacttactaagtaaacgtagtacggtaactccgggtacccttagaacgacctactcccgtagacgtacgtctttcgtcgtacggcccttaccgacgtcgtacgtaacggaaaccgtacgacgtacccctacgttacctaccggtacccacttaacccgggaaccccgggtaacccaacggttaacctacgggttacgtacgtaacggaaacgtcgttaacgtttacccgtaatttaccggtaccggtcgtaacggggtccgggtttaacgggaccggacgggttaccggaaccggtttaccggttcggggttttaccgggttttacccggggaccgggtaacccggggtaaccgtaacggttcccggttaacgggtacccccgttttacggaccggggttacccggtaaccgggtacccccggttaacggggcccccggttaccccccgtacccccgggtttacggttaccccggttaccccgtttcccggtttaaccccccggtcccccggttaccccgttacccccggg

SEQ ID NO: 276555 - DNA, 775 bp, Homo sapiens
  misc_feature: GYAE6OF01D5HJJ.16.9.A09.1.454.CMB.1.raw
  modified_base (278)..(278): a, c, t, g, unknown or other
  misc_feature (278)..(278): n is a, c, g, or t
tcagtgtactactccacgaccggtgctcgatttagcgagacgcgcagggggagagaggggcccagccctgggattttcaggtgttttcatttggtgatcaggactgaacagagagaactcaccatggagtttgggctgagcgtggtcttttctagtggcttaattttaaaaggtgtccagtgtgtaggtgctaggttggtggactgtgggggagacctgataccgccgtgggggtccctgagactctcctgtacagcctctggattcactttaggacnccatgccagtcgagcgtgggtcccgccgaggcctaccgaggggagggcgtggaggtggtctctactattactgactagtacggtaatactagtcgacaacgttactaagtgacctaacggtaaccttccggtacgggaaacgggggtcccgtttacctacccgttaccgaacccgaagggtaactaacgtaaaacctttaacccgaaaacggtaaccctaaaccgtccctttaactacttacccgtaagtaacttaaacgttacgtaacccgaaccggtcccgtacggacgacccggtaccggaacgggaaccgaccgggtacccgtaagttacgttaacgtttaccttaacggtaaacttaaaccgggttaccgggaccggggttccgggaccccggtccggggtaccccggttaaccggttaccgggtaggttttaccgggttttacggtacgttttaccgggaaccgggggtacccggtaaaggggtaaacccg

SEQ ID NO: 276556 - DNA, 718 bp, Homo sapiens
  misc_feature: GYAE6OF01B4XUD.16.9.A09.1.454.CMB.1.raw
  modified_base (188)..(188): a, c, t, g, unknown or other
  misc_feature (188)..(188): n is a, c, g, or t
tcagtgtactactccacgaccggtgctcgatttagcgagacgcgcagggggagagaggggcccagccctgggattttcaggtgttttcatttggtgatcaggactgaacagagagaactcaccatggagtttgggctggagcgtgtcgtttctaggtggctaatttaaaggtgtcagtgtgaggtgcngttggtggactcgtgggggagacctgacgtaccggccggtcggggggtccctggacgtaccttctcctcgtacacgtccttcgtggtacttcctaccgtttaagggactccagttcgcctagtgacgtcgttcgggcccgccgacggcctaccggaggggaacgggtcgtggacggtcgggtctaccgtattactacgtcgacgttagtaggtaactatatcgactatacttagtcgactaacggtccgtaccggtagggtaaaccgggtcccggttacctaacccgttaccgaaccgaaggtaaccgtaacctaacggttaaacccgaaacggaaaccctaacggtccttaaactacgtttccagtaacctaattccggacctagtcccggagaccgacgaccggaagaccgaccgtctagttcgtaattacgtaacgtaactacggtccggaggtcccgggacgtcccggaacggtccgtacggttagtttcggttcgacggttcgggaacggtacgtaacgggtaac

SEQ ID NO: 276557 - DNA, 653 bp, Homo sapiens
  misc_feature: GYAE6OF01DILPY.16.9.A09.1.454.CMB.1.raw
  modified_base (172)..(172): a, c, t, g, unknown or other
  misc_feature (172)..(172): n is a, c, g, or t
  modified_base (176)..(176): a, c, t, g, unknown or other
  misc_feature (176)..(176): n is a, c, g, or t
  modified_base (181)..(181): a, c, t, g, unknown or other
  misc_feature (181)..(181): n is a, c, g, or t
  modified_base (186)..(186): a, c, t, g, unknown or other
  misc_feature (186)..(186): n is a, c, g, or t
  modified_base (261)..(261): a, c, t, g, unknown or other
  misc_feature (261)..(261): n is a, c, g, or t
  modified_base (263)..(263): a, c, t, g, unknown or other
  misc_feature (263)..(263): n is a, c, g, or t
  modified_base (274)..(274): a, c, t, g, unknown or other
  misc_feature (274)..(274): n is a, c, g, or t
tcagtgtactactccacgaccggtgctcgatttagcgagacgcgcagggggagagaggggcccagccctgggattttcaggttgttttcatttggtgatcaggactgaacagagagaactcaccatggagtttgggctggagcggtcgtgttctaggcgctaatttaaaggngtcngtgtnagtgnagtgtgctgagggcactgatcgcgtcggggtccagagctctcctgcgacgtcctatggtatcgacctttagggcncncgtcgcagtgngtcgtcggtccgcgacgcgcggagggagggcgtggtggtcggtcgtcgtacgtagtacgtgtcgtagtagtactatagtagatactactagtacgtacgtacgtacgtcggtacggtacggtaccgtacgtacgtacgtacgtacgtacgtaacgtaacgtaacgtaacgtaacgtaccgtactacgtacgtacgtacgtacgtaacgtacgacgtacgtacgtacgacggacggacggacgtaccgtacgtcgtacgttacgttacgttacgtaacgtacgtacgtacggtacgggtccggtccggtaccggtaccggttccggttcggttcggtttacggtttcggttacggttacggtacggtacggtacggtacg

SEQ ID NO: 276558 - DNA, 852 bp, Homo sapiens
  misc_feature: GYAE6OF01DA28G.16.9.A09.1.454.CMB.1.raw
  modified_base (195)..(195): a, c, t, g, unknown or other
  misc_feature (195)..(195): n is a, c, g, or t
tcagtgtactactccacgaccggtgctcgatttagcgagacgcgcaggggctgggcctcaggaagcagcatcggaggtgcctcagccatggcatggatccctctcttcctcggcgtccttgcttatgcacgaggatccgtgccttctatgagttgacctcacgtccttcccatgtcgtccgtcggtccccggganagacacgccctagcctatacctacctcggccttacgtaggtaacgtaacctaaccggtagggtaaatttaactttcgtttacgtaggtactacgacggtacggacgaccgacggtacctacggttcccttagtttacgactattaacgtaagtaacgtacgtaacggtaacgtccggtacctacgaacgtaccgaccgttcctaaggtacgtaccggttaacgttccgtacgtccggtcctacgtacgtaccgttaccggaacggtaaaaccaccggtaccacccgttaccgtccgttaaaccgaacccgtacctacccgggtaacccggaacctaacgtacgtaacggtaacgtaacgtaacgtaaccgtacgttaactaaccgtttaacttacggttaccggtaacggtaccggtacgggtaccggacgtaccgggacggtttacgtaccggtttacggggtttacggttaccggggtaacgggaaccgttaaccgggtaacgttccgtaacccggtaacccggttcgggaaccccgttaacgggaccccggtaaccggggttacccgcccccgttaccgggtacccccggtttaccgtaaaccctcccggtttacccccggttaaccgtttccccccggtagttaaaccccggg

SEQ ID NO: 276559 - DNA, 764 bp, Homo sapiens
  misc_feature: GYAE6OF01DIF4P.16.9.A09.1.454.CMB.1.raw
  modified_base (435)..(435): a, c, t, g, unknown or other
  misc_feature (435)..(435): n is a, c, g, or t
tcagtgtactactccacgaccggtgctcgatttagcgagacgcgcagggggagagaggggcccagccctgggattttcaggttgttttcatttggtgatcaggactagaacagagagaactcaccatggagttgggctgagcgtggtcttttcttggtggacttaattttaaaggtgtccagtgtgaggtgcgagttggtggacgtcgtgggggacgtaccgtgacgtacccgccgttcggggggtccctggagacctcctccgtgtactcgcctcgttggacttccgtaccgtttaggacgccgtatcgcatgtcgcgtcggccgacgagccgtcgaaggggtagggctgggtagtcgggtccttacgtaactttacgttacgttacgacgttaacggttagtaaagttcctaacgtggtactaactagtaacngacacggaccttaccgggaggtaaaccgggtcccgtttaccacccgttacccaacgaagacgaacctaagtaacccaaagaccacgtctactaagtcacgtataactacgacctacgccgtacggacgacccgcggaaccgacgaccggtactacggtactttaacgtactaacggttaacgttaaaccggtcggggacccgggtcggggtaccccggttacccgggggtacccggttaccccggggttacgttacggggtttttcggttttacggttaaccgggttttaccggggtacccggggtaaacgggtaaggttaaaccgggg

SEQ ID NO: 276560 - DNA, 809 bp, Homo sapiens
  misc_feature: GYAE6OF01C293S.16.9.A09.1.454.CMB.1.raw
  modified_base (173)..(173): a, c, t, g, unknown or other
  misc_feature (173)..(173): n is a, c, g, or t
  modified_base (198)..(198): a, c, t, g, unknown or other
  misc_feature (198)..(198): n is a, c, g, or t
  modified_base (210)..(210): a, c, t, g, unknown or other
  misc_feature (210)..(210): n is a, c, g, or t
tcagtgtactactccacgaccggtgctcgatttagcgagacgcgcaggggctgggcctcaggaagcagcatcggaggtgcctcagccatggcatggactccctctcttcctcggctcctgcttactgcacagactccgtggcctctatgagttcgactcacgtccttccctgngttcgtccggtcggtaccccggganacgacacgccanactactccaccttgctcgtaggataactaaccgtaggtaaactttaactttcttcggtagactcgacggacggaacgccgacggaccttacggttcccttggttttacgacttagttaacgttaagtaaaggtacgtaacggtaccttaccggtaccctacgaactacgtacctcccgtaggtaccacgtttacgttccgtacgtcgtccctacgactccgtacgaaccggaaactccggtacaccctctaccgtaccaactaccgtacccggaacccgggacctacgttaacggtatacgggactaagtaccgtagttaacgtaccgttaacgtttacgtacggtacgtacggggtaccggtagggaacgtaccggtacgggtcgtttaaccggggttttggggtttaccgggggttaccgggaacccgggaaccgggtaaccggtaccggttcccggtaaccggtttccccgtccgggttaaaccgggcccggtaaacccggtaccgggtcccggtccccgttccccggtccccgttacggttacccttcccctttccccgggtttaaccccgcccccggtttcccgtaacccgggg

SEQ ID NO: 276561 - DNA, 1034 bp, Homo sapiens
  misc_feature: GYAE6OF01CIJM4.16.9.A09.1.454.CMB.1.raw
  modified_base (204)..(204): a, c, t, g, unknown or other
  misc_feature (204)..(204): n is a, c, g, or t
tcagtgtactactccacgaccggtgctcgatttagcgagacgcgcaggggctgggcctcaggaagcagcatcggaggtgcctcagccatggcatggatccctctcttcctcggcgtccttgcttactgcacaggatccgtggcctcctatgagttgactcagtccttccctcgagttcgtacccggttcggtacccccgggganacgaccaggaccaacgcctaacttccgaaccgttgtccttacgttagggaacgtaacgttaacccggttaggggttaaaaacgttttaaaacttttacccgttttcggttagggttaacttaccggtaacggtaccgggtaaaacggcccgtaacgggtcccgtaaccggtttcccccgttaggtttttaggtaccctaagtttacgttaaaacgtaaaacggtaacgttaaggggaacccgttcccggtaccccgttaagaccggtaaccttaccgttacccccgttaagggaaaccccgtttccgtaccgtttttaacccgtccggttaccggtaccgttaacccggtaaacgttcccgttaaaccggttaaacccgggaaaactaacccggggtaacccgtacccgtaacccctttaccggtaaccgaaaccccgtttaacgggtaacccccgggaacccccggggtaaaccccggtaaacggttaacccgggttaacggttaacgggtaaccggttaaccggtaaccgttaacccggtttaacggttaaaccgtttaaaccgttttaccggtacgggttaaaccggtaacgggggttaccggtacgggggttaaccaccgggtacccgggttaaggtaacccgggttttcgggttaaccgggggtttttaccggaccgggttaaccgggtaacccgtaccggttacgggtacccgtaacccggttccgaccgggttaccgacccggtaccgacggttaccccgtcccggtacccccgttacgtacccctacgtttcccggaccccctttccgtcccgtaaacccgg

SEQ ID NO: 276562 - DNA, 755 bp, Homo sapiens
  misc_feature: GYAE6OF01CCOKA.16.9.A09.1.454.CMB.1.raw
  modified_base (306)..(306): a, c, t, g, unknown or other
  misc_feature (306)..(306): n is a, c, g, or t
tcagtgtactactccacgaccggtgctcgatttagcgagacgcgcagggggagagaggggcccagccctgggattttcaggtgttttcatttggtgatcaggactgaacagagagaactcaccatggagtttgggctgagcgtggtctttttcttgtggcttaattttaaaggtgtccagtgtgaggtgcgtagttggtggactcggtggggacgaccgtgacgtacccggccggtcgggggtccctggacgtaccttcctccgtagtaccacgtccttcgtggtacttcctaccgttacgggacnccctagtcgacctagtcgacgtccggtcgggtcccgaccgacggtccctaccgggaagggggacggggtcggtagggtacgggttcgggttcctaccgttacgtttacgttacgtacgtacgtaggtttaggtaactagtacgtcgacctagttaactagtcgacgtacgtaccggtccggtacgggaccgggtcccgttacctaccgttaccaaccgtagtaacgacttaaaccgtaccgaaacgacctacgtacttacctagtccgtagacgttaacgtaccgaccgtacgtcgtacggaccgcggaccgaacggacgtccgactagttacttacgtctaacgtacgtaacgtcgggacgggtccgacccgggtcggtacccggttcggacgggtttcgttcggttttacgtaccggtttaggggaccgggtaagtaccggtaacgg

SEQ ID NO: 276563 - DNA, 596 bp, Homo sapiens
  misc_feature: GYAE6OF01C59CR.16.9.A09.1.454.CMB.1.raw
  modified_base (253)..(253): a, c, t, g, unknown or other
  misc_feature (253)..(253): n is a, c, g, or t
  modified_base (275)..(275): a, c, t, g, unknown or other
  misc_feature (275)..(275): n is a, c, g, or t
  modified_base (304)..(304): a, c, t, g, unknown or other
  misc_feature (304)..(304): n is a, c, g, or t
  modified_base (310)..(310): a, c, t, g, unknown or other
  misc_feature (310)..(310): n is a, c, g, or t
  modified_base (328)..(328): a, c, t, g, unknown or other
  misc_feature (328)..(328): n is a, c, g, or t
  modified_base (373)..(373): a, c, t, g, unknown or other
  misc_feature (373)..(373): n is a, c, g, or t
  modified_base (586)..(586): a, c, t, g, unknown or other
  misc_feature (586)..(586): n is a, c, g, or t
tcagtgtactactccacgaccggtgctcgatttagcgagacgcgcgagggggagagagggcccagccctgggattttcaggtgttttcatttggtgatcaggactgaacagagagaactcaccatggagttgggctgagctggtctttttcttgtggcttaattttaaaaggtgtccagtgtgaggtgcagttggtggatcgtgggggagacctgatacccgccgtgggggtccctgagacctctcctgtacngcctgtgtattcactttagganccatcgccagtgcgtcgtcgggccaccgnggtccncggaggggacgggcaggngtcggctacgtactatctgctagtagtactcgatggacataactngacgaagtcgtacgaggaacgggtcccgtactacccttacacgtagactacgaattaccaaagacctacgtactactacgttactacgactatcacgacgcctaggacgcgaccggacgaccgaccggttcaacttgttactactatacgtaagtcggacggtccggccggcgtcccggtacgtcgtgttacggtttagtacgttggccgggntacgggaacg

SEQ ID NO: 276564 - DNA, 714 bp, Homo sapiens
  misc_feature: GYAE6OF01BGRWL.16.9.A09.1.454.CMB.1.raw
  modified_base (170)..(170): a, c, t, g, unknown or other
  misc_feature (170)..(170): n is a, c, g, or t
  modified_base (190)..(190): a, c, t, g, unknown or other
  misc_feature (190)..(190): n is a, c, g, or t
  modified_base (195)..(195): a, c, t, g, unknown or other
  misc_feature (195)..(195): n is a, c, g, or t
  modified_base (213)..(213): a, c, t, g, unknown or other
  misc_feature (213)..(213): n is a, c, g, or t
  modified_base (218)..(218): a, c, t, g, unknown or other
  misc_feature (218)..(218): n is a, c, g, or t
  modified_base (241)..(241): a, c, t, g, unknown or other
  misc_feature (241)..(241): n is a, c, g, or t
tcagtgtactactccacgaccggtgctcgatttagcgagacgcgcaggggctgggcctcaggaagcagcatcggaggtgcctcagccatggcatggatccctctcttcctcggcgtccttgcttactgcacaggatccgtggcctcctatgagttgactcagcttccctnagtgtccgtgtccccggganagacngccagcatccacctgctntgganataacctgggaattaatttcttnggtatcagcggaagccaggccagtccctgttttggcatctataaagataggaactccggccctcacgacactacccctgagcctagttctccgtaggcctaccgagtcctaccgtacggaaaaccaccgacggacccctacttaccgtaccggtaacccacgttacccgaaccccggggacccctacgtaaccgtagtacggtactacgaaggtcgttacgtaaccttaacttaccgttaggtaccgaagggtccgggtacggggtaccaacggccgggtacctaacggttcgggttacggggtttttaccgggaccgggtacgggtaaccgtaacgggtcccgttacgggtaccccggttaccggtccggtaccgtaccggtaaccccggtacggccccgttccccggtaccccccggttcggtaccccttaccgttacccgtttcccgttcccccctaccccggttacccg

SEQ ID NO: 276565 - DNA, 732 bp, Homo sapiens
  misc_feature: GYAE6OF01EGKJZ.16.9.A09.1.454.CMB.1.raw
  modified_base (159)..(159): a, c, t, g, unknown or other
  misc_feature (159)..(159): n is a, c, g, or t
  modified_base (171)..(171): a, c, t, g, unknown or other
  misc_feature (171)..(171): n is a, c, g, or t
  modified_base (195)..(195): a, c, t, g, unknown or other
  misc_feature (195)..(195): n is a, c, g, or t
tcagtgtactactccacgaccggtgctcgatttagcgagacgcgcaggggctgggcctcaggaagcagcatcggaggtgccctcagccatggcatggatccctctcttcctcggcgtccttgcttactgcacaggatccgtgcctctatgagttgactnagtccttacccngtagtcgtccgtcgtaccccgganacgaccagccagtccatccgactgctcgtggaacgattaaccgtagggtaaatttaaacttttacttacgtaggtatacgaaggacggaacgcccgacggtcccgtaccgttcccgttaggttttacggacctaattacgttaaacgtaaacgtagttaacgggaacgttcccggacctacgacgtaaccaccgttacccgtaaggacgtaccgttactttccgtacgtcggccaccgtagtcccgttacgtaacgaaacctacgacgccctacgctaccgaacctacgtaaccggaacccggaaccgaacgtactagtacgggtaataggacgtacttacgtaccttaagtctagacggtaggtacgtaggacgtacgccggtagtacggttcgggttaggggttaccggaacgggtacggtaccgacgttccggtaaccgtacccggtccgtccggaccgaccgtaccgtacccggtccgttacccccgccgttcgtacctaccttcccggttacccctcccgtacccgtaccgg

SEQ ID NO: 276566 - DNA, 1030 bp, Homo sapiens
  misc_feature: GYAE6OF01EZPB2.16.9.A09.1.454.CMB.1.raw
tcagtgtactactccacgaccggtgctcgatttagcgagacgcgcagggggagagagggcccagccctgggattttcaggtgttttcatttggtgatcaggactgaacagagagaactcaccatggtagtttgggctgagctggtctttttcttgtggcttattttaaaaggtgtccagtgtgaggtgcgagttggtggactcgtgggggagacctgactaccgccgtcgggggtccctgacgactcgtcctgtacacgcctcgtggtacttctaccgttttaggacgtcccatcgaccctaagtcgtagtccgtcggggtcccgacccggacgggtcccgtaccccggaagggggaaacgggggccggttaggggaaggggtttccggggttccgtttcccgttaaccgtttaagtttaaccggttagtaccggtttaaggttagggttaaactccgaaatcggtactaacgttaactaacgttaggaaccgtaacgtaacccggttacccggtaagggttaacccggggggtaccccggttttaccccgtaaccccgtttacccgaaaacccgtaaacggttaaaccgtaaaccgttaaacccgtttaaccccgaaaagggtaaaacccccgaacccggttaacccgtttaccctaaacgtttaacccggtttaacgtaacccgttaaacgtttaacccggaacccgtaaccggtacccgtttaagggaacccgggtaaccccggggtaacccgggtaaaccggggaaacccgtacccggggaacccttaaagtttacccggtttaaatttaacccggtttaaaccggttaaaccgggtttaaacccggttaccgggggttaaccccgggggtacccggggtcccccggggtacccccgggggtttaacccccgggttacccggtttaccccgggggtttaaggttttacccggggttttttacgggttaccggtttttaccggggaacccgggggttaaaccgggtaaaaccgggggttaaacccgg

SEQ ID NO: 276567 - DNA, 856 bp, Homo sapiens
  misc_feature: GYAE6OF01D0AX9.16.9.A09.1.454.CMB.1.raw
  modified_base (133)..(133): a, c, t, g, unknown or other
  misc_feature (133)..(133): n is a, c, g, or t
  modified_base (195)..(195): a, c, t, g, unknown or other
  misc_feature (195)..(195): n is a, c, g, or t
  modified_base (201)..(201): a, c, t, g, unknown or other
  misc_feature (201)..(201): n is a, c, g, or t
  modified_base (207)..(207): a, c, t, g, unknown or other
  misc_feature (207)..(207): n is a, c, g, or t
  modified_base (218)..(218): a, c, t, g, unknown or other
  misc_feature (218)..(218): n is a, c, g, or t
tcagtgtactactccacgaccggtgctcgatttagcgagacgcgcaggggctgggcctcaggaagcagcatcggaggtgcctcagccatggcatggatccctctcttcctcggcgtccttgcttactgcacgnggactccgtggccttctagtgtagttgactcagtccttcctcagtcgtccgtcgtcccgganacgacncgccanctatcaccgtnctagtggaagacgtaaccggtagggtaaacttaacttttaccgttgtagtactacgacggtacggaacgaccgacggcccgtaccgttcccgtttggttttcgtactacgttacttaaagtaaaagtacggtaagggtaccgtcccggtaccctagaacggtacctaccgtaccgtacggacgtacgttacttaccgtcgtaccgccttaaccgaacgtccgttacgaaaccgggtaaaccaacggtcctaccctaccgttccgtaacgaacccgtaacgtccccgggaaccggtaacccgtaacgtaacgttaggtaacgtaacgtaacggtaaccgtacgttaacgtaacgtttaccgtacggttacggtacggtacgggtaccgggtaacgggtacgaccgggttaccggtaccggtttaacgggtttcggggtttacccggggttaccgggtaaccgggtaaccggggtaaacccggttaccggttacccggtaacccgggttccccggttacccggttaccggacccgtaacccggtccccggtaaacggtcccccggttaccccggtccccgttaccggtacccgttccccttacccggtttccccccgtccccgttacccggtaaccccgg

SEQ ID NO: 276568 - DNA, 1047 bp, Homo sapiens
  misc_feature: GYAE6OF01A41MA.16.9.A09.1.454.CMB.1.raw
  modified_base (208)..(208): a, c, t, g, unknown or other
  misc_feature (208)..(208): n is a, c, g, or t
tcagtgtactactccacgaccggtgctcgatttagcgagacgcgcgagggggagagacggggcccagccctgggtattttcaggttgttttctagtttggtgatcgaggactgaacagagagtaactccaccagtggtaggttggctgagcgtggttcttttcgtgtggtactttaagttttaaaggtcgtccgagtggtaggagtgngtaggttggtcggacgtcggtgggacgtcgtagtacgtaccggtccgggtacggggtccctgactccgttcctacgtacgtacgcgtccgtgtcggtcttaccgtaccgttaggacctcgtacgtcgtactagtcggtacggtcggtccggtccgacggtaccggtaccggtacggggacgggggtacgggtcggtaggggttacggttacggttaccttacgtaacgtttaccgttacgtacggttacggttaacggttaggttaacgtacgtacgtacggtaaccttaacggttaacgtacgtttaccgaccggttaaccgttaccggggttaaccggttaccggggttaccccgggttaccccgttaaccccgttaacccgtaaccggtaacggtaaaccggtaaccgttaaaccccggttaaaccgtaaacccgggtaaacccgttacccgtaaaccctttaccgtttaaacccgttccggttaacccgttaacccggtttaaacgttaccgggtaaccccgtaaacccgggtaccggtaaccggtttcccggggaacccgggtaacccgggtaaccgggtaacccggtaacccggttaccccggtaaccgtttaccgggtttaaaccgttaacccgttaaacggtttaacccggttaacccgggttaacggggttacccccgggtaccgggggttaccccggtccccggggttaacccccggggttaccggttaacccgggtttaccgggtttaccggtttttaaccggttacccgggtttaacccgggttaacggggttaacccccggggttaacgggaaccgggtaaaccgg

SEQ ID NO: 276569 - DNA, 513 bp, Homo sapiens
  misc_feature: GYAE6OF02IT9M0.16.9.A09.1.454.CMB.1.raw
  modified_base (190)..(190): a, c, t, g, unknown or other
  misc_feature (190)..(190): n is a, c, g, or t
  modified_base (347)..(347): a, c, t, g, unknown or other
  misc_feature (347)..(347): n is a, c, g, or t
  modified_base (380)..(380): a, c, t, g, unknown or other
  misc_feature (380)..(380): n is a, c, g, or t
tcagtgtactactccacgaccggtgctcgatttagcgagacgcgcaggggctgggcctcaggaagcagcatcggaggtgcctcagccatggcatggatccctctcttcctcggcgtccttgcttactgcacaggatccgtggcctcctatgagttgactcagcttccctcagtgtccgtgtccccggganagacagccagcatcacctgctctggagataacctgggaagttaaatttacttctggtatcagcggaagccaggccagtcccctgtttggtcatctataagataggaatcggccctcagacatccctgagcgattctctggctccagctctggaaacncagccactctgaccatcacgggacccagactanggatgaagctgactattactgtcaggcgtggacagcgcacgtgtggtttcggcggaggaccaagcgtgaccgtcgtcggtcgaggcccaaggcctcgccccctcggtccactccgtcgttcccgaccctcccg

SEQ ID NO: 276570 - DNA, 528 bp, Homo sapiens
  misc_feature: GYAE6OF02F3H05.16.9.A09.1.454.CMB.1.raw
  modified_base (376)..(376): a, c, t, g, unknown or other
  misc_feature (376)..(376): n is a, c, g, or t
tcagtgtactactccacgaccggtgctcgatttagcgagacgcgcagggggctgggcctcaggaagcagcatcggaggtgcctcagccatggcatggatccctctcttcctcggcgtccttgcttactgcacaggatccgtggcctcctatgagttgactcagcttccctcagtgtccggtgtccccgggacacgaccagccagcagtccacctgctctggagataacctgggaaattaaatttacctttctaggtatcagcggaagccaggccagtcccctgtttggtcatctataagataggaatcggcctcagacgactccctgacgcgtattctcgtggctccagctctggtaaacacagccactctgaccnctcaccgggacccagactatggatgagctgactattactgtcaggcgtggacagcgcactgtggtttcggcggaggaccaagcgtgaccgttcgacggtcacgccgaacggcctcgcccccgtgtccaccttcgtcgttcccgcccttcccg

SEQ ID NO: 276571 - DNA, 517 bp, Homo sapiens
  misc_feature: GYAE6OF02GWRZW.16.9.A09.1.454.CMB.1.raw
tcagtgtactactccacgaccggtgctcgatttagcgagacgcgcaggggctgggcctcaggaagcagcatcggaggtgcctcagccatggcatggatccctctcttcctcggcgtccttgcttactgcacaggatccgtggcctcctatgagttgactcagcttccctcagtgtccgtgtccccgggacagacagccagcatcacctgctctggagataacctgggaataaatttactttctggtatcagcggaagccaggccagtcccctgttttggtcatctataaagataggaatcggccctcagacatccctgagcgattctctggctccagctctggaaacacagccactctgaccatcaccgggacccagactatggatgaagctgactattactgtcaggcgtgggacagcggcactgtggtttcggcggagggaccaagctgaccgtccgtcggtcacgcccgaaggcctcgccccgtcggtcaccttcgtcgttccccaccctcccg

SEQ ID NO: 276572 - DNA, 524 bp, Homo sapiens
  misc_feature: GYAE6OF02I34RB.16.9.A09.1.454.CMB.1.raw
tcagtgtactactccacgaccggtgctcgatttagcgagacgcgcaggggctgggcctcaggaagcagcatcggaggtgcctcagccatggcatggatccctctcttcctcggcgtccttgcttactgcacaggatccgtggcctcctatgagttgactcagcttccctcagtgtccgtgtccccgggacagacagccagcatcacctgctctggagataacctgggaataaatttactttctggtatcagcggaagccaggccagtccccctgtttggtcatctataaagataggaatcgccctcagacatccctgagcgattctctggctccagctctggaaacacagccactctgaccatcaccgggacccagactatgatagaagctgactattactgtcaggcgtgggacaggcggcgacgttgtgggttttcggcggtagggaccaaggctgacccgtcgtcggtcgacgcccgaaggcctcgccccgtcggtcacgtcgtcgttcccgtccctcccg

SEQ ID NO: 276573 - DNA, 539 bp, Homo sapiens
  misc_feature: GYAE6OF02HXNQU.16.9.A09.1.454.CMB.1.raw
tcagtgtactactccacgaccggtgctcgatttagcgagacgcgcagggggagagaggggcccagccctgggattttcaggtgttttcatttggtgatcaggactgaacagagagaactcaccatggagtttgggctgagctggctttttcttgtggctattttaaaaggtgtccagtgtgaggtgcagttggtggactctgggggagacctgataccgcctggggggtccctgagactctcctgtacagcctctggattcacctttaggagccatgccatgagctgggtccgccaggctccagggaaggggctgggagtgggtctctactattactgctagtggtaatcatgcatactatgcagactccgtgaacgggccgtcaccttcaccagagacaattccaagaacacgctactatctgcaattgaccagcctgagcgccgaggaccacggccatgtattactgtactaatcggcgggtggccggcggccggtacctcggagttcggttttgagtttcgtcggggccaagggac

SEQ ID NO: 276574 - DNA, 589 bp, Homo sapiens
  misc_feature: GYAE6OF02GT938.16.9.A09.1.454.CMB.1.raw
tcagtgtactactccacgaccggtgctcgatttagcgagacgcgcagggggagagaggggcccagccctgggattttcaggtgttttcatttggtgatcaggactgaacagagagaactcaccatggagtttgggctgagcgtggcttttctgtggctattttaaaaggtgtccagtgtgaggtgcagttggtggactctgggggagacctggataccgccgtggggggtccctgagactctcctgtacagcctctggattcacctttaggagccatgccatgagctgggtccgccaggctccgagggaaggggctggagtgggtctctacgtattactgctagtggtaatcatgacatactatgcagactccgtagaaggccgttcaccttcacagagacaatccaagacacgctataatctagactaattcgaaccacgcctggacgccgaccggaggaccacggcctagttagtaacttactagttaactaaacgtcggcgggtacggcccggtaccgggcccggtaaccgtcgggtagttcgggtttttcgtaacgtttcgggtacggggtaccgtaagggtacc

SEQ ID NO: 276575 - DNA, 553 bp, Homo sapiens
  misc_feature: GYAE6OF02GB1GR.16.9.A09.1.454.CMB.1.raw
tcagtgtactactccacgaccggtgctcgatttagcgagacgcgcagggggagagaggggcccagccctgggattttcaggtgttttcatttggtgatcaggactgaacagagagaactcaccatggagtttgggctgagctggcttttcttgtggctattttaaaaggtgtccagtgtgaggtgcagttggtggactctgggggagacctgataccgcctggggggtccctgagactctcctgtacagcctctggattcacctttaggagccatgccatgagctgggtccgccaggctccaggggaaggggctgggagtggggtctctactattactgctagtggtaatcatgcatactatgcagactccgtagaacggggccgttcaccttcaccagagacaattccaagaacacgctctatctgacattcaccagcctgagcgccgaggacacgccatcgtattactgtactaagtcgcgggtcggcccggcggcccggtaccgtcggtagttcggtttgtacgtttcgtcgggggacctaagggtaccg

SEQ ID NO: 276576 - DNA, 548 bp, Homo sapiens
  misc_feature: GYAE6OF02JAZ9F.16.9.A09.1.454.CMB.1.raw
  modified_base (348)..(348): a, c, t, g, unknown or other
  misc_feature (348)..(348): n is a, c, g, or t
  modified_base (358)..(358): a, c, t, g, unknown or other
  misc_feature (358)..(358): n is a, c, g, or t
  modified_base (415)..(415): a, c, t, g, unknown or other
  misc_feature (415)..(415): n is a, c, g, or t
tcagtgtactactccacgaccggtgctcgatttagcgagacgcgcaggggctgggcctcaggaagcagcatcggaggtgcctcagccatggcatggatccctctcttcctcggcgtccttgcttactgcacaggatccgtggcctcctatgagttgactcagcttccctcagtgtccgtgtccccgggacagacagccagcatcacctgctctggagataacctgggaagtaaatttactttctggtatcagcggaagccaggccagtcccctgtttggtcatctataaagataggaatcggccctcagacatccctgagcgattctctggctccagctctggaaacncagccactcngaccatcaccgggacccagactatggatgaagctgactattactgtcagcgtggacngcggcacgtggtcggttttcggcggtagggaccgaagcgtacgacccgttccgtcggtccgacggacccgaacggtccgtccgtcccccgtcggtaccgtaccgttaccgtccgttccccgccccttccccgg

SEQ ID NO: 276577 - DNA, 532 bp, Homo sapiens
  misc_feature: GYAE6OF02FSPPD.16.9.A09.1.454.CMB.1.raw
  modified_base (347)..(347): a, c, t, g, unknown or other
  misc_feature (347)..(347): n is a, c, g, or t
tcagtgtactactccacgaccggtgctcgatttagcgagacgcgcaggggctgggcctcaggaagcagcatcggaggtgcctcagccatggcatggatccctctcttcctcggcgtccttgcttactgcacaggatccgtggcctcctatgagttgactcagtttccctcagtgtccgtgtccccgggacagacagccagcatcacctgctctggagataacctgggaagtaaatttacttctggtatcagcggaagccaggccagtcccctgtttggtcatctataaagataggaatcggccctcagacatccctgagcgattctctggctccagctctggaaacncagccactctgaccatccaccgggacccagactatgatgaagctagactattactgtcaggtcgtgggacagcggcacgtggttcggttttcgggcgggtacgggaccgaagccgtgaccgtccgtcggtccgagcccaaggctcgccccgtcggtccaccgtctcgttcccaccctcctaccgg

SEQ ID NO: 276578 - DNA, 516 bp, Homo sapiens
  misc_feature: GYAE6OF02I9W67.16.9.A09.1.454.CMB.1.raw
  modified_base (217)..(217): a, c, t, g, unknown or other
  misc_feature (217)..(217): n is a, c, g, or t
  modified_base (421)..(421): a, c, t, g, unknown or other
  misc_feature (421)..(421): n is a, c, g, or t
  modified_base (508)..(508): a, c, t, g, unknown or other
  misc_feature (508)..(508): n is a, c, g, or t
tcagtgtactactccacgaccggtgctcgatttagcgagacgcgcaggggctgggcctcagtaagcagcatcggaggtgcctcagccatggcatggatccctctcttcctcggcgtccttgcttactgcacaggatccgtggcctcctatgagttgactcagcttccctcagtgtccgtgtccccgggacagacagccagcatcacctgctctgganataacctgggaagtaaatttacttctggtatcagcggaagccaggccagtcccctgttttggtcatctataaagataggaatcggccctcagacatccctgagcgattctctggctccagctctaggaaacacagccactctgaccatcgaccgggacccagactatggatagaagctagactattactgtcaggcgtgggacngcgcacgtgtggtttcggcggagggacgagctgccgtccgtcggtcgcgccgaggcctcgccccgtcggtccacctcctcgttcccnccctcccg

SEQ ID NO: 276579 - DNA, 548 bp, Homo sapiens
  misc_feature: GYAE6OF02GSCUP.16.9.A09.1.454.CMB.1.raw
  modified_base (386)..(386): a, c, t, g, unknown or other
  misc_feature (386)..(386): n is a, c, g, or t
tcagtgtactactccacgaccggtgctcgatttagcgagacgcgcaggggctgggcctcaggaagcagcatcggaggtgcctcagccatggcatggatccctctcttcctcggcgtccttgcttactgcacaggatccgtggcctcctatgagttgactcagcttccctcagtgtccgtgtccccgggacagacagccagcatcacctgctctggagataacctgggaattaaatttactttctggtatcagcggaagccaggccagtcccctgtttggtcatctataaagataggaatcggccctcagacatccctgagcgattctctggctccagctctaggaaacacagccactctgaccatccgaccgggacccagactagnggatgaagctagactattactgtcgaggcgtgggacaggcggacacgttggttcggttttcgggcgggtagggaccgaagtcgtacgaccgtcgtccggtcgacggacccaacgggcctcgcccctcggtcctaccgttccgtcgttccccacccttcccgg

SEQ ID NO: 276580 - DNA, 520 bp, Homo sapiens
  misc_feature: GYAE6OF02FRX4U.16.9.A09.1.454.CMB.1.raw
  modified_base (217)..(217): a, c, t, g, unknown or other
  misc_feature (217)..(217): n is a, c, g, or t
tcagtgtactactccacgaccggtgctcgatttagcgagacgcgcaggggctgggcctcaggaagcagcatcggaggtgcctcagccatggcatggatccctctcttcctcggcgtccttgcttactgcacaggatccgtggcctcctatgagttgactcagcttccctcagtgtccgtgtccccgggacagacagccagcatcacctgctctgganataacctgggaataaatttacttctggtatcagcggaagccaggccagtcccctgttttggtcatctataaagataggaatcggccctcagacatccctgagcgattctctggctccagctctggaaacacagccactctgaccatcaccgggacccagactatggatgaagctgactattactgtcaggcgtgggacagcggcacgtgtggttttcggcggagggaccaaggctcgaccgtccgtcggtcacggcccaaggcctcgccccgtcggtccaccttctcgttccccaccctcccg

SEQ ID NO: 276581 - DNA, 561 bp, Homo sapiens
  misc_feature: GYAE6OF02H55X6.16.9.A09.1.454.CMB.1.raw
  modified_base (294)..(294): a, c, t, g, unknown or other
  misc_feature (294)..(294): n is a, c, g, or t
  modified_base (359)..(359): a, c, t, g, unknown or other
  misc_feature (359)..(359): n is a, c, g, or t
  modified_base (385)..(385): a, c, t, g, unknown or other
  misc_feature (385)..(385): n is a, c, g, or t
  modified_base (392)..(392): a, c, t, g, unknown or other
  misc_feature (392)..(392): n is a, c, g, or t
  modified_base (445)..(445): a, c, t, g, unknown or other
  misc_feature (445)..(445): n is a, c, g, or t
tcagtgtactactccacgaccggtgctcgatttagcgagacgcgcagggggagagaggggcccagccctgggattttccaggtgttttcatttggtgatcaggactgaacagagagaactcaccatggagtttgggctgagctggctttttcttgtggctattttaaaaggtgtccagtgtgaggtgcagttggtggactctgggggagacctgataccgcctggggggtccctgagactctcctgtacagcctctggattcacctttaggagccatgccatgagctgggtccnccaggctccagggaaggggctggagtgggctctacattactgctagtggtaatcatgcatactangcagactcgtgaaggccgttcacttnaccaganacaattccaaagaacacgctactaatctgacaattacgaccagtcctagacgngcccgaaggaccacgggccaatgtaacttactagttactaaaatcggaccgggtggcccgcgggccggtaaccgtcggatgggttttcggattttcgtcggggcccaagggaaccg

SEQ ID NO: 276582 - DNA, 580 bp, Homo sapiens
  misc_feature: GYAE6OF02IF39F.16.9.A09.1.454.CMB.1.raw
  modified_base (168)..(168): a, c, t, g, unknown or other
  misc_feature (168)..(168): n is a, c, g, or t
  modified_base (268)..(268): a, c, t, g, unknown or other
  misc_feature (268)..(268): n is a, c, g, or t
  modified_base (290)..(290): a, c, t, g, unknown or other
  misc_feature (290)..(290): n is a, c, g, or t
  modified_base (359)..(359): a, c, t, g, unknown or other
  misc_feature (359)..(359): n is a, c, g, or t
  modified_base (385)..(385): a, c, t, g, unknown or other
  misc_feature (385)..(385): n is a, c, g, or t
tcagtgtactactccacgaccggtgctcgatttagcgagacgcgcaggggagagaggggcccagccctgggattttcaggtgttttcatttggtgatcaggactgaacagagagaactcaccatggagtttgggctgagcgtgcgtttctagtggctattttaaaggngtccagtgtgaggtgcagttggtggactctgggggagacctgataccgcctggggggtccctgagactctcctgtacagcctctggattcacctttaggngccatgccatgagctgggtccnccaggctccagggaagggctggagtgggtctcgtactattactgctagtggtaatcatgcatactatgnagactcgtgaacggccgttcaccttnacagagacaacttaccaagtacacgtctctaatctgctaatgaccagccgtagcgccgccgaggaccacggacccattacgttacttaccgtaggttaacctaaagtccggaggttcgggcccgtaccgggtcccgttaaccgtcgggacgtttcggttttcgacgtttccggtaggggtacctaagggtaaccg

SEQ ID NO: 276583 - DNA, 541 bp, Homo sapiens
  misc_feature: GYAE6OF02ISROM.16.9.A09.1.454.CMB.1.raw
  modified_base (305)..(305): a, c, t, g, unknown or other
  misc_feature (305)..(305): n is a, c, g, or t
  modified_base (325)..(325): a, c, t, g, unknown or other
  misc_feature (325)..(325): n is a, c, g, or t
  modified_base (386)..(386): a, c, t, g, unknown or other
  misc_feature (386)..(386): n is a, c, g, or t
  modified_base (408)..(408): a, c, t, g, unknown or other
  misc_feature (408)..(408): n is a, c, g, or t
  modified_base (431)..(431): a, c, t, g, unknown or other
  misc_feature (431)..(431): n is a, c, g, or t
tcagtgtactactccacgaccggtgctcgatttagcgagacgcgcaggggctgggcctcaggaagcagcatcggaggtgcctcagccatggcatggatccctctcttcctcggcgtccttgcttactgcacaggatccgtggcctcctatgagttgactcaggttccctcagtgtccgtgtccccgtgacagacagccagcatcacctgctctggagataacctgggaataaatttctttctggtatcagcggaagccaggccagtcccctgtttggtcatcgtataaagataggaatcggcctnagacatccctgagcgattcnctggctccagctctaggaaacacgagcccaactctcgaccatccgaccgggaccagactancggatgaagctagactattacngttcgaggtcgtaggacagcggnacgtgtggtttcggcggaggaccgaagcgtagacccgtccgtacggtcaacgtcccgaaggtcctaccgcccctggcctaccgtccgtaccgttccccgtaccctcccgg

SEQ ID NO: 276584 - DNA, 565 bp, Homo sapiens
  misc_feature: GYAE6OF02GH92X.16.9.A09.1.454.CMB.1.raw
  modified_base (191)..(191): a, c, t, g, unknown or other
  misc_feature (191)..(191): n is a, c, g, or t
tcagtgtactactccacgaccggtgctcgatttagcgagacgcgcaggggctgggcctcaggaagcagcatcggaggtgcctcagccatggcatggatccctctcttcctcggcgtccttgcttactgcacaggatccgtggcctcctatgagttgactcagcttccctcagtgtccgtgtcccccggganagacagccagcatcacctgctctggagataacctggggaattaaatttactttctggtatcagcggaagccaggccagtcccctgtttggtcatctataaagataggaatcggccctcagacactccctgagcgtattctctggcctccagctctaggaaacacacgccactctcgacccatccgaaccgggacccagactagtggatgaagctagaacttattactgtcgaggtcggtagggacaggcggctacgtggttgggtttccgggacgggtacgggaccaaggcgtcgaccgttccgtcggtcgacgacccgaacggcctccggcccccgtcggtacctccgtccgtccgttaccccacccgtcccg

SEQ ID NO: 276585 - DNA, 756 bp, Homo sapiens
  misc_feature: GYAE6OF02IJ2YF.16.9.A09.1.454.CMB.1.raw
  modified_base (212)..(212): a, c, t, g, unknown or other
  misc_feature (212)..(212): n is a, c, g, or t
  modified_base (216)..(216): a, c, t, g, unknown or other
  misc_feature (216)..(216): n is a, c, g, or t
  modified_base (361)..(361): a, c, t, g, unknown or other
  misc_feature (361)..(361): n is a, c, g, or t
tcagtgtactactccacgaccggtgctcgatttagcgagacgcgcaggggctgggcctcaggaagcagcatcggaggtgcctcagccatggcatggatccctctcttcctcggcgtccttgcttactgcacaggatccgtggcctcctatgagttgactcagcttccctcagtgtccgtgtccccgggacagacagccagcatcactgctcngganataacctggaattaatttacttctggtatcagtcgaagccaggccacgtcccctggttttcggtctatctaagtaaagataggaatccggacctcagacatccctgagcgtattctcgtcggctccagccttacgtaggaaaacncacggaccctacgtacctaccggaccctaacgtcccggaaaccccgggtaaccccaagtaaccttaacggtacggtaactacggaacgtacgttaacggaaccttaaacgtttaccgttaccgggttaccgaacggggttaccgggtaacgggggtaaccgtaacgggacccggggtacctaacccggttttcggggtttacggggtttttcccggggaaccgggggtaaccggggtaaacccgtaaacggtccgttaccggtaacccggttcccggttaccgggttacccgaaccgggtaccccgaacgggtacccgttacccggtcccccccgttaccgggtacctaccccgttacccgtttcccggttacccccctaccccgtttaccccgg

SEQ ID NO: 276586 - DNA, 613 bp, Homo sapiens
  misc_feature: GYAE6OF02JGSJM.16.9.A09.1.454.CMB.1.raw
  modified_base (290)..(290): a, c, t, g, unknown or other
  misc_feature (290)..(290): n is a, c, g, or t
tcagtgtactactccacgaccggtgctcgatttagcgagacgcgcagggggagagaggggcccagccctgggatttcaggtgttttcatttggtgatcaggactgaacagagagaactcaccatggagtttgggctgagctggcttttcttgtggctatttaaaaggtgtccagtgtgaggtgcagttggtggactctgggggagacctgataccgcctggggggtccctgagactctcctgtacagcctctggattcacctttaggagccatgccatgagctgggtccnccaggctccgagggaaggggctggaggtgggtctctactattactgctagtggtaatcatgcatactatgcagactccgtaggaagggtccgttcacctttcaccagagacaattcaagaacacgtactactatctgactaattcgaccagcctagacgcgccggagaccgacgaccagtacgttattactagttactaaacgttccggacggggtacgggtcccggccgggtacccggggttaacccgtccgggtaacgtttacggggttttacggtaaccgttttccgggtacgggggtacccggtaaggggtaaacccgg

SEQ ID NO: 276587 - DNA, 601 bp, Homo sapiens
  misc_feature: GYAE6OF02IXVOB.16.9.A09.1.454.CMB.1.raw
  modified_base (271)..(271): a, c, t, g, unknown or other
  misc_feature (271)..(271): n is a, c, g, or t
  modified_base (292)..(292): a, c, t, g, unknown or other
  misc_feature (292)..(292): n is a, c, g, or t
  modified_base (389)..(389): a, c, t, g, unknown or other
  misc_feature (389)..(389): n is a, c, g, or t
  modified_base (453)..(453): a, c, t, g, unknown or other
  misc_feature (453)..(453): n is a, c, g, or t
tcagtgtactactccacgaccggtgctcgatttagcgagacgcgcagggggagagaggggcccagccctgggattttcaggtgttttcatttggtgatcaggactgaacagagagaactcaccatggagtttgggctgagcgtgcgttttctgtggctaattttaaaaggtgtccagtgtgaggtgcagttggtggactctgggggagacctgataccgcctggggggtccctgagactctcctgtacagcctctggattcacctttaggngccatgccatgagctggtccncaggctccgagggaagggctggagtgggtctctactattactgtctagtggtaatcatgtatactatgcagactcgtagaacgggtcgtctaccttnaccgagacgacaacttaccaagaaccacgctactatctgactaattacggaccagcctaggacnccgaccgtaggaccacggccctaatacgtaacttacgtacttaaccgtaaagtccggcggggtaccggccggtaccgggccccggtacggtcggtaacgtttcggttttacgtacgtttccgtacggggacctaagggacttaacggg

SEQ ID NO: 276588 - DNA, 722 bp, Homo sapiens
  misc_feature: GYAE6OF02GVNIX.16.9.A09.1.454.CMB.1.raw
  modified_base (172)..(172): a, c, t, g, unknown or other
  misc_feature (172)..(172): n is a, c, g, or t
  modified_base (193)..(193): a, c, t, g, unknown or other
  misc_feature (193)..(193): n is a, c, g, or t
  modified_base (199)..(199): a, c, t, g, unknown or other
  misc_feature (199)..(199): n is a, c, g, or t
tcagtgtactactccacgaccggtgctcgatttagcgagacgcgcagggggagagaggggcccagccctgggattttcaggtgttttcatttggtgatcaggactgaacagagagaactcaccatggagtttgggctgagcggtcgtggttctaggtcgctaatttaaaggncagtgtgagtgcagtgtgctntggganactgataccgcctgggggtcctgagactctcctgtacagcctctggaattcaccgttttagggacacctagtcgaccagtgagtcgtcggtccgacgacggtaccgtaccggaaggggaagggcgtaggtaggtacggtcgttcgtacgttacgttacgtagtacgtaggtagtatacgtagtcgtactacttactagtacgtacgtacgtacgtacggtacggtaacggtaccggttacgtaccgtaccgacgaacgacgtaactaacgtaaccgaacgaaccgaccgtactacgtactacgtacgtactaacgtacgtaccgtacgtcgtacgacggaccgaccggaacggaccggaccgaccgtacgttacgttaacgttaacgttaacgttaaccgttaaccgtacggtaccgggtaccgggtccggtacccggtacccgggtacccggttaccggttacggtttacggttttacggtttacggtttaccgggttaccgggtaccgggtaacggtaacg

SEQ ID NO: 276589 - DNA, 532 bp, Homo sapiens
  misc_feature: GYAE6OF02HZQ4D.16.9.A09.1.454.CMB.1.raw
  modified_base (477)..(477): a, c, t, g, unknown or other
  misc_feature (477)..(477): n is a, c, g, or t
  modified_base (520)..(520): a, c, t, g, unknown or other
  misc_feature (520)..(520): n is a, c, g, or t
tcagtgtactactccacgaccggtgctcgatttagcgagacgcgcagggggagagaggggcccagccctgggattttcaggtgttttcatttggtgatcaggactgaacagagagaactcaccatggagtttgggctgagctggcttttcttgtggctattttaaaaggtgtccagtgtgaggtgcagttggtggactctgggggagacctgataccgcctgggggtccctgagactctcctgtacagcctctggattcacctttaggagccatgccatgagctgggtccgccaggctccagggaaggggctgggagtgggtctctactattactgctagtggtaatcatgcatactatgcagactccgtgaacgggccggttcaccttcaccagagacaattccaaagaaccagctactatctagctaattcgaccagcctgagcgccgagacacggcatgtaattctgtactaancgcgggtacgccgcggccgtacctcggatggtttcagtttcgngggaccagggac

SEQ ID NO: 276590 - DNA, 599 bp, Homo sapiens
  misc_feature: GYAE6OF02JMCVV.16.9.A09.1.454.CMB.1.raw
  modified_base (297)..(297): a, c, t, g, unknown or other
  misc_feature (297)..(297): n is a, c, g, or t
  modified_base (368)..(368): a, c, t, g, unknown or other
  misc_feature (368)..(368): n is a, c, g, or t
  modified_base (396)..(396): a, c, t, g, unknown or other
  misc_feature (396)..(396): n is a, c, g, or t
  modified_base (452)..(452): a, c, t, g, unknown or other
  misc_feature (452)..(452): n is a, c, g, or t
tcagtgtactactccacgaccggtgctcgatttagcgagacgcgcagggggagagaggggcccagccctgggattttcaggtgttttcatttggtgatcaggactgaacagagagaactcaccatggagtttgggctgagctggctttttcttgtggctattttaaaaggtgtccagtgtgaggtgcagttggtggactctgggggagacctgataccgccgtggggggtccctgagactctcctgtacagcctctggattcacctttaggacgccatcgccatgagctgggtcccnccaggcctccgagggaacggggctgggtacgtgggtctctactatctgtctaggtagtatcatgcatactngcagactcggtagaacgggtccgttacncctcactagacgactactacaaagaccacgtcttatactctcgtacaattcgaccncgcctagcgaccggtacgacgaccgaccgacctagttgttacgtaacttacgtaactaacgtcgggtcgggtaccggcccgtacgggcccggttaacctccgggtaagttcggttttcgacgtttccggaggggacccaagggtacg

SEQ ID NO: 276591 - DNA, 599 bp, Homo sapiens
  misc_feature: GYAE6OF02GCD4Y.16.9.A09.1.454.CMB.1.raw
  modified_base (217)..(217): a, c, t, g, unknown or other
  misc_feature (217)..(217): n is a, c, g, or t
  modified_base (308)..(308): a, c, t, g, unknown or other
  misc_feature (308)..(308): n is a, c, g, or t
tcagtgtactactccacgaccggtgctcgatttagcgagacgcgcaggggctgggcctcaggaagcagcatcggaggtgcctcagccatggcatggatccctctcttcctcggcgtccttgcttactgcacaggatccgtggcctcctatgagttgactcagcttccctcagtgtccgtgtccccgggacagacagccagcatcacctgctctgganataacctgggaattaaatttactttctggtatcagcggaagccaggccacgtcccctgtttggtcatctataaagataggaatcggccctnagacatccctgacgcgtattctctcggctccagctctaggaaacacacgccactctcgacccatccgacccgggacccagactatggatgaaagctagaacttacttactcgtacagggcgtagggacaggccggactacgttggtttgggtttcggcgggaacgggaccgaaggccgttacgacccgttccgtccggtaccgaccggacccgtagggccccttccggaccccccgttcgggtacccttacccgttcccgttacccggtttcccccgtccccgttccccgg

SEQ ID NO: 276592 - DNA, 533 bp, Homo sapiens
  misc_feature: GYAE6OF02HQXSW.16.9.A09.1.454.CMB.1.raw
  modified_base (188)..(188): a, c, t, g, unknown or other
  misc_feature (188)..(188): n is a, c, g, or t
  modified_base (241)..(241): a, c, t, g, unknown or other
  misc_feature (241)..(241): n is a, c, g, or t
  modified_base (304)..(304): a, c, t, g, unknown or other
  misc_feature (304)..(304): n is a, c, g, or t
  modified_base (317)..(317): a, c, t, g, unknown or other
  misc_feature (317)..(317): n is a, c, g, or t
  modified_base (324)..(324): a, c, t, g, unknown or other
  misc_feature (324)..(324): n is a, c, g, or t
tcagtgtactactccacgaccggtgctcgatttagcgagacgcgcaggggctgggcctcaggaagcagcatcggaggtgcctcagccatggcatggatccctctcttcctcggcgtccttgcttactgcacaggatccgtggcctctatgagttgactcagcttccctcagtgtccgtgtccccgganagacagccagcatcacctgctctggagataacctgggaattaaatttctttcnggtatcagcggaagccaggccacgtcccttgtttgcatctataaagataggaatcggaccctnagacactcctgancgattcnctggcctccagctcgtaggaaacacacgccactctagaccatccgaacccgggaccagacctagaggatgaagctagacttatactgtcgagcgtaggacaggcgacacgtggtggtttcggacgggtacggaccgaggcctgacccgtcgtcggtcgacgccaaggcctccgcccgtcggtacctcgtcctcgttccccacgttcccg

SEQ ID NO: 276593 - DNA, 674 bp, Homo sapiens
  misc_feature: GYAE6OF02HI5SU.16.9.A09.1.454.CMB.1.raw
tcagtgtactactccacgaccggtgctcgatttagcgagacgcgcagggggagagaggggcccagccctgggattttcaggtgttttcatttggtgatcagggctgaacagagagaactcaccatggagtttgggctgagctggctttttcttgtggctattttaaaaggtgtccagtgtgaggtgcagctgttggagtctgggggaggcttggcacagccgtggggggtccctgagacctctcctgtgcagcctctggattcaccttttgacagctatgccatcgacctgggtcccgccaggcctccgaggggaacggggcgtgggaagtggggtctcgtaaggtactttacgtgggttggtggtttaactaccactactacgtacgacagtaccttaccggtaggaacggggtcccgtttaccaccgtactcccgttccaaggacaaccgtaaacttttacccgaaaagaaccaaactaccgttacgtactcctaggacaaaacgttagaaacacgcctaggacgacgacccgtaacgaaccgaccggacccattaacgttaacttactgtacgaacggaacgtaccgacccggacgtacggtttaccgtacctaaccccaatttaccctttaactttacggtaacctttacgttcgggacttaaccccggg

SEQ ID NO: 276594 - DNA, 557 bp, Homo sapiens
  misc_feature: GYAE6OF02FIP72.16.9.A09.1.454.CMB.1.raw
  modified_base (362)..(362): a, c, t, g, unknown or other
  misc_feature (362)..(362): n is a, c, g, or t
tcagtgtactactccacgaccggtgctcgatttagcgagacgcgcaggggctgggcctcaggaagcagcatcggaggtgcctcagccatggcatggatccctctcttcctcggcgtccttgcttactgcacaggatccgtggcctcctatgagttgactcagcttccctcagtgtccgtgtccccgggacagacagccagcatcacctgctctggagataacctgggaagttaaatttactttctggtatcagcggaagccaggccagtcccctgttttggtcatctataaagataggaatcggccctcagacatccctgacgcgattctctggctccagctctaggaaacacagccactcncgaccatccgaccgggacccagactatggatgaagctagactattactgtacaggcgtgggacgacgcggcgacgttggttcgggttttcggcgggtacgggaccaaggcgtacggaccgttccgtcggtccgacgacccgaaggcctccgcccccgtcggtcctaccgttccgtccgttccccacccgttcccg

SEQ ID NO: 276595 - DNA, 735 bp, Homo sapiens
  misc_feature: GYAE6OF02H6DK2.16.9.A09.1.454.CMB.1.raw
tcagtgtactactccacgaccggtgctcgatttagcgagacgcgcagggggagagaggggcccagccctgggattttcaggtgttttcatttggtgatcaggactgaacagagagaactcaccatggagtttgggctgagctggcttttcttgtggctattttaaaaggtgtccagtgtgaggtgcagttggtggactcgtgggggagacctgataccgcctgggggtccctgagactctcctgtacagcctctggattcaccgtttaggacgccatgccatgagctgggtcccgcaggctcgagggagggctggagtgggtctctactattactgctagtggtaatcatgctatactatgacagactccggtaggaacggggtccgtttaccacccgtttaccaaccgtaaggacgtaacctaaacttaccgaaacgaaaccgaccgtaccttaccttaactccgtacgtaccttaaacgttaccggaaccctacgcccgttaggaccggtccggaacccggtacgggaacccgtaaccgggacccgttaacgttcgtttaaacgttaaccgttaacgttaaccgttaaaacggttccggtacccgggggtacgggtaccccggggtcccgggtaccccgggtttacccggtaccggggttacgttttacggggttttttacggtaccgtttttccgggggtccggggttaacccggtaaggggttaaacccgg

SEQ ID NO: 276596 - DNA, 595 bp, Homo sapiens
  misc_feature: GYAE6OF02H3316.16.9.A09.1.454.CMB.1.raw
  modified_base (191)..(191): a, c, t, g, unknown or other
  misc_feature (191)..(191): n is a, c, g, or t
  modified_base (217)..(217): a, c, t, g, unknown or other
  misc_feature (217)..(217): n is a, c, g, or t
  modified_base (337)..(337): a, c, t, g, unknown or other
  misc_feature (337)..(337): n is a, c, g, or t
tcagtgtactactccacgaccggtgctcgatttagcgagacgcgcaggggctgggcctcaggaagcagcatcggaggtgcctcagccatggcatggatccctctcttcctcggcgtccttgcttactgcacaggatccgtggcctcctatgagttgactcagccttccctcagtgtccgtgtccccggganagacagccagcatcactgctctgganataaccgtagggaattaattttacttctggtatcagcggaagccgaggccacgtccccttgttttcggcatctaataaagataggaactccggcctcagacactccctagagcgtattcnctggcctccgagcctctacggaaacacgacgcccaacttcacgacctacgtccgaacccgggaccagtaacctagtggatagagctacgtacttacttacgtgtacgaggtcgtagggacacggcggctacgttggttcggtttcgggacggtacggaccgagtcgtacgccgtccgtcggtaccgcgacccgaggtcccttacccgccccggttcggtaccctaccgttcccgtaccgttcccccgccttaccccgg

SEQ ID NO: 276597 - DNA, 756 bp, Homo sapiens
  misc_feature: GYAE6OF02HTYKR.16.9.A09.1.454.CMB.1.raw
  modified_base (209)..(209): a, c, t, g, unknown or other
  misc_feature (209)..(209): n is a, c, g, or t
  modified_base (297)..(297): a, c, t, g, unknown or other
  misc_feature (297)..(297): n is a, c, g, or t
  modified_base (344)..(344): a, c, t, g, unknown or other
  misc_feature (344)..(344): n is a, c, g, or t
tcagtgtactactccacgaccggtgctcgatttagcgagacgcgcagggggagagaggggcccagccctgggattttcaggtgttttcatttggtgatcaggactgaacagagagaactcaccatggagtttgggctgagctggctttttcttgtggctattttaaaaggtgtccagtgtgaggtgcagttggtggactcgtggggganacctgataccgccgtgggggtccctgagactctcctgtacagcctctggattcacctttaggagccatgaccatgagcgtgggtcccnccgaggcctaccgaggggaaggggctggagtgggtctctactatacngctagtgtaatcatgactagtactagtcgacaagtaccttcggtaggaacggggtccccggttactacccgtttaccgaacccgtaaaggtaacggaaaccgtaaacgtttaaccccgaaaacggtaaaaccctaccggtaccttacccgttaacgttactaccggtactaaaacgtttcgaaccctaacggtccctaggaccgacccggaccggaacggaccgaaccggtacctaacgttagtttaacgttactaacgttaacgttaaaccggttccggggaccggggttaccgggccccgggtaacccgggttacccggtaaccccggttacgggtttacggtttacggggttttttaccgttaacggttttaccggggttacggggtacccggtaaacggggttaaccg

SEQ ID NO: 276598 - DNA, 863 bp, Homo sapiens
  misc_feature: GYAE6OF02GPZKY.16.9.A09.1.454.CMB.1.raw
  modified_base (275)..(275): a, c, t, g, unknown or other
  misc_feature (275)..(275): n is a, c, g, or t
tcagtgtactactccacgaccggtgctcgatttagcgagacgcgcagggggagagaggggcccagccctgggattttcaggtgttttcatttggtgatcaggactgaacagagagaactcaccatggagtttgggctgagctggctttttcttgtggctattttaaaaggtgtccagtgtgaggtgcagttggtggactcgtgggggagacctgactaccgccgtggggggtccctgagactctcctgtacacgcctctggacttcactttaggngccatcgccatgacgtcgtcgggtcccgccgaggcctaccggaagggggaacgggggtccgtaggggtaggttcgggggttaccttaccgttaacgttacgttttaaccgtcggtaccgttaggttacgggttaaacttacgaagttacgacgtaacttaacgtaagttcggacgtaacgtaccgttaccgggttacggaaacgggggttccccggtttaacccgtaacccgtttacccgaaacccgtaaggtaaccgtaaacctaaaccggtttaaccccgaaaaggtaaaacccgtaccggtacccttaaccgttaacgtaccgttacgggtaaccttaaacggtttaccgaaacccgtaaccgtcccgttaacgggaaccgggtacccgggaccccgggaacgggaacccggtaccgggtacccgtagtttacggtttaactttaaacgtacgttaaaccgttaaacgtccggggtacgggttaccgggccccgggtaccgggtacccggttaaccggtcggttacgtttcggggttttacgttacggttttccgggtaaccgggtaccggtaagggtaacccgg

SEQ ID NO: 276599 - DNA, 567 bp, Homo sapiens
  misc_feature: GYAE6OF02HQWW6.16.9.A09.1.454.CMB.1.raw
  modified_base (169)..(169): a, c, t, g, unknown or other
  misc_feature (169)..(169): n is a, c, g, or t
  modified_base (190)..(190): a, c, t, g, unknown or other
  misc_feature (190)..(190): n is a, c, g, or t
  modified_base (349)..(349): a, c, t, g, unknown or other
  misc_feature (349)..(349): n is a, c, g, or t
tcagtgtactactccacgaccggtgctcgatttagcgagacgcgcaggggctgggcctcaggaagcagcatcggaggtgcctcagccatggcatggatccctctcttcctcggcgtccttgcttactgcacaggatccgtggcctcctatgagttgactcagcttcccncagtgtccgtgtccccggganagacagccagcatcacctgctctggagataacctgggaaattaatttactttctggtatcagcggaagccaggccagtcccctgtttggcatctataaagataggaatcggccctcagacatccctgagcgattctctggctccgagtctctggaaacncacgccactactcgacccatcccgaccgggaccacgtactaagtcggatagaacgctagacgttattacgtagtcagggtcgtagggaccacgggcgacgtacgttcggtaggtttcggcgggtacggaccgaagcgtacgtaccgtccgtcggtcgacgcccgaaggtcctccggccccttcggtcctacgttccgtaccgttccccgccttacccg

SEQ ID NO: 276600 - DNA, 735 bp, Homo sapiens
  misc_feature: GYAE6OF02HS02S.16.9.A09.1.454.CMB.1.raw
  modified_base (133)..(133): a, c, t, g, unknown or other
  misc_feature (133)..(133): n is a, c, g, or t
  modified_base (393)..(393): a, c, t, g, unknown or other
  misc_feature (393)..(393): n is a, c, g, or t
tcagtgtactactccacgaccggtgctcgatttagcgagacgcgcaggggctgggcctcaggaagcagcatcggaggtgcctcagccatggcatggatccctctcttccgtcggcgtccttgcttactgcacnggactccgtgcctacctatgagttgactcagtccttccctcagttcgtcccggtcgtaccccgggacagacagccagcatccacctgcctctaggagtaactaaccgtgggtaaactttaaacttttactttcgtaggttaactcgaacggtacggaacgtccgacggccctacgttccccgtttggttttcggcctagtctaagtaaagtagtaaggactccggccctagacgacacgttcctggacgcgtacgttacncgttcggtaccgtccgtagtccgttacgaacggaaaacctaccacggccttaaccctcgtaccgaacctactccgaggtaccgtacgggtcggaaccgggccggggtaatcggaaccgggtcccttaagtaacgttaccggtacggtacgtaggggtcgtaaggggtacgttaaaggtaggttacgggttaataacccggttataacgttttaggtcgtttcccgggttaacgtacttcgggtacgggaccgttaccgggtccctaccgggtacttaccggacgaccgaaccccgtaccgaacccgaccccctgtaccggtacccttacgccccgtttcccg

SEQ ID NO: 276601 - DNA, 724 bp, Homo sapiens
  misc_feature: GYAE6OF02HV39P.16.9.A09.1.454.CMB.1.raw
tcagtgtactactccacgaccggtgctcgatttagcgagacgcgcagggggagagaggggcccagccctgggattttcaggtgttttcatttggtgatcaggactgaacagagagaactcaccatggagtttgggctgagctggtctttttcttgtggcttattttaaaaggtgtccagtgtgaggtgcaggttggtggactcgtgggggagacctgataccgccgtgggggtccctgagactctcctgtacacgcctctggtacttctaccgtttaggacgtccatcgccagtgacgtcgtcgggtcccgccgaggcctccgaagggggaacggggcgtgggacggtgggtctccttactattacgtgacgtaggttggtaatcatgactatactatgcaagtctccggtaggaacgggtcccgttacctaccttccaaccgtagaacgtaactaacttaccgaaagaaccacgtctaccttatccgttacgacttaaacgtttcgaaaccctagtcccgtagaccggtccggacccggaacgggacccaaccgggtccctagttacgtttaaccttaacgttaacgtaaacgttaaccggtccggggtacggggttacccgggccccgggtacccggggtaccccggttaacccgttacgggtagttttacggggttttcgtaacggtttttccggggaaccgggaccggtaacgggtaacg

SEQ ID NO: 276602 - DNA, 759 bp, Homo sapiens
  misc_feature: GYAE6OF02GIAEQ.16.9.A09.1.454.CMB.1.raw
  modified_base (218)..(218): a, c, t, g, unknown or other
  misc_feature (218)..(218): n is a, c, g, or t
tcagtgtactactccacgaccggtgctcgatttagcgagacgcgcaggggctgggcctcaggaagcagcatcggaggtgcctcagccatggcatggatccctctcttcctcggcgtccttgcttactgcacaggatccgtggcctcctatgagttgactcagccttccctcagtgtccgtgtccccgggacagacagccagcatcacctgctctgganataaccgtgggaaattaaatttactttctaggtatcaggcggaagccaggcctacgttccccttgttttggctatctaataaagataggaactccggccctcgagactacgtccctgacgtcgtattcctcgtcggtcctccgagtccttcgtaacgggaaaccacgacgaccctaactccgtaccgaaccctacctacccgggaaccccggggaaccccaacgtaaccttacgtacgggtattaaggaaacgtcgttaacgtaacttaacgttaacgttcggtaccggtacgggtccggtacggggaccgacgggtaccggaccgttaaccggtttgggttttacggggttttccggggaaccggggtaccggggtaaacccgtaacgggtccgttaacccgggtcccgggtttacccggttccgggtaccggtaacccgggtaccccgtaaacgggtccccgttaccccggtacccccggttccgggttaccctaccccggtttccgttccccggttcccccgtccccgtttaccccgg

SEQ ID NO: 276603 - DNA, 681 bp, Homo sapiens
  misc_feature: GYAE6OF02JD7SG.16.9.A09.1.454.CMB.1.raw
  modified_base (208)..(208): a, c, t, g, unknown or other
  misc_feature (208)..(208): n is a, c, g, or t
  modified_base (305)..(305): a, c, t, g, unknown or other
  misc_feature (305)..(305): n is a, c, g, or t
tcagtgtactactccacgaccggtgctcgatttagcgagacgcgcagggggagagaggggcccagccctgggattttcaggtgttttcatttggtgatcaggactgaacagagagaactcaccatggagtttgggctgagcgtggcttttctgtggctattttaaaaggtgtccagtgtgaggtgcagttggtggactcgtggggganacctgataccggccgtcgggggtccctgagactctctgtcagcctctggattcacctttaggcgtccagtcgcctatgagtcgtcgggtccgaccgnggcctccgaaggggaacggggctcggaggtgggttcctcgtaactagttactgtcgtaaggtcgtaatcaagtcgatactactagacgcgatcgtcgtagtaacgggccgttacacttccgacagtagaactacgtacaaataccacgtctactactctcgactagttcgaacacgtcctggagacccggcggtaaaccggaactacccgggtacgttaacgtccggttaaactttaccgtaacgttaaaccgttaaacgtcgggttaccggggtcgggaaccccggtccggggtaccccggtaccccgttgggtaacggtttcgggtttttacgtccgtttaagggtttcccggggaaccgtaacggggtaaccg

SEQ ID NO: 276604 - DNA, 614 bp, Homo sapiens
  misc_feature: GYAE6OF02HUC2X.16.9.A09.1.454.CMB.1.raw
  modified_base (181)..(181): a, c, t, g, unknown or other
  misc_feature (181)..(181): n is a, c, g, or t
  modified_base (185)..(185): a, c, t, g, unknown or other
  misc_feature (185)..(185): n is a, c, g, or t
  modified_base (191)..(191): a, c, t, g, unknown or other
  misc_feature (191)..(191): n is a, c, g, or t
  modified_base (193)..(193): a, c, t, g, unknown or other
  misc_feature (193)..(193): n is a, c, g, or t
  modified_base (201)..(201): a, c, t, g, unknown or other
  misc_feature (201)..(201): n is a, c, g, or t
  modified_base (206)..(206): a, c, t, g, unknown or other
  misc_feature (206)..(206): n is a, c, g, or t
  modified_base (280)..(280): a, c, t, g, unknown or other
  misc_feature (280)..(280): n is a, c, g, or t
  modified_base (316)..(316): a, c, t, g, unknown or other
  misc_feature (316)..(316): n is a, c, g, or t
  modified_base (330)..(330): a, c, t, g, unknown or other
  misc_feature (330)..(330): n is a, c, g, or t
  modified_base (369)..(369): a, c, t, g, unknown or other
  misc_feature (369)..(369): n is a, c, g, or t
  modified_base (436)..(436): a, c, t, g, unknown or other
  misc_feature (436)..(436): n is a, c, g, or t
  modified_base (451)..(451): a, c, t, g, unknown or other
  misc_feature (451)..(451): n is a, c, g, or t
  modified_base (497)..(497): a, c, t, g, unknown or other
  misc_feature (497)..(497): n is a, c, g, or t
tcagtgtactactccacgaccggtgctcgatttagcgagacgcgcagggggagagaggggcccagccctgggattttcaggtgttttcatttggtgatcaggactgaacagagagaactcaccatggagtttgggctgagcggtgtcgtttctaggtgctaatttaaaggtgtcagtgtgngtgnagttgngntgtggganctgancgccgtggggtcctgagtctctctgacagcctctggtacttcgtaccgtttaggacgtccatacgcagtggacngttcggccgaccgtgcctcggaaggggaggctgggngttggcctctactntactgatagttcgtaatcagtgactaatactaggtccanagtaccgtcggttacgaacgggtccgttccactaccgacgaagtaacgacttaacgacgtaaaaccncgacgtactactacncgtatactacgtaccacgtccgtcagacggccgtaaggccgtaacncgacttgttaacttacgtataagtaacgtcggaccgggtccgggacggtcccggccggtaccggttcggttagttcggtttaggttcggttacggttacggacggtacgtacgtagg

SEQ ID NO: 276605 - DNA, 680 bp, Homo sapiens
  misc_feature: GYAE6OF02G3EP5.16.9.A09.1.454.CMB.1.raw
  modified_base (218)..(218): a, c, t, g, unknown or other
  misc_feature (218)..(218): n is a, c, g, or t
  modified_base (372)..(372): a, c, t, g, unknown or other
  misc_feature (372)..(372): n is a, c, g, or t
tcagtgtactactccacgaccggtgctcgatttagcgagacgcgcaggggctgggcctcaggaagcagcatcggaggtgcctcagccatggcatggatccctctcttcctcggcgtccttgcttactgcacaggatccgtggcctctatgagttgactcagcttccctcagtgtcccgtgtccccgggacagacagccagccatcacctgctctgganataacctgggaattaaatttactttctaggtatcagcggaagccaggccacgtccccttgttttggctatctaataaagataggaactccggccctacgagacactccctagagcgtaattcctcgtggtcctccgagtcctcgtacggaaacncgtacgcctaacgtctacgacctagtcacgcgacgggtacgaaggccggggatacggacggccgtacttatacgtgtacgtagggtagtaggggtaactaggttaacggtagttacgacgttaaccttagtttaacgtacggtttaccgttcggggtaacttccgggttaacggggaaccccgttacggggttccttaaccccgggttccggttaacgggtccctaaaccgggtaaccccgtaaaccgggacccccttaaaaccccgtcggttaccggtcccgttacccgttcccgtttacccccggg

SEQ ID NO: 276606 - DNA, 697 bp, Homo sapiens
  misc_feature: GYAE6OF02JOW91.16.9.A09.1.454.CMB.1.raw
  modified_base (176)..(176): a, c, t, g, unknown or other
  misc_feature (176)..(176): n is a, c, g, or t
  modified_base (199)..(199): a, c, t, g, unknown or other
  misc_feature (199)..(199): n is a, c, g, or t
  modified_base (622)..(622): a, c, t, g, unknown or other
  misc_feature (622)..(622): n is a, c, g, or t
tcagtgtactactccacgaccggtgctcgatttagcgagacgcgcaggggctgggcctcaggaagcagcatcggaggtgcctcagccatggcatggatccctctcttcctcggcgtccttgcttacgtgcacgaggactccgtggcctcctatgagttcgactcagtccttccctnagtcgtccgtcggtacccggganagacacgccagcatccactgctcgtaggaagtactaaccgtagggtaaactttaacttttcgtttcgtagttaactcgtaggacggtaacgccgtacggtcctaccggttaccccgtttggttttacggactacgttacttaaagtaaaggtacgtaggtaactcccgggcctagacgtaactacctccgtagacgtccgtacgtttaccgtcgtacggaccttaccgacgtccgttaacgacggaaacccaccgtagaccctactacgtaccgacctacgtacccggacccgggaaccctagtaaccgtaggttacgaactacggaactacgtacggttaacttacgttacgtacggtacggacgggtcggtacggacgtacggcgtcgttacggtcggtttcgggtaccggaggaccgtanacgtcgacgtccgcgtacgcgacgtcgacgtccgtaccgtcctacggtctcgtacccgtccgtacctcccgtagg

SEQ ID NO: 276607 - DNA, 655 bp, Homo sapiens
  misc_feature: GYAE6OF02FX8RG.16.9.A09.1.454.CMB.1.raw
  modified_base (171)..(171): a, c, t, g, unknown or other
  misc_feature (171)..(171): n is a, c, g, or t
  modified_base (196)..(196): a, c, t, g, unknown or other
  misc_feature (196)..(196): n is a, c, g, or t
  modified_base (207)..(207): a, c, t, g, unknown or other
  misc_feature (207)..(207): n is a, c, g, or t
  modified_base (264)..(264): a, c, t, g, unknown or other
  misc_feature (264)..(264): n is a, c, g, or t
  modified_base (289)..(289): a, c, t, g, unknown or other
  misc_feature (289)..(289): n is a, c, g, or t
  modified_base (300)..(300): a, c, t, g, unknown or other
  misc_feature (300)..(300): n is a, c, g, or t
  modified_base (394)..(394): a, c, t, g, unknown or other
  misc_feature (394)..(394): n is a, c, g, or t
  modified_base (537)..(537): a, c, t, g, unknown or other
  misc_feature (537)..(537): n is a, c, g, or t
  modified_base (579)..(579): a, c, t, g, unknown or other
  misc_feature (579)..(579): n is a, c, g, or t
tcagtgtactactccacgaccggtgctcgatttagcgagacgcgcagggggaggaggaggggcccagccctgggattttcaggtgttttcatttggtgatcaggactgaacagagagaactcaccatggagtttgggctgagcgtggcgtttctagtggctatttaaaggngtccagtgtgagtgcagttggtagntcgtggggganaccgtgacgtaccgccggttgggggtccctagagacctctcctagtaccagcccttntcggtattccgtacctttagggacncctatcgcagngacgcgttggtcccgacgacggctccggaggggaacgggcgtgggtaggttcgggtactcgtaacttacgttactggtactaggtaggttaacnctaatcgactagttaacgtgtgacgtacgtaaccgtccggtaaggaccgggttccgttactaccgtacccagaacggactaaccgtaacttaaccgaaacggtacaacggacttactaacgttcaccggacttattcgaaccngtcgtacgcgaaccgcgtacgacgacgtctagtgtacttacngtaaactgacgtcgggtacgcgtccggtccggtacctagggtcttaggtttcgtagttcgggcgtacgaggtaccg

SEQ ID NO: 276608 - DNA, 643 bp, Homo sapiens
  misc_feature: GYAE6OF02HL25R.16.9.A09.1.454.CMB.1.raw
  modified_base (358)..(358): a, c, t, g, unknown or other
  misc_feature (358)..(358): n is a, c, g, or t
tcagtgtactactccacgaccggtgctcgatttagcgagacgcgcaggggctgggcctcaggaagcagcatcggaggtgcctcagccatggcatggatccctctcttcctcggcgtccttgcttactgcacaggatccgtggcctcctatgagttgactcagcttccctcagtgtccgtgtccccgggacagacagccagcatcacctgctctggagactaaccgtaggtaaattaattttacctttcgtaggttatcgaggcggaacgccgaggccacgttccccttggttttcggctatctaagtaagagtaggaactccggccctgacgacctactcccgtagacgacgtattcnctggcctccgagtcctcgtacgaaacacacgacctactctacgaccacgtcccgaacccggaccacgactagtcggacgtagacgtctagtactacttacgtgtacgacggtcggtaggacgacggtcgaccgtacggttggttcgggtttaccgggacgggaaccgggtaccgtaaaggccgttaccgacccgttccgtaccggtacgaccggtaccggacggtcccgtcccggaccccgttcgtaccgtacccgttccgttcccggtccccgtcccttcccgg

SEQ ID NO: 276609 - DNA, 716 bp, Homo sapiens
  misc_feature: GYAE6OF02IPLWQ.16.9.A09.1.454.CMB.1.raw
  modified_base (103)..(103): a, c, t, g, unknown or other
  misc_feature (103)..(103): n is a, c, g, or t
  modified_base (170)..(170): a, c, t, g, unknown or other
  misc_feature (170)..(170): n is a, c, g, or t
  modified_base (188)..(188): a, c, t, g, unknown or other
  misc_feature (188)..(188): n is a, c, g, or t
  modified_base (222)..(222): a, c, t, g, unknown or other
  misc_feature (222)..(222): n is a, c, g, or t
  modified_base (420)..(420): a, c, t, g, unknown or other
  misc_feature (420)..(420): n is a, c, g, or t
tcagtgtactactccacgaccggtgctcgatttagcgagacgcgcaggggctgggcctcaggaagcagcatcggagttgcctcagccatggcatggatccctntcttcctcggcgtccttgcttactgcacaggatccgtggcctctatgagttgactcagtcttccctnagtgtccgtgcccggganagacagccagcatcactgctcgtgacataaccgngggaattaaattttcttcgtaggttataccgaggacggaaagccaacggcctacgttcccccgttggtttttcggtacctataccttaataaaacggtagtaacgggtaaactccggtaccctacgaacggaccaactttccccgaggacgtaccgtagttcctacgttcggaccttccgagtccgtagtacgaaacncgaagcctaaccgccgacacgtcgacccggtacacgtactagagactagacgtcgtagtacttagttacgtacgtcggtacggcgggtacgacgacggaccggtctaaccgggttggtttccgggttaccggggaccggtaacgggaccgtaacggtccgttaaccgggtacccgttccggtaccgggttacgacccgggtacccgtaacgggttcccctaacccggttccccccggttggtacccttacccggttccgttaccccggtcccccgtacccgttcccgttaaccggg

SEQ ID NO: 276610 - DNA, 667 bp, Homo sapiens
  misc_feature: GYAE6OF02FIAH8.16.9.A09.1.454.CMB.1.raw
  modified_base (146)..(146): a, c, t, g, unknown or other
  misc_feature (146)..(146): n is a, c, g, or t
  modified_base (366)..(366): a, c, t, g, unknown or other
  misc_feature (366)..(366): n is a, c, g, or t
  modified_base (373)..(373): a, c, t, g, unknown or other
  misc_feature (373)..(373): n is a, c, g, or t
tcagtgtactactccacgaccggtgctcgatttagcgagacgcgcagggggagagaggggcccagccctgggattttcaggtgttttcatttggtgatcaggactgaacagagagaactcaccatggagtttgggctgagcgtggngtttctagtggctattttaaaaggtgtccagtgtgaggtgcagttggtggactctgggggagacctgataccgcctggggggtccctgagactctcctgtacagcctctggacttcacctttaggagccatgccatgagctgggtcccgcgaggcctccgaggggaaggggctggagtgggtctcgtactattactgctagtggtaatcatgctatactntcgtcanacgtccgtagaacgggcccgttcaccttacaccagagaactaattcccaaagtaaccgacgcctttactacttctgacctaattacgacctaaccgccgttaggaccgcggacccggaaggaacccgaccgggacccgtaagttacggttaacttaacgttacgttaactaaacgtttccgggacggggttacgggcccgggtacccggggaccccggttacccggtcgggttaacggtttcgggtttttacggtaccgttttcggggtcggggtacccggtaaggggtaaccg

SEQ ID NO: 276611 - DNA, 689 bp, Homo sapiens
  misc_feature: GYAE6OF02HA0N9.16.9.A09.1.454.CMB.1.raw
  modified_base (260)..(260): a, c, t, g, unknown or other
  misc_feature (260)..(260): n is a, c, g, or t
  modified_base (553)..(553): a, c, t, g, unknown or other
  misc_feature (553)..(553): n is a, c, g, or t
tcagtgtactactccacgaccggtgctcgatttagcgagacgcgcagggggagagaggggcccagccctgggattttcaggtgttttcatttggtgatcaggactgaacagagagaactcaccatggagtttgggctgagctggtctttttcttgtggcttattttaaaaggtgtaccagtgtgaggtgcagttggtgactcgtgggggagacctgactacccgccggtcggggggtccctgacgactccttcctgtacncgcctctggtattctaccgtttaggacgccatggccatcggacgccgttagggtcccgccgtaggcctaccggaacgggggaacgggggcgttagggtaacggttcggggttcttaccgtaaccgtttaattaccgtggtcttaagggttaggttaagtccagttgactaacgttactatgactaagttccgtacggtacggaacggggtcccgttaccaccttccacgaagacgtactaataccgaacaaaccgacctctacttactactacgactaactcaacgtcgtacncggaccgacgccggaacgaccgacggtcagttacgttataccgtagtaacgtaacgtcggtcgggtacggccggtccgggtaccggtaccggtcggtagtttggttagttcggttcggtacgggacggagtaacgg

SEQ ID NO: 276612 - DNA, 589 bp, Homo sapiens
  misc_feature: GYAE6OF02HBYY0.16.9.A09.1.454.CMB.1.raw
  modified_base (291)..(291): a, c, t, g, unknown or other
  misc_feature (291)..(291): n is a, c, g, or t
  modified_base (407)..(407): a, c, t, g, unknown or other
  misc_feature (407)..(407): n is a, c, g, or t
  modified_base (416)..(416): a, c, t, g, unknown or other
  misc_feature (416)..(416): n is a, c, g, or t
tcagtgtactactccacgaccggtgctcgatttagcgagacgcgcagggggagagaggggcccagccctgggattttcaggtgttttcatttggtgatcaggactgaacagagagaactcaccatggagtttgggctgagctggctttttcttgtggctattttaaaaggtgtccagtgtgaggtgcagttggtggactctgggggagacctgataccgcctggggggtccctgagactctcctgtacagcctctggattcaccttaggagccatgccatgagctgggccncaggctccgagggaggggctggagtgggtctctactatactgctagtgtaatcatgcatactatgcagactcgtagacggccgttcaccttcgacagagactaatccaaagacacnctactatcngacaattgaccagcctagacgccgaccggaaggaccgaaccggcctaagttacgttaacttactagtaaaccttaaagtccgggacgggtccgggcccggtaccgggcccggtacccgtgggatttcgggttttagtacgttttccggtacgggggacccgaaagggtaaccg

SEQ ID NO: 276613 - DNA, 699 bp, Homo sapiens
  misc_feature: GYAE6OF02F5T50.16.9.A09.1.454.CMB.1.raw
  modified_base (170)..(170): a, c, t, g, unknown or other
  misc_feature (170)..(170): n is a, c, g, or t
  modified_base (192)..(192): a, c, t, g, unknown or other
  misc_feature (192)..(192): n is a, c, g, or t
  modified_base (431)..(431): a, c, t, g, unknown or other
  misc_feature (431)..(431): n is a, c, g, or t
  modified_base (497)..(497): a, c, t, g, unknown or other
  misc_feature (497)..(497): n is a, c, g, or t
tcagtgtactactccacgaccggtgctcgatttagcgagacgcgcaggggctgggcctcaggaagcagcatcggaggtgcctcagccatggcatggatccctctcttcctcggcgtccttgcttactgcacaggatccgtggcctcctatgagttgactcagcttccctnagtcgtccgtcgtccccggganagacagccagctactcacctgcctcgtggatactaaccgtagggtaaattaacttttacgttcgtaggtactcgagcggaacgccgacggcctacgttccccgttggttttcggtactacttacgtaagtaaacgaagtacggaacgttccggcccttacgagtaacctacttccccgtagacgccggtaactttccgtacgtcggtacctaccgacgtcttacggtaacggaaaaccncgtaaccggtaccctaacgtccgtaccgaccctacgtacccgacccgggtaaccagacctaggagntaacgagtacagtaacttagtacgttcgacgaacggtcgtaggaccacggcgtactaccggttggttaccgggttcggacgggtacggtaccgaagtcgtaccggcccgtacgtccggaccgtacggacccgtacggtcccgtccccgtacccggtccgttacctcccgttaccgttccccggtcccgtacccgttaccggg

SEQ ID NO: 276614 - DNA, 751 bp, Homo sapiens
  misc_feature: GYAE6OF02F4WS7.16.9.A09.1.454.CMB.1.raw
  modified_base (197)..(197): a, c, t, g, unknown or other
  misc_feature (197)..(197): n is a, c, g, or t
  modified_base (458)..(458): a, c, t, g, unknown or other
  misc_feature (458)..(458): n is a, c, g, or t
  modified_base (714)..(714): a, c, t, g, unknown or other
  misc_feature (714)..(714): n is a, c, g, or t
tcagtgtactactccacgaccggtgctcgatttagcgagacgcgcagggggctgggcctcaggaagcagcatcggaggtgcctcagccatggcatggatccctctcttcctcggcgtccttgcttactgcacaggactccgtggcctctatgagttgactcagtccttccctcaggtcgtccgtcggtccccggganaggacacgccagcatccacctgccttcgtaggaagtaactaaccggtagggtaaaatttaaacttttaccttgtaggtactcgaacggtacggaacggccgacggtcctaccgtttccccgttggttttcgactagttactaagtaaagagttaacggacgtccggaccctagaacgtacctaccgtaccgtagaacgttaccgttactttcgtaccgtcggtaccttaccggctacctacgtaacgaaacctacggaccncctaacgtccgacgtaccgtaccgtaacccggacccgggtacctaacggtactacggacgtaacgtacggaccgtacgttaacgaacgtttacttaccggtacgtacggtacggggacggtacggacgtaacgggtccgtaacggttcgggtttcgggtttacgggtaccgggaacggggtaccgtaacgtacggtccgttcgtaacccggttcgaacgaccgtaccgtaccgcggtaccccgcgtttaccccggngttccctgttaccccgttacccgcccttccgtaccgg

SEQ ID NO: 276615 - DNA, 774 bp, Homo sapiens
  misc_feature: GYAE6OF02IWWXY.16.9.A09.1.454.CMB.1.raw
  modified_base (199)..(199): a, c, t, g, unknown or other
  misc_feature (199)..(199): n is a, c, g, or t
  modified_base (223)..(223): a, c, t, g, unknown or other
  misc_feature (223)..(223): n is a, c, g, or t
  modified_base (227)..(227): a, c, t, g, unknown or other
  misc_feature (227)..(227): n is a, c, g, or t
tcagtgtactactccacgaccggtgctcgatttagcgagacgcgcaggggctgggcctcaggaagcagcatcggaggtgcctcagccatggcatggatccctctcttcctcggcgtccttgcttactgcacaggatccgtggcctcctatgagttgactcacgtccttccctcgagtcgttccggtcggtccccggganagacagccagcatccactgctcgngganactaaccgtagggtaaattaattttacttcgtagttatcgtaggacgggaacgaccgacggaccctacggttcccccgttaggttttcggtcctaacttacttaaagttaaacgtaagtaacggtaacgtccggtaccctacgacgaacactaccgtagacgtcgtattctaccgtcggctcgacgtcctagtacggaaacacgacgacctacgtctagtactaccgtacgcccgacccggaaccctaacggtacctaacgtacggtaacgtacggtaaacgtaccggtaacgtaacttaacgttaaccgtttggtaccggacgggtacggggtaccggacggtaacggtcggaaccgtttcggtacgggttttcggggtttacgggaccgggtaaccgggtaacccggaacggtaccgttaccggtacccggttaccgttaccgggaccggtaccggtaccggtaccgggtacccgttcccggtacccccggttaccggtcccgttacccggtaccccggtttccccggttacccccgttccccgg

SEQ ID NO: 276616 - DNA, 717 bp, Homo sapiens
  misc_feature: GYAE6OF02G7Z91.16.9.A09.1.454.CMB.1.raw
  modified_base (169)..(169): a, c, t, g, unknown or other
  misc_feature (169)..(169): n is a, c, g, or t
  modified_base (263)..(263): a, c, t, g, unknown or other
  misc_feature (263)..(263): n is a, c, g, or t
tcagtgtactactccacgaccggtgctcgatttagcgagacgcgcaggggctgggcctcaggaagcagcatcggaggtgcctcagccatggcatggatccctctcttcctcggcgtccttgcttactgcacaggatccgtggcctcctatgagttgactcagcttcccncagtgtccgtgtccccgggacagacagccagcatccactgcctcgtggagactaaccgtgggaaattaattttactttctggtatcagcggaanccgaggccacgtccccttgtttggtcatctaataaagatagggactccggccctcagaccatcccgtgacgcgtattcctcgtcgcctccgagtcttaccgtaggaaacctacgacgacctaactcgtacgaaccctacgtacccgaaccccggggacccaaggtaaccttaaggtacgggaattacggaacggtccgttaaggtacccttaagtttaccgttacggtaccggagggtcggtacgggacgacgggcccggagttaccgttcgggtttcgggttcgggaccggggtacggtaacccgtaggtccgttcccggtaacccggttccgttaccgggaccgtacccgggtaacccggtaaccggtcccggttaccccggaccccccttcgggttaaccctcccgtttcccgggttaccccgggtttccccggtacccccttaacccggg

SEQ ID NO: 276617 - DNA, 878 bp, Homo sapiens
  misc_feature: GYAE6OF02FYNSU.16.9.A09.1.454.CMB.1.raw
  modified_base (104)..(104): a, c, t, g, unknown or other
  misc_feature (104)..(104): n is a, c, g, or t
  modified_base (177)..(177): a, c, t, g, unknown or other
  misc_feature (177)..(177): n is a, c, g, or t
tcagtgtactactccacgaccggtgctcgatttagcgagacgcgcagggggctgggcctcaggaagcagcatcggaggtgcctcagccatggcatggatccctntcttcctcggcgtccttgcttactgcacaggatccgtggcctcctatgagttgacctcacgtccttcccctanaggttcgtcccgttacggtccccccggggacaggaccacggcccagcaactccgacccgttgcctccgtggagactaacccgtgggaagttaaaacttttccttaccgtgggttaacttccgaagccgggaacgccccgaacgggccctacgttccccccgttggtttttacggacctactttacctaagtaaacggtaacgttaacggaacgttccgggtccccttaccgaacggtaaccctaacgttccccttaaggggaccggtaccgtaactttaccgttccgttcggcccgtttacccgaggtacccttacggtaaccggggaaaacctacccggaccgaacccctaccgtccgttacccggtaaccgtacctcccgggaacccccggggtaacccctaagggaaccttacgtaacggaacgtaccgggtaaacggttccctaacgggtacccttaacgttaccgttacggtaacctaacgggtaccgttacgggaccgtacgggtaccggaccgttaccgggtttcggtttaccggggttttaccgggacgggttacccgggaacctaacgggtacctccgggtacccggtaccgttccggtaccggtaccgaccgggtaacccggtcccgtacccggtacccccgttcggccccgtaaccttccggtaccccggttacccctcccgttaacccg

SEQ ID NO: 276618 - DNA, 725 bp, Homo sapiens
  misc_feature: GYAE6OF02IP5CK.16.9.A09.1.454.CMB.1.raw
  modified_base (294)..(294): a, c, t, g, unknown or other
  misc_feature (294)..(294): n is a, c, g, or t
  modified_base (693)..(693): a, c, t, g, unknown or other
  misc_feature (693)..(693): n is a, c, g, or t
tcagtgtactactccacgaccggtgctcgatttagcgagacgcgcagggggagagaggggcccagccctgggattttcaggttgttttcatttggtgatcaggactgaacagagagaactcaccatggtagtttgggctgagcgtggtctttttcttggtggcttaagttttaaaaggtgtccagtgtgaggtgcgtagttggtggactcgtggggagacctgatacccggccgtcgggggtccctgacgacctcgtcctgtacagcctctggtacttcgtaccgtttaggacnccatcgaccagtcgagtcgtcggtcccgccgaggcctaccggaaggggtagggcgttcgggtacggtcggtacctcgtaaccgttacgttaaccgtgtaccgtaaggttacgttaaacgtcaagttcgtactaagttacctaagtcgacgtacgtaccgtacggtaggaaccggttccgttacctaccgtacgacgaaggaactaacctaacgtaccgaaacgtaaccgcgttactactaacgtcgaacgtaacctagttacgacccgtacgctacggaccggtaccgaccgtaagacccgaccgtactacgttactacgtttaaccagttaaacgttcgacgggtcgggtcccggacggtccccgggacgttaccggtacggttagtttcggttttanaccggtttccgggaacggtaccgtagggtaac

SEQ ID NO: 276619 - DNA, 752 bp, Homo sapiens
  misc_feature: GYAE6OF02H62TC.16.9.A09.1.454.CMB.1.raw
  modified_base (179)..(179): a, c, t, g, unknown or other
  misc_feature (179)..(179): n is a, c, g, or t
  modified_base (197)..(197): a, c, t, g, unknown or other
  misc_feature (197)..(197): n is a, c, g, or t
  modified_base (203)..(203): a, c, t, g, unknown or other
  misc_feature (203)..(203): n is a, c, g, or t
tcagtgtactactccacgaccggtgctcgatttagcgagacgcgcagggctgggcctcaggaagcagcagtcggaggtgcctcagccatggcatggactcctctcttcctcggcgtccttgcttacgtgcacgaggtactccgtggcctcctatcgagttcgacttcagtccttcccgnagtgtccgtgtcccgganagtacngccaggcatccacctgctcgaggatacgtaccgtagggaaacttaactttcgttgtcggtaactcgacgtacggtaacgcgacggccgtacgttccccgttggtttcggtactactacgtaaagtaaacggacgtacggtaacgtccggaccgttacgacgacgtacgtacccgtagtaccgtacgtacttccgttcgtcggtcctaccgaacggttccgtacgtaacggaaacgtacgtaccgacccgtacgtaccgtacgtaaccgtacgtacccggaaccggtaaccgacgtaacgttacgtacggtaacgtacggtacgtacgtacgtaaccgttagttaccggttacgaccggtacggtaccggttacggtacgaaccgggtcgtaccgttacggttacggtttaccggggttcggaacgggaccggttacgaccggttacgtaccggtaccgtcggtaccgtaacgtccggtaacccgtaggtcccgtaccgtcccgttacggtaccgtccgttacccgtaccggtttaccccgccgttaccg

SEQ ID NO: 276620 - DNA, 597 bp, Homo sapiens
  misc_feature: GYAE6OF02FV69E.16.9.A09.1.454.CMB.1.raw
  modified_base (217)..(217): a, c, t, g, unknown or other
  misc_feature (217)..(217): n is a, c, g, or t
  modified_base (316)..(316): a, c, t, g, unknown or other
  misc_feature (316)..(316): n is a, c, g, or t
  modified_base (329)..(329): a, c, t, g, unknown or other
  misc_feature (329)..(329): n is a, c, g, or t
  modified_base (359)..(359): a, c, t, g, unknown or other
  misc_feature (359)..(359): n is a, c, g, or t
  modified_base (369)..(369): a, c, t, g, unknown or other
  misc_feature (369)..(369): n is a, c, g, or t
  modified_base (396)..(396): a, c, t, g, unknown or other
  misc_feature (396)..(396): n is a, c, g, or t
tcagtgtactactccacgaccggtgctcgatttagcgagacgcgcaggggctgggccctacaggaagcagcatcggaggtgcctcagccatggcatggatccctctcttcctcggcgtcccttgcttactgcacaggatccgtggcctcctatgagttgactcagcttccctcagtgtcccgtgtccccgggacagacagccagcatcacctgctcnggagataacctgggaagttaaatttactttctggtattcagcggaagccaggccagtccccctgttttggtcatctataaagataggaatcggcccttnagacatccctagngcgattctctggctaccagctctggaaacncagccactcngaccactccaccgggtacccagactanaggatagaaacgtctagtactattactgttacaggcgtacgggacaggccggacgacgttacgttgggttttccggtacgggtaggggtaacccaaggccgtagacccggttcctccggtacgtaacggccctaaacgggcctccggccccccgtcggttaccgaccgttccttccggttcccccgtcccgtttaccccgg

SEQ ID NO: 276621 - DNA, 953 bp, Homo sapiens
  misc_feature: GYAE6OF02GHB7S.16.9.A09.1.454.CMB.1.raw
tcagtgtactactccacgaccggtgctcgatttagcgagacgcgcagggggagagaggggcccagccctgggattttcaggtgttttcatttggtgatcaggactgaacagagagaactcaccatggagtttgggctgagctggtctttttcttgtggcttaattttaaaaggtgtccagtgtgaggtgcagttggtggactcgtgggggagacctgataccgccgtggggggtccctgagactctcctgtacacgcctctggattcctaccgtttaggacgccatcgccatgacgtcgtcgggtcccgccgacggccgtaccgaagggggaacggggcgtagggaggttcggggttcctacgttaacttaagtttaccgtggtaccgttaagggttagggttaaattaccgtaagttcggaccgtaattaacgtttaagttacgacgtaacggtaccgtttacccgggttacgggtaaaccgggggttcccggtttacccgtacccttacccgaaacccgtaaggtaaccgtaaaccctaaactttaaccccgaaaaaggtaaacccctaaccggtacctttaaacccttaacgttacccgtaacggttaacccgtaaaagtttttacccggaaacccctaaacggttcccccgttaagggaaacccgggttacccccgggtaacccggggaaaaccgggtaaaccccggaacccggggttaccctaaaggttttaaccgtttaaaccgttttaaaccgttaaacggtttaaaacccgttaaaccgggttcccgggggtacccggggtaccggggtcccccgggtaccccggggggtaacccccgtttaacccggggttaccgggtttaacgtttttcgggggttttttaccgttacggtttttaacccgggggtacccggggggtaaacccggtaaggggttaaacccggg

SEQ ID NO: 276622 - DNA, 761 bp, Homo sapiens
  misc_feature: GYAE6OF02ISA5I.16.9.A09.1.454.CMB.1.raw
tcagtgtactactccacgaccggtgctcgatttagcgagacgcgcagggggagagaggggcccagccctgggattttcaggtgttttcatttggtgatcaggactgaacagagagaactcaccatggagtttgggctgagctggctttttcttgtggcttattttaaaaggtgtcctagtgtgaggtgcagctgttcggagtcgtggggagcgttggtacagccgtgggggtcctgacgactcctcctgtgccgtacctcgtggattctaacctttagccagtacgtatcgaccagtgacgcgtgggtcccgaccgaaggccgttaccggaagggggaacggggtctagggtacggtgggttacctaacgtaacttaagtttaggtaggttaacggtggtaccggtacctacaacttacccgttccgtacgtacggtaccgttcggtaacggtaacgggtcccggtttacaccgacttaccgtaccgagtaacaaccgttacccgttaacaaacggtaactaccgggtttaaacgttcgtagacccgtaaaggttcgaactaaccgtagtccgttacggaacgacggacccgtaaacggaaacccacccggggtactaaacgtttcgtaaaccttttacgaccggttgaaaacccgggtaaagttccgtacccgtttaaaccccgttcccccggttaaccggttaagaacgtacggttacgaacttaaacgtaactttcggttacccgtacgtattaccgg

SEQ ID NO: 276623 - DNA, 867 bp, Homo sapiens
  misc_feature: GYAE6OF02IYTBN.16.9.A09.1.454.CMB.1.raw
  modified_base (170)..(170): a, c, t, g, unknown or other
  misc_feature (170)..(170): n is a, c, g, or t
  modified_base (190)..(190): a, c, t, g, unknown or other
  misc_feature (190)..(190): n is a, c, g, or t
tcagtgtactactccacgaccggtgctcgatttagcgagacgcgcaggggctgggcctcaggaagcagcatcggaggtgcctcagccatggcatggatccctctcttcctcggcgtccttgcttactgcacaggatccgtggcctctatgagttgactcagtcttccctnacgtgtccgtcgtcccgganagacagccagtcactcacctcgtctcgtggagtaacgtaacccgtgggtaaacgttaaaacgttttccttttcggaggttaacttcgaggacggtaacgccgacggccctacgttccccttgttttcggctacttacgtaattaaagtaagttacggaacttccggtaccctacgtacgtacctaccgttcccgaggtacgtaccggtcgtttccgtcgtccggtaccttaccgtaacggtccgttaccggtaagggaaacccaacgttacgaaccccttacgttccgtacgacccgttaaccgtccgaaccccgggtaaccgaacgtaacgtacgtaacgtacggtacgaaacgtctaaggtaacctttacgttaaccgtggtaaaccgtcgggtacggtaacggtacgtaaccgggtccggtaactaaccggggttttggtttaccgggggtttacgggtaaccggggtaagggtaacccgtaaacccggttaccgggttaccggttaacccccggttacgggttaccccggtaacccgggttaaccccggaaacccgggtaaacccggttaccccggttccccgggtacccccccggttttaccgggtaacccgttaaccccggtttcctttaaccccccggggtttaccccggttacccccgttaaccccggg

SEQ ID NO: 276624 - DNA, 832 bp, Homo sapiens
  misc_feature: GYAE6OF02JTCGG.16.9.A09.1.454.CMB.1.raw
tcagtgtactactccacgaccggtgctcgatttagcgagacgcgcagggggagagaggggcccagccctgggattttcaggtgttttctatttggtgatcaggactgaacagagagaactccaccatggagtttgggctgagcgttgggtctttttcttggttcggtacttaacgttttaaaagggttcgtacctaggtgtggtaggtggcgtaggttgggtgggacgttcggtagggggtacgtacccgtggtacgtacccggtccgggttcgggggggttccccttcggacggtacctccgttcccgttcgtacgtcggtccctcgttagggtacttaccgtaccgtttacggtacgcctagttccggactacgttacggacgtccggttccggggttaccccgacccggaacggggtccgtacccgaaggggggtaaccggggtcggtaggggttacgggtcgggttccttacgttaaacgtttaccgttacgttaggtcgttaaggttcggttaagtaccgtagtacacgtactacgtatgacgtacgtcgtccgttacggaacggttcccggtacttaccgtacacgtaacgacgtactaacgtacccgaatacgaccgtccttacgtatcgttaccgattaaccgtactacccgaacgtccgtaacgcggaccgaacgggtcccgaacggcccgtaccttaggtacctacttaaccggttataaccgtcggtacggccgggtcgaacccggggttccgtacccggtacgtacggttcggtttacggttcggttacgttacccgggccgggtaccggtacggtaacg

SEQ ID NO: 276625 - DNA, 703 bp, Homo sapiens
  misc_feature: GYAE6OF02FPSZ4.16.9.A09.1.454.CMB.1.raw
tcagtgtactactccacgaccggtgctcgatttagcgagacgcgcaggggctgggcctcaggaagcagcatcggaggtgcctcagccatggcatggatccctctcttcctcggcgtccttgcttactgcacaggatccgtggcctcctatgagttgactcacgtccttccctacagtcgtcccgtcggtccccgggacagacgacgccagcactcacctgctctggaagtactaaccgtgggtaaagttaaattttacgtttctcggtaatcgaggtacggaacgcctacggccgtacgttccccttggttttcggactatacctaaagtaaaagtagttaacggaacgtcccggtacctacgaagacctactcccgtagacgacgtacttctcgtcgtctaccgagtcctacgtaacggaactaccgaacgtcccgtaactaccgtagaaccctacgtaacccggaacccggggtaacccaacggtaaccttagtacggtaacgtaccggaaagtccgttacgtaaaccttaatttacggtcgttacgtacgggtcggttacggactacgggacgaccgttaggttcggttcgggtttaccgggcgggtaacgggactaacggtcgacgtccgtcgtacgtcgacgaccgacgcccgtccggtcccgtaggtccctaacttccgtaccgtcccctccgtacg

SEQ ID NO: 276626 - DNA, 834 bp, Homo sapiens
  misc_feature: GYAE6OF02JJQG3.16.9.A09.1.454.CMB.1.raw
tcagtgtactactccacgaccggtgctcgatttagcgagacgcgcaggggagagaggggcccagccctgggattttcaggtgttttcatttggtgatcaggactgaacagagagaactcaccatggagtttgggctgagctggactttttcttgtggtctaattttaaaaggtgtaccagtgtgaggtgctagttggtggactcgtgggggagacctgactaccgccgtgggggtccctgagactctcctgtaccagccctgtaggtacttacctaccgtttaggaacgccctagttcgaccagttcgaagtccgtagggtcccgaccgacggtcctacccggaagggggtaacgggccgtgggaacggttcgggttcctacgtaaggtttaggtttacgggttagggtacggttagggttacttaacccgaacgtactttaaccgaaccggtcaacgtacgtccggtaggtaaccggggtccggtttaaccaaccgtaattccccgttaccgaaggtaacgtaacccgtaaaactttccccgaaaaagtaaacccgtaaacctaaacttaaacttacgtaaccgtacggtaaaactaaaacgttaccggaaagtaacccggtaccttaaggaacgtaacgaccgggtaaacgtaaccgaacccgggtaccggttaaatttacggtaccgttaacggtaacgaacgggtaaacggtacggaaccggggttataccgacggttaaggtcgggtaacgttacggtaaaccccgtaacgggtcggggaaccctaaccggggtacctaccgggttaacccgccgtttacccgtaaccg

SEQ ID NO: 276627 - DNA, 542 bp, Homo sapiens
  misc_feature: GYAE6OF01BAUM8.10.75.G09.1.454.CMB.1.raw
  modified_base (427)..(427): a, c, t, g, unknown or other
  misc_feature (427)..(427): n is a, c, g, or t
  modified_base (431)..(431): a, c, t, g, unknown or other
  misc_feature (431)..(431): n is a, c, g, or t
tcagcatagtagtgcacgaccggtgctcgatttagtatagacatcaggggggggtctcaggaggcagcgctctcgggacgtctccaccatggcctgggctctgctattcctcaccctcctcactcagggcacaggttcctgggcccagtctgccctgtctcagcctgcctccgtgtctgggtctcctggacagtcgatcaccatctcctgcaatggaagcgaaaagtgacattggttctttaaattttgtctcttggtaccaacagagcccagacaaacgacccccaaaattatcatttctgctgtcagtaatcggccctcgtagggtttctagtcgcttctctggctccaagtctggcaacacgcctccctgaccatctcgtgggctccgaggctggaggacgaggctagtattattatgcagctnatanacaaacaccaaagtcttagattacgttcggacggaggaaccaaacgtcgacccgttaccttcgtcacgacccaaggcctcgccccctggtaccacctctcgtcccctaccc

SEQ ID NO: 276628 - DNA, 524 bp, Homo sapiens
  misc_feature: GYAE6OF01A3BP7.10.75.G09.1.454.CMB.1.raw
  modified_base (263)..(263): a, c, t, g, unknown or other
  misc_feature (263)..(263): n is a, c, g, or t
tcagcatagtagtgcacgaccggtgctcgatttagtatagacatcaggggggggtctcaggaggcagcgctctcgggacgtctccaccatggcctgggctctgctattcctcaccctcctcactcagggcacaggttcctgggcccagtctgccctgtctcagcctgcctccgtgtctgggtctcctggacagtcgatcaccatctcctgcaatggaagcgaaagtgacattggttctttaaattttgtctcttggtaccaanagagcccagacaaagcccccaaaattatcatttctgctgtcagtaatcggcctcgagggtttctagtcgcttctctggctcaagtctggcaacacggcctccctgaccatctctgggctccaggctgaggacgaggctgatttatattgcagctcatataacaaacacctaaagctttagattagttcggacggtaggaccaaacgtgacccgtccttcgcagcccaaggcctcgccccctggtccactctgtccccaccc

SEQ ID NO: 276629 - DNA, 554 bp, Homo sapiens
  misc_feature: GYAE6OF01DSXH2.10.75.G09.1.454.CMB.1.raw
tcagcatagtagtgcacgaccggtgctcgatttagtatagacatcaggggggggtctcaggaggcagcgctctcgggacgtctccaccatggcctgggctctgctattcctcaccctcctcactcagggcacaggttcctgggcccagtctgccctgtctcagcctgcctccgtgtctgggtctcctggacagtcgatcaccatctcctgcaatggaagcgaaagtgacatttggttcttttaaattttgtctcttggtaccaacagagccagacaaagcccccaaaattatcatttctgctgtcagtaatcggcctcagggtttctagtcgcttctctggctcaagtctggcaacacggcctccctgaccatctctgggctccaggctgaggacgaggctagattattatgcagctcataactacaaacaaccaagtctttagacttagttcgggacggacgggtaaccaaacgtcgtacccgtccttcgtccacgacccgtaacggccgtccgccccccgtcggtacccaccttcctcgttcccctaccccc

SEQ ID NO: 276630 - DNA, 620 bp, Homo sapiens
  misc_feature: GYAE6OF01CBPJK.10.75.G09.1.454.CMB.1.raw
  modified_base (309)..(309): a, c, t, g, unknown or other
  misc_feature (309)..(309): n is a, c, g, or t
tcagcatagtagtgcacgaccggtgctcgatttagtatagacatcagggggggggtctcaggaggcagcgctctcgggacgtctccaccatggcctgggctctgctattcctcaccctcctcactcagggcacaggttcctgggcccagtctgccctgtctcagcctgcctccgtgtctgggtctcctggacagtcgatcaccatctcctgcaatggaagcgaaagtgactattggtttactttaaattttgtcttcttggtaaccaacagacgcccagaacaaacgacccccaaaattactcatttcngtctgtacagtaatcggccctcgtagggtttctagtcgcttctctgtcctccaagtctggacaacgaccggcccttcccgtacgaccctattcctcgtcgggtcctaccagtactggaaggaccggaggtctagtattacttacgtcgcagctcactactaacgaagcggacaggtcgggttgggtcgggttcggggacgggggtaccacgtaccgtcggtacccgttacgtacgggtccgacggaccccgtaagggcccgtccgtccccccgtcggtacccaccgttccgtcccgttcccccgtcccccg

SEQ ID NO: 276631 - DNA, 521 bp, Homo sapiens
  misc_feature: GYAE6OF01DN3YK.10.75.G09.1.454.CMB.1.raw
  modified_base (232)..(232): a, c, t, g, unknown or other
  misc_feature (232)..(232): n is a, c, g, or t
  modified_base (502)..(502): a, c, t, g, unknown or other
  misc_feature (502)..(502): n is a, c, g, or t
tcagcatagtagtgcacgaccggtgctcgatttagtatagacatcagggtctccctcactgcccagctgggatctcagggcttcattttctgtcctccaccatcatggggtcaaccgccatcctcgccctcctcctgactgttctccaaggtcagtcctgccgagggcttgaggtcacagaggagaacgggtggaaaggagccccggattcaaattttcggttcccccccanaggagtctgtgccgaggtgcagctggtgcagtcaggagcagaggtaaagaggcccggggagtctctgaagatctctgtaaggcctctggattcatgtttagccactcctggatcggctgggtgcgccagatggcccgggaaagcctggagtggaagtgggggatcgagtcgtggcctagtgactctgatatcagatacacgtccgtccttccgaacggccaggtcacctatcctcgacgccgaacaacgtccatcacgcaccgctactcngcagtggacgtgcgtacgg

SEQ ID NO: 276632 - DNA, 608 bp, Homo sapiens
  misc_feature: GYAE6OF01EH958.10.75.G09.1.454.CMB.1.raw
tcagcatagtagtgcacgaccggtgctcgatttagtatagacatcagggggggggtctcaggaggcagcgctctcgggacgtctccaccatggcctgggctctgctattcctcaccctcctcactcagggcacaggttcctgggcccagtctgccctgtctcagcctgcctccgtgtctgggtctcctggacagtcgatcaccatctcctgcaatggaagcgaaagtgactatttggtttacttttaaatttgtcttcttggtaaccaacagacgacccaagaacaaaacgacccccctaaaaattactactaatttctgcttgtcaagtaactccggtccctcgtaggggtttctagtcgtctttctcgtggctccaagtctggacaacaccggcctcctcgacctatctcgtcggtcctccgacggtcgtaggacggacggacggtctagtatttagttattgactagtctactaattaactaacaaactaaccgtaaagttctttagtacttagtcgggacggtacggaacctaaacgtcgtaccgtcttacgactacgaccgtacgcctccgccccgtcgtcctactccttccgtcccgtcccc

SEQ ID NO: 276633 - DNA, 516 bp, Homo sapiens
  misc_feature: GYAE6OF01ATKLP.10.75.G09.1.454.CMB.1.raw
  modified_base (231)..(231): a, c, t, g, unknown or other
  misc_feature (231)..(231): n is a, c, g, or t
  modified_base (362)..(362): a, c, t, g, unknown or other
  misc_feature (362)..(362): n is a, c, g, or t
tcagcatagtagtgcacgaccggtgctcgatttagtatagacatcagggtctccctcactgcccagctgggatctcagggcttcattttctgtcctccaccatcatggggtcaaccgccatcctcgccctcctcctgactgttctccaaggtcagtcctgccgagggcttgaggtcacagaggagaacgggtggaaaggagccccggattcaaattttcggtcccccccanaggagtctgtgccgaggtgcagctggtgcagtcaggagcagaggtaaagaggcccggggagtctctgaagatctcctgtaaggcctctggattcatgtttagccactcctggatcggctgggtgcgccagntggcccgggaaaggcctggagtgggagtgggggatcgatcgtggcctagtgactctgatatcagatacagtccgtccttcaaggccaggtcaccatctcagccgacacgtccatcacgccaccgcctactctcgcaggtggagtgccgtacggg

SEQ ID NO: 276634 - DNA, 775 bp, Homo sapiens
  misc_feature: GYAE6OF01BBYLH.10.75.G09.1.454.CMB.1.raw
  modified_base (230)..(230): a, c, t, g, unknown or other
  misc_feature (230)..(230): n is a, c, g, or t
  modified_base (376)..(376): a, c, t, g, unknown or other
  misc_feature (376)..(376): n is a, c, g, or t
tcagcatagtagtgcacgaccggtgctcgatttagtatagacatcagggtctccctcactgcccagctgggatctcagggcttcattttctgtcctccaccatcatgggtcaaccgccatcctcgccctcctcctgactgttctccaaggtcagtcctgccgagggcttgaggtcacagaggagaacgggtggaaaggacgccccggattcaaattttcggtccccccanaggatctgtgccgaggtgcagcgtggtgcagtcaggagcagaggtaaagacggcccgggatcgtctagaagatcgtccgtgtaacggccttcgtggtattcattcgtttagccctaacttccgtggacgttcggcgttgggggtcnccggtccaaggtacgttacggggaaccccccgggggtaaaaagggtccccgttagggggtaacggtagggggtaagggttacggggggtaacttaccgtaagtttccgggttcgggtaccccgtttaagggttcggtaaccgtttaccgtaggtaacgttaacgttacgaaaggtaacttaaccggtacggtttaccccggtttacccccgtttaaccggaaaccgggtaccccgtaacgggttacccctaaacccgttaacttcccgttaacccgaaccgggtaccccgaaacgtaaaccgttacccaacgttaccgaaccgtacccgaccccggtaccccttacgttcccgtacggtccaacgggttacggaacggttaccgtcccggtaaacgggg

SEQ ID NO: 276635 - DNA, 600 bp, Homo sapiens
  misc_feature: GYAE6OF01D8YKK.10.75.G09.1.454.CMB.1.raw
  modified_base (235)..(235): a, c, t, g, unknown or other
  misc_feature (235)..(235): n is a, c, g, or t
tcagcatagtagtgcacgaccggtgctcgatttagtatagacatcagggtctccctcactgcccagctgggatctcagggcttcatttttctgtcctccaccatcatggggtcaaccgccatcctcgccctcctcctgactgttctccaaggtcagtcctgccgagggcttgaggtcacagaggagaacgggtggaaaggcgccccggattactaaattttccggtaccccccanaggatctgtgccgaggtgcagcgtggtgcagtcaggagcaggaaggtaaaggacggcccggggatcgtcgtggaagtatcctccgtaggtaacggcctcgtggattcagttgtttacgcctactccgtaggactcggcgtgggtcgccgcgagacgtcggaccggggtaaacgcgtaggagtggaggtggggactcgacgtcgtggtaccttaggtacgtacttcgtagtatactacgagtactacgtcgttacccgtccgttaccgacgtccgacgtccaacctctcctacacgacccgaacacgtccataccgacgtcccaccgtcctactcgtacgcgtacggtagagtaccgcgtaacggg

SEQ ID NO: 276636 - DNA, 618 bp, Homo sapiens
  misc_feature: GYAE6OF01ES6D9.10.75.G09.1.454.CMB.1.raw
  modified_base (232)..(232): a, c, t, g, unknown or other
  misc_feature (232)..(232): n is a, c, g, or t
  modified_base (282)..(282): a, c, t, g, unknown or other
  misc_feature (282)..(282): n is a, c, g, or t
  modified_base (296)..(296): a, c, t, g, unknown or other
  misc_feature (296)..(296): n is a, c, g, or t
tcagcatagtagtgcacgaccggtgctcgatttagtatagacatcagggtctccctcactgcccagctgggatctcagggcttcattttctgtcctccaccatcatggggtcaaccgccatcctcgccctcctcctgactgttctccaaggtcagtcctgccgagggcttgaggtcacagaggagaacgggtggaaaggagccccggattcaaattttcggttcccccccanaggagtctgtgccgaggtgcagctggtgcagtcaggagcagaggtaaagnggcccgggatctcngaagatctcctgtaacggcctcgtggattcattgtttacgcctactccgtggactcggcgtggggtcgccgccgagacgtcggacccgggaaaggccgtggagtggagtggggatcgatcgtcgtcgtagtgtactctagatatcagtactacgtacgttcccgtccgttacgaacggtcccgtacggtaccaaccgtacttcctaccgacggaccccgtaaccgtaacgtacccaactaccgtaaccgtacccgtaaccccgtcccttaacgttccgtacggtaccgtacgggttacgggaacgttacggcccgtaacggg

SEQ ID NO: 276637 - DNA, 692 bp, Homo sapiens
  misc_feature: GYAE6OF01DLX79.10.75.G09.1.454.CMB.1.raw
tcagcatagtagtgcacgaccggtgctcgatttagtatagacatcagggtctccctcactgcccagctgggatctcagggcttcattttctgtcctccaccatcatggggtccaaccgccatcctcgccctcctcctgactgttctccaaggtcagtcctgccgaggcttgaggtcacagaggagaacgggtaggaaaggcgcccggtattactaaacgttttccggtaccccccagaggtagtctggtcgccggaggtgcgagcgtggtgcgaggtcgaggagacgaaggaaagggtaaacggaccggggacccggggagtccgtacggtaggaagtactccgtaccgttaggtaacggtccttcgtaggtacttcgtaagtttcgttacgccctaacgttccggtaggtacgtcgggtcggttcgggtcggaccgaccgtaggtacggtaccgggaaccggggtaaacggccggtagggacggtcggggtaggtcggggtatcggagttccggtcggtaccgttaggtcgtacgtcgtgaattagtacgacgtactaccgtaccgttccgtacccgtacgaacggtaccgtacgtacctacctactcgaccgacgtaccgtaacacgtccacgtacgaccgaccgaccctcgttagtccgcgtacgaggtaggacgtcggaccgtacggg

SEQ ID NO: 276638 - DNA, 625 bp, Homo sapiens
  misc_feature: GYAE6OF01BFFQO.10.75.G09.1.454.CMB.1.raw
  modified_base (446)..(446): a, c, t, g, unknown or other
  misc_feature (446)..(446): n is a, c, g, or t
tcagcatagtagtgcacgaccggtgctcgatttagtatagacatcaggggggggtctcaggaggcagcgctctcgggacgtctccaccatggcctgggctctgctattcctcaccctcctcactcaggcacaggttcctgggcccagtctgccctgtctcagcctgcctccgtgtctcgggtctcctggacagtcgactcaccatctcctgcagtggaagcgaaagtgactattggttactttaaattttgtcttcttggtaccaacagacgcccagacaaacgcccccacaccttcttgtatttatagtaatcaagtaacgccggtccctacgtaggggttttctaggtcgtcttctctcgcctacagtcgtgacaacgacgtccctcctgacatctcgtggcctccgagctcgacgacgtaggctagaatattactgcatctanattatagtagtagtagggtctcctttcgtttacgttacgggttttcgggacggtacgggccgtaggtccgtacggtacccgttaccgttaaggacccgtccggaaccccgaaccggtcccgtacccccggtaccccccgtttaccgggtacccttacccgttccggtttacccccccgg

SEQ ID NO: 276639 - DNA, 700 bp, Homo sapiens
  misc_feature: GYAE6OF01BUELO.10.75.G09.1.454.CMB.1.raw
tcagcatagtagtgcacgaccggtgctcgatttagtatagacatcagggtctccctcactgcccagctgggatctcagggcttcattttctgtcctccaccatcatgggtcaaccgccatcctcgccctcctcctgactgttctccaaggtcagtcctgccgaggcttgaggtcacaggaggagaacgggtggaaaggacgccccggtattacgtaaattttccggttacccccccagaggtagtctgtcgccgagtgcagctggtgcagtcaggagcgaaggtaaggtaaacggacgggaccggggagtctcgtaggaagtactccgtccgtaggtaacgtccgttacgtggtattctagtttacgtttacgaccctacttcgtggtacgtcggtcgtagggtcgcgacgtagtacgtacggacccgggaaagtccgtaggacgtggagtgggactcgtacgttcgtcgtacgtaggtacgacttcgtagtactactcgaagttaccacgtaccgttacccgtaccgtaaccgaaccggaccgttaccgtaccgtaacctacgttaccaccggtacggaccccgtaaagtaacccggttaccaacgttacccgaacccgtacccgtaaccccgtaccttacggtacccgtacggtaccgtagggttacgtaacggtacccggtaacggtaaacccgggg

SEQ ID NO: 276640 - DNA, 974 bp, Homo sapiens
  misc_feature: GYAE6OF01D5DP6.10.75.G09.1.454.CMB.1.raw
tcagcatagtagtgcacgaccggtgctcgatttagtatagacatcagggtctccctcactgcccagctgggatctcagggcttcattttctgtcctccaccatcatgggtcaaccgccatcctcgccctcctcctgactgttctccaaggtcagtcctgccgagggtcttgaggtcacgaggaggaggaacgggtaggaaacggcggccccgggtaatttaccgtaaaacgttttttcccggttacccccccccgaagtacgggtacgttccgttcggttcggacccggtagggtcgaccgaggtccgtgggtcgacgtaggtaccgaagggtacgacgaaggtaaaggggttaaaacgggacgggggtacccgggggtaattccgttacgtagggaaacgtacttccgttaccggttaaggtaaccggtcccttcggttacggtacttacgttagtttacggtttaccggacccttaacgttccgtagggtacgttccggtccggttgggtccgacccggacgtaacggtaacggtaccggggtaacccggggtaaacgggtccggttaaggggtacgggttacgggtaacgggttacgggggtactaccggttacgttccgggtacgggtaccgtttaacgggtacgttaaccgtttacggttaacggtactttaaaccggtaccgttaaagtaccggtttaaacccgtcccggttttaaccccggttcccgttaaacccgggaaccgggttaaccccggtacggtttaacccccaaccgtttacggttaccccgttaaccgggaacccggtaaccccggtaaaccgtaacccgttccccggtaacgttacccggtaaccggtaacccccgtaaccccggtttacccgttaaaccgtttcggtaacggtaaccccgggttaaggggttaaaccgggttacccgggttaaacgtaccccgggttaaaccgggg

SEQ ID NO: 276641 - DNA, 601 bp, Homo sapiens
  misc_feature: GYAE6OF01A9ZK1.10.75.G09.1.454.CMB.1.raw
  modified_base (232)..(232): a, c, t, g, unknown or other
  misc_feature (232)..(232): n is a, c, g, or t
  modified_base (296)..(296): a, c, t, g, unknown or other
  misc_feature (296)..(296): n is a, c, g, or t
tcagcatagtagtgcacgaccggtgctcgatttagtatagacatcagggtctccctcactgcccagctgggatctcagggcttcattttctgtcctccaccatcatggggtcaaccgccatcctcgccctcctcctgactgttctccaaggtcagtcctgccgagggcttgaggtcacagaggagaacggttggaaaggagccccggattcaaattttcggttcccccccanaggagtctgtgccgaggtgcagctggtgcagtcaggagcagaggtaaagaggcccggggagtcnctgaagatctcctgtaacggcctcgtggattcatgtttacgcctactccgtggatcggctggggtgccgccaggactcggaccccggggaaaggtcccgtaggacggtgggaagtgggggatcgagtcgtcggaccgttagtcgacttcgtcgtatagtcaagactaccgacgtccccgttaccttaccgaacggtcccgtacggtacccaacctactctaccacggacccgactaacgtccgactaccgacgacccacccgtccctatccgtacgccgtaggtacggacgtggtcccgtacggg

SEQ ID NO: 276642 - DNA, 642 bp, Homo sapiens
  misc_feature: GYAE6OF01BBNLB.10.75.G09.1.454.CMB.1.raw
  modified_base (234)..(234): a, c, t, g, unknown or other
  misc_feature (234)..(234): n is a, c, g, or t
tcagcatagtagtgcacgaccggtgctcgatttagtatagacatcagggtctccctcactgcccagctgggatctcagggcttcatttttctgtcctccaccatcatggggtcaaccgccatcctcgccctcctcctgactgttctccaaggtcagtcctgccgagggcttgaggtcacagaggagaacgggtggaaaggacgccccggattcaaattttcggttcccccccanaggagtctgtgccgaggtgcagctggtgcagtcgaggagcaggaggtaaagacgggcccggggagtctcgtagaagatctccgtagtaacggcctcgtggtattcgattgtttacgccctaccttccgtggtactcggtcgttggggtcgccgaccgagtacgtcggacccggggaaaggtccgtaggacggtgggagtggggactcgacgtcgtcggtcctagtcgtactcgtagtatacgtacgagtactacgtacgttcccgttacccgttaccgaaccggtacccgtacgggtacctaccgtacttccgtaccgacggacccgtaacaacgtcccaacgtaccgaccgacccacccggtccttaacgtccgtacgtacgtaggtaggacggtcgccgtaacggg

SEQ ID NO: 276643 - DNA, 633 bp, Homo sapiens
  misc_feature: GYAE6OF01BBJFN.10.75.G09.1.454.CMB.1.raw
  modified_base (386)..(386): a, c, t, g, unknown or other
  misc_feature (386)..(386): n is a, c, g, or t
  modified_base (601)..(601): a, c, t, g, unknown or other
  misc_feature (601)..(601): n is a, c, g, or t
tcagcatagtagtgcacgaccggtgctcgatttagtatagacatcagggtctccctcactgcccagctgggatctcagggcttcattttctgtcctccaccatcatggggtcaaccgccatcctcgccctcctcctgactgttctccaaggtcagtcctgccgagggcttgaggtcacagaggaggaacgggtggaaaggacgccccggtatttactaaacgttttccggtcccccccagaggagtctgtgccgaggtgcagctggtgcagtcaggagcaggaggtaaagcggccggggatcgtctgaagatcgtcctggtaacggcctcgtggtattcagtttgtttacgcctacgttcctagggacgttcggcgttcggggtcncccggccgaaggacgtcgggacccgggaaaggtcccggtagggaggtgggaggtgggggaactcgtaacgttcgtcgggtcctaggttcgtacttcgtagtaacttagtacgagtaactaccgtacgttcccgttaccctttaccgaacggtccgtacggtccaccgtatcctacgacgacccgaataaccgtcactcgacgcccaccgtctacncgtcgacgtaggtaggtacgtcgcgtaacggg

SEQ ID NO: 276644 - DNA, 607 bp, Homo sapiens
  misc_feature: GYAE6OF01D1WYR.10.75.G09.1.454.CMB.1.raw
  modified_base (234)..(234): a, c, t, g, unknown or other
  misc_feature (234)..(234): n is a, c, g, or t
  modified_base (261)..(261): a, c, t, g, unknown or other
  misc_feature (261)..(261): n is a, c, g, or t
  modified_base (359)..(359): a, c, t, g, unknown or other
  misc_feature (359)..(359): n is a, c, g, or t
  modified_base (365)..(365): a, c, t, g, unknown or other
  misc_feature (365)..(365): n is a, c, g, or t
tcagcatagtagtgcacgaccggtgctcgatttagtatagacatcagggtctccctcactgcccagctgggatctcagggcttcattttctgtcctccaccatcatggggtcaaccgccatcctcgccctcctcctgactgttctccaaggtcagtcctgccgagggcttgaggtcacagaggagaacgggtggaaaggagccccggattcaaacgttttcggttcccccccanaggagtctgtgccgaggtgcagctggngcagtcaggagcaggaggtaaagacggcccggggatctctgaagatctctaggtagcctcgtggattctagttcgttacgcctactccgtggatcggngtgggngcgccagagtcggaccgggaaagccgtaggagtggaagtggggatcgacgttcgtggtaccttaggtcgactctagtattctacgagtacttacgtcgttccccgtaccgttacgaacggtccctaacggtcctaaccgtctcgtacgacgaccgtaactaaacggtcccaagtccgaaccgtaccgacccgtccttacgtccgacgtccgtaagggttcggtaaacgtccgccgtaacggg

SEQ ID NO: 276645 - DNA, 589 bp, Homo sapiens
  misc_feature: GYAE6OF01A7NOH.10.75.G09.1.454.CMB.1.raw
  modified_base (200)..(200): a, c, t, g, unknown or other
  misc_feature (200)..(200): n is a, c, g, or t
  modified_base (231)..(231): a, c, t, g, unknown or other
  misc_feature (231)..(231): n is a, c, g, or t
  modified_base (504)..(504): a, c, t, g, unknown or other
  misc_feature (504)..(504): n is a, c, g, or t
  modified_base (558)..(558): a, c, t, g, unknown or other
  misc_feature (558)..(558): n is a, c, g, or t
tcagcatagtagtgcacgaccggtgctcgatttagtatagacatcagggtctccctcactgcccagctgggatctcagggcttcattttctgtcctccaccatcatggggtcaaccgccatcctcgccctcctcctgactgttctccaaggtcagtcctgccgagggcttgaggtcacagaggagaacgggtggaaaggngcccggattactaaattttcggtccccccanaggagtctgtgccgaggtgcagcgtggtgcagtcaggagcaggaaggtaaagaggcccggggagtctctgaagatctccgtgtaacgcctcgtggtattcagttgttagcctactccgtggatcggcgttcgggtcgccgccgaggacgtacggacccggggaaaggcccgtagggacgtgggagtggggactcgatcgtggtccgtaggtcgacgtcgtagtactatcgaagtactacgacgttccgtccttacgacgaccacggtctaccnttactcgacgaccgaacgaacgtccacgtccgagacccacccgtctacgttacncggtacagggttagacggtacgcgtaacggg

SEQ ID NO: 276646 - DNA, 726 bp, Homo sapiens
  misc_feature: GYAE6OF01A0Z94.10.75.G09.1.454.CMB.1.raw
  modified_base (695)..(695): a, c, t, g, unknown or other
  misc_feature (695)..(695): n is a, c, g, or t
tcagcatagtagtgcacgaccggtgctcgatttagtatagacatcagggtctccctcactgcccagctgggatctcagggcttcattttctgtcctccaccatcagtgggtcaaccgccatcctcgccctcctcctgactgttctccaaggtcagtcctgccgaggcttgaggtcacgagaggagaacgggtggaaaggacgccccggtattacgtaaacgttttccggtaccccccagaggacgtcgtggtcgccggaggtcgcgtaggcttgggtgcgtagtcgagggacgacgtaaggaagggtaaaaggacggggtccccgggggtaagtccgttacgtaaggaaacgtacttccgtaccgttaggtaaacggtcccttacggtcggtaatttaccgtaagtttcggtttaaccgtacccctaacgttccggtaggtacggtcggtcggttcgggtcgcgtaccgagtacggtccgggaaccggggaacgtcggtagggtaggtacgggtagggtacggggtactacggtaagttccggtacggtccgttaaggtcgtaacccgttgttaagtaacttacgtagaagtaacgtaccgtacgttccccgttaccttaccgaacggtccgtacggtacctaccgtatcctacgactaaccgactacgcctaatccgacgcccaccgtctcgtntacgcgttaggacggaagtcggcgtaacggg

SEQ ID NO: 276647 - DNA, 751 bp, Homo sapiens
  misc_feature: GYAE6OF01B37Z4.10.75.G09.1.454.CMB.1.raw
  modified_base (683)..(683): a, c, t, g, unknown or other
  misc_feature (683)..(683): n is a, c, g, or t
tcagcatagtagtgcacgaccggtgctcgatttagtatagacatcagggtctccctcactgcccagctgggatctcgagggtcttctatttttctgtcctccaccatcagtggggtcaaccgccatcctcgccctctcctgactgttctccgaaggtcagtcctggccggagggcgttaggacggtcacgaggagggaagggaacggggtagggaaacggacggtacccggtatttacgttaaacgttttcccggtaccccccagaggtacgtcgtggtcggccggtaggtgcgagcgtggtgacgagtacgaggagacgaaggaacgggtaaagggcggggacccggggtagtcgtacggtaggaacgtactcgtacgtaggtaaccgtcttcggtagtacttactagtttacgttaccgaccgtacttccggtaggtacggtcggtcggtggggtacggaccgtacggaaggtaccggtaccgggggaaccggggtaaacgggtcccggtaggggtacgggttacggggtacgggttagggggtactacggttaacggtcgggttcggtaccgttaggtacgtacgtcgtaagtatacgatacggtactacgtaccgttcgttacccgtaacgacggtaccgtaacggtcctaacggtacttccgaccgacggtaacccgngtaaccgcaacgtcgaccggtaccaccgtctacggtcgtacgtcgacggttaggcgcgtacggtacgg

SEQ ID NO: 276648 - DNA, 714 bp, Homo sapiens
  misc_feature: GYAE6OF01DCGA6.10.75.G09.1.454.CMB.1.raw
  modified_base (198)..(198): a, c, t, g, unknown or other
  misc_feature (198)..(198): n is a, c, g, or t
tcagcatagtagtgcacgaccggtgctcgattttagtatagacatcgagggggggggtctcaggaggcagcgctctcgggacgtctccaccatggcctgggctctgctattcctccaccctcctcactcagggcacaggttcctggcccagtctcgccctgtctcacgcctgcctccgtgtcgtggtctccgtggacngtcgatcaccattcctcctgactaagtagggaaagacgtaaagtcgtaacttagttttaggttttaactttttaaattttcggtcctttacgttacggtaaccaacgaagaaccgacccgaagaaaccaaaaccgaaccccctaaaaattactcttatttctcgtcttagtacgtaagttaaccgtccggtccgttacggttacgggtttctacgtcgtctttctcgtcgtcctactagtcgtacgacaaccgaccggtccctccgtcgtacctactcgtcgtcggtccgtcgacggtcgtaggacggacgaggtctagttactttacttacgctcgtacgacgtcgtacggtaccggaccgtaccgtcgtcggtagttcggggttcgggtttacgggttccgggacgggaccgtaacgtacgtccgtacggtaccgtacggtacgaccgaccggtaccgaaccgtcccgcccggttaccccgtacggtcttacccgtcccgttcccgtaaccccc

SEQ ID NO: 276649 - DNA, 797 bp, Homo sapiens
  misc_feature: GYAE6OF01D6VY1.10.75.G09.1.454.CMB.1.raw
  modified_base (247)..(247): a, c, t, g, unknown or other
  misc_feature (247)..(247): n is a, c, g, or t
  modified_base (326)..(326): a, c, t, g, unknown or other
  misc_feature (326)..(326): n is a, c, g, or t
tcagcatagtagtgcacgaccggtgctcgatttagtatagacatcagggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgtactttgtgcttataactntgtctcctggtaccagcaccaccaggacaaacgccccctaaacttcctttgttttgaggtacaggtaacgccggccctnacggactccctagacttcggttctctcgcctcaagtctggacaacgaccggtcctacccgtacgacccgttctccgtggtcctacgacggtctaggaggatcgggaaggtcgtagttaactttaaccgttaacgtcggaccgtacggtaccgactaaacgtttacgttacccggaacccgggaaccccccggttaaaagggttacgggggtttacggggttttaccggggcccggggggttaacccggggttaaaccgggtttaaacgggggttcccgggtaaacccccgggttttcccggggtacgggggtttaacccgaaccccggggttcccccggtaaacgggggtcccccgttcccccgggttaccccccccggggtttcgggttaccccccgttaacccgtttcccggtttaccccccgggttttccccccccggttaccccttccccccggttttaaacccccg

SEQ ID NO: 276650 - DNA, 612 bp, Homo sapiens
  misc_feature: GYAE6OF01CE2VZ.10.75.G09.1.454.CMB.1.raw
  modified_base (466)..(466): a, c, t, g, unknown or other
  misc_feature (466)..(466): n is a, c, g, or t
tcagcatagtagtgcacgaccggtgctcgatttagtatagacatcagggggggggtctcaggaggcagcgctctcgggacgtctccaccatggcctgggctctgctattcctcaccctcctcactcagggcacaggttcctgggcccagtctgccctgtctcagcctgcctccgtgtctgggtctcctggacagtcgatcaccatctcctgcaatggaagcgaaagtgactattggtttacttttaaattttgtcttcttggtaaccaacagacgcccagaacaaacgacccccaaaattatcatttctgctgtcagtaatccggcctcgtagggtttctagtcgtcttctctcgcctcaagtctgcaacgaccggcctcctgaactatctcgtcgggcctccgaggctgacgacggacggctagtaaatacgttacgtcgactacgtctacaattagtagtaagngttaggtcctcctttacgtttacggtaagggttttcgggacggacgggtaccgagggtacctacgggtacccgtaccgttaaggtccgacggacccgtaacggcccttcccggcccccgttacggcctaccgttcccgttaccccg

SEQ ID NO: 276651 - DNA, 855 bp, Homo sapiens
  misc_feature: GYAE6OF01CPCEB.10.75.G09.1.454.CMB.1.raw
  modified_base (262)..(262): a, c, t, g, unknown or other
  misc_feature (262)..(262): n is a, c, g, or t
tcagcatagtagtgcacgaccggtgctcgatttagtatagacatcagggtctccctcactgcccagctgggatctcagggcttcatttttctgtcctccaccatcatggggtcaaccgccatcctcgccctcctcctgactgttctccaaggtcagtcctgccgagggcttgaggtcacagaggagaacgggtggaaaggacgcccggattactaaattttcggtcccccccagaggagtctgtgccgaggtgcagctggtncagtcgaggagacaggaaggtaaaggacgggcccggggagttccgtcgtaggaagtacgttccttccgtaggtaaacgggtcccttcgtagggtactttctagtttcggtttaacgcccgtaaccttccgtggtacgttccgggtcgttcgggggttcgccggaccgaaggtacggttaccgggaaccccgggggtaaagggtccccggttaggggaacggtttacgggggtaaggttcggggggtaacttaccgtaacggtttccggttacgggtaccccggtttaagggttacgttaaccgtttacggttacggttaagttaacgttaaccgaaagtaaccgtttaaccgtttaacccggttttaccccggtttacccccgttttaacccggtaaaccggtaccccggttaaccggtttaaccccgaacccgttacgttacccgtaacccgacggaaccccggtaaaccgtaacccgtacccgtaacgttacccgaccggtaaccccgtaaccccggttacccgttacgttcccgtacggtaccggttaacgggttagggtaaccggttaacggtccccggttaaacgggg

SEQ ID NO: 276652 - DNA, 723 bp, Homo sapiens
  misc_feature: GYAE6OF01BJMCD.10.75.G09.1.454.CMB.1.raw
tcagcatagtagtgcacgaccggtgctcgatttagtatagacatcagggtctccctcactgcccagctgggatctcagggcttcattttctgtcctccaccatcatgggtcaaccgccatcctcgccctcctcctgactgttctccaaggtcagtcctgccgaggcttgagtcacagaggagaacgggtggaaaggcgcccggattactaaacgttttccggtaccccccagaggtacgtcgtgtcgaccggaggtgcgaggtcgtggtgacgaggtcgaaggagacgaaggtaagggtaaacggcggggtacccggggtatcgtacgagaacgtactccgtcgtacggtaacgccttgtcggtattcgtagtttcgttaacgccctaacgttccgtaggtacgtccgggtcgtcgggtcgcccgtacgacggtacgttaccggggaacccggggtaaacggtccggttagggtaagggtcgggtaggggttacggggtaactttccggaacggtttccgtacgggttacccgttaggtaccgtacttcgtagtaacttacggtacgaagtactaaccggttccggttaccccgttaccgttaacgaacggtcctaacggtaccctaccgttactaccgtacgaccgtaccactaacgtccaagtccgacgcccgtaccgtcttaagtccgacgtcggaaggtacggctaccgtcgtaacggg

SEQ ID NO: 276653 - DNA, 665 bp, Homo sapiens
  misc_feature: GYAE6OF01B1W6M.10.75.G09.1.454.CMB.1.raw
  modified_base (200)..(200): a, c, t, g, unknown or other
  misc_feature (200)..(200): n is a, c, g, or t
  modified_base (230)..(230): a, c, t, g, unknown or other
  misc_feature (230)..(230): n is a, c, g, or t
  modified_base (369)..(369): a, c, t, g, unknown or other
  misc_feature (369)..(369): n is a, c, g, or t
tcagcatagtagtgcacgaccggtgctcgatttagtatagacatcagggtctccctcactgcccagctgggatctcagggcttcattttctgtcctccaccatcatggggtcaaccgccatcctcgccctcctcctgactgttctccaaggtcagtcctgccgagggcttgaggtcacagaggagaacgggtggaaaggngccccggattcaaattttcggtccccccanaggagtctgtgccgaggtgcagctggtgcagtcaggagcagaggtaagacggcccggggatctctagaagtatctaccgtgtaacggcctcgtggtacttcagttgtttacgcctacgtcgtggatcggcgtggggtcncgaccaggtacgtcggaccccggggaaagtcccgtaggacggtggaacgtgggggatcgtaacgttcgtcggtaccgtaggtacgtaccgttcgtaggtacttagtaccgtaagtaacgtaccgtacggttccccgttacccttaccggaacggtcccgtagggtaccctaacccgtactcgtcgaacggtcccgaaacgtacgttacccagttacccggacgtcccgtaaccccggtcccttacgttccgtacgggtctaacgggttagggaaccgttacggcccgttaacgggg

SEQ ID NO: 276654 - DNA, 819 bp, Homo sapiens
  misc_feature: GYAE6OF01BDF75.10.75.G09.1.454.CMB.1.raw
tcagcatagtagtgcacgaccggtgctcgatttagtatagacatcaggggggggtctcaggaggcagcgctctcgggacgtctccaccatggcctgggctctgctattcctcaccctcctcactcagggcacaggttcctgggcccagtctgccctgtctcagcctgcctccgtgtctgggtctccgtggacagtcgatcaccatctcctgactaagtggaagacgaaagtgactagtttggtttacttttaaagttttgtcttcgtttacggtaacctaacgacggacgacccgaagaaccaaaaccggtacccccctaaaaatttacttaccttaacttttctacgtccttacgttacctaaggttaaaccgtccggtaccccttacggttacggggttttacttacggttccgtcttttccgtcgttcgggtaccttaccgtaacgttccgtacggtacctaaccgaccgggtccctacccttacgaccctacgtccgttccggtcgggtaccgtaccgtacggtccgtagggtacggaccggtaggtacgttagttaactttaagtttacgttcggactacgtaccttaacaacttaacgtaaaccctaaaccgaaccttaaaggttaccttttaaggtaacgtttacggtttaccgggacgggtaaccggaaccgtaaaaccgttccggtaaaccccgtttccgttacccgggtaccgtaaccggaccccggtaaacgggtccccttacccccgggtacccccgttccgggttaccctaacccgtttcccgttccccgttacccccctaccccg

SEQ ID NO: 276655 - DNA, 963 bp, Homo sapiens
  misc_feature: GYAE6OF01BYJRF.10.75.G09.1.454.CMB.1.raw
tcagcatagtagtgcacgaccggtgctcgatttagtatagacatcagggtctccctcactgcccagctgggatctcagggcttcattttctgtcctccaccatcatggggtcaaccgccatcctcgccctcctcctgactgttctccaaggtcagtcctgccgagggcttggacggtcacgaggaggaggaacgggtagggaaaggacggccccggtattactaaacgtttttccggttcccccccaagagggtacgtcgtggtcggccggtagggtgcgagtcgtgggtcgacgagtcgaacggagacgaaggaagggtaaaggaccggggccggggtagtcgtacgtagaacgtacgtccgtacggtaggtaaccggtccgtcggttaggtacgtttaccgtagtttacggtttaaccgtacccgtaccgttccggtagggtaccgttacgggtcggttaggggttcccggaccggtaccgtaaacggtaccgggttaacccgggggaaccccgggggtaaaacgggtcccggttaacgggggtacgggttaacgggggtaacggggttacggggggtaaccttacggttaccggtttaccgggttacgggttaaccccgtttaaacgggttaccgggtaacccttacgggttaaggtaaactttaccgggttaacgaaaccgggttaaaccgtttaccggttaaaccccgggttttccccgttaaccccggtttaaccggaaacccggggttacccgttaaacccgggttaaccctaacccgttaacgtttaccccggtaacccgtaaccggtaaacccccggttaacgtaaacccgggttacccaaacggttacccggaacccggttacccgaccccggtttaccttacccggttacccggtacggacccggttaagggggtaaccgtaacgggttacccggacccggttaaaccgggg

SEQ ID NO: 276656 - DNA, 674 bp, Homo sapiens
  misc_feature: GYAE6OF01EYP93.10.75.G09.1.454.CMB.1.raw
  modified_base (201)..(201): a, c, t, g, unknown or other
  misc_feature (201)..(201): n is a, c, g, or t
  modified_base (233)..(233): a, c, t, g, unknown or other
  misc_feature (233)..(233): n is a, c, g, or t
tcagcatagtagtgcacgaccggtgctcgatttagtatagacatcagggtctccctcactgcccagctgggatctcagggcttcatttttctgtcctccaccatcatggggtcaaccgccatcctcgccctcctcctgactgttctccaaggtcagtcctgccgagggcttgaggtcacagaggagaacgggtggaaaggngccccggattcaaaacttttcggtccccccanaggatctgtgccgaggtgcagctggtgcagtcaggagcaggaggtaaagcggcccggggagtctcgtagaagatctccgtggtaacggcccttcgtggtatttcagttcggtttacgccctacgtccgtggacgtcggtcgtggggtgccgccgaggacgtcggacccggggaaacggtccgtagggagtgggaggtggggattcagttcgtcggcgttagtcgacgttctacgtatacgtacaagtactaccgtacgttccccgttacccgtttaccgaaacggtacccgaacggtaccctaacccgtaactttccgaaccgtaaccggcccggtaaaccgtaaccgttacccaagtacccggaacgtcccgaaccccggtcccttaaacgttcccgtacgtaccggtacggttagggacgttacgccgggttaaacggg

SEQ ID NO: 276657 - DNA, 812 bp, Homo sapiens
  misc_feature: GYAE6OF01CJHXS.10.75.G09.1.454.CMB.1.raw
tcagcatagtagtgcacgaccggtgctcgatttagtatagacatcagggtctccctcactgcccagctgggatctcagggcttctattttctcgtcctccaccatcagtcggggtacaacccgccactccctccgcccctcctcctgacttcgttcctaccaaggtcacgtcccgtcggccggaggtcgttggacggtccaacgaggaagggaacgggaacggggtaggaaacggaccggaccccggtaagttaccgttaaaaccgttttcccggtacccccccgaaggtaacggtcgttcctgggtcggaccgggtagggtcgacgtcggcgttgggtcgtacgtacgtacggaaggagaacggaaagggtaaacgggtaaaacggggaccgggggtaccggggtagttccgtacgtagaaacgtcttccgtaccgtaggttaaccggcgttacgtacggttacttacgtagttacgttaccgcctaccgtacggtaggtaccgtcggtggtcgggtacgcccgacggtagtacgggaccgggaacccggggtaaaggtccgggtaggtagggtacggggtaacgggtcggggttaacctacgttacggttccgggtacggtaacccgttaaggtacccttacgtaacgtagtaacttaagacgtaagtacctaacgttcccgtcgtaaccgtacggacgaccgttacgaccctatccctacgcctaaccggaccaacgtacgtaccatacccggactccccgtactaccgtcgatcgggacgttacgggattaccgggcgtacggacggg

SEQ ID NO: 276658 - DNA, 817 bp, Homo sapiens
  misc_feature: GYAE6OF01B430K.10.75.G09.1.454.CMB.1.raw
  modified_base (237)..(237): a, c, t, g, unknown or other
  misc_feature (237)..(237): n is a, c, g, or t
tcagcatagtagtgcacgaccggtgctcgatttagtatagacatcagggtctccctcactgcccagctgggatctcagggcttcattttctgtcctccaccatcatggggtcaaccgccatcctcgccctcctcctgactgttctccaaggtcagtcctgccgagggcttgaggtcacgagaggaggaacgggtaggaaaggacggcccggtattactaaacttttccgtcccccanaggagtctgtcgcgaggtgcagcgtggtgacagtcgaggagcgaggaagggtaaggacgggcccggggagtcgtacgtagaagactcctacgtagtaacggtccttgtcggtattcgtagtttacgtttacgtaccacgttccgtggtacgtcgggtcggtcggggtcggccgaccgtaacggacgtaccgggggaacccgggggaaacggtcccgggtaggggtaacgggttaggggtacgggtacgggggtaacgttacgtaacggttccgggtttaacgggtacccgttaacgggttcgtaaccgtttccgtaagtaacgttaacgttccgaaacggtaacgttaacccgtacgggttacccctttaccccgtttaaaccgggaaccggtacccggtaacccgggtaccttaaccccgtacgttaccccgtaaccgacgggtaacccccgacgtaaaaccgttcccgaaacttccgaaccggtaccccgtaaccccggtcccttaacgtttacccggtaaccgtaccgggtttaacgggtaacggggtacccgttaggggttaccccgtaacggggg

SEQ ID NO: 276659 - DNA, 718 bp, Homo sapiens
  misc_feature: GYAE6OF01C0FAV.10.75.G09.1.454.CMB.1.raw
  modified_base (192)..(192): a, c, t, g, unknown or other
  misc_feature (192)..(192): n is a, c, g, or t
tcagcatagtagtgcacgaccggtgctcgatttagtatagacatcagggggggggtctcaggaggcagcgctctcgggacgtctccaccatggcctgggctctgctattcctcaccctcctcactcagggcacaggttcctgggcccagtctgccctgtctcagcctgcctccgcgtccgggtctctggacngtcagtcaccatcctcctgcacgtggaaccagcagtgtacttttgttgacttataactatcgtctctaggtaccacgccaccaccgagaccaaaccgccccctaaacttcgttttggttttacgaggtacaaggtacgccggtccctagacggtacctcccgtgtacgttccggttcctcgtccgtccctacgtaagttccgtacggaccaacgtacccggtcccttacccgtcggtacccgtcgtacggttccgggccttccggaggtcgtaggaggtacgtggacgtcgttagttaacttacgtacgtgaccgtagtcgtaacttactaccggtaccgacccgggtaaccctaaggggttacggggttcgttacgggggccggtaacgggttaaccggtacgggtccggtacccggttcgggtaccggtaccgaaccgggacccgtagggtacccgtccccggtaccccggttcgtaccctaccgtttcccgttacccttaccccccgacccttccgtaaaccc

SEQ ID NO: 276660 - DNA, 794 bp, Homo sapiens
  misc_feature: GYAE6OF01EC10B.10.75.G09.1.454.CMB.1.raw
  modified_base (336)..(336): a, c, t, g, unknown or other
  misc_feature (336)..(336): n is a, c, g, or t
tcagcatagtagtgcacgaccggtgctcgatttagtatagacatcagggtctccctcactgcccagctgggatctcagggcttcattttctgtcctccaccatcatggggtcaaccgccatcctcgcccctcctcctgactgttctccaaggtcagtcctgccgagggtcttgaggtcacaggaggagaacggggtggaaaggacgcccccggtatttacgtaaacgtttttccggttacccccccagagggacgttctggtcgccggaggtcgcgagcgtggtgcgagtcgaggagcaaggaaggtaaaggcgggccggggatcgtgtagaagtntccgtccgttaggtaacggcccgttcgtaggtactttcgtagtttgtttaaccgcccttaccgttccggtaggtacgttccgggcggttggggtcggcccggaccgtaaggtaccggtaccggggaaccccgggggtaaaacgggtcccggtagggggaacgggttagggtaacgggtacgggggtaatccgtaacgttcccggttacgggtaccgttaaggttacgtacctttcgtagttaacgttagtacgtaaacggtacgttaaccgtcggttttacccccgttaccgtttaaccgaaccgggttacccgtacggtaccctaacgtacttcccgtaacgaccggacccgtaaccgtaacgttaccctacgttccggaacctaccccaacccggtcccttacggttccgaccggtacgtagggttacggtaaccggtccggtccgtaaaccgggg

SEQ ID NO: 276661 - DNA, 653 bp, Homo sapiens
  misc_feature: GYAE6OF01A3KU9.10.75.G09.1.454.CMB.1.raw
  modified_base (411)..(411): a, c, t, g, unknown or other
  misc_feature (411)..(411): n is a, c, g, or t
tcagcatagtagtgcacgaccggtgctcgatttagtatagacatcagggtctccctcactgcccagctgggatctcagggcttcattttctgtcctccaccatcatggggtcaaccgccatcctcgcccctcctcctgactgttctccaaggtcagtcctgccgagggcttgaggtcacagaggagaacgggtggaaacggcgccccggattctaaacgttttcggtcccccccagaggagtctgtgccggaggtcgcagctggtgcagtcgaggagacgaggaaggtaaaggacgggcccggggagtctcgtagaacgtacgttcctcgttaggtaacggcccgttcgtaggtactttccgtagtttcggtttacgaccctaccgtccgtggtacgtcggtcgtgggtcnccgcgagtcgtcggaccgggaagcggtggaggtggagtgggactcgtagttccgtggtaccgttggtacgtacgtcgtagtacttactacgatacgtaccgtcgttacccgtaccttacggacgaccgtacggtaccacctagtcctacgaccgtacccgaacaccgtaccactccgacgtacccaccggtccttaccgtcgtacgtacgtacggtacggtaacgtcgggtccgtaacgggg

SEQ ID NO: 276662 - DNA, 808 bp, Homo sapiens
  misc_feature: GYAE6OF01A4ER3.10.75.G09.1.454.CMB.1.raw
tcagcatagtagtgcacgaccggtgctcgatttagtatagacatcagggtctccctcactgcccagctgggatctcagggcttcattttctgtcctccaccatcatgtggtcaaccgccatcctcgccctcctcctgactgttctccaaggtcacgtcctgccgagggtcttggaggtcacgaggaaggaggaacggggtaggaaagggacggaccccgggtattaccgtaaacgttttccggttaccccccaagagggtagttcctggtcggacccggtagggtcgccgtaggtcgtgggtcgacgtacggtacgaagggacgacgaagggtaaacgggtaaacgggacggggaccccggggtagtaccgtacgtaggaacgtacgttaccgtccgttaggtaaaccgggtcctccggttagtacttcgtagttacgtttacggtcctaccgtccggttacgggacgtccggtacgggtcgggtcgccgtccgacggtagtccgggggaacccggggtaacggcggttagggtacgggtagggtacgggtagggtacgtactagggttcgacggttacggaacgtcggttaaactcggtaagtaacgttacggtaactacggaaccgtttacgaccggggttaccctttaccggtaccgtaaccgggtccggtaaccggtcctaaccgtacttcgtacggaacggttaccgaagtacccgtacgtacgtaccggtccgaccccgttaaccgcggttaacctcggtaccggtaaggacggtttaccggggaagcggttaaaccccggg

SEQ ID NO: 276663 - DNA, 739 bp, Homo sapiens
  misc_feature: GYAE6OF01C4DH4.10.75.G09.1.454.CMB.1.raw
  modified_base (531)..(531): a, c, t, g, unknown or other
  misc_feature (531)..(531): n is a, c, g, or t
tcagcatagtagtgcacgaccggtgctcgatttagtatagacatcagggtctccctcactgcccagctgggatctcgagggctttctattttctgtcctccaccatcatggggtccaaccgccatcctcgcccctcctcctaactgttctccaaggtcagtcctgccggagggtctggaggtcacgaggagggaaggaacggggtaggaaacgggacgccccggtattacgtaaacttttcccggttaccccccccagaggtacgttcgtgtcggccggtaggtgcgagcgttgggtcgcgaggtcgagggagacgaagggaagggtaaacgggacggggacccggggtacgtcgtacgtagtaacgtactccgtccgtaggttaaccggtcctacgtggtacttactagtttagtttaccgccctaccgttccgtgggtacgtcggtcggttcggggtccgaccggccgtagggtacgtccggggaaccgggtaacgggtcggtaggggtaggtggtagggtacggggtntaccgtcgtcggtcggtacgtagtcgtagtcgtaagagtacgtagtagtactacgtaccggtttcccgtacccgtaccgaccggtaccgtacgtaccgtacctacgtaccgacgacggaccgaactaccgtaccactaccgaccgccctaacccgcttctccgacgacggtcgggtaacgtacgggacgccgggtacggtaacccggg

SEQ ID NO: 276664 - DNA, 715 bp, Homo sapiens
  misc_feature: GYAE6OF01BETW7.10.75.G09.1.454.CMB.1.raw
  modified_base (233)..(233): a, c, t, g, unknown or other
  misc_feature (233)..(233): n is a, c, g, or t
tcagcatagtagtgcacgaccggtgctcgatttagtatagacatcagggtctccctcactgcccagctgggatctcagggcttcattttctgtcctccaccatcatggggtcaaccgccatcctcgccctcctcctgactgttctccaaggtcagtcctgccgagggcttgaggtcacagaggagaacgggtggaaaggacgccccggattctaaattttcggtcccccccanaggagtctgtgccgaggtgcagctggtgcagtcaggagcaggaggtaaagcggcccgggatctctgaagatcgtcgtgtaacggccttcgtggtattcgagttcgtttacgcctacttccgtaggacgtccggcgttggggtcgccgacgaggtacgtacgggacccggggaaaggtccgtaggggtaagtcgggaggttcggggtatacgtagttcggtacggtaccgttaggttacgtactcgtagtacttaacgtactaggtaacgttaccgtaccggtttccccggttacccgtttacccgaaccggtacccgtacgggttaccctaacccgtacgttcccgtaaccgacccggaacccgtaaccgtaaaccggttaccccaagttacccgaaccggtaccccgtaaccccggtaccttaccgttccgtacgtaccgtaacgggtacgggtaacggttaccgtccggtaaacccgggg

SEQ ID NO: 276665 - DNA, 756 bp, Homo sapiens
  misc_feature: GYAE6OF01BTCR9.10.75.G09.1.454.CMB.1.raw
  modified_base (709)..(709): a, c, t, g, unknown or other
  misc_feature (709)..(709): n is a, c, g, or t
tcagcatagtagtgcacgaccggtgctcgatttagtatagacatcgagggggggggtctcaggaggcagcgctctcgggacgtctccaccatggcctgggctctgctattcctccaccctcctcactcgagggcagacggttccgtgggaccctagtccgtcggcccttgtcctcacgtcctcgtccgtccgtcgtcgttcgggtcctcgtcggactagtcgtactccaacctactcctcctagacctaaaggtacggaaacggtaacgtaaagtacggtaacttagttttacggttttaactttttaaagtttcggtacttacggttaaccggtaaaccaaagacgaaccgacccgaagtaaaaccaaaacccgtaaacccctaaaatttacgtacttaacttcgacgtctacgtaacgtaacgtaacgttcccggtacgtacggttacgggtttactacgtccgttacttcgtcggtacgactacgtaacgcgtacggacctaacgccgtacctaccgtagtaacctcttaccggtagtaccggactacggacgtacgaaggtacgggagtacgtatagttacttagtacgtacgtagtactaccgattaacaactaaaccaaataccgtattaccgtagtacgtacggtacggaacggtaaccgaacgtaactaccggtcctttacgaacggtacacgaaccggtnaccccgtaccggtctcccggtaactccgtacttcccgtaccctaccg

SEQ ID NO: 276666 - DNA, 813 bp, Homo sapiens
  misc_feature: GYAE6OF01CO9FL.10.75.G09.1.454.CMB.1.raw
tcagcatagtagtgcacgaccggtgctcgatttagtatagacatcagggtctccctcactgcccagctgggatctcagggcttcatttttctgtcctccaccatcatggggtcaaccgccatcctcgccctcctcctgactgttctccaaggtcagtcctgccgagggcttggaggtcacgaggaggaggaacgggtagggaaaggacggccccggattactaaacgtttttccggttaccccccccagaggacgttccgtggtgccggagggtgccgagcgttgggtcgacgtaggtccgaagggacgacgaagggaagggtaaaaggaccggggccccgggggtattccgtcgtaggaagtactccgtaccggttaggtaacggcccttcgttagggtaacttttcgtaagttttacggtttaacgaccccttacgtacccggttgggtaacgtcgggtccggttaggggtcgccggtaaccgagtaaccggtaccggggaacccggggtaaacggtcccggttaggggacggttacggggtagggtacgggggtcttacggtacggttaccgtcgggtaacccttagggtacgtacttacggtagtaatagtaaccgtaagacgttaacccgtacggttaccccgttccgttaaccggaaccgggtacccgaacggttacccacgttacctccgtaaccgccggtaaccaacgtaacgcccaagttcccgaccggtacccgaacccgttccctaagttcccgacggtaaccggtacgggtagggtaccgtaccgggtcgtaaacccgggg

SEQ ID NO: 276667 - DNA, 675 bp, Homo sapiens
  misc_feature: GYAE6OF01B3YGF.10.75.G09.1.454.CMB.1.raw
  modified_base (236)..(236): a, c, t, g, unknown or other
  misc_feature (236)..(236): n is a, c, g, or t
  modified_base (591)..(591): a, c, t, g, unknown or other
  misc_feature (591)..(591): n is a, c, g, or t
tcagcatagtagtgcacgaccggtgctcgatttagtatagacatcagggtctccctcactgcccagctgggatctcagggcttcattttctgtcctccaccatcatggggtcaaccgccatcctcgccctcctcctgacctgttctccaaggtcagtcctgccggagggcttgaggtcacagaggagaacgggtaggaaaggagccccggatttactaaattttcggtccccccanaggatctgtcgccggtaggtgcagcgtggtcgcagtcgaggagcgaaggaaggtaaaggacggcccgggggagttccgtacgtaggaagtctcgtaccgtgtaacggccctcgtaggtattaccgtattagtttacgccgtactaccgtggtacgtcggtcgtggggtcgccggtacccgagacggttacgggacccggggtaaacggccggttagggacgggtgggtacgggttaggggactacggtacttcgtcgggacccttaggtacgtacttcggtacgtaatacgtagaagtaagtccgtaaccgttcctacccgtttacggaaaccggtccgtaaccggacctaaccncttaccgccaacgaccgaacgtaccgtactacgacaccgtcacccgccttatccgtgccgtagtaggacgttcggtcgaacggg

SEQ ID NO: 276668 - DNA, 783 bp, Homo sapiens
  misc_feature: GYAE6OF01CYVNA.10.75.G09.1.454.CMB.1.raw
  modified_base (432)..(432): a, c, t, g, unknown or other
  misc_feature (432)..(432): n is a, c, g, or t
tcagcatagtagtgcacgaccggtgctcgatttagtatagacatcagggtctccctcactgcccagctgggatctcgagggctttctatttttctcgtcctcccaccatcagtggggtaccaaccgccatccctcgccctcctcctgacttgttcctccgaaggtcacgtcctcggccggagggtcttaggacggtcaacgaggaggaaggaacgggtaggaaacggacgcccggtaattacgtaacgttttcccggtacccccaggtacggtacgttctggtcgaccggaggtcgcgaggtcgttggtcgagtacggtcgaaggtacgaaggaaagggtaagggtaaacgggacggggtacccgggtgtacgtacgaggtaacgtctaccgtcgtacggtacgtccgtgtacgttatacgttattcgtacnccgtacgttccggtagcgtcgggtacgtgggtacacgacggagtacggtaccgggaacccggggagttaaccgggtgggtaagggtaggggtacggtacgggtacgtacggtacggttcggtacggttaccggttagtacgtacttacggtaacgtagtaacgtaactaaccgtttaaccgtacggttaccccggttaaccggttacccgtaaccggtaaccgtaccggtaacccgtaccgtaaccgtacctacgaaccgtaccgtacccgtacgtaccgtacaccgtcgaccgttacccgacgtactacgtcgacggtaacggtcgaaggtaacggcgtacggtaaccgg

SEQ ID NO: 276669 - DNA, 796 bp, Homo sapiens
  misc_feature: GYAE6OF01DC4L9.10.75.G09.1.454.CMB.1.raw
  modified_base (164)..(164): a, c, t, g, unknown or other
  misc_feature (164)..(164): n is a, c, g, or t
  modified_base (206)..(206): a, c, t, g, unknown or other
  misc_feature (206)..(206): n is a, c, g, or t
  modified_base (212)..(212): a, c, t, g, unknown or other
  misc_feature (212)..(212): n is a, c, g, or t
tcagcatagtagtgcacgaccggtgctcgatttagtatagacatcgagggggggggtctcaggaggcagcgctctcgggacgtctccacatggcctgggctctgctattcctcaccctcctcactcagggcacacggttcctgggcccagtctgccctgtctcngcctgcctccgtgtctgggtctccgtggacagtcgatcactntcctcngcacgtcggctaccggcagtcgactagtaggtctacttaataactatcgttccgtccgtagtaaccaaccaacaccgacgccgacggccccagactcatctattgtagtgttactcgtaagtcgtacggtccggttaccggtttaggtactttacgtaactcgttcttctcgttcgtacctaccgtaagttcgacggtaccaacggtaccgttacccgttcccgtaacgtaccctaccgtccggttacccggtacctaccgtaccggtcggttaacgggaaacgggtcccggtacgtaccgttaaacgtttacgttaaccgttaacgtcgttaacgtacgttaccgttaaacgtaaacgtttaacccggttaacccgtaaacccggggttaccgggtacccttaccgtttacccgggttaacgttaaccggtttaacggttaccggggtttaccgggggacccgggggttaaacggggtaccccggttcgggtaaacccggttaaccccggtacccggtttaacccggtaccgtaacccggtaaccgggaaaccccggttaacgggtccccgttacccccgggg

SEQ ID NO: 276670 - DNA, 948 bp, Homo sapiens
  misc_feature: GYAE6OF01E4T3T.10.75.G09.1.454.CMB.1.raw
  modified_base (916)..(916): a, c, t, g, unknown or other
  misc_feature (916)..(916): n is a, c, g, or t
tcagcatagtagtgcacgaccggtgctcgatttagtatagacatcgagggggggtctcaggaggcagcgctctcgggacgtctccaccatggcctggctctgctattcctcaccctcctcactcgagggcactacggttccgtcgggcccagtctgccctgtctcacgcctcgtccctccggtgtcgtcgggtcctaccgtcggactacggtcgaacttaccaaccctagttcccttaccgtacgaaccgtaaggtacgggaaggaaccggaaaaggttaccgtaacgttagtttttacggtttttaacgttttttaaactttttcgttaccgtttactacgggttaaaccccaacgtaacggtaccgaaccccgaaacgtaaacccgtaaacccggtaaacccccttaaaacgtttaattacccgttacttttaccggtacggttacccttacggtttaacctaaacggtttaaacccggtcccccggtaacccggttaccgggtttacggggttttacgtttaccgggttccgtttaccgttaccgttccgttaccgggtaaccctttaccggtaacgttcggtaaacccggaccgtaaacccgggttaccccgtcccccgtacccgttacgaaacccttacgtttacccgttcgggttacccggtcgttaccgggcgtacgtacgggaacggtacggtacgtacgttgtttaacttaacgttctacggtacgtacgtactacttaacgtaacctaaaaccgaacttaaccgtaagtttccgttaagggtaacgtttaccgggaccgggaacgggttaaacccggaaccgttaacccgtaccggttaccccgttaccgtaccggtaccgacccggtacgtaaccgtcccgtacccccgtacccgttacccgggnttaccccgttccgtcccgtcccccgttacccg

SEQ ID NO: 276671 - DNA, 558 bp, Homo sapiens
  misc_feature: GYAE6OF02H7NIZ.10.75.G09.1.454.CMB.1.raw
  modified_base (230)..(230): a, c, t, g, unknown or other
  misc_feature (230)..(230): n is a, c, g, or t
  modified_base (533)..(533): a, c, t, g, unknown or other
  misc_feature (533)..(533): n is a, c, g, or t
tcagcatagtagtgcacgaccggtgctcgatttagtatagacatcagggtctccctcactgcccagctgggatctcagggcttcattttctgtcctccaccatcatggggtcaaccgccatcctcgccctcctcctgactgttctccaaggtcagtcctgccgagggcttgaggtcacagaggagaacgggtggaaaggagccccggattcaaattttggttccccccanaggagtctgtgccgaggtgcagctggtgcagtcaggagcaggaaggtaaagagggcccggggagtctcgtagaagatctccgtggtaacggcctcgtggattcatgtttacgcctactccgtggatcggcgttggggtgccgccgagacgtcgggaccccggggaaaggcccgtaggggacgtgggagtggggatcgatcgtggcctagtgactcgtgatatcagatactacgtccgtccttacgtaacggcctaggtccaccatcctcacgaccgacacgtccatcgacgccaccgccttanctcgcaggtggacgtacgcgtacgg

SEQ ID NO: 276672 - DNA, 515 bp, Homo sapiens
  misc_feature: GYAE6OF02IJ14M.10.75.G09.1.454.CMB.1.raw
  modified_base (230)..(230): a, c, t, g, unknown or other
  misc_feature (230)..(230): n is a, c, g, or t
  modified_base (357)..(357): a, c, t, g, unknown or other
  misc_feature (357)..(357): n is a, c, g, or t
tcagcatagtagtgcacgaccggtgctcgatttagtatagacatcagggtctccctcactgcccagctgggatctcagggcttcattttctgtcctccaccatcatggggtcaaccgccatcctcgccctcctcctgactgttctccaaggtcagtcctgccgagggcttgaggtcacagaggagaacgggtggaaaggagccccggattcaaattttcggtccccccanaggagtctgtgccgaggtgcagctggtgcagtcaggagcagaggtaaaggaggcccggggagtctctgaagatctcctgtaacggcctctggattcattgtttagccactcctggatcggctgggtncgcagatgcccgggaaagcctgggagtgggatggggatcgatcgtggcctagtgactctgatatcagatacagtcctccttcaaggccaggtcacctatcctcacgccacgacgtccatcgagccaccgcctatctgcgaggtggacgtagccgtagg

SEQ ID NO: 276673 - DNA, 514 bp, Homo sapiens
  misc_feature: GYAE6OF02HVM7Y.10.75.G09.1.454.CMB.1.raw
tcagcatagtagtgcacgaccggtgctcgatttagtatagacatcaggggggggtctcaggaggcagcgctctcgggacgtctccaccatggcctgggctctgctattcctcaccctcctcactcagggcacaggttcctgggcccagtctgccctgtctcagcctgcctccgtgtctgggtctcctggacagtcgatcaccatctcctgcaatggaagcgaaagtgacattggttctttaaattttgtctcttggtaccaacagagcccagacaaagcccccaaaattatcatttctgctgtcagtaatcggccctcaggggtttctagtcgcttctctggctccaagtctggcaacacggcctccctgaccatctctgggctccaggctgaggacgaggctgattattattgcagctcatatacaaacaccaaagctttgatattcggcggaggaccaactgaccgtcttcgcagcccaaggctgcccctcggtccactctcgtccctaccc

SEQ ID NO: 276674 - DNA, 535 bp, Homo sapiens
  misc_feature: GYAE6OF02GBGCZ.10.75.G09.1.454.CMB.1.raw
tcagcatagtagtgcacgaccggtgctcgatttagtatagacatcaggggggggtctcaggaggcagcgctctcgggacgtctccaccatggcctgggctctgctattcctcaccctcctcactcagggcacaggttcctgggcccagtctgccctgtctcagcctgcctccgtgtctgggtctcctggacagtcgatcaccatctcctgcaatggaagcgaaagtgacattggttctttaaattttgtctcttggtaccaacagagcccagacaaagcccccaaaattatcatttctgctgtcagtaatcggccctcagggtttctagtcgcttctctggctccaagtctggcaacacggcctccctgacccatctctgggctccagactgaggacgaggctgattattactgcagctcacatacaagcggcagcggttgggtgttcgggcgggggaccacgacgtgaccgtccgtaggtcacggcccgaaggcctcgccccctcggtccaccgtcgttccgttccccgtcccc

SEQ ID NO: 276675 - DNA, 518 bp, Homo sapiens
  misc_feature: GYAE6OF02GEOZD.10.75.G09.1.454.CMB.1.raw
  modified_base (285)..(285): a, c, t, g, unknown or other
  misc_feature (285)..(285): n is a, c, g, or t
  modified_base (298)..(298): a, c, t, g, unknown or other
  misc_feature (298)..(298): n is a, c, g, or t
  modified_base (318)..(318): a, c, t, g, unknown or other
  misc_feature (318)..(318): n is a, c, g, or t
tcagcatagtagtgcacgaccggtgctcgatttagtatagacatcaggggggggtctcaggaggcagcgctctcgggacgtctccaccatggcctgggctctgctattcctcaccctcctcactcagggcacaggttcctgggcccagtctgccctgtctcagcctgcctccgtgtctgggtctcctggacagtcggtcaccatctcctgcactggacccagcactgatgttgggcattataaccttgtctcctggtatcaacaacgcccagacaaagcccccanactcttgatttangaagtcagtaagcggccctnaggggtttctagtcgcttctctgcctcaagtctggcaacacggcctcctgacaatctctggctcagctgacgacgagctgaatattactgcagctcatatgtagatggtgtccttctttctaacggttttcggcggtaggtaccaggtctcggaccgtccgtaagtcgagcccgaaggccgtcgcccctcggtcctaccg

SEQ ID NO: 276676 - DNA, 546 bp, Homo sapiens
  misc_feature: GYAE6OF02I01IE.10.75.G09.1.454.CMB.1.raw
tcagcatagtagtgcacgaccggtgctcgatttagtatagacatcaggggggggtctcaggaggcagcgctctcgggacgtctccaccatggcctgggctctgctattcctcaccctcctcactcagggcacaggttcctgggcccagtctgccctgtctcagcctgcctccgtgtctgggtctcctggacagtcgatcaccatctcctgcaatggaagcgaaagtgacattggttctttaaattttgtcttcttggtaccaacagagcccaagaacaaacgacccccaaaattatacatttctgctgtcagtatcggcctcgtagggttctagtcgtcttctctggctcaagtctggcaacacgcctcctgaccatctcgtcgggcctcgacggctggacggacggagctagtatttattatgcagtctacatactaacaaacacaaagtctttagattagttcggacggaggaaccaacgtcgaccgttcttacgcacgccgaaggcctccgcccctcggtcctacgtcctcgttccccgtccc

SEQ ID NO: 276677 - DNA, 626 bp, Homo sapiens
  misc_feature: GYAE6OF02I7P3J.10.75.G09.1.454.CMB.1.raw
  modified_base (232)..(232): a, c, t, g, unknown or other
  misc_feature (232)..(232): n is a, c, g, or t
tcagcatagtagtgcacgaccggtgctcgatttagtatagacatcagggtctccctcactgcccagctgggatctcagggcttcattttctgtcctccaccatcatggggtcaaccgccatcctcgccctcctcctgactgttctccaaggtcagtcctgccgagggcttgaggtcacagaggagaacgggtggaaaggagccccggattcaaattttcggttcccccccanaggagtctgtgccgaggtgcagctggtgcagtcaggagcaggaggtaaagacgggcccggggagtctcgtagaagtatcctccgtggtaacggcccttcgtggtactttcattgtttacgcctactccgtggactcggcgttggggtcgccgccgaagtacgtcgggacccggggaaaggcccgtagggacggtgggagtggggatcgagtcgtcggtcctagtcgacttcgtagtatatacgagactacgacgtccgtaccgttaccgaacggtaccgacggtccaccgtacttccgacgacgacccgactaacgtaccacgtacgacgaccctaccgtacccttactccgttacgaccgtaggttcgggtaacgttacggtcccgtaacggg

SEQ ID NO: 276678 - DNA, 563 bp, Homo sapiens
  misc_feature: GYAE6OF02F7XKZ.10.75.G09.1.454.CMB.1.raw
  modified_base (232)..(232): a, c, t, g, unknown or other
  misc_feature (232)..(232): n is a, c, g, or t
tcagcatagtagtgcacgaccggtgctcgatttagtatagacatcagggtctccctcactgcccagctgggatctcagggcttcattttctgtcctccaccatcatggggtcaaccgccatcctcgccctcctcctgactgttctccaaggtcagtcctgccgagggcttgaggtcacagaggagaacgggtggaaaggcgccccggattcaaattttcggttcccccccanaggagtctgtgccgaggtgcagcgtggtgcagtcaggagcagaggtaaagaggcccggggagtctctgaagatctcctgtaaggcctcgtggattcattgtttagccactcctggatcggctgggtgccgccagagtcggacccgggaaggccgtgggagtggagtggggatcgagtcgtggccgttagtcgtacgtcgtgattatacgagtatacgcgttcccgtccttaccgacggcctaggtaccaccactctccacgcccgaactacgtccatccgaacgccacccgtcctactcgtacgccgtagtggtacgtacggaccgtacgg

SEQ ID NO: 276679 - DNA, 693 bp, Homo sapiens
  misc_feature: GYAE6OF02FJEN3.10.75.G09.1.454.CMB.1.raw
  modified_base (231)..(231): a, c, t, g, unknown or other
  misc_feature (231)..(231): n is a, c, g, or t
  modified_base (268)..(268): a, c, t, g, unknown or other
  misc_feature (268)..(268): n is a, c, g, or t
tcagcatagtagtgcacgaccggtgctcgatttagtatagacatcagggtctccctcactgcccagctgggatctcagggcttcattttctgtcctccaccatcatggggtcaaccgccatcctcgccctcctcctgactgttctccaaggtcagtcctgccgagggcttgaggtcacagaggagaacgggtggaaaggacgccccggattcaaattttcggtccccccanaggagtctgtgccgaggtgcagctggtgcagtcaggngcgagaggtaaagcgggcccggggatctctagagatctcgtgtaaggcctcgtggattcgagttgtttacgccctactccgtggtactcggcgttggggtcgccgccgagtacgtcggaacccggggaaaggtccgtaggggaggtcgggaggtacggggtatcgtagttcgtcggtacccgttaggtcgtacttcgtaggtacttacgtacgaagtaacttaaccgtaccgtttaccccgttacccgttaacccgtaaccgggacccgttaaccgggttacccaacccgttacgttccctaaccggaccggtacccgtaaaccgtaaccgtacccacgtaccgtaacgacccgtaccccggtccttaccgttccgtacggtaccgtagggttacggtacggttacccggacccgttaaccgggg

SEQ ID NO: 276680 - DNA, 570 bp, Homo sapiens
  misc_feature: GYAE6OF02F0PEA.10.75.G09.1.454.CMB.1.raw
  modified_base (418)..(418): a, c, t, g, unknown or other
  misc_feature (418)..(418): n is a, c, g, or t
tcagcatagtagtgcacgaccggtgctcgatttagtatagacatcaggggggggtctcaggaggcagcgctctcgggacgtctccaccatggcctgggctctgctattcctcaccctcctcactcagggcacaggttcctgggcccagtctgccctgtctcagcctgcctccgtgtctgggtctcctggacagtcgatcaccatctcctgcaatggaagcgaaagtgacattggttactttaaattttgtctcttggtaccaacagagcccagacaaacgcccccaaaattatacatttctgctgtcagtaatcggcctcagggtttctagtcgtcttctctggctccaagtctgcaacacggcctccctgaccatcctctgggtcctccgaggctggacggacgaggctgtattatnttgcagctacatataaccaaacaaccaaagtctttagattacgtcggacggaacggaaccaaacgtcgtacccgtcgttacggcaacgcccgaaacggcctaccggcccccgttcggtaccctaccgtccgttcccgttccccgtacccccg

SEQ ID NO: 276681 - DNA, 609 bp, Homo sapiens
  misc_feature: GYAE6OF02IUHL0.10.75.G09.1.454.CMB.1.raw
  modified_base (232)..(232): a, c, t, g, unknown or other
  misc_feature (232)..(232): n is a, c, g, or t
tcagcatagtagtgcacgaccggtgctcgatttagtatagacatcagggtctccctcactgcccagctgggatctcagggcttcattttctgtcctccaccatcatggggtcaaccgccatcctcgccctcctcctgactgttctccaaggtcagtcctgccgagggcttgaggtcacagaggagaacgggtggaaaggagccccggattcaaattttcggttcccccccanaggagtctgtgccgaggtgcagctggtgcagtcaggagcaaggaaggtaaagacgggccccggggatctcgtagaagatctccgtaggtaacggccttgtggtattcattgtttacgcctactccgtggactcggcgtgggtcgccgaccgagacgtcggacccgggaaagccgtagggagtgggagtggggactcgagtcgtcggcctagtcgtacttcgtagattatcgtagtactacgacgttcccgtaccgttacgaacggtacctacggtaccaaccgtactcctacgacgaccgaacctaacgtaccacgtaccgacgacccaccgtcctacgtccgtacgcgtacggttaggaacgttacgaccgtacgg

SEQ ID NO: 276682 - DNA, 532 bp, Homo sapiens
  misc_feature: GYAE6OF02JGSOI.10.75.G09.1.454.CMB.1.raw
  modified_base (229)..(229): a, c, t, g, unknown or other
  misc_feature (229)..(229): n is a, c, g, or t
  modified_base (445)..(445): a, c, t, g, unknown or other
  misc_feature (445)..(445): n is a, c, g, or t
tcagcatagtagtgcacgaccggtgctcgatttagtatagacatcagggtctccctcactgcccagctgggatctcagggcttcattttctgtcctccaccatcatggggtcaaccgccatcctcgccctcctcctgactgttctccaaggtcagtcctgccgagggcttgaggtcacagaggagaacgggtggaaaggagccccggattcaaattttggtccccccanaggagtctgtgccgaggtgcagctggtgcagtcaggagcagaggtaaagaggcccggggagtctctgaagatctcctgtaaggcctctggattcattgtttagccactcctggatcggctggggtgcgccagagtcggaccccggggaaaggcccgttagggacggttgggagtgggggatcgatcgtggcctaggtgactctgatatcagatacngtccgtccttccgaggccaggtcaccatctcacgccgacaacgtcatcgacgccaccgcctatctcgcaggtggacgtacgcgtagg

SEQ ID NO: 276683 - DNA, 600 bp, Homo sapiens
  misc_feature: GYAE6OF02GKJY5.10.75.G09.1.454.CMB.1.raw
  modified_base (230)..(230): a, c, t, g, unknown or other
  misc_feature (230)..(230): n is a, c, g, or t
tcagcatagtagtgcacgaccggtgctcgatttagtatagacatcagggtctccctcactgcccagctgggatctcagggcttcattttctgtcctccaccatcatggggtcaaccgccatcctcgccctcctcctgactgttctccaaggtcagtcctgccgagggcttgaggtcacagaggagaacgggtggaaaggagccccggattcaaattttcggtccccccanaggagtctgtgccgaggtgcagctggtgcagtcaggagcaggaggtaaagacgggcccggggagtctcgtagaagtatctccgtaggtaacggtccctcgtggtatttccaagttgtttacgcctactccgtggactcggcgtggggtcgcgaccgagacgtcggacccgggaaagccgtagggagtcggagtggggatcgtatcgtcggtccgtagtgtacgtctagactagtcagtactacgtacgtccgtaccttaccgaacggtaccgtacggtacctacccgtacttcctacgacgaccgaacgtaccgtccataccgagaccacccgtactactcgtcgacgtaggtcggacgtacgcgtacgg

SEQ ID NO: 276684 - DNA, 670 bp, Homo sapiens
  misc_feature: GYAE6OF02JQBNN.10.75.G09.1.454.CMB.1.raw
  modified_base (284)..(284): a, c, t, g, unknown or other
  misc_feature (284)..(284): n is a, c, g, or t
  modified_base (391)..(391): a, c, t, g, unknown or other
  misc_feature (391)..(391): n is a, c, g, or t
tcagcatagtagtgcacgaccggtgctcgattttagtatagacatcagggtctccctcactgcccagctgggatctcagggcttcattttctgtcctccaccatcatgggtcaaccgccatcctcgccctcctccctgacctgttctccaaggtcagtcctgccgagggcttgaggtcacagaggagaacgggtggaaaggacgccccggattacaaagtttcggttcccccccacgaggacgtctgtggccgtaggtcgcgagtcgtggtgcaggtcgaaggngacaggaaggtaaacggacgggcccggggaagtcgtcgtaggaagtactcgtccgtaggtaacggcctcgtaggattcaagttgttagcctactccgtaggcgtcgnggtcgggtgaccgcgagtacgtcgggaaccccgggtaaaggcccggtagggacggtggggtacgtacgggggtatacgtacgtcggtacggtccgtaaggtcggtacgtacgtacggattacgtcgaagtacgtactacgtccgtccttaacgacgacctacggtaccaccactctaccgacgtaaccgaaccgtacgtcctacgaccgtaacgtccctacccggtaacctctaccgtacgtacccgtagggtacggtaacggtccgaccggttaacgg

SEQ ID NO: 276685 - DNA, 703 bp, Homo sapiens
  misc_feature: GYAE6OF02F0O99.10.75.G09.1.454.CMB.1.raw
  modified_base (193)..(193): a, c, t, g, unknown or other
  misc_feature (193)..(193): n is a, c, g, or t
  modified_base (228)..(228): a, c, t, g, unknown or other
  misc_feature (228)..(228): n is a, c, g, or t
  modified_base (314)..(314): a, c, t, g, unknown or other
  misc_feature (314)..(314): n is a, c, g, or t
  modified_base (403)..(403): a, c, t, g, unknown or other
  misc_feature (403)..(403): n is a, c, g, or t
tcagcatagtagtgcacgaccggtgctcgatttagtatagacatcagggggggggtctcaggaggcagcgctctcgggacgtctccaccatggcctgggctctgctattcctcaccctcctcactcagggcacaggttcctgggcccagtctgccctgactcagcctccctccgcgtccgggtctcctggacngtcagtcaccatctcctgcactggaaccagcagtnactttgtgcttaataactatgtctcctcgtaccagcaccaccaggacaaacgccccaactccttgtttgaggtcagtacgcgcctnaggctcctgactcggttctctcgcctcctaagtcgtggaccaaccgacggtccctccgtacgtacccgttcctccgtcgggcctaccgnggtcgtggaggtatggacggtctagtaactttaccgtacgtcgacgtaacgcacctaacttacgtttaccgaaccggtaaccccgtaacggtacggggtttccgtttacggggccggggtaaccggggtaacgtttaaaccgggtccgggtaacccggttcccggttacggggttaccaacgggtaacccccgtaagggtacccgttccccgggtacccccccgtttcgggtacccttaacccgttccgtttaccccggttacccccctaacccccgtttcccgtaccccgttaaccccg

SEQ ID NO: 276686 - DNA, 581 bp, Homo sapiens
  misc_feature: GYAE6OF02GZ0LW.10.75.G09.1.454.CMB.1.raw
  modified_base (231)..(231): a, c, t, g, unknown or other
  misc_feature (231)..(231): n is a, c, g, or t
tcagcatagtagtgcacgaccggtgctcgatttagtatagacatcagggtctccctcactgcccagctgggatctcagggcttcattttctgtcctccaccatcatggggtcaaccgccatcctcgccctcctcctgactgttctccaaggtcagtcctgccgagggcttgaggtcacagaggagaacgggtggaaaggagccccggattcaaattttcggtcccccccanaggagtctgtgccgaggtgcagctggtgcagtcaggagcagaggtaaagaggcccggggagtctctgaagatctccgtgtaacggcctctggattcattgtttagccactccgtggatcggctggggtgcgccagatcggacccgggaaaggcctagggagtggagtggggatcatcgtcggaccgtaggtcgactcgtagtattagtcgaagtactacgacgttcccgtccttaccgaacgggcctacggtccaccgtactccgtaccgacgcccgactaacgtccatccgagacccaccgtccttacgttccgtacgccgtacggtagggtacgtacgccgtaacggg

SEQ ID NO: 276687 - DNA, 555 bp, Homo sapiens
  misc_feature: GYAE6OF02FI877.10.75.G09.1.454.CMB.1.raw
  modified_base (232)..(232): a, c, t, g, unknown or other
  misc_feature (232)..(232): n is a, c, g, or t
  modified_base (282)..(282): a, c, t, g, unknown or other
  misc_feature (282)..(282): n is a, c, g, or t
tcagcatagtagtgcacgaccggtgctcgatttagtatagacatcagggtctccctcactgcccagctgggatctcagggcttcattttctgtcctccaccatcatggggtcaaccgccatcctcgccctcctcctgactgttctccaaggtcagtcctgccgagggcttgaggtcacagaggagaacgggtggaaaggagccccggattcaaattttcggttcccccccanaggagtctgtgccgaggtgcagctggtgcagtcaggagcagaggtaaagnggcccggggagtctctgaagatctcctgtaaggcctctggattcatgtttagcctactcctggatcggctggggtgcgccagatcggcccgggaaagcctgggagtggagtggggatcgatcgtggcctaggtgactctgatagtcaagactacacgtccgtacctttaccgaagggcccgacggtccaccgtacttcctcacgtccgaacaacgtcccaatccgaagccacccggccttactcgtcgctacggtgggacgtacgccgtacgg

SEQ ID NO: 276688 - DNA, 680 bp, Homo sapiens
  misc_feature: GYAE6OF02JG8O5.10.75.G09.1.454.CMB.1.raw
  modified_base (270)..(270): a, c, t, g, unknown or other
  misc_feature (270)..(270): n is a, c, g, or t
tcagcatagtagtgcacgaccggtgctcgatttagtatagacatcagggtctccctcactgcccagctgggatctcagggcttcattttctgtcctccaccatcatgggtcaaccgccatcctcgccctcctcctgactgttctccaaggtcagtcctgccgaggcttgaggtcacagaggagaacgggtggaaaggagccccggattcaaagttttcggttccccccacaggagtctgtgccgaggtgcagcgtggtgcagtcgacggngcagaggtaaagacgggcccggggatctacgagaagacttccgtccgtaggtaacggccttcgtgggtaactttcgaagtttgtttaacgcctaacttccgtggacgtccggtcgtaggggttcgaccgtccgaagtacgtaccgggacccgggggtaaaagtcccgtagggtacggttgggaacgttggggtactacgtagtcgtcggtaccgtaggtagtacttcgtacgtagtacttacgaacgtacttaaccgtcgttacccgtccgttaaccgaacggtccgtacggtacctaaccgtcttaccgtacgaccgtaccgtaactaccgtccgtaactaccgtaccggaccctaccgacccttattccgtacgtacgtacggtacggtacggtacgtcccgtaacgg

SEQ ID NO: 276689 - DNA, 644 bp, Homo sapiens
  misc_feature: GYAE6OF02HKZ80.10.75.G09.1.454.CMB.1.raw
  modified_base (231)..(231): a, c, t, g, unknown or other
  misc_feature (231)..(231): n is a, c, g, or t
  modified_base (381)..(381): a, c, t, g, unknown or other
  misc_feature (381)..(381): n is a, c, g, or t
tcagcatagtagtgcacgaccggtgctcgatttagtatagacatcagggtctccctcactgcccagctgggatctcagggcttcattttctgtcctccaccatcatggggtcaaccgccatcctcgccctcctcctgactgttctccaaggtcagtcctgccgagggcttgaggtcacagaggagaacgggtggaaaggcgccccggattcaaattttcggttccccccanaggagtctgtgccgaggtgcagctggtgcagtcaggagcaggaggtaaagacggcccggggagtctcgtgaagatctcctaggtaacggcctcgtggtattcagttgtttagccctacttccgtggactcggcgttgggtgccgccgagngtcggacccggggaaaggcccgtagggacgtgggagtggggatcgagtcgtcggccgttaagtcgtacttcgtagtattacttacgagtaacttaaccgtacgttccccgttaccctttaccgaaccgggtccgtaacgggtacccaaccgtacttcctaccgaccgacccgaacgtaaccgtcccaacgttccgaaccgaccgtaacccgtccgttacgtccgtacgccgtaaggtcgggtacgtacggtcccgttaacggg

SEQ ID NO: 276690 - DNA, 857 bp, Homo sapiens
  misc_feature: GYAE6OF02IQUJS.10.75.G09.1.454.CMB.1.raw
  modified_base (265)..(265): a, c, t, g, unknown or other
  misc_feature (265)..(265): n is a, c, g, or t
tcagcatagtagtgcacgaccggtgctcgatttagtatagacatcagggtctccctcactgcccagctgggatctcagggcttcattttctgtcctccaccatcatgggtcaaccgccatcctcgccctcctcctgactgttctccaaggtcagtcctgccgagggcttgaggtcacagaggagaacgggtggaaaggacgcccggattcgaaattttcggtccccccagaggtagtctgtgccggaggtgccagtcgtggtcgngacgtcgaaggagcgaaggaggtaaaggacgggcccgggggaagtcgtcgtaggaaagcgtacgtccgtaggtaacggtcccgtgttagggatttcgtaagttcggtttaacgccctacgttaccgtgggtaacgtccgggtcgtcgggggttcggaccggtacccgtaaggtaacggttccgggaaccccggggtaaaaggggtccccgttaggggtaccgggtagggtacgggttacgggggtaacgttccgtaaaggttccggtttacgggaccccggtttaaggttacggggtaacccttcgggttaacgggtaaacgtttaacggtaccgttaaacggtaacggtttaacccgtaacgggtttccccggtttacccgttaacccggtaaacgggttcccggtaaacgggtacccgtaaccgtaccgttccgttaaccggaccgaacccggtaaccgttaaccggtacccgtaaaccgtttccgaaaccgggtcccctaaacccgggttccccgttaaaccgttcgttaaccgggtcccggtaaaggttccgggtaaacggtttcccgggtaacccggttaaccgggg

SEQ ID NO: 276691 - DNA, 670 bp, Homo sapiens
  misc_feature: GYAE6OF02I432S.10.75.G09.1.454.CMB.1.raw
  modified_base (259)..(259): a, c, t, g, unknown or other
  misc_feature (259)..(259): n is a, c, g, or t
tcagcatagtagtgcacgaccggtgctcgatttagtatagacatcagggtctccctcactgcccagctgggatctcagggcttcattttctgtcctccaccatcatgggtcaaccgccatcctcgccctcctcctgactgttctccaaggtcagtcctgccgagggcttgaggtcacagaggagaacgggtggaaaggacgccccggattcaaattttcggtccccccagaggagtctgtgccgaggtgcagcgtggtncagtcgaggcgcaggaggtaaagacgggcccggggatcgtcgtagaagactccgtccgtaggtaacggtccctcgtaggtacttccgtaagtttcggttttaacgcctaaccgttccgtaggtacgtcggtcgttaggggtcgccgaccgtaggtacgtcgggaacccggggaagccgtagggtagtgggagtggggactcgagtcgtacggtcttaggtcgtaccttacgtgtaacttagacgtaagtacgttaaccgtacgtttccccgttacccttacccgaacggtcccgtaaccggtaccaaccgtacttcccgttacgacccggtaccgaacgtacgtacccagtaccgaccgtaccgacccgtaccttcttcgacgcgtaggtacggtacgtaccgcgtaacgg

SEQ ID NO: 276692 - DNA, 637 bp, Homo sapiens
  misc_feature: GYAE6OF02FO3R3.10.75.G09.1.454.CMB.1.raw
  modified_base (231)..(231): a, c, t, g, unknown or other
  misc_feature (231)..(231): n is a, c, g, or t
tcagcatagtagtgcacgaccggtgctcgatttagtatagacatcagggtctccctcactgcccagctgggatctcagggcttcattttctgtcctccaccatcatggggtcaaccgccatcctcgccctcctcctgactgttctccaaggtcagtcctgccgagggcttgaggtcacagaggagaacgggtggaaaggagccccggattcaaattttcggtcccccccanaggagtctgtgccgaggtgcagcgtggtgcagtcaggagcagaaggtaaagacgggcccggggagtctctggaagactcgtccgtgtaacggcccttcgtggattcagttcgtttagcctactccgtggatcggcgtggggtgcgtccagacgtcggacccgggaaagccgtagggagtgggagtgggatcgagtcgtcggtcctagtcgacttcgtagtatacgtacagtactaacgtacgttcccgttacccttaccgaacggtacccgtacggtacccaacccgtacttacccaccgtaacggtacccgaacgtaacgttaccaacgtccgaacgaccctaacccggtcccttaacgtccgtacggacgtaacgggtagggtaacgtaccggccgtaaccggg

SEQ ID NO: 276693 - DNA, 876 bp, Homo sapiens
  misc_feature: GYAE6OF02JKT7K.10.75.G09.1.454.CMB.1.raw
tcagcatagtagtgcacgaccggtgctcgatttagtatagacatcagggggggggtctcaggaggcagcgctctcgggacgtctccaccatggcctgggctctgctattcctcaccctcctcactcagggcacaggttcctgggcccagtctgccctgtctcagcctcgcctcgtgtcgtggtcctcgtgacagtcgactccaccactcctcctgacaagtgggaacgacgaaagtcgactagtttggtttaaccttttaaagttttcgttcttcgtttacggtaacccaaacgtacggaccgtacccgaaggaaaccaaaacccggtaaccccccttaaaaaatttacctacctttaaacctttttccgtacggttccttacggttaaccgtaaacggtttaaaccggtccccgggtacccccgtttacgggtttaaccggggggtttttaccttaacgggtttcccgttccgttttaccgtccggttacggtacccttacccggttaaacggtttcggtacggaaccctaaacgtacccggtcccttacccgtacgtaccctacttccgttaccggtcgggtccctaccggaggtccgtagggtaccgggaacggtcggtacgttaacggttaacttttaacgtttacgttcgggaccgtacgtaccgttactaaacgttaaactaaaccgaaaccgtaaaccgttaaacggttccttttaaggtaacgtttacgggtaccggggtaacggggtaaaccggaacccttaaccggtccggttacccgttccgtaccgtaacccgaacggtacccgacgtcccgtacccgccccggttcgacccttaccgttcccgttacccgttccccctacccg

SEQ ID NO: 276694 - DNA, 810 bp, Homo sapiens
  misc_feature: GYAE6OF02IAUAR.10.75.G09.1.454.CMB.1.raw
tcagcatagtagtgcacgaccggtgctcgatttagtatagacatcagggtctccctcactgcccagctgggatctcagggcttcattttctgtcctccaccatcatggggtcaaccgccatcctcgccctcctcctgactgttctccaaggtcagtcctgccgagggcttgaggtcacagaggagaacgggtggaaaggagccccggattacaaagtttttcggttcccccccagacggagtctgtgccgaggtgcagctggtgcagtcaggacgcgaaggtaaggtaaaggacgggaccccggggtagtccgttcgtagaaagaactccgttcctaggttaacggcccgttcgtaggtactttaccgagtttcggttttaacgaccctaccgttccgttaggtacgttccggtcgttggggtcgaccgtccgaagtacgttcgggaaccccggggtaaaggcccgttaggggacggttgggaacggtgggggtacttacgtacgttccgtacgggtaccgttaaggtacgtaccgttacgtacgggttaacttacgttacgaacgttaaccttaccggttaccggtttaccccgtttacccgtttaacccggaaaccgggttaccccgtaaccgggttacccaacccgttacgtttacccgtaaccgtacccggtaaccccgtaacgtaaaccgtacccgttaacgttacccgaaccgccccgtaaccccggttacccttaacgttacccgttaccggtacgttaaccgggttacgggaaccggttacccggtccggttaaaccggggg

SEQ ID NO: 276695 - DNA, 738 bp, Homo sapiens
  misc_feature: GYAE6OF02JIWQ7.10.75.G09.1.454.CMB.1.raw
  modified_base (228)..(228): a, c, t, g, unknown or other
  misc_feature (228)..(228): n is a, c, g, or t
tcagcatagtagtgcacgaccggtgctcgatttagtatagacatcagggtctccctcactgcccagctgggatctcagggcttcattttctgtcctccaccatcatggggtcaaccgccatcctcgccctcctcctgactgttctccaaggtcagtcctgccgagggcttgaggtcacagaggagacggtggaaaggagcccggattcaaattttcggttccccccanaggagtctgtgccgaggtgcagctggtgcagtcaggagcaggaggtaaggacggcccggggagtcgtcgtgaagatctcctgtaacggcctctggattcgatgtttagcctactcctgggatccggcgtgggtcgccggaccagacgtcggaccccggggaaagggcccgtagggaggtgggaacgtggggacgtcgtaacgtcgtacgggcctaacggttgtaaccgttcgtagtaacgttacgttaccgtaagtaacttaaccgtaacggttacccggtttaccctttacccgggtaaaccgggtccccggttaaacggggtttcccctaaaccccggttaactttaacccgttacccgtaaccgtaacccccgggtaaccgtaaacccggttcccgtaacccgtaccgtaaacccgggaccctaacccggtaccccgtttacgtacccgttaccggtaccggtaaggttaccggggtaacggttaacccggtacccggtaaccgggg

SEQ ID NO: 276696 - DNA, 601 bp, Homo sapiens
  misc_feature: GYAE6OF02FNOG7.10.75.G09.1.454.CMB.1.raw
  modified_base (232)..(232): a, c, t, g, unknown or other
  misc_feature (232)..(232): n is a, c, g, or t
  modified_base (332)..(332): a, c, t, g, unknown or other
  misc_feature (332)..(332): n is a, c, g, or t
  modified_base (521)..(521): a, c, t, g, unknown or other
  misc_feature (521)..(521): n is a, c, g, or t
tcagcatagtagtgcacgaccggtgctcgatttagtatagacatcagggtctccctcactgcccagctgggatctcagggcttcattttctgtcctccaccatcatgggtcaaccgccatcctcgccctcctcctgactgttctccaaggtcagtcctgccgagggcttgaggtcacagaggagaacgggtggaaaggagccccggattcaaattttcggttccccccccanaggagtctgtgccggaggtgcagctggtgcagtcgaggagcaggaaggtaaaggaggccccgggggagtcctcgtgaagattctcctggtaacggcctcnggtaattcattgtttagcctacgttccgtggactcggtcgtggggtcgcgccaggagtggaccccggggaaaggccctgggaggtcgggagtggggatacgatcgtggccttaggtgacttgtagtattatcgaagtataccgtacgtcccgttccgttaccgaacggaccgacggtaccaccacttcncgacgaccgaacaaccgtccatcgacgacccacccgtcctacgtcctcggacgtaggtacggtacggtaccgtcgtacgg

SEQ ID NO: 276697 - DNA, 676 bp, Homo sapiens
  misc_feature: GYAE6OF02GVWLP.10.75.G09.1.454.CMB.1.raw
  modified_base (322)..(322): a, c, t, g, unknown or other
  misc_feature (322)..(322): n is a, c, g, or t
tcagcatagtagtgcacgaccggtgctcgatttagtatagacatcagggggggggtctcaggaggcagcgctctcgggacgtctccaccatggcctgggctctgctattcctcaccctcctcactcagggcacaggttcctgggcccaggtctgccctgtctcagcctgcctccgtgtctgggtctccgtggacagtcgatcaccatctctgacaatggagcgaaagtcgactagttaggttacttttaaagttttgtcttcgttacggtaaccaactagacgcccaagaacaaaccgaccccctaaaattactctatttcngtctgtactaagtactccggtcccgtgtacgggtttctacgtcgtctttctctggtcctcaagttcgtcgaccaaacgccggtacctcccgtacgtacctacttccgtcgtcgggtacctaccgacggtccgtaggacggacggtacgtcgtaggtactttattacgttgctacgtacctataactacgtaaaccaaacaaccgtaaagtctttagtaattaccggtgggaaccggtacgggtaaccctaacgttccgtaccgttccgttacgaccgtaaccgtacccgacggttaccctcccggtacccccttcggtacccctacttccgttaccccttccccctaacccccg

SEQ ID NO: 276698 - DNA, 622 bp, Homo sapiens
  misc_feature: GYAE6OF02JQWLA.10.75.G09.1.454.CMB.1.raw
  modified_base (200)..(200): a, c, t, g, unknown or other
  misc_feature (200)..(200): n is a, c, g, or t
  modified_base (230)..(230): a, c, t, g, unknown or other
  misc_feature (230)..(230): n is a, c, g, or t
tcagcatagtagtgcacgaccggtgctcgatttagtatagacatcagggtctccctcactgcccagctgggatctcagggcttcattttctgtcctccaccatcatggggtcaaccgccatcctcgccctcctcctgactgttctccaaggtcagtcctgccgagggcttgaggtcacagaggagaacgggtggaaaggngccccggattcaaattttcggtccccccanaggatctgtgccgagtgcagctggtcgcagtcaggagcagaggtaagagggcccgggagtcgtctgaagtactctccgtaggtaacgcctcgtggtattcgtattgttacgcctacgttccgtaggtactcggtcgtggggttcgccgaccgagtacgtcgggacccggggtaaaggtcccgtagggtaccgtgggaagtggggactcgtagtcgtacggtcctaggtcgtacgtctagattacgtacgagtactacgtacgttccgtaccgttacgaacggtcctacggtaccgacctacgttcaccgtacgacccgaactaacgtccaactccgacggacctaccggtcctacgtcgacgcgtacggtaggtaacggtacgtacgtacgg

SEQ ID NO: 276699 - DNA, 732 bp, Homo sapiens
  misc_feature: GYAE6OF02JKFLZ.10.75.G09.1.454.CMB.1.raw
tcagcatagtagtgcacgaccggtgctcgatttagtatagacatcagggtctccctcactgcccagctgggatctcagggcttcattttctgtcctccaccatcatgggtcaaccgccatcctcgccctcctcctgactgttctccaaggtcagtcctgccgaggcttggagtcacagaggagaacgggtggaaaggacgccccgggtattactaaaacgtttttccggttacccccccaagacgggtagttcctagtcggtccggaggtcgacgagcgtcggtgacgtagtcgaaggacgcgaaggaaggttaaaggcgggacccggggagttcgtacgtggtaacgacgttccgtccgtaggtaacggtcccgttacgtcggtaactttcgtaagtttcggtttacgaccctaccgttaccgtaggtacgtcggtacgtcggggtcgaccggtacgacggtacgtacgggaacccgggtaaacgggtccgtagggtacggtacgggtaggttacggggtactacgtacggttcggtacggtacgttaggtcgtacgttacgtacgtatacgttcgaaggtactacgtccgttacccgtccgtacgtaacggccgtacgaccgtacctacgtcgcgtacgaccgtactaccgtactacgtaccggctaaccggtaccctaccgtacgtacgttacgacgtacgggtacggtacgttaccggacgtaaccgg

SEQ ID NO: 276700 - DNA, 769 bp, Homo sapiens
  misc_feature: GYAE6OF02HBKQM.10.75.G09.1.454.CMB.1.raw
tcagcatagtagtgcacgaccggtgctcgatttagtatagacatcagggtctccctcactgcccagctgggatctcagggcttcattttctgtcctccaccatcagtggggtcaaccgccatccctcgccctcctcctgacttgttctccaaggtcagtcctgccgaggcttgagtcacgaggaggaggaacgggtaggaaacggacgacccggtattacgtaaacgttttcccggtaccccccaagtaggtacgttcgtggtcggaccggtaggtcgccgtaggtccgttggtcgtacgtaggtacggaagggaagacggtaaagggtaaacgggtaaacgggaccggggtacccggggtagttaccgtacgtaaggtaacgtccttaccgttaccgtacggtaaccggtccttggtacggtctttacgtagttttacggttaccaccgtacgttcggtaggtacgtccggtcggtcgggtccgacggtacgaaggtaccggtaccggggaacccgggtaacggtccggtagggtacggtaggtacgggtacggtacctggtaacgttccgggtacgttacggttacgtagttacctagtaacgtatacccggtaagaacgttccgttaccgtacccgggttcctacgaccggtacggtacctaccgcctaacggtcctacgacgaaccctactacgtacctcgagacccgtaactccctcgtactcgtaggcgaccggttgaccgtaacggttcccgaggtaaccgg

SEQ ID NO: 276701 - DNA, 717 bp, Homo sapiens
  misc_feature: GYAE6OF02HPFKR.10.75.G09.1.454.CMB.1.raw
  modified_base (229)..(229): a, c, t, g, unknown or other
  misc_feature (229)..(229): n is a, c, g, or t
tcagcatagtagtgcacgaccggtgctcgatttagtatagacatcagggtctccctcactgcccagctgggatctcagggcttcattttctgtcctccaccatcatggggtcaaccgccatcctcgccctcctcctgactgttctccaaggtcagtcctgccgaggcttgaggtcacagaggagaacgggtggaaaggcgcccggattctaaattttcggtccccccanaggagtctgtgccgaggtgcagcgtggtgcagtcaggagcaggaaggtaaaggacgggcccggggagtctcgtagaagtactccgtccgttagtaacggccttacgtgggtacttcgtagttggtttacgacctaccgttccgtagggtactcgggacgttcgggggtcgaccgaccgaaggtacgttccgggaaccccgggggtaaaacgggtcccgtaggggtacggttagggtacgggttacgggggtacttacgaacgtttccggtacgggtacccgtttaaggtcgtaccgttcgtacgtaacttaagtcgtaagtaacgtaacgtccgttacccgtacccttaccgaacgggacccgtacggtacccaccgtacttccgtacgtaacgacccgtaacgacgtaccacgtaccgcggtacccaccggtacccttacgtccgtacgtacgtacgggttaggtaacggtacgtaccggtaacggg

SEQ ID NO: 276702 - DNA, 660 bp, Homo sapiens
  misc_feature: GYAE6OF02FXPB3.10.75.G09.1.454.CMB.1.raw
tcagcatagtagtgcacgaccggtgctcgatttagtatagacatcaggggggggtctcaggaggcagcgctctcgggacgtctccaccatggcctgggctctgctattcctcaccctcctcactcagggcacaggttcctgggcccagtctgccctgtctcagcctgcctccgtgtctgggtctcctggacagtcgatcaccatctcctgcaatggaagcgaaagtgacattggttacttttaaattttgtcttcttggtaaccaaacagtagaccccaagaaccaaaacgaccccccaaaaatttactactaacttttctgtcttgtacctagtaaactccggtacccttcgtacggggtttctagttcgtcttctctcggcctaccaagtcgtcggacaacgacggtccctccctagacctactctacgtcgggtctccgaggtctaggacggacgaggctagtaatttatagtttgactacgtctactaacgtataaaccaaactaaccgaaaagttccttttacgattacggttccggacgggaacggaacctaaacgttccgtaccgttacccgttcggtacaaccgacccgtaaggtccttacccgccccccggttaggtacctacccgtcgttacccgttccccccgtacccg

SEQ ID NO: 276703 - DNA, 728 bp, Homo sapiens
  misc_feature: GYAE6OF02H2BOW.10.75.G09.1.454.CMB.1.raw
tcagcatagtagtgcacgaccggtgctcgatttagtatagacatcagggggggggtctcaggaggcagcgctctcgggacgtctccaccatggcctgggctctgctattcctcaccctcctcactcagggcacaggttcctgggcccagtctgccctgtctcagcctgcctccgtgtctgggtctcctggacagtcgatcaccatctcctgacaatggaagcgaaagtgaactatttaggttttacttttaaattttcgtccttcttaggtaaccaaacgagacgacccaagaacaaacgtaccccctaaaattatactatttcgtgctgtacagtaactccggcctcgtagggtttctagtccgtcttcttctggtcctaccgagtcgtggaccaaccgaccggtccctcctacgaccctactctcgtcgggtacctccgaggtcgtagggaacgggaccggacggtctaggttaactttagtttaagtttcgaccgtaggtccttaacaattaaacaaaaccctaaacccgtaaaccgtaaacgttcgttttaagtaacgttacggttaccggggaacgggaaacggtaaacccgtaaacgtaccgtacccgtttacccgtaaccgtccgaaccgtacccggtaaaccggttccctacccggttacccccgttccggtacccgttaacccgtttccccgtttaccccgttacccccgtaacccccc

SEQ ID NO: 276704 - DNA, 886 bp, Homo sapiens
  misc_feature: GYAE6OF02JNBX2.10.75.G09.1.454.CMB.1.raw
  modified_base (174)..(174): a, c, t, g, unknown or other
  misc_feature (174)..(174): n is a, c, g, or t
tcagcatagtagtgcacgaccggtgctcgatttagtatagacatcaggggggggtctcaggaggcagcgctctcgggacgtctccaccatggcctgggctctgctattcctcaccctctcactcagggcacaggttcctgggcccagtctgccctgtctcagcctgcctccgtntctgggtctcctggacagttcgactcacctattcctcctgctaagtggaacgtaccgaaagtcgaactagtttggttttaccttttaaattttcgtcgtttaccgtttagggttaaccctaaacgaacggttacggtacccccctaaacggtaaaccgtaaaaaaccccggtacccccccttaaaaaaagttttcccgttaccgtttaaaactttttcccgtaacggtccttaacggttacctaacggttaaacgttccgggtaccccttacggttacggggtttactacggttacgttcctttcgtcgtcgtcttacccaaggttcaggtaccaaacgtcccggtccttaccgtacgtaccctaacgttcgtccgttcgggtcccctacggtaccgtctaacgggaacggtaccggaggttacgtacgttatttaacgttacgttcggaaacctcggtttaccacgttacttaaaacctaaaccgaaaacccgtaacccgttaaaacgttccgttttacgaaacctttttcccggggaaaccggtacggggtaaaaccccggtaaccgttaaaccgttacgggtacccccgttaccgttttacccggaacccggtaacggtacccggttaaacccgtccgttaacccccggtcccctttaccgggaaccttccccgggttaaccctttcccggaccccccctttaccccgg

SEQ ID NO: 276705 - DNA, 846 bp, Homo sapiens
  misc_feature: GYAE6OF02G9RFU.10.75.G09.1.454.CMB.1.raw
  modified_base (779)..(779): a, c, t, g, unknown or other
  misc_feature (779)..(779): n is a, c, g, or t
tcagcatagtagtgcacgaccggtgctcgatttagtatagacatcagggtctccctcactgcccagctgggatctcagggcttcattttctgtcctccaccatcatgggtcaaccgccatcctcgccctcctcctgactgttctccaaggtcagtcctgccgaggcttgaggtcacgaggaggaggaacgggtaggaaacggacggccccggtatttacctaaaacgtttttccggttaccccccccagaacgggtacgttcttcggtcggccggtacgggtcgcgacgcgtgggtgctagtccgaggagcaaggaaggtaaaggacgggccccggggagtccgtcttaggaacgtacgtccgttacccgtaggttaaacggtcccgttacggttacgggtactttacgttaacgtttacggttttaacgaccccgttacccgtttccggtaacgggttaacttccggggttaccggttcgggggtttaccggccggtacccggtaaggtaccggtttaccggggaacccgggggtaaaacccggggtcccgggttaaggggtaggggttaccggggaggggttacggggggtaaccttacccggtacggtttaccgggttcgggtacccgttagggttaaccgtcgttccgttaagtacttaacgaccgtactaacgtaccggtacttcccggtaacccgttacccgggacggtacccgacggtacccaccgtacttcctaaccggactaacccggtacttaccgtacctacgtaccncggaaccctacccggtcttacgtccgtacgtacggtcggttacggacggttacccgccggtaaccgg

SEQ ID NO: 276706 - DNA, 558 bp, Homo sapiens
  misc_feature: GYAE6OF02GIH0P.10.75.G09.1.454.CMB.1.raw
  modified_base (232)..(232): a, c, t, g, unknown or other
  misc_feature (232)..(232): n is a, c, g, or t
  modified_base (489)..(489): a, c, t, g, unknown or other
  misc_feature (489)..(489): n is a, c, g, or t
tcagcatagtagtgcacgaccggtgctcgatttagtatagacatcagggtctccctcactgcccagctgggatctcagggcttcattttctgtcctccaccatcatggggtcaaccgccatcctcgccctcctcctgactgttctccaaggtcagtcctgccgagggcttgaggtcacagaggagaacgggtggaaaggagccccggattcaaattttcggttcccccccanaggagtctgtgccgaggtgcagctggtgcagtcaggagcgagaggtaaagaggcccggggatctctgaagatctcctgtacggcctcgtggtattcattgtttacgcctactccgtggatcggcgttggggtgccgccagacgtcggacccggggaaaggcctagggagtgggagtggggatcgtagtcgtcggcctagtcgtactcgtagatagtcagactacgtacgtccgtccttaccgaagccgacgtcaccntactcacgccacacgtccatcacgaccaccgtcctacgtctcgacgtaggtaggacgtacgccgtacgg

SEQ ID NO: 276707 - DNA, 975 bp, Homo sapiens
  misc_feature: GYAE6OF02I9N1C.10.75.G09.1.454.CMB.1.raw
  modified_base (174)..(174): a, c, t, g, unknown or other
  misc_feature (174)..(174): n is a, c, g, or t
tcagcatagtagtgcacgaccggtgctcgatttagtatagacatcagggtctccctcactgcccagctgggatctcagggcttcattttctgtcctccaccatcatggggtcaaccgccatcctctccctcctcctgactgttctaccaaggtcagtcctgccgagggcttggnggtcacgagaggaggaacggggtgggaaaggacggccccggattacgtaaacttttccggttaccccccacgaggagttctggtcgccggtaggtcgcagcgtggtgcgagtcgaggagacgtaggaagggtaaagccggggacccgggagttccgtacgtaggaagtacgtccgtaccgtaggtaacggcccgttgtggtacttcgtagttacgtttacggacctccgtccgtagtacgtccggtcggttaggggtcgcgtaccgtacggtacggtacccggggtaacccgggggaacgtcccggtagggtacggtacggggtagggttacgggggtacctaccggtacggttacccgtacggggtaaccgttttacgggaacccgggttacctttaacgggtacgttaaaacgtttacccgttaacgggtaaaacggttaacccgttaacccgggttaaccccggttttacccccccggttttaacccgggtttaaacccccgggggtaaaccgttaccccccggggggttacggtttaacccccccgtaaaaaccgtttcccggtttaaccccggtttaacccggaaacccggttaaccccccggttaaaacggttaaccccgttaacccgtaacccgtttaaccccgggaaaacccggttccccccccggtaaacccccggttttaaccccggacttttaaacccccggggtttcggggtaacccggtttaaaccgggggggtaacggggtttaaacccccggttttacggggaccccccgggttttaaaaccgggg

SEQ ID NO: 276708 - DNA, 840 bp, Homo sapiens
  misc_feature: GYAE6OF02G8L1K.10.75.G09.1.454.CMB.1.raw
  modified_base (231)..(231): a, c, t, g, unknown or other
  misc_feature (231)..(231): n is a, c, g, or t
  modified_base (257)..(257): a, c, t, g, unknown or other
  misc_feature (257)..(257): n is a, c, g, or t
tcagcatagtagtgcacgaccggtgctcgatttagtatagacatcagggtctccctcactgcccagctgggatctcagggcttcattttctgtcctccaccatcatgggtcaaccgccatcctcgccctcctcctgactgttcctccgaaggtcagtcctgccgaggcttgagtcacagaggagaacgggtaggaaaggcgcccggtattactaacttttcgtccccccanaggagtctgtgccgagtgcagctggngcgagtcgaggagcgaaggaaggtaaaggacgggacccggggtagtcgtcgtaggaacgacttccgtaccgtaggtaaccggccgttcgtaggtactttcgtagtttacgttttacgccctaccgtccgtcggtacgtcggtcggttgggtcgccgaccgtaggtacgtaccgggaccggggtaaacggtccggtagggtacggttagggtaacgggttacggggtaacttaccggtacgttcggttaccgggttaccgttaacggttacggtaccgttacggttaaggtaacgtttaagtaaccgtaaacgttaacgttaccggttaacccggtttacccccgtttacccgtttaacccggaaccgggtacccggtaacccggtaacccttaacccgtaaccggttacccttaaccgggaacccggtaacccggtaacccgtaaaccgttcccgtaaaccgttacccggaacccgtacccggttaacccccgtacccgtttaaccgttaacccggttaccgtaacccgggttagggttaaccggggttaacccgggttaacggtaccccggttaacccgggg

SEQ ID NO: 276709 - DNA, 1037 bp, Homo sapiens
  misc_feature: GYAE6OF02F018U.10.75.G09.1.454.CMB.1.raw
  modified_base (977)..(977): a, c, t, g, unknown or other
  misc_feature (977)..(977): n is a, c, g, or t
tcagcatagtagtgcacgaccggtgctcgatttagtatagacatcagggtctccctcactgcccagctgggatctcagggcttcattttctgtcctccaccatcatggggtcaaccgccatcctcgccctcctcctgactgttctccaaggtcagtcctgccgagggcttgaggtcacagaggagaacgggtggaaaggcgcccggattctaaattttccggtccccccagagggtagtctggtgcccgaggtcgacacggcgtgggtcgaccgaggttaccgaaggggagaccgaaggtaaacggggttaaaacgggacggggggtacccccggggggtaaacgttccgtttaccgaggggtaaaacggtactttcccggtttaccccggtaagggttaaaccggggtcccgtttaacggtacgggtttaaacttttccgtaagttttaaccgggtttttacgacccccgttaaccgttaccccgggttaggggtaaccgttaccggggttacgggtttacgggggggttccgtacccggggaccccgtaaaggggtaacggttttacccgggggaaaacccccggggggtaaaaagggtcccgggttaaaggggggtaaacggttacgggggtaacgggtttagggggaacctttaccggtaacgttcccgggttacgggggtaaccccgtttaaggttaccgggtaacccgtttcggtaacgtaaacgtttaacgttacggaaaacggttaaccgtttaaacccgggttaccccgggttttaccccggttaaccccgtttaaacccggggtaaaccggggtacccggttaaacccgggtaaccccctaaaccggttaccctttcccggtaaaccggtacccggtaacccgggttaaaacctaacccgggtcccttaaacggtacccggaaccctaacccggttacccgttaaacccctttggtttaacccccgngggttacccggttaacgggtaacgggtaaccggtttacccgacccggttaaacccggggg

SEQ ID NO: 276710 - DNA, 614 bp, Homo sapiens
  misc_feature: GYAE6OF02GI4QI.10.75.G09.1.454.CMB.1.raw
  modified_base (229)..(229): a, c, t, g, unknown or other
  misc_feature (229)..(229): n is a, c, g, or t
  modified_base (371)..(371): a, c, t, g, unknown or other
  misc_feature (371)..(371): n is a, c, g, or t
  modified_base (550)..(550): a, c, t, g, unknown or other
  misc_feature (550)..(550): n is a, c, g, or t
tcagcatagtagtgcacgaccggtgctcgatttagtatagacatcagggtctccctcactgcccagctgggatctcagggcttcattttctgtcctccaccatcatggggtcaaccgccatcctcgccctcctcctgactgttctcaaggtcagtcctgccgagggcttgaggtcacagaggagaacgggtggaaaggacgcccggattcaaattttcggtccccccanaggacgtctgtgccgaggtgcgagctggtgcagtcaggagcgagaggtaaagacgggccggggagtctctaggaagactccgtccgtaggtaacggtcctcggtagtacttctagttggtttacgcctactcctggatcggngtgggtcgccgcaggacgtcggacccggggtaaagccgtagggaggtggaggtggggactcgagttcgtacggtccttaggtcgtacttcgtagacttgtacagtactacgtacgtccctaccgttacgaacggcgtacgtccacctctacgtccgacgtaccgaacctacgtacctanccgacgtcccaccgtaccttacgtccgtcgtacgtaacggtcggtacgtaccggtctaaccggg

SEQ ID NO: 276711 - DNA, 897 bp, Homo sapiens
  misc_feature: GYAE6OF02F8I99.10.75.G09.1.454.CMB.1.raw
  modified_base (199)..(199): a, c, t, g, unknown or other
  misc_feature (199)..(199): n is a, c, g, or t
tcagcatagtagtgcacgaccggtgctcgatttagtatagacatcagggtctccctcactgcccagctgggatctcagggcttcattttctgtcctccaccatcatgggtcaaccgccatcctcgccctcctcctgactgttctccaaggtcagtcctgccgagggcttgaggtcacagaggagaacgggtggaaaggngcccggattcaaattttcggtccccccagaggagtctgtgccgaggtgcagcgtggtcgcagtcgaggagcgaaggaaggtaaaggacgggccccgggggaagttccgtacgtaggaacgtacgttccgtccgttaggtaacggtcccttacggtagggtaactttcgtaagtttacggttttaacgaccccgttaaccttcccggttagggtacgtccgggtcggttcgggggtcgtacccggacccgtaaggtaacggttaccggggaaaccccgggggtaaaacgggcccgggttaagggggtaacgggttacgggggtaacgggttacggggggtaacttaccggtaacggtttccggtacggggttaccccgttaagggttaccgggtaaccgtttccggttaacggttaaacgttaaccgttaaccggtaaacgttaaccgttaaccggttacccggtttaccccggtttaccccgtttaacccgggtaaaccgggtacccggtaaccgggttaccctaaacccgttaccgtttacccgtaacccggtaaccggtaaccccgtaaaccgtaaaccggtacccgtaacgtacccggtaaacggtcccccgtaacccggttacccttaacgttcccgttaacggtaccggttaacgggtacgggtaaccggttaccggtacccgttaaccgggg

SEQ ID NO: 276712 - DNA, 639 bp, Homo sapiens
  misc_feature: GYAE6OF02F91RN.10.75.G09.1.454.CMB.1.raw
  modified_base (232)..(232): a, c, t, g, unknown or other
  misc_feature (232)..(232): n is a, c, g, or t
tcagcatagtagtgcacgaccggtgctcgatttagtatagacatcagggtctccctcactgcccagctgggatctcagggcttcattttctgtcctccaccatcatggggtcaaccgccatcctcgccctcctcctgactgttctccaaggtcagtcctgccgagggcttgaggtcacagaggagaacgggtggaaaggagccccggattctaaattttcggttccccccanaggagtctgtgccgaggtgcagctggtgcagtcgaggagcaaggaaggtaaaggacgggcccggggtatcgtcgtagaagatcctccgtaggtaacggcctcgtaggtattcgattgttacgcctactccgtaggtactcggtcggtggtacgccgccgtaagacgtcggacccggggtaagtccgtgggacgtggaggtggggactacgtactcggtacgacgttagcgtaccgtgtagtacttagtacgaattacgttaaccgcggttaccccgttaccttaccgaacggtacccgtaggtacccacctagtcctaccgacgtaaccgactaacgtcccatccgaacgccctaaccgtcctacgtccgtacgtcgtaaggttacggacgttaccgacgtaacggg

SEQ ID NO: 276713 - DNA, 751 bp, Homo sapiens
  misc_feature: GYAE6OF02H9VEC.10.75.G09.1.454.CMB.1.raw
  modified_base (196)..(196): a, c, t, g, unknown or other
  misc_feature (196)..(196): n is a, c, g, or t
  modified_base (202)..(202): a, c, t, g, unknown or other
  misc_feature (202)..(202): n is a, c, g, or t
  modified_base (485)..(485): a, c, t, g, unknown or other
  misc_feature (485)..(485): n is a, c, g, or t
tcagcatagtagtgcacgaccggtgctcgatttagtatagacatcaggggggggggtctcaggaggcagcgctctcgggacgtctccaccatggcctgggctctgctattcctcaccctcctcactcaggcacaggttcctcgggcccagtctcgccctgtctcagcctgccctcgtgtctcgggtctcgtggacngtcgancacatctcctgacaagtaggagacgaaagtgactagtttggtttacttttaaattttggtcttcgtttacggtaaccctaacgagtaaccggacccaagaacccgaaaaaccgaacccccctaaaaatttacttaaccttacttttaccgtacgttacgttcgttacgtaagttaacggttcccggtccccgttacgggttacggggttttacgtaacggttccgtctttccgtcgtcggtacctccgtaagttcgtacgactaaaccgccggtcccttaccncgtaacctacgttaccgtcgtcggtcctcggacggtacgacggtacgggacggtaggtacttagtaagttttaacttagtcgaacgtacgtaccttataacgtaacaaaaccaaaccgttaaccaaagttcctttagtaagttaccgtacgggtacggtaaaccgaaacctacggtacctacgttcccgtagacccgtacgaacccggaagtcccgtacccgtcccgttcgtaccctccgttcccttaccggtcccccttaccccg

SEQ ID NO: 276714 - DNA, 1075 bp, Homo sapiens
  misc_feature: GYAE6OF02JVT8C.10.75.G09.1.454.CMB.1.raw
tcagcatagtagtgcacgaccggtgctcgatttagtatagacatcagggtctccctcactgcccagctgggatctcagggcttcattttctgtcctccaccatcagtgggtccaaccgccatcctcgccctcctcctgactgttctccaaggtcagtcctgccgagggtcttgaggtcacaggaggaggaacgggtagggaaaggacggacccgtagttactaaagttttccggttaccccccagacggtacgtctcggtcgccggtaggtgcgagtcgttggtcgacgtaacggtcgaagggacggacgtaaaggaacggggtaaaagggaccgggggaccccggggtagttaccggttaccgtaagggtaaaacggtaccgttaccgttacccgtaagggttaaccgggtccctttacggtacgggttaacctttcgtaagtttacggttttaaccgtcccgtaaccggtttaccgttggggaacggttccgggtccgggtttacgggggtccgggtcccgtaccgtaacgggtaaccggtacgggggtaaccccgggggtaaaaacgggttcccggggttaaggggttaaacgggtacgggggttaacggggtttaagggggtaaaccgttccggtaaaaccgttttcgggttaccccgggtaaacgggtttaacgggttacccggttaagtttacccgggttaagtaaccgtttaaaggtaacccgtaaagggtttaaaccccggaaccggttttaccccggttttacccgggttaaccccccgttttaaaccggggaaacccggggtttacccgggtaacccgggtttaaccccctaacgttaaccccggttttaaccccgtccgggaaaaccccggtaaacccccggggtaaacttaaacccccgggttcccgtaaacggttaaccccccggaaaacggtaaccccccggttaaaccggttttaacccggacgttttaacccggggaaaccgtttccggggggttaaaaccggggtttcccggggaaaccgggttttaaacccccgttacccgggggtaaacccggggg

SEQ ID NO: 276715 - DNA, 778 bp, Homo sapiens
  misc_feature: GYAE6OF02JC0E6.10.75.G09.1.454.CMB.1.raw
  modified_base (202)..(202): a, c, t, g, unknown or other
  misc_feature (202)..(202): n is a, c, g, or t
tcagcatagtagtgcacgaccggtgctcgatttagtatagacatcgagggtctccctcactgcccagctgggatctcagggcttcattttctgtcctccaccatcatggggtcaaccgccatcctcgccctcctctgactgttctccaaggtcagtcctgccgagggcttgaggtcacagaggagaacggggtaggaaaggnggccccggattacgtaaacgtttttccggttcccccccagtacggacgtccgtgtcgccgtaggtgcagcgtggtcgcgtagtcgaggacgcaggaaggtaaaggacggggtcccggggtagtccgtacgtaggaacgtacgttccgtccgttacggtaacggtcccgttacggtagggtactttcgtaggtttcgttttaaccggacccttaccgttcccgttagggtacgttccgggcgttggggtacgacccgtaccgaaggtacggttccgggaaccccgggggtaaagtcccggttaggggtaacggttggggaacggttcgggggtactacgtaacgttcggtacggtaccgtaggtcgtacgtcgtagtaactacgtacgaagtacgtaccgtacgttcccgttaccttaccgaaccggtaccgtacgtaccgacctacgttccgtaccgaccgtaccgtaaccgttaccgtacccgtacgttacccgacggtacccgaacccgttaccgtacgttaaccgtcggtacgttaccgggtaaggtaccggttaccgtaccggttaaccggg

SEQ ID NO: 276716 - DNA, 754 bp, Homo sapiens
  misc_feature: GYAE6OF02IJ720.10.75.G09.1.454.CMB.1.raw
  modified_base (231)..(231): a, c, t, g, unknown or other
  misc_feature (231)..(231): n is a, c, g, or t
tcagcatagtagtgcacgaccggtgctcgatttagtatagacatcagggtctccctcactgcccagctgggatctcagggcttcattttctgtcctccaccatcatggggtcaaccgccatcctcgccctcctcctgactgttctccaaggtcagtcctgccgaggcttgaggtcacagaggagaacgggtggaaaggacgccccggattcgaaattttcggtccccccanaggagtctgcgccgaggtgcagcgtggtcgacaggtcgaggagcgaggaacggtaaagacgggcccggggtagtcgtaccgtaggaaagtacgttccttaccgtaggtaacggtcccttacgtaggtatttccgaatttggttacgaccttaccgtccgttaggtacgtcggtacggttggggtccgccggacctaaggtacggttcccggggaaccccggggtaaacggtcccggttaaggggacggtacggggacgggttagggggacttacggtaacgttccgggttacgggtacccgtagggttacgtaccgtacggttacgtaagttacgtaccgtaagtaaccgttaccgttaccggttacccgttaccttaccggaacgtacccgtaacggttacccaacgtacttaccgtaccgacgaccctaagtaaccgtcctacgtaccgaacgtacccgacccgtaaccttacgtccgttacggacgttacgggtacggtaacgtccggaaccgtaacggg

SEQ ID NO: 276717 - DNA, 698 bp, Homo sapiens
  misc_feature: GYAE6OF02JUMPA.10.75.G09.1.454.CMB.1.raw
  modified_base (168)..(168): a, c, t, g, unknown or other
  misc_feature (168)..(168): n is a, c, g, or t
  modified_base (675)..(675): a, c, t, g, unknown or other
  misc_feature (675)..(675): n is a, c, g, or t
tcagcatagtagtgcacgaccggtgctcgatttagtatagacatcagggtctccctcactgcccagctgggatctcagggcttcatttttctgtcctccaccatcagtgggtcaaccgccatccctcgccctctcctgactgttctcaaggtcagtcctgacgaggtnttgaggtcacagaggagaacggggtggaaaggacggccccggtattacgtaaacgttttccggttcccccccaagacggtagtctggtcggccgtaggtagcaggtctggtcgctagtcgaggtagcaaggaaggtaaggacgggccgggtattcgtcgtagaacgtattccgtcgtaggtacggtcctcggtaggtacttcgtagttcgttacgcctacgtccgtaggtaccgtcggtcgtggtcgaccgcgagtacgtccgggaaccggggaagttccggtagggtaggtcgggaaggttgggactcgtaaccgtttggtacggacgtttacgtacgtaacgttcgtacggtacttagactaacgggacttaacccggacgtttcccgtttaccggttacgaaaccgggttcgtaccggttaacgactccgttacgacccgaggtacccgtaagacccgttcgatccgtcgacccgtacgtctacgtggtaccgtgtaacgggtntaaccggttaggacccgtaacgg

SEQ ID NO: 276718 - DNA, 837 bp, Homo sapiens
  misc_feature: GYAE6OF02HQO5U.10.75.G09.1.454.CMB.1.raw
tcagcatagtagtgcacgaccggtgctcgatttagtatagacatcagggtctccctcactgcccagctgggatctcagggcttcattttctgtcctccaccatcagtggggtacaaccgccatcctcgccctcctcctgactgttctccaaggtcacgtcctgccgagggcttgtaggtcacaggaggaggaacggggtaggaaaggcggacccggtattacgtaaacgttttcccggtacccccagacggtacgtcgtgtcggaccggaggtcgcgacgcgttgggcgcgtagtcggaggacgtacgaagggaaacgggtaacggaccgggggacccgggggtacgttaccgtacggtaacggtaacgtacgttccgttaccggtaacgggttaaccggccgttacggtaggttacttacggttacgtttacggtttaaccgtcccgttaaccggttaccggtacgggtaacggttccgggtcgggttacggggtccggacccggtaccgtaaacggtccgggtaaccggggtaacccgggggtaaacgggtcggttaacgggggtaggtaggggtacgggttaggggaaccttcggtaacgtcgggttacggtaaccgttaggttaacgttacggtctaaacggtcgtaacggtaacttaggtaacctttaacccggtacccggtttaacccggttcccttaaaccgggtacggtaccgtaccggtaccctaaccgtacgtccgtaccgtacgacctaaacgtccgtacgtacctacgaccggtaccacggtctactcggtactacggtacggtaggtaccgtggaccgtacggg

SEQ ID NO: 276719 - DNA, 794 bp, Homo sapiens
  misc_feature: GYAE6OF02FRMTJ.10.75.G09.1.454.CMB.1.raw
  modified_base (247)..(247): a, c, t, g, unknown or other
  misc_feature (247)..(247): n is a, c, g, or t
  modified_base (361)..(361): a, c, t, g, unknown or other
  misc_feature (361)..(361): n is a, c, g, or t
tcagcatagtagtgcacgaccggtgctcgatttagtatagacatcgagggggggggtctcaggaggcagcgctctcgggacgtctccaccatggcctgggctctgctatcctcacccttcctcactcagggcacaggttcctgggcccagtctcgccctgtctcagcctagcctccgtgtcgtcgggtctccgtggacacggtcgaacttccacgactccgtcctgcctaagtggaacgcgtaaagnaactacgttttggtttacttttaaagttttgtacctttcgttacggtaaccaagtacgacgtacccaagaaccgtaaaccgtaaccccctaaaattaccgtactacgttttccnggtacttacgtacgtaaggttaaccgtcccggtaccgttacggttaccgggggttttacttaccgggtaccgttccttacggttacgttcggtaccgttaccgtaaacggttcgttaacggaactaacccggaccgttcccgtacccgtacgttaaccgtacgttccgtaaccggttcggtacccgtaccggtacgggtacgtaacgggacgggtaaccggttacgtcggttaacgttaaagtttcttaacggttgacctttacgcgtttaacaacttaaacgtaaccaaaccggtaaactaagttccgttaagtacggttacggtcggacggtaacgtaaccgtaactccggttaactccgttacggacgtaccgaacggtacgtaccgtcccgtcggttacctacgtccgtacttcccggtaccctacccg

SEQ ID NO: 276720 - DNA, 800 bp, Homo sapiens
  misc_feature: GYAE6OF02H35MM.10.75.G09.1.454.CMB.1.raw
tcagcatagtagtgcacgaccggtgctcgatttagtatagacatcagggtctccctcactgcccagctgggatctcagggcttcatttttctgtcctccaccatcatggggtcaaccgccatcctcgccctcctcctgactgttctccaaggtcagtcctgccgagggcttgaggtcacagaggagaacgggtggaaaggacgccccggtattactaaacgtttttccggttacccccccagaggtagttctgtgccggtaggtcgcagctggtgcagtcgaggagacgaggaaggtaaaggacgggcccggggagtcgtcgtaggaacgacttccgtacgtaggtaacggtccgttcgtagggtactttcgtaagtttacggttttaacggcccctaaccgttcccgtagggtaacgttccgggtacggttgggggttcggacccggtaccgaagggtacggttaccggggtaacccccggggggtaaaaagggtccccggtttaaggggtaacggtttacgggggaagggtttacggggggtaacttaaccggtacgtttaccgggttaccgggttacccgttaaggtccgttaaccgttcgttagtaacttaacgtacgtaagtaacgtaccgtacggtccctacccgttaaccgaacggtaccgtaacgtcctaacctactaccgtacgaaccgtaccgtaaccgtaacgtaccctacgtaccgaacgtacccgtacccgtaccttacgtccgttacggacgtaagggtacggtacggtaccggtacgtaaccggg

SEQ ID NO: 276721 - DNA, 835 bp, Homo sapiens
  misc_feature: GYAE6OF02G4UQT.10.75.G09.1.454.CMB.1.raw
tcagcatagtagtgcacgaccggtgctcgatttagtatagacatcaggggggggtctcaggaggcagcgctctcgggacgtctccaccatggcctgggctctgctattcctcaccctcctcactcagggcacaggttcctcgggcccagtctcgtccctgtctcgacgcctgcctccgtgtcgtgggtctcgtggacacgtcgataccacatcctccgtgacaacgtaggagacgtaagtcgactagtttcggtttacttttaagtttcgtcgttcttacggtaccaaacgtagacgaccgaagtaaccaaaccggaccccctaaaagttactacgttaattttccgacgtcttacggtactaacggttaacgtcccggtcccgttaacgggttacggggttttactacggttacgtcccttttacgttcgtcggtaccttacccggtaacgttcggtacggacctaaacccgccggtaccccgttacccgtacggtaaacccttacttccggttccggttacgggtacctacccggtacggtaccggttaacggggtaaaccgggtaccggtacgggttaccgtttaacgttaaacgtttttagtttaacggtttacgacgttacggtacctaccaaactttaacctaaaaccgtaaaccctaaaccggtaacggtttacctagttaacggtttaccgggaccgggttaacggggtaaccgtaaaccgtaccgttaccggtcccgtttaacgtttcccggacgtaaccgacccggactcccggttacccgtcccggtacttcccgtaccttaccggttccgtaccccctacccg

SEQ ID NO: 276722 - DNA, 525 bp, Homo sapiens
  misc_feature: GYAE6OF01EIOBJ.48.24.C02.1.454.CMB.1.raw
  modified_base (181)..(181): a, c, t, g, unknown or other
  misc_feature (181)..(181): n is a, c, g, or t
  modified_base (412)..(412): a, c, t, g, unknown or other
  misc_feature (412)..(412): n is a, c, g, or t
  modified_base (445)..(445): a, c, t, g, unknown or other
  misc_feature (445)..(445): n is a, c, g, or t
  modified_base (447)..(447): a, c, t, g, unknown or other
  misc_feature (447)..(447): n is a, c, g, or t
  modified_base (516)..(516): a, c, t, g, unknown or other
  misc_feature (516)..(516): n is a, c, g, or t
tcagagtatacatacacgaccggtgctcgatttagtacagatcgttagggaaagggctgagagaggagcccagccctgggattctcaggtgttttcatttggtgatcaggactgaacagagagaactcaccatggagtttgggctgagcggtgtgtttctaggtcggctattttaaaggtntcagtgtgaggtgcactgttggagtgtgggggaggcttggtacagccgtggggggtccctgagactctcctgtgcagcctctggattcacctttagcagctatgccatgagcgttgggccgccagggctccgaggggacgggctggagtgggtctcagctatgtggtagtggtggtggcacatactacgacgagacgtccgtgaacgggtcggttcgaccactctccaganacaatacaacaacacacttatctgcgatgacancngagagcgacgacgacgaccgtatatacgtgtgtacgaagagtacgtaggttacgtatagtatagtaggngtgttaacg

SEQ ID NO: 276723 - DNA, 569 bp, Homo sapiens
  misc_feature: GYAE6OF01BRDKE.48.24.C02.1.454.CMB.1.raw
  modified_base (417)..(417): a, c, t, g, unknown or other
  misc_feature (417)..(417): n is a, c, g, or t
  modified_base (456)..(456): a, c, t, g, unknown or other
  misc_feature (456)..(456): n is a, c, g, or t
  modified_base (517)..(517): a, c, t, g, unknown or other
  misc_feature (517)..(517): n is a, c, g, or t
tcagagtatacatacacgaccggtgctcgatttagtacagatcgttagggaaaggggctgagagaggagcccagccctgggattctcaggtgttttcatttggtgatcaggactgaacagagagaactcaccatggagtttgggctgagcgtgtcgttttctaggtggctattttaaaaggtgtccagtgtgaggtgcacctgttggagtcgtgggggaggcttggtacagccgtggggggtccctgagactctcctgtgcagcctctggattcacctttagctagctatgccatgagcgtgggtccgccaggctccgaggggccggggctgggagtgggtctcagtctagttaggtggtagtgggtggtggcacgatactacgcagactccggtaggaacgggtccgttcaacctntcctaccagagaacaattaccaaagaactactactttanctgactaatcgaactacgcctagacggacgccggaaggaccgacggtccgtatacgttacngtagacgaaagagtcgtaaggttactagtctagtagtcgggtagtgttacgg

SEQ ID NO: 276724 - DNA, 533 bp, Homo sapiens
  misc_feature: GYAE6OF01ES037.48.24.C02.1.454.CMB.1.raw
  modified_base (356)..(356): a, c, t, g, unknown or other
  misc_feature (356)..(356): n is a, c, g, or t
  modified_base (460)..(460): a, c, t, g, unknown or other
  misc_feature (460)..(460): n is a, c, g, or t
tcagagtatacatacacgaccggtgctcgatttagtacagatcgttagggaaaggggctgggcctaaggaagcagcactggtggtgcctcagccatggcctggaccgttctcctcctcggcctcctctctcactgcacaggctctgtgacctcctatgttctgactcagccaccctcggtgtcagtggccccaggaaagcggccaggattacctgtggaggaaacaacattggaagtaaaagtgtgcactggtaccagcagaagccaggccaggcccctgtgctggtcgtctttgatgataccgaccggccctcgagggatccctgagcgattctctggctccagctctgtgaacncggcccaccctgaccatcagcgagggtcgaagccggggatggaggccgactattactgtcgaggtgtgggatagtagtagtgatcatctagttgggtgttcggnggagggaccaagctgaccgtcgtaggtcagcccgaggctcgcccccgtcggtacactcctcgtcccctacccc

SEQ ID NO: 276725 - DNA, 627 bp, Homo sapiens
  misc_feature: GYAE6OF01AWGRQ.48.24.C02.1.454.CMB.1.raw
tcagagtatacatacacgaccggtgctcgatttagtacagatcgttagggaaaggggctgggcctaaggaagcagcactggtggtgcctcagccatggcctggaccgttctcctcctcggcctcctctctcactgcacaggctctgtgacctcctatgttctgactcagcccaccctcggtgtcagtcggccccgaggaaagacggccaggattacctggtggaaggaaacaacattaggaaagtaaaagtgtgcactggtaccagcagaagccaggccaggcccctgtgcctggtcgtctttgatgactacccgaccggccctcgagggactccctggagccgtattcgtctggcctaccaactcgtgtacgaaccgacggcccctaccctgaaccctatccgaaggccgaacggggtcggaacggccggggagtcggacgggccgtacttagttacgtgtcgtaggtgggtagggagtagtagtaggtgagtcagtaccgtaagttgggtgttcggggacggacgggacgagcgtacggacccgttcgtacggtacgaccgaccgacggcctccggtcccccgtcggtcccgtaccgttcctcccgttcccccgtccccgttccc

SEQ ID NO: 276726 - DNA, 765 bp, Homo sapiens
  misc_feature: GYAE6OF01AFRE6.48.24.C02.1.454.CMB.1.raw
  modified_base (203)..(203): a, c, t, g, unknown or other
  misc_feature (203)..(203): n is a, c, g, or t
  modified_base (225)..(225): a, c, t, g, unknown or other
  misc_feature (225)..(225): n is a, c, g, or t
  modified_base (259)..(259): a, c, t, g, unknown or other
  misc_feature (259)..(259): n is a, c, g, or t
  modified_base (715)..(715): a, c, t, g, unknown or other
  misc_feature (715)..(715): n is a, c, g, or t
tcagagtatacatacacgaccggtgctcgatttagtacagatcgttagggaaaggggctgagagaggagcccagccctgggattctcaggtgttttcatttggtgatcaggactgaacagagagaactcaccatggagtttgggctgagcgtgtcgtttctagtcggctaatttaaaggtgtcagtgtgaggtgcactgtggngtcgtggggagtcgttggtacncgccggtcgggggtcctgacgctctccgtgtgcncgtccgtctggtacttcctaccgtttagctagtctatcgcctagtgcgtcgtcgggtccgaccgacggtcctccggagggccgggtcgtgggcggttcgggtcctcgagtcgttaagtttcggtggttaggtgggtcgggtacgacgtaactagttacctacgacgtacgtaccgttcggtacgggtaaccgggttccgttaccaacctacgttccacggacggtaaacaacttaaccggtaaccctaaacggaacccttaaccttattttaccgacgtacggtaaaccctaaggttaaacccgaacgccgggaacccgttagggaaacgggttaccccggaacgggttaacccgggaaaccgttaccccggtaaggttaaccgttacggttttaaccacggggttaaacgtaaaacgggtaaaggtacccggtttaggtaaaacccgggtttttnaaacggttaaggttaaccggtgggttaaacgggttattccggttaacggg

SEQ ID NO: 276727 - DNA, 792 bp, Homo sapiens
  misc_feature: GYAE6OF01C1EXC.48.24.C02.1.454.CMB.1.raw
  modified_base (390)..(390): a, c, t, g, unknown or other
  misc_feature (390)..(390): n is a, c, g, or t
  modified_base (442)..(442): a, c, t, g, unknown or other
  misc_feature (442)..(442): n is a, c, g, or t
tcagagtatacatacacgaccggtgctcgatttagtacagatcgttagggaaaggggctgagagaggagcccagccctgggattctcaggtgttttcatttggtgatcaggactgaacagagagaactcaccagtggaggtttgggctgagcgtggtctttttcgttggtggtacttaagttttaaaaggtgtcctagtgtgaggtgcactggttggagtcgtggggagtcttggtacaggccggtgggggtccctggagtacctctccgtgtcgcacgtccgtctggtatttctaccgtttagctagctatgccatggacgtcggtcgggcccgaccgcggtcctacccgggagggggaccggggcgtggggacgttggggtcctacgngtcttaggttaggtgggttaggtggggtaggtcgacgaactagtacgtacgntaacggtcgtccggtaggaacggggtcccgttacacccgtagttcccgtaccgaagggaactaaacctacgttaacccaaaagttaaccaacttaccgttttaacgtccgttaacggaccgtaaagttcccggaaacgttaccggaccggttagggaacggaacggggaccccggaacggggtaaccccgtaacccggggtaaccgtttaacgtttaaacgttcgtaaacgggttaccggaaaaccggttaaaaaaggttacggtttcccgggttaaaaacgggtttaccttaaaggttccgggttaaatacggggttaaaccggggttaggtttaaaggttaccccggg

SEQ ID NO: 276728 - DNA, 604 bp, Homo sapiens
  misc_feature: GYAE6OF01E1PFL.48.24.C02.1.454.CMB.1.raw
  modified_base (216)..(216): a, c, t, g, unknown or other
  misc_feature (216)..(216): n is a, c, g, or t
tcagagtatacatacacgaccggtgctcgatttagtacagatcgttagggaaaggggctgggccgtaaggaagcagcactggtggtgcctcagccatggcctggaccgttctcctcctcggcctcctctctcactgcacaggctctgtgacctcctatgttctgactcagccaccctcggtgtcagtggccccaggaaagacggccaggattaccngtggaggaaacaacattggaagtaaaagtgtgcactggtaccagcagagccaggccaggcccctgtgctggtcgtctttgactgactaccgaccggcctcgagggactccctgacgcgtattctctacggctaccgaactcttagcgaacgacggacccaccctgacccaatccgagcgagggtaccgaacggccgggatggacgggccgtacgtacttactgtcgtaggtcgtgggtatgtagtagtgatcatctaagttgggtgttacgggcgggtagggacacgcgtgtaccggtcgtacggtcgtacggccccgaaagggcctacccggtcccccgttaccggtaccgtactacccgttcccgttccccctaaccccttacccg

SEQ ID NO: 276729 - DNA, 614 bp, Homo sapiens
  misc_feature: GYAE6OF01AEKQN.48.24.C02.1.454.CMB.1.raw
tcagagtatacatacacgaccggtgctcgatttagtacagatcgttagggaaaggggctgggcctaaggaagcagcactggtggtgcctcagccatggcctggaccgttctcctcctcggcctcctctctcactgcacaggctctgtgacctcctatgttctgactcagccaccctcggtgtcagtcggccccaggaaacgacggccaggattaccgtgtggaaggaaacaacattaggaagtaaaagtgtgcacgtggtaccagcagaacgccaggccaggccctgtcgctggtcgtctttgatgactaccgaccgtccctgacgggactccctgacgcgtacttcgtctggcctaccgaactcgtagtacgaaccaccggccacccgtgaccatcagcgagggtcgaaggccgggatggacgcgacttatactgtacgtaggtcgtaggtatacggtagtacgtgactctactccgttaaggttgggttcggttcgggacggtacggaccgtaacgcgtccggtaccgtccgtacggtcgaccggacccgtaaggcccgtccgccccccgtacggttcccaccgttccgtcccgttcccccgtacccttccc

SEQ ID NO: 276730 - DNA, 796 bp, Homo sapiens
  misc_feature: GYAE6OF01BAU8S.48.24.C02.1.454.CMB.1.raw
tcagagtatacatacacgaccggtgctcgatttagtacagatcgttagggaaaggggctgggcctaaggaagcagcactggtggtgcctcagccatggcctggaccgttctcctcctcggcctcctctctcactgcacaggctctgtgacctcctatgttctgactcagccaccctcggtgtcagtcggcccaggaaagacggccaggattactgtaggaaggaaacaacattaggaaagtaaaagtgtagcacgtggtaccagcagaagccaggccaggcccctgtgcgtggtcgttcgtttgatgactaccgacccggccctcgagggtactccccgtaggacgtcggtacttccgttcgtacgggacccttccccgtaaacgttccgttaggtaacgaaacccgtacccgggacccctaccccgttacgaaccctaacgtaccgaacggtcggtaaaccgggggtaccggaaaccggggtacccgggggaacgttacgggaaccggggtacccggtaacgtttaacgtttaaccgttacggtaccggtaggggttgggtaggggtagttaaggtaagggtaagttagtacgttacgtacgttaaccgtttaaggtttcggggtttacggggtttacgggtaccgggggtaacgggtaacccgtaagggccgttaccggtaacccggttccggtacgggtaccgaccgggtacccgtaacgggtcccgttcccggtaccccccgttccggtacctacccgttaccgtttcccggttccccctccccgttacccc

SEQ ID NO: 276731 - DNA, 818 bp, Homo sapiens
  misc_feature: GYAE6OF01CRP4C.48.24.C02.1.454.CMB.1.raw
  modified_base (177)..(177): a, c, t, g, unknown or other
  misc_feature (177)..(177): n is a, c, g, or t
  modified_base (185)..(185): a, c, t, g, unknown or other
  misc_feature (185)..(185): n is a, c, g, or t
  modified_base (254)..(254): a, c, t, g, unknown or other
  misc_feature (254)..(254): n is a, c, g, or t
  modified_base (349)..(349): a, c, t, g, unknown or other
  misc_feature (349)..(349): n is a, c, g, or t
  modified_base (492)..(492): a, c, t, g, unknown or other
  misc_feature (492)..(492): n is a, c, g, or t
tcagagtatacatacacgaccggtgctcgatttagtacagatcgttagggaaaggggctgggcctaaggaagcagcacgtggtggtgcctcagccagtggcctggccgttctcctccgtcgccctcctctctcactgcacgaggctctgtcgaccttaccttatcgttctgaactcncgtacccnccctcggtgtccgagtccgaccccgaaggaaacgaccggcaaggattaccgtggtaggaaacggtaaanaacgtagttaaggtaaaagtaaaggtgtacgtcgtactaaggtaccaaggtaacgacgcgacgaccgacgtacctgtacgtgttacggtccgttnttaggactacggtaaccgtacccggccgtacccgtaggacggttcctacggtacggaaccggtccgttaacgttccgtaacgttcggaccttaaccgttacctacgttcggaaacaacccgggtaccgaacccctacgtaacncccggtaatacgaacccggacggggtaacggtaccggaacggggttcccgggaaggtcggacggtaacccgttacttaacggttacgtacgtagtaccgggtaggtacggtacgtttaaggtaggttacgtaacggtcttaaccgtacgttacgtttaacgggtttgggtaccggtaacgggtaccggtaacgaacggttaaccggagttacccgggtacggtacgtaccggtaccgtacccggaacgttaacccggtccgtcccgggtaacccctggttaaccccgtccttaactttccccgtaaccctcccgttaccgttaccg

SEQ ID NO: 276732 - DNA, 567 bp, Homo sapiens
  misc_feature: GYAE6OF02GCGT7.48.24.C02.1.454.CMB.1.raw
  modified_base (153)..(153): a, c, t, g, unknown or other
  misc_feature (153)..(153): n is a, c, g, or t
  modified_base (181)..(181): a, c, t, g, unknown or other
  misc_feature (181)..(181): n is a, c, g, or t
  modified_base (262)..(262): a, c, t, g, unknown or other
  misc_feature (262)..(262): n is a, c, g, or t
  modified_base (301)..(301): a, c, t, g, unknown or other
  misc_feature (301)..(301): n is a, c, g, or t
  modified_base (304)..(304): a, c, t, g, unknown or other
  misc_feature (304)..(304): n is a, c, g, or t
  modified_base (322)..(322): a, c, t, g, unknown or other
  misc_feature (322)..(322): n is a, c, g, or t
  modified_base (333)..(333): a, c, t, g, unknown or other
  misc_feature (333)..(333): n is a, c, g, or t
tcagagtatacatacacgaccggtgctcgatttagtacagatcgttagggaaaggggctgagagaggagcccagccctgggattctcaggtgttttcatttggtgatcaggactgaacagagagaactcaccatggagtttgggctgagcggngtgttctaggtcggctaattttaaaggngtcagtgtgaggtgcactgttggagtctgggggaggcttggtacagcctggggggtccctgagactctcctgtgcagcctntggattcacctttagcagctatgcatgagctggtcgccngcnccgaggacgggcgtgggngtggtcgtcgngtctagttagtggtaggtggtggtggcgactactacgtacgacgacgacgtcgtacggacgggtccggtcgtacctactctacacgagaactaactaccaacgaacaactacttacttactacgtacgaatagaacacgacgtagacgacgacgacgacgacgacgtacgtactacgtagtacgacgaagtaagtacgtacggttagtagtagtagtagtacggtagtagtacg

SEQ ID NO: 276733 - DNA, 558 bp, Homo sapiens
  misc_feature: GYAE6OF02JC31G.48.24.C02.1.454.CMB.1.raw
  modified_base (442)..(442): a, c, t, g, unknown or other
  misc_feature (442)..(442): n is a, c, g, or t
  modified_base (458)..(458): a, c, t, g, unknown or other
  misc_feature (458)..(458): n is a, c, g, or t
tcagagtatacatacacgaccggtgctcgatttagtacagatcgttagggaaaggggctgagagaggagcccagccctgggattctcaggtgttttcatttggtgatcaggactgaacagagagaactcaccatggagtttgggctgagcgtgtcgtttctaggtggctatttaaaggtgtcagtgtgaggtgcacctgttggagtctgggggaggcttggtacagccgtggggggtccctgagactctcctgtgcagcctctggattcacctttagcagctatgcatgagctgggtccgcaggctccgaggggacgggctgggagtgggtctcagctagttagtggtagtgggtggtggactacgatactacgcagacctccgtggaacgggtccgttacaccatcctccgagacgacaactccaaagaacactactttanctagacgaatgaacancctgagacgccggagacaccggcgtatacgttactggtcgaacgaaaagacgtacgaagggtttaactaggtagtaacgtaggtacgggagttattacgg

SEQ ID NO: 276734 - DNA, 575 bp, Homo sapiens
  misc_feature: GYAE6OF02JW5JZ.48.24.C02.1.454.CMB.1.raw
  modified_base (359)..(359): a, c, t, g, unknown or other
  misc_feature (359)..(359): n is a, c, g, or t
  modified_base (410)..(410): a, c, t, g, unknown or other
  misc_feature (410)..(410): n is a, c, g, or t
  modified_base (442)..(442): a, c, t, g, unknown or other
  misc_feature (442)..(442): n is a, c, g, or t
  modified_base (549)..(549): a, c, t, g, unknown or other
  misc_feature (549)..(549): n is a, c, g, or t
tcagagtatacatacacgaccggtgctcgatttagtacagatcgttagggaaaggggctgggccgtaaggaagcagcactggtggtgcctcagccatggcctggaccgttctcctcctcggcctcctctctcactgcacaggctctgtgacctcctatgttctgactcagccaccctcggtgtcagtggccccaggaaagacggccaggattacctgtggaggaaaacacattggaagtaaaagtgtgcactgggtaccagcagaagccaggccaggcccctgtgctggtcgtctttagatgatccgaccggcctcagggactcccgtgagcgtattcctgttggacttccaactcgtntgaaccacggccaccctgacctatcaagccagggtacgaacgccgggtaangagggccgactattacgtgtacgagtgtgggnttaagtgtagtcgatcatctagttgggtgttcggacggagggtaccgaagtcgacgtacgtcctaggcgtacggaccctaaggccgttaccgccccgttcgggtacnccgttccgccgttcccaccccgttcc

SEQ ID NO: 276735 - DNA, 655 bp, Homo sapiens
  misc_feature: GYAE6OF02G5EXE.48.24.C02.1.454.CMB.1.raw
  modified_base (243)..(243): a, c, t, g, unknown or other
  misc_feature (243)..(243): n is a, c, g, or t
  modified_base (258)..(258): a, c, t, g, unknown or other
  misc_feature (258)..(258): n is a, c, g, or t
  modified_base (349)..(349): a, c, t, g, unknown or other
  misc_feature (349)..(349): n is a, c, g, or t
  modified_base (360)..(360): a, c, t, g, unknown or other
  misc_feature (360)..(360): n is a, c, g, or t
  modified_base (445)..(445): a, c, t, g, unknown or other
  misc_feature (445)..(445): n is a, c, g, or t
  modified_base (449)..(449): a, c, t, g, unknown or other
  misc_feature (449)..(449): n is a, c, g, or t
  modified_base (485)..(485): a, c, t, g, unknown or other
  misc_feature (485)..(485): n is a, c, g, or t
  modified_base (608)..(608): a, c, t, g, unknown or other
  misc_feature (608)..(608): n is a, c, g, or t
  modified_base (646)..(646): a, c, t, g, unknown or other
  misc_feature (646)..(646): n is a, c, g, or t
tcagagtatacatacacgaccggtgctcgatttagtacagatcgttagggaaaggggctgagagaggagcccagccctgggattctcaggtgttttcatttggtgatcaggactgaacagagagaactcaccatggagtttgggctgagcggtgtggtttctaggtcggctaagtttaaaggtgtcagtgtgagtgcactgtggagtcgtggggagtcttggtacagccgtgggggtcctganactctcctgtcgcgngccttgtggacttcctacctttaagccagctaagtcgcctatgagtccgttcgggtcccgcgaggtccaccggaggggccggggctagggngttcggggtcntagtcgtagttaggtggtaggtggtggttacgctacgtagtaccgtacgctagtaccgtcgagggtaacgggtccgtacaccgtntacnccgaggacaagtaacctagaacgactactaagtttnacgttgaagtacacggtaaactgtacctaggagtaccgtcgggaaagaacccgacggttaacgtaacgtttacgtaccgtggttaccggtaaccgggaaaagttcggtaacgttaacgggttnttaaccggtagtaacgtttcggggtaacggtacggttntttaacggg

SEQ ID NO: 276736 - DNA, 672 bp, Homo sapiens
  misc_feature: GYAE6OF02F5NIN.48.24.C02.1.454.CMB.1.raw
  modified_base (304)..(304): a, c, t, g, unknown or other
  misc_feature (304)..(304): n is a, c, g, or t
  modified_base (480)..(480): a, c, t, g, unknown or other
  misc_feature (480)..(480): n is a, c, g, or t
tcagagtatacatacacgaccggtgctcgatttagtacagatcgttagggaaaggggctgagagaggagcccagccctgggattctcaggtgttttcatttggtgatcaggactgaacagagagaactcaccatggagtttgggctgagctggctttttcttgtggctattttaaaaggtgtccagtgtgaggtgcactgttggagtctgggggagcttggtacagccgtggggggtccctgagactctcctgtgcagcctctggattccacctttagcagtctatcgccatgagctgggtccncaggcctcgaggggacgggtctgggagtgggtctcgagtctagttgtggtagtgggtggtgcactatacgtacgcagacgtccggtaggaacgggtcccggtttaccaaccgtacttccgtacccgaaggacgtaacaaacgtttcccgaaagtaaacctacttaaccgtttttanccgttaggaccgtaaattcgaaacctggacccgttagggaacggtacggacccggaagggtaacccgtaccgggtaccgttaattacgtttaccgttggtaacgggtaaccggtaaaaggtacggttaccggtaaggggttttaaccaggttacggtaacgttaacgggtcgggggttattacggtttacgg

SEQ ID NO: 276737 - DNA, 538 bp, Homo sapiens
  misc_feature: GYAE6OF02JB4B7.48.24.C02.1.454.CMB.1.raw
  modified_base (455)..(455): a, c, t, g, unknown or other
  misc_feature (455)..(455): n is a, c, g, or t
  modified_base (460)..(460): a, c, t, g, unknown or other
  misc_feature (460)..(460): n is a, c, g, or t
tcagagtatacatacacgaccggtgctcgatttagtacagatcgttagggaaaggggctgagagaggagcccagccctgggattctcaggtgttttcatttggtgatcaggactgaacagagagaactcaccatggagtttgggctgagctggctttttcttgtggctattttaaaaggtgtccagtgtgaggtgcacctgttggagtctggggaggcttggtacagcctggggggtccctgagactctcctgtgcagcctcgtggattcacctttagcagctatgccatgagcgtggggtacccgccgaggcctccggagggacggggctgggagtgggtctcgagctagtagtggtagtggtggtggcacatactacgcagacctccgtggaacgggtccgttcaccatcctcagagacaattccaagaaccactactttatctagacgtaangaacngacctgagagccgagacacgaccgtatatactgtagacgaagtagccgtaggttacagtgatgacgggtatagttacg

SEQ ID NO: 276738 - DNA, 902 bp, Homo sapiens
  misc_feature: GYAE6OF02JDYWJ.48.24.C02.1.454.CMB.1.raw
tcagagtatacatacacgaccggtgctcgatttagtacagatcgttagggaaaggggctgggcctaaggaagcagcactggtggtgcctcagccatggcctggaccgttctcctcctcggcctcctctctcactgcacaggctctgtcgacctcctatcgttctgtacctcacgcccaccctcggtgtccaggtcggccccgaaggaaacgaccggccaggacttaccgtggtcggaaggaaaccactagttcgggaaagttaaaagtgtagacgtacgttagggtaccaggcaaggaacgacccgaacgggcccgtaccggtccccccgttggtcggtccgttacgggttccggtttccgttttaggtacgtttaggaacctttaaccccggggaccccgggttacccctacggtaaccgggggtaccttaccccgtagggaccggtacgggttacttttccgtcctcggggtaccttaccctaacgtttccgtacggttaacggaacccgtaaccgggtccccctaacccgtcgaaaccccgttacaccgaaccgggtcggtaacgggggtacgggtaaccggggtaccggggtaacgtacgggtaccgggtacccggtaacctttaacgttacgttacggttaccggtaagggttgttacggggttaagttaggttaaggttacggtagtattaccgtaacgtttaccggttaacgggtttgggtttaccggggtacgggtccgggggtaacggtaaccggtaaccggtccgtaccggtacccggttaccgttaccgggtacgacccggtacccggaacggtccccggtacgtttcccccccggtacgtcccgtttaacccgttccgttccccggttccccggttacccccttaccccg

SEQ ID NO: 276739 - DNA, 803 bp, Homo sapiens
  misc_feature: GYAE6OF02FIS4W.48.24.C02.1.454.CMB.1.raw
tcagagtatacatacacgaccggtgctcgatttagtacagatcgttagggaaaggggctgggcctaaggaagcagcactggtggtgcctcagccatggcctggaccgttctcctcctcggcctcctctctcactgcacaggctctgtgacctcctatgttctgactcacgcccacccgtggtgtcaggtcggaccccaaggaaacgaccggccagggtactttaccgtggtacgggaacggaaaccaacgtagtttagggaaaagttaaaaggtggtagactacgttcggtaaccgaggacgaacgaacggcccgaagggacccgaacgggcccccttggtacggacgtttcggggttaccgtttccttttaggacgttcggtaaccgttaaccccgggaccccggtaccccgttacggaacggggtaccctttcccgtaggacggtacgtacgtttccgttacgtcgggtacccttaccgaaccgtttcgtacgggtaccgaaacccgacccgggtaccccaacccgttcggaaccctagtaccgacggtaccggaacgggggtaccggaacggggtccggggtaagtacgggacgggtacccgtaactttacgttaccgttaggtacgtaggggtcggtagggttataggttagtagtgtacgtctaacgtcgttaaggttcggggtcgttcggacgggtacgacgtacgtcgtcgtaccgtcgtacgacgtaaccggaccgacggtccgtcccgtcccgtcggacctaccgttccgttacccggtccccgtaccgttccg

SEQ ID NO: 276740 - DNA, 675 bp, Homo sapiens
  misc_feature: GYAE6OF02F0XV0.48.24.C02.1.454.CMB.1.raw
  modified_base (286)..(286): a, c, t, g, unknown or other
  misc_feature (286)..(286): n is a, c, g, or t
  modified_base (289)..(289): a, c, t, g, unknown or other
  misc_feature (289)..(289): n is a, c, g, or t
tcagagtatacatacacgaccggtgctcgatttagtacagatcgttagggaaaggggctgagagaggagcccagccctgggattctcaggtgttttcatttggtgatcaggactgaacagagagaactcaccatggagtttgggctgagcgtgcttttctgtggctatttaaaaggtgtcagtgtgagtgcacctgttggagtctgggggaggcttggtacagcctggggggtccctgagactctcctgtgcagcctctggacttcactttagcagctatgcatgngcnggtccgcgaggctccgaagggcggggctggagtgggtctcgagctagttagtggtagtcggtggtggcacgatacgtacgtacgagccttccggaggaacggggtccgggtttccaaccctaagtttcctacccaagaacggtaaacctaaacgtttaacccgaaataaacccgaaccttaaccgttttatacccgttgtaacccgaattacggaaaacctaacggccttagggaacgaacggacccggtaacggaaccgaaacccgggtccccggttaattaaccgtttagtacggttcggaacggtaaaggtaaccggttcaaaggggtttaaccttagtaaccggtaattagggggtaccgggtagggttagttttaaccggg

SEQ ID NO: 276741 - DNA, 931 bp, Homo sapiens
  misc_feature: GYAE6OF02FKT8C.48.24.C02.1.454.CMB.1.raw
  modified_base (157)..(157): a, c, t, g, unknown or other
  misc_feature (157)..(157): n is a, c, g, or t
  modified_base (216)..(216): a, c, t, g, unknown or other
  misc_feature (216)..(216): n is a, c, g, or t
tcagagtatacatacacgaccggtgctcgatttagtacagatcgttagggaaagggggctgagagaggagcccagcccctgggacttcgtctaggtgttttctatttggtgatcaggactgaacagagagaactccaccatggtagtttgggcgtgngcgtggtctttttcttgtggtctaattttaaaggtgtccagtgtgaggtgcgactgtgngtgtggggagtcgtgggacacggtcgtcgggggtacctggacggtctcgtctcgtcgtcgcgtccgtcgtcggtacttcctaccgtttagccgttaccgtactactccgcctagtcgacggtccgttcgggtcccggtccgacggcctaccggacgggacggggtacgtgggggtacggttcgggtccttacggacggttaccttaggttaggttacgggttagggttggggttacggggttcgaaccgttaacgtaacgtaacccggtagaacccggtaacggtacccggttaccgggtaaggggaaccccgggtccccgggttaacccgtaacccgtaccgtttaacccccgtactaaacccggtaaggtaaacccttaaacttacccggaaaaccgtaaaccgttaacccttaaacggtttacttaccgtaacggtaaccgttaactaaaaccggaaaccgttacccggacgttaaccgggaacggaacccggggaaaccggggaaccccgggtaaccggaaacccggggttacccccgtttaaggtttaacccgttttaccgggtaaccgtttaacggggtaaaacccttaaaacgggggaaaaccggttttaaccggtaaacgggtttaaaccgtttacgggtaaccgggtttaaacgggtaaccgggttacggggggttaaccgggtttaaaccgtttaaccccggggg

SEQ ID NO: 276742 - DNA, 284 bp, Homo sapiens
  misc_feature: GYAE6OF01B20QR.22.34.D01.1.454.CMB.1.raw
  modified_base (282)..(284): a, c, t, g, unknown or other
  misc_feature (282)..(284): n is a, c, g, or t
tcagacatacgcgtcacgaccggtgctcgatttagatcgtctgtgaccgcagcggacacggccgtgtattactgtgcgagagagtccgggtccgatatctggccgttcgacccctggggccagggaaccctggtcaccgtctcctcagcctccaccaagggcccatcggtcttcccctggcgccctgctccaggagcacctccgagagcacagcggccctgggctgcctggtcaaggactacttccacgcgtatgtctgagcgggctggcaaggcgcatagnnn

SEQ ID NO: 276743 - DNA, 283 bp, Homo sapiens
  misc_feature: GYAE6OF01ER8QF.22.34.D01.1.454.CMB.1.raw
  modified_base (280)..(283): a, c, t, g, unknown or other
  misc_feature (280)..(283): n is a, c, g, or t
tcagacatacgcgtcacgaccggtgctcgatttagatcgtctgtgaccgcagcggacacggccgtgtattactgtgcgagagagtccgggtccgatatctggccgttcgaccctggggccagggaaccctggtcaccgtctcctcagcctccaccaagggcccatcggtcttcccctggcgccctgctccaggagcacctccgagagcacagcggccctgggctgcctggtcaaggctacttccacgcgtatgtctgagcgggctggcaaggcgcatagnnnn

SEQ ID NO: 276744 - DNA, 282 bp, Homo sapiens
  misc_feature: GYAE6OF01CL4AV.22.34.D01.1.454.CMB.1.raw
  modified_base (279)..(282): a, c, t, g, unknown or other
  misc_feature (279)..(282): n is a, c, g, or t
tcagacatacgcgtcacgaccggtgctcgatttagatcgtctgtgaccgcagcggacacggccgtgtattactgtgcgagagagtccgggtccgatatctggccgttcgaccctgggccagggaaccctggtcaccgtctcctcagcctccaccaagggcccatcggtcttcccctggcgccctgctccaggagcacctccgagagcacagcggccctgggctgcctggtcaaggactacttccacgcgtatgtctgagcggctggcaaggcgcatagnnnn

SEQ ID NO: 276745 - DNA, 283 bp, Homo sapiens
  misc_feature: GYAE6OF01CKOVT.22.34.D01.1.454.CMB.1.raw
  modified_base (279)..(283): a, c, t, g, unknown or other
  misc_feature (279)..(283): n is a, c, g, or t
tcagacatacgcgtcacgaccggtgctcgatttagatcgtctgtgaccgcagcggacacggccgtgtattactgtgcgagagagtccgggtccgatatctggccgttcgaccctgggccagggaaccctggtcaccgtctcctcagcctccaccaagggcccatcggtcttcccctggcgccctgctccaggagcacctccgagagcacagcggccctgggctgcctggtcaaggactacttccacgcgtatgtctgagcggctggcaaggcgcatagnnnnn

SEQ ID NO: 276746 - DNA, 287 bp, Homo sapiens
  misc_feature: GYAE6OF01BVX2C.22.34.D01.1.454.CMB.1.raw
  modified_base (282)..(287): a, c, t, g, unknown or other
  misc_feature (282)..(287): n is a, c, g, or t
tcagacatacgcgtcacgaccggtgctcgatttagatcgtctgtgaccgcagcggacacggccgtgtattactgtgcgagagagtccgggtccgatatctggccgttcgaccctggggccagggaaccctggtcaccgtctcctcagcctccaccaagggcccatcggtcttccccctggcgccctgctccaggagcacctccgagagcacagcggccctgggctgcctggtcaaggactacttccacgcgtatgtctgagcgggctggcaaggcgcatagnnnnnn

SEQ ID NO: 276747 - DNA, 555 bp, Homo sapiens
  misc_feature: GYAE6OF01ECJC6.22.34.D01.1.454.CMB.1.raw
tcagacatacgcgtcacgaccggtgctcgatttagatcgtctgtgttgggtttgggggaagaggaagactgacggtcctgtcccaggtgcagctgcaggagtcgggcccaggactggtgaagccttcggagaccctgtccctcacctgtactgtctctggtggctccgtcactggttaccactggagctggatccggcagcccccagggaagggactggagtggattggctatatttcttacagtggccgcaccaactcccacccctcctcaagagtcgagccaccatatcagtcgacacgtccaagaaccagttctccctgaaactgaggtctgtgaccgcagcggacacggccgtgtattactgtgcgagagagtccgggtccatatctggccgttcgaccctgggccagggaccctggtcaccgtctcctcacgcctccaccaacgggcccatccggtccttcccctggccgcccctgcctccacggacgccacctccgagacgccacgacgcggccctgggcctgccctggtcaaggcctacgttccgacg

SEQ ID NO: 276748 - DNA, 580 bp, Homo sapiens
  misc_feature: GYAE6OF01CXREJ.22.34.D01.1.454.CMB.1.raw
  modified_base (318)..(318): a, c, t, g, unknown or other
  misc_feature (318)..(318): n is a, c, g, or t
  modified_base (508)..(508): a, c, t, g, unknown or other
  misc_feature (508)..(508): n is a, c, g, or t
tcagacatacgcgtcacgaccggtgctcgatttagatcgtctgtgttgggtttgggggaagaggaagactgacggtcctgtcccaggtgcagctgcaggagtcgggcccaggactggtgaagccttcggagaccctgtccctcacctgtactgtctctggtggctccgtcactggttaccactggagctggatccggcagcccccagggaagggactggagtggattggctatatttcttacagtggccgcaccaactcccacccctccctcaagagtcgagccaccatatcagtcgacacgtccaagaaccagttcnccctgaaactgaggtctgtgaccgcagcggacacggccgtgtattactgtgcgagagacgtccgggtccgatagtctggccgtttcgaccccgtggggccagggaaccctggtccaccgtctccctcacgccctccaccgaacgggcccacgtccggtccttcccccgtggccgccctcgcctccaggcncacctccgagcgcacgacgccggcccgtgggcctcgccgtcgggtacaaggtacctaccgttcccgaaccgg

SEQ ID NO: 276749 - DNA, 572 bp, Homo sapiens
  misc_feature: GYAE6OF01BVNSI.22.34.D01.1.454.CMB.1.raw
tcagacatacgcgtcacgaccggtgctcgatttagatcgtctgtgttgggtttgggggaagaggaagactgacggtcctgtcccaggtgcagctgcaggagtcgggcccaggactggtgaagccttcggagaccctgtccctcacctgtactgtctctggtggctccgtcactggttaccactggagctggatccggcagcccccagggaagggactggagtggattggctatatttcttacagtggccgcaccaactcccacccctccctcaagagtcgagccaccatatcagtcgacacgtccaagaaccagttctccctgaaactgaggtctgtgaccgcagcgacacggccgtgtattactgtgcgagagagtccgggtccgatatctggccgttcgaccccgtggggccagggaaccctggtcaccgtctcctcacgcctccaccaacgggccccatccggtccttcccccgtggccgcccctcgcctccaggacgccacctccgagcgccacgacgcggccccgtgggcctcggcccgtggtccaaggcctaccgttcccgaccgg

SEQ ID NO: 276750 - DNA, 574 bp, Homo sapiens
  misc_feature: GYAE6OF01ACVZH.22.34.D01.1.454.CMB.1.raw
  modified_base (318)..(318): a, c, t, g, unknown or other
  misc_feature (318)..(318): n is a, c, g, or t
tcagacatacgcgtcacgaccggtgctcgatttagatcgtctgtgttgggtttgggggaagaggaagactgacggtcctgtcccaggtgcagctgcaggagtcgggccccaggactggtgaagccttcggagaccctgtccctcacctgtactgtctctggtggctccgtcactggttaccactggagctggatccggcagcccccagggaagggactggagtggattggctatatttcttacagtggccgcaccaactcccacccctccctcaagagtcgagccaccatatcagtcgacacgtccaagaccagttcnccctgaaactgagtctgtgaccgcagcggacacggccgtgtattactgtgcgagagagtccgggtccatatctggccgttcgacccgtgggccagggaaccccgtggtccaccgtctcctcacgccctccaccgacgggcccagtccggtccttccccgtggccgccctgcctccaggaccgccaccgtccgagacgccacgcgccggcccgtgggcctggccctcgggtaccaacggcctaccgttccgaaccgg

SEQ ID NO: 276751 - DNA, 594 bp, Homo sapiens
  misc_feature: GYAE6OF01CF1MT.22.34.D01.1.454.CMB.1.raw
  modified_base (515)..(515): a, c, t, g, unknown or other
  misc_feature (515)..(515): n is a, c, g, or t
tcagacatacgcgtcacgaccggtgctcgatttagatcgtctgtgttgggtttgggggaagaggaagactgacggtcctgtcccaggtgcagctgcaggagtcgggcccaggactggtgaagccttcggagaccctgtccctcacctgtactgtctctggtggctccgtcactggttaccactggagctggatccggcagcccccagggaagggactggagtggattggctatatttcttacagtggccgcaccaactccccacccctccctcaagagtcgagcccaccatatcagtcgacacgtccaagaaccagttcctccctgaaactgaggtctgtgaccgcagcggacacggccgtgtatacgtgtgcgagagaggtccgggtcatactcgtcggtccgttcgaccccgtggggaccacgggaaccctggtcaccgtctcctcacgcctaccaccgaacgggcccacgtccggtccttccccgtggcccgcccgtcgcctccgaggaccnccgaccctccggacgacgccgacgacggccggcccgtgggcctcggcccgtggccaaggtccctaccgttcccgaccgg

SEQ ID NO: 276752 - DNA, 576 bp, Homo sapiens
  misc_feature: GYAE6OF01DZPAK.22.34.D01.1.454.CMB.1.raw
  modified_base (440)..(440): a, c, t, g, unknown or other
  misc_feature (440)..(440): n is a, c, g, or t
tcagacatacgcgtcacgaccggtgctcgatttagatcgtctgtgttgggtttgggggaagaggaagactgacggtcctgtcccaggtgcagctgcaggagtcgggcccaggactggtgaagccttcggagaccctgtccctcacctgtactgtctctggtggctccgtcactggttaccactggagctggatccggcagcccccagggaagggactggagtggattggctatatttcttacagtggccgcaccaactcccacccctccctcaagagtcgagccaccatatcagtcgacacgtccaagaaccagttctccctgaaactgaggtctgtgaccgcagcggacacggccgtgtattactgtgcgagagagtccgggtcgatatcgtggcccgttcgaccccgtgggccagggaccctggtcaccgtctcctcncgcctccaccacgggcccatccgtccttccccgtcggccgcccctgcctccgacggacgccacccgtccgacgacgccacgacgccggcccgtgggcctggcccgtgggtacaagggaccttaccgtcccgaccgg

SEQ ID NO: 276753 - DNA, 288 bp, Homo sapiens
  misc_feature: GYAE6OF01AXKGO.22.34.D01.1.454.CMB.1.raw
  modified_base (281)..(288): a, c, t, g, unknown or other
  misc_feature (281)..(288): n is a, c, g, or t
tcagacatacgcgtcacgaccggtgctcgatttagatcgtctgtgaccgcagcggacacggccgtgtattactgtgcgagagagtccgggtccgatatctggccgttcgaccctggggccagggaaccctggtcaccgtctcctcagcctccaccaagggcccatcggtcttcccctggcgccctgctccaggagcacctccgagagcacagcggccctgggctgcctggtcaaggactacttccacgcgtatgtctgagcgggctggcaaggcgcatagnnnnnnnn

SEQ ID NO: 276754 - DNA, 286 bp, Homo sapiens
  misc_feature: GYAE6OF01B2BNG.22.34.D01.1.454.CMB.1.raw
  modified_base (253)..(253): a, c, t, g, unknown or other
  misc_feature (253)..(253): n is a, c, g, or t
  modified_base (282)..(286): a, c, t, g, unknown or other
  misc_feature (282)..(286): n is a, c, g, or t
tcagacatacgcgtcacgaccggtgctcgatttagatcgtctgtgaccgcagcggacacggccgtgtattactgtgcgagagagtccgggtccgatatctggccgttcgaccctggggccagggaaccctggtcaccgtctcctcagcctccaccaagggcccatcggtcttccccctggcgccctgctccaggagcacctccgagagcacagcggccctgggctgcctggtcaaggactacttccacgcgtntgtctgagcgggctggcaaggcgcatagnnnnn

SEQ ID NO: 276755 - DNA, 721 bp, Homo sapiens
  misc_feature: GYAE6OF01BHEJ1.22.34.D01.1.454.CMB.1.raw
tcagacatacgcgtcacgaccggtgctcgatttagatcgtctgtgttgggtttgggggaagaggaagactgacggtcctgtcccaggtgcagctgcaggagtcgggcccaggactggtgaagccttcggagaccctgtccctcacctgtactgtctctggtggctccgtcactggttaccactggagctggatccggcagcccccagggaaggactggagtggattggctatatttcttacagtggccgcaccaactcccacccctcctcaagagtcgagccaccatatcagtcgacacgtccaaagaaccagttcctccctagaaacctgacggtctgtgaccgcagcggacacggccgtgtattacgtgtgcgtagagaggtcccgggtacgatacgtccgtagggtcccgttccggacccccgtgggggtacccaacggggtaacccccgttgggtacccgtaacccggttcctccccgtacgaccgtccctacccgaacccgaaccgggtccccaacgttcccggttaccccttccccccgtcgggccccgtcccccgttcgggccccttacccgaacgggtacccgcccgtaaccccgttcccggaacggtaccgacccgaaccggtaccggccccgggtacccccggtggggcccttaccggccccgttacgggtacccgaaacgggttcccttaccgtttcccccggaaccggg

SEQ ID NO: 276756 - DNA, 299 bp, Homo sapiens
  misc_feature: GYAE6OF01BXL2G.22.34.D01.1.454.CMB.1.raw
  modified_base (294)..(299): a, c, t, g, unknown or other
  misc_feature (294)..(299): n is a, c, g, or t
tcagacatacgcgtcacgaccggtgctcgatttagatcgtctgtgaccgcagcggacacggccgtgtattactgtgcgagagagtccgggtccgatatctggccgttcgacccctggggccagggaacctcggtcaccgtctcctcagcctcccaccaacgggcccgactcggtccgttccccctcggcgccctcgctccaggagcacctccgagagcacagcggcccgtgggcgtgcctcggtcaaggactacttccacgcgtatgtctgagcgggctggcaaggcgcatagnnnnnn

SEQ ID NO: 276757 - DNA, 593 bp, Homo sapiens
  misc_feature: GYAE6OF01B9J6Y.22.34.D01.1.454.CMB.1.raw
  modified_base (511)..(511): a, c, t, g, unknown or other
  misc_feature (511)..(511): n is a, c, g, or t
tcagacatacgcgtcacgaccggtgctcgatttagatcgtctgtgttgggtttggggggaagaggaagactgacggtcctgtcccaggtgcagctgcaggagtcgggcccaggactggtgaagccttcggagaccctgtccctcacctgtactgtctctggtggctccgtcactggttaccactggagctggatccggcagcccccagggaagggactggagtggattggctatatttcttacagtggccgcaccaactccccacccctccctcaagagtcgagccaccatatcagtcgacacgtccaagaaccagttctccctgaaacctgaggtctgtgaccgcagcggacacggccgtgtattactgtgcgagagagtccgggtcgatatcgtcggccgttcgaccccgtgggcccagggaccctggtccaccgtctcctcacgccctccaccgaacgggcccagtccggtcccttcccccgtggcccgccctcgcctccgacggacnccacctccggacgacgccacgacgccgggcccgtgggcctcggcccgtcggtaccgaaggtaccctaccgttcccgaaccgg

SEQ ID NO: 276758 - DNA, 285 bp, Homo sapiens
  misc_feature: GYAE6OF01B6K2L.22.34.D01.1.454.CMB.1.raw
  modified_base (282)..(285): a, c, t, g, unknown or other
  misc_feature (282)..(285): n is a, c, g, or t
tcagacatacgcgtcacgaccggtgctcgatttagatcgtctgtgaccgcagcggacacggccgtgtattactgtgcgagagagtccgggtccgatatctggccgttcgacccctggggccagggaaccctggtcaccgtctcctcagcctccaccaagggcccatcggtcttcccctggcgccctgctccaggagcacctccgagagcacagcggccctgggctgcctggtcaaggactacttccacgcgtatgtctgagcgggctggcaaggcgcatagnnnn

SEQ ID NO: 276759 - DNA, 580 bp, Homo sapiens
  misc_feature: GYAE6OF01AUAQ7.22.34.D01.1.454.CMB.1.raw
  modified_base (318)..(318): a, c, t, g, unknown or other
  misc_feature (318)..(318): n is a, c, g, or t
tcagacatacgcgtcacgaccggtgctcgatttagatcgtctgtgttgggtttgggggaagaggaagactgacggtcctgtcccaggtgcagctgcaggagtcgggcccaggactggtgaagccttcggagaccctgtccctcacctgtactgtctctggtggctccgtcactggttaccactggagctggatccggcagcccccagggaagggactggagtggattggctatatttcttacagtggccgcaccaactcccacccctccctcaagagtcgagccaccatatcagtcgacacgtccaagaaccagttcnccctgaaactgaggtctgtgaccgcagcggacacggccgtgtattactgtgcgagagagtcccgggtccgatatctggccgttcgacccctgggccagggaaccctggtcaccgtctcctcacgcctccaccaacgggcccactccggtccttcccccgtggccgcccctgcctccacggacgccaccctcccgagacgccaccgacgccggcccctggggcctcggccctcgggtccaaggaccttaccgttcccgaccgg

SEQ ID NO: 276760 - DNA, 579 bp, Homo sapiens
  misc_feature: GYAE6OF01DY6Q6.22.34.D01.1.454.CMB.1.raw
  modified_base (292)..(292): a, c, t, g, unknown or other
  misc_feature (292)..(292): n is a, c, g, or t
tcagacatacgcgtcacgaccggtgctcgatttagatcgtctgtgttgggtttggggggaagaggaagactgacggtcctgtcccaggtgcagctgcaggagtcgggcccaggactggtgaagccttcggagaccctgtccctcacctgtactgtctctggtggctccgtcactggttaccactggagctggatccggcagcccccagggaagggactggagtggattggctatatttcttacagtggccgcaccaactcccacccctccctcaagagtcgagccaccatancagtcgacacgtccaagaaccagttctccctgaactgaggtctgtgaccgcagcggacacggccgtgtattactgtgcgagagagtccgggtccgatatctcggccgttcgaccccgtggggcccagggaccctggtccaccgtctcctcacgcctaccgacccgaacggcccatccggtccttcccccgtggcccgccctcgcctccgacggacgccaccctccgagacgccacgacggcccggcccgtgggcctgcccgtggtacaaggccttacgtccgaccgg

SEQ ID NO: 276761 - DNA, 847 bp, Homo sapiens
  misc_feature: GYAE6OF01EQW7Q.22.34.D01.1.454.CMB.1.raw
  modified_base (405)..(405): a, c, t, g, unknown or other
  misc_feature (405)..(405): n is a, c, g, or t
tcagacatacgcgtcacgaccggtgctcgattttagatcgtctgtgttgggggtttggggggaagaggaagacctgacggtacctgtcccaggtgccagctgcacggagtcgggcccaggacctggtgaacgcctttcgggagaccctgtcccgtcgacctcgtacttgttctcgtggtggctccgtcactggttaccactggagctggactccggcacgcccccgagggaagggactgggaggtgggatttgggcgttaagttaagtttacgttaccgtagggtcggcccgacaccgaacctccccacccctccctacaagacgtccgacgccaaccatagtcaacgtcgacacgtccaacgaacctgttctcccgtagaaacgtcgaggtcgtggtcgaccgngaggcggacgacggcgtagtacttacgtgtgcgagacgacggtccgggtaccgagttacgtcgtagggtcccgtttaccggacccccgttgggggacccaacgggggtaaccccttgggtacccgaacccggttccgttcccgtaccgaacggtcccccgtacccgaaacccggtaaccggggaccccctacggtttaccccggggttacccctttaccccccggtaccggggtacccccggtacccccgtacggtcccgtttaacccggaagggtacccgtacccgtaaccccgggtacccggaacggtacccggtaccgtaaccggtaacgggtccccgggaccccggtaccggggacccgttcggggaccccgggttacgggggtaaccccgttaaaaccggggttacccctttaaaccggtttccccggaaacccggg

SEQ ID NO: 276762 - DNA, 659 bp, Homo sapiens
  misc_feature: GYAE6OF01CZ3P4.22.34.D01.1.454.CMB.1.raw
  modified_base (351)..(351): a, c, t, g, unknown or other
  misc_feature (351)..(351): n is a, c, g, or t
  modified_base (554)..(554): a, c, t, g, unknown or other
  misc_feature (554)..(554): n is a, c, g, or t
tcagacatacgcgtcacgaccggtgctcgatttagatcgtctgtgttgggtttggggggaagaggaagactgacggtcctgtcccaggtgcagctgcaggagtcgggcccaggactggtgaagccttcggagaccctgtccctcacctgtactgtctctggtggctccgtcactggttaccactggagctggatccggcagccccgagggaagggactggagtggattggctatatttcttacagtggccgcaccaactcccacccctcctcaacgagtcgacgccaaccatatcagtcgacacgtcaagaaccagttcctaccctagaaacctggacgtctgtcgaccgngacgcggacacggccgtgtatacgtgtcgcgagaggacggtccgggtacatagtcgtcggtcccgttccgacccgtggggaccgacggggaacccctgggtaccctaccgtcctcctcgaccgtcccgtacccgaccgaacgggcccctacgttccggtacccttccccgtcggcccgtcccctgtccctcccgacgggaccnccgacccgtccgacgtacgaccgaccgacgggcccggccccgtcggggcccttacgggccccgtacgggtacccaaagggtcccttaacccgttcccgtaaccgg

SEQ ID NO: 276763 - DNA, 614 bp, Homo sapiens
  misc_feature: GYAE6OF01CY6KX.22.34.D01.1.454.CMB.1.raw
  modified_base (293)..(293): a, c, t, g, unknown or other
  misc_feature (293)..(293): n is a, c, g, or t
tcagacatacgcgtcacgaccggtgctcgatttagatcgtctgtgttgggtttggggggaagaggaagactgacggtcctgtcccaggtgcagctgcaggagtcgggcccaggactggtgaagccttcggagaccctgtccctcacctgtactgtctctggtggctccgtcactggttaccactggagctggatccggcacgcccccgagggaagggactggagtggattggctatatttcttacagtggccgcaccactcccacccctcctcaagagtcgacgccaccatancagtcgaacacgtaccaagaaccagttcctccctagaaactggaggtctgtcgaccgcagccggacacggccgtgtattactgtgcgagagacgtcccgggtccgatacgtcgtcggtcccgttccggaaccccgtggggcccgaacggggacccctgggtaccctacccggtctccctcgacgccctacccacccgaacgggcccctagtccgtccttccccgtcggccgcccgtgcctccgagacgccaccgtccgagacgccacgacggccggcccgtgggacctcggccgtggaccacggacttccgtccgtaccgg

SEQ ID NO: 276764 - DNA, 590 bp, Homo sapiens
  misc_feature: GYAE6OF01C9HHE.22.34.D01.1.454.CMB.1.raw
  modified_base (353)..(353): a, c, t, g, unknown or other
  misc_feature (353)..(353): n is a, c, g, or t
  modified_base (379)..(379): a, c, t, g, unknown or other
  misc_feature (379)..(379): n is a, c, g, or t
  modified_base (553)..(553): a, c, t, g, unknown or other
  misc_feature (553)..(553): n is a, c, g, or t
  modified_base (566)..(566): a, c, t, g, unknown or other
  misc_feature (566)..(566): n is a, c, g, or t
tcagacatacgcgtcacgaccggtgctcgatttagatcgtctgtgttgggtttggggggaagaggaagactgacggtcctgtcccaggtgcagctgcaggagtcgggcccaggactggtgaagccttcggagaccctgtccctcacctgtactgtctctggtggctccgtcactggttaccactggagctggactccggcacgcccccgagggaaggactggagtggattggctatatttcttacagtggccgcaccaacctccccacccctccctacaagacgtccgagccaaccatactcagtcgacacgtcaaagaccagttcctcctagaaactgagtctgtcgaccgnacgcgacacggccgtgtacttactgngacgagagacgtccgggtacatactcgtacggcccgttccgacccgtggggacccgacgggtaacccctcgggtacctacccgtcctacccgtacgaccgtccctaccgaaccgacgggccctacgtccgttcctccccgtgcccgccctgcctccgagcgccaccgtcgagcncacgcgccgccgnggctcgctggacagctcgtcgacg

SEQ ID NO: 276765 - DNA, 287 bp, Homo sapiens
  misc_feature: GYAE6OF01EVXN9.22.34.D01.1.454.CMB.1.raw
  modified_base (283)..(287): a, c, t, g, unknown or other
  misc_feature (283)..(287): n is a, c, g, or t
tcagacatacgcgtcacgaccggtgctcgatttagatcgtctgtgaccgcagcggacacggccgtgtattactgtgcgagagagtccgggtccgatatctggccgttcgacccctggggccagggaaccctggtcaccgtctcctcagcctccaccaagggcccatcggtcttccccctggcgccctgctccaggagcacctccgagagcacagcggccctgggctgcctggtcaaggactacttccacgcgtatgtctgagcgggctggcaaggcgcatagnnnnn

SEQ ID NO: 276766 - DNA, 587 bp, Homo sapiens
  misc_feature: GYAE6OF01ER1DE.22.34.D01.1.454.CMB.1.raw
tcagacatacgcgtcacgaccggtgctcgatttagatcgtctgtgttgggtttggggggaagaggaagactgacggtcctgtcccaggtgcagctgcaggagtcgggcccaggactggtgaagccttcggagaccctgtccctcacctgtactgtctctggtggctccgtcactggttaccactggagctggatccggcagcccccagggaagggactggagtggattggctatatttcttacagtggccgcaccaactcccacccctccctcaagagtcgagcccaccatatcagtcgacacgtccaagaaccagttctccctgaaactgaggtctgtgaccgcagcggacacggcctgtattactgtgcgagagagtcccgggtcgatatctggcccgttcgaccccgtggggccagggaccctggtcaccgtctcctcacgcctccaccgacggcccagtccgtccttcccccgtggccgccctcgcctcccgaggacgccaccctccgacgacgccaccgacggcccggccccgtgggcctcggcccgtggtaccgaaaggacccttaccgttcccgaaccgg

SEQ ID NO: 276767 - DNA, 583 bp, Homo sapiens
  misc_feature: GYAE6OF01AK04N.22.34.D01.1.454.CMB.1.raw
tcagacatacgcgtcacgaccggtgctcgatttagatcgtctgtgttgggtttgggggaagaggaagactgacggtcctgtcccaggtgcagctgcaggagtcgggcccaggactggtgaagccttcggagaccctgtccctcacctgtactgtctctggtggctccgtcactggttaccactggagctggatccggcagcccccagggaagggactggagtggattggctatatttcttacagtggccgcaccaactcccacccctcctcaagagtcgagccaccatatcagtcgacacgtccaagaaccagttctccctgaaactgaggtctgtgaccgcagcggacacggccgtgtattactgtgcgagagagtccgggtcatatcgtggccgttcgacccgtggggccacgggaaccctggtccaccgtctcctcacgccctccaccgaacggcccacgtccggtccttcccccgtggccgccctgccctccgacggcgccaccctccgacgacgccacgacggccggcccgtgggcctcggcccgttgggtaccaaggaccttaccgttcccgaccgg

SEQ ID NO: 276768 - DNA, 732 bp, Homo sapiens
  misc_feature: GYAE6OF01BJLG2.22.34.D01.1.454.CMB.1.raw
tcagacatacgcgtcacgaccggtgctcgatttagatcgtctgtgttgggtttggggggaagaggaagactgacggtcctgtcccaggtgcagctgcaggagtcgggcccaggactggtgaagccttcggagaccctgtccctcacctgtactgtctctggtggctccgtcactggttaccactggagctggatccggcacgcccccgagggaagggactggagtggattggctatatttcttacagtggccgcaccaacctccccacccctccctacaagacgtcgacgccaaccatatcagtcgacacgtaccaaagaaccagttcctccctagaaacctgacggtctggtacgaccgcgacggccggaaccgaccgggccgttaggttaacttaccgtggtacggcggaaggaggacggtcccggggtccgagttactcgtcgggcccgtttaccggaccccggttcggggacccgtaacggggtaaccccgttgggtacccacccgggttcctacccgtccgaccgtccctacccgaacccgaaccggggcccctaacggttcccggttcccctttcccccggcgggccccgtcccccgtcggtccctacccggaggaccgccctacccgtccggaagccgaccgaccgacgggtccccggacccggtcggggcccttcggcccgtcgggtaaccctaacggtcccttaaccgttcccggtaacccgg

SEQ ID NO: 276769 - DNA, 588 bp, Homo sapiens
  misc_feature: GYAE6OF01CKLMS.22.34.D01.1.454.CMB.1.raw
  modified_base (494)..(494): a, c, t, g, unknown or other
  misc_feature (494)..(494): n is a, c, g, or t
tcagacatacgcgtcacgaccggtgctcgatttagatcgtctgtgttgggtttgggggaagaggaagactgacggtcctgtcccaggtgcagctgcaggagtcgggcccaggactggtgaagccttcggagaccctgtccctcacctgtactgtctctggtggctccgtcactggttaccactggagctggatccggcagcccccagggaagggactggagtggattggctatatttcttacagtgccgcaccaactccccacccctccctcaagagtcgagccaccatatcagtcgacacgtccaagaaccagttctccctgaaactgagtctgtgaccgcagcggacacggccgtgtacttacgtgtgcgagagagtccgggtccatatcgtgggcccgttcgaccccgtggggacccacggggaaccctgggtcaccgtctcctcacgccctccaccgaacgggccccagtccggtccttccccgtggccnccccgtcgcctccgaggacgccacccgtccgagcgaccacgacgccgcccgtcgggcctcgcccgttggacaagggaccttccgttcccgacgg

SEQ ID NO: 276770 - DNA, 732 bp, Homo sapiens
  misc_feature: GYAE6OF01A0PGK.22.34.D01.1.454.CMB.1.raw
tcagacatacgcgtcacgaccggtgctcgatttagatcgtctgtgttgggtttggggggaagaggaagactgacggtcctgtcccaggtgcagctgcaggagtcgggcccaggactggtgaagcctttcggagaccctgtccctcacctgtactgtctctggtggctccgtcactggttaccactggagctggatccggcagccccagggaggactggagtggattggctatactttctacagtggccgcaccgaactccccacccctcctacaacgtacgtccgacgccaccatatccagtcgacacgtaccaacgaacctagttcctcctagaaactggagtctgtcgaccgcgagcggacacggtccgtagtacgttactggtcgcgagacggtcggtccgggtcgattacgtcgtcggtcccgttacgaccccgtgggaccacggggtaaccctcgggttacctaaccggttcctaccgttaccgacgtaccccgttacccgaacccggtaaaccgggtcccctaacggttacccggttcccgtttacccccgtcgggtaccccgtcccgttacggttaccgtaccccggacggtaaccgcccgtaacccggtccggaacggtacccggaccgtaacccggtacgggtcccggtacccggttcggggtacccgttacggcccggttacgggtaccgtaacgggtccctttacccgtccggtaacccgg

SEQ ID NO: 276771 - DNA, 651 bp, Homo sapiens
  misc_feature: GYAE6OF01CF2FI.22.34.D01.1.454.CMB.1.raw
  modified_base (276)..(276): a, c, t, g, unknown or other
  misc_feature (276)..(276): n is a, c, g, or t
tcagacatacgcgtcacgaccggtgctcgatttagatcgtctgtgttgggtttgggggaagaggaagactgacggtcctgtcccaggtgcagctgcaggagtcgggcccaggactggtgaagccttcggagaccctgtccctcacctgtactgtctctggtggctccgtcactggttaccactggagctggatccggcagcccccgagggaagggactggagtggattggctatatttcttacagtggccgcaccaactcccacccctcctcaagngtcgagccaccatatcagtcgacacgtccaagaaccagttcctccctagaaactgaaggtctgtcgaccgcaggcggacacggccgtgtacttacgtgtgcgagagacggtcccgggtacgattactcgtcgggtcccgttccgaccccggtggggcccgaacggggaaccccgttgggtacccgacccgttcctccgtccacgtccctaccacccgaacgggccccagttccggtcccttcccccgtcgggcccgtcccctcgccctccgacgggacgcccacccgtccggagacgaccgacgacggcccggccccgtggggccctcggtcccggttcggtaccgaaacgggtacccttaccgttcccgaccgg

SEQ ID NO: 276772 - DNA, 589 bp, Homo sapiens
  misc_feature: GYAE6OF01A1Z00.22.34.D01.1.454.CMB.1.raw
  modified_base (311)..(311): a, c, t, g, unknown or other
  misc_feature (311)..(311): n is a, c, g, or t
  modified_base (350)..(350): a, c, t, g, unknown or other
  misc_feature (350)..(350): n is a, c, g, or t
  modified_base (365)..(365): a, c, t, g, unknown or other
  misc_feature (365)..(365): n is a, c, g, or t
tcagacatacgcgtcacgaccggtgctcgatttagatcgtctgtgttgggtttgggggaagaggaagactgacggtcctgtcccaggtgcagctgcaggagtcgggcccaggactggtgaagccttcggagaccctgtccctcacctgtactgtctctggtggctccgtcactggttaccactggagctggatccgggcagcccccagggaaggactggagtggattggctatattcttacagtggccgcaccaactcccacccctcctcaagagtcgagccaccatatcagtcgacacgtccaagaaccngttctccctagaaactgaggtctgtgaccgcagcggacncggccgtgtattacngtgcgagagagtccgggtccgattacgtctgggccctttcgaccccgtgggcccacgggaaccctggtccaccgtctccgtcacgcctccaccacggcccagtccgtccttccccgtgccgccctgccgttcccgaggacgccacccgtccgacgtcgcctacgacgcccgggtccctggggccctggcccttcggtccgaaggacccttaccgttccgaccgg

SEQ ID NO: 276773 - DNA, 678 bp, Homo sapiens
  misc_feature: GYAE6OF01CPUDQ.22.34.D01.1.454.CMB.1.raw
tcagacatacgcgtcacgaccggtgctcgatttagatcgtctgtgttgggtttggggggaagaggaagactgacggtcctgtcccaggtgcagctgcaggagtcgggccccaggactggtgaagccttcggagaccctgtccctcacctgtactgtctctggtggctccgtcactggttaccactggagctggatccggcacgcccccgagggaagggactggagtggattggctattatttcttacagtggccgcaaccaactccccacccctccctcaagacgtcgacgccaaccatactcagtcgacacgtaccaaagaaccagttcctccctagaaaacctgacggtctgtgacccgcaggcggaccacggccgtagtacttactgtgcgagtagaggtccgggtcatactcgtcggccgttccgacccgtggggcctacgggaccctcggtccaccggtctccgtcgaccgtccctaccgaaccgaaccgggtcccaacgtttcccggtaccctttccccccgtacggccccgtccccgtcgcccgttacccgacggaccgtacccgaacccgttcccggaacgtacgacccgaaccgtaacggccccggtcccgtacgggccgttacgcccggtacggtaccgaaaggtaccccttacgtttcccgaaccgg

SEQ ID NO: 276774 - DNA, 585 bp, Homo sapiens
  misc_feature: GYAE6OF01E47YB.22.34.D01.1.454.CMB.1.raw
  modified_base (487)..(487): a, c, t, g, unknown or other
  misc_feature (487)..(487): n is a, c, g, or t
tcagacatacgcgtcacgaccggtgctcgatttagatcgtctgtgttgggtttggggggaagaggaagactgacggtcctgtcccaggtgcagctgcaggagtcgggcccaggactggtgaagccttcggagaccctgtccctcacctgtactgtctctggtggctccgtcactggttaccactggagctggatccggcagcccccagggaagggactggagtggattggctatatttctacagtggccgcaccaactcccacccctccctcaagagtcgagcccaccatatcagtcgacacgtccaagaaccagttctccctgaaactgaggtctgtcgaccgcagcggacacggccgtgtattactgtgcgagagacgtccgggtccgatatctgggcccgttcgaccccgtggggccacgggaaccctggtcaccgtctcctcacgccctccaccgaacgggcccacgtccggtccttccccgnggccgccctcgcctccgacggacgccacctccgagacgccacgcggccggcccgtcgggcctcgcccgtggtaccgaaggtcctaccgttccgaccgg

SEQ ID NO: 276775 - DNA, 625 bp, Homo sapiens
  misc_feature: GYAE6OF01ERUXL.22.34.D01.1.454.CMB.1.raw
  modified_base (494)..(494): a, c, t, g, unknown or other
  misc_feature (494)..(494): n is a, c, g, or t
tcagacatacgcgtcacgaccggtgctcgatttagatcgtctgtgttgggtttggggggaagaggaagactgacggtcctgtcccaggtgcagctgcaggagtcgggcccaggactggtgaagccttcggagaccctgtccctcacctgtactgtctctggtggctccgtcactggttaccactggagctggatccggcacgcccccagggaagggactggagtggattggctatatttcttacagtggccgcaccaacctccccacccctccctcaagcgtcgagcccaccatatcagtcgacacgtaccaagaccagttcctccctgaaactgaggtctgtcgaccgcagccggacacggccgtagtattacgtgtgcgagagacggtcccgggtaccgatactcgtcggccgttcgaccccgtggggcccagggaccctgggtccaccgtctcctcacgcctccacgacggcccagtccgtccttccccgnggcctcccgtgcctccgacggacgtccacccgtccggacgacgaccacccgacggccccgggccccgtggggccctcggccccggttgggttacccgaagggttaccccttaccgttccccgtaacccggg

SEQ ID NO: 276776 - DNA, 287 bp, Homo sapiens
  misc_feature: GYAE6OF01CPI4P.22.34.D01.1.454.CMB.1.raw
  modified_base (283)..(287): a, c, t, g, unknown or other
  misc_feature (283)..(287): n is a, c, g, or t
tcagacatacgcgtcacgaccggtgctcgatttagatcgtctgtgaccgcagcggacacggccgtgtattactgtgcgagagagtccgggtccgatatctggccgttcgaccctggggccagggaaccctggtcaccgtctcctcagcctccaccaaggcccatcggtcttccccctggcgccctgctccaggagccacctccgagagcacagcggccctgggctgcctggtcaaggtactacttccacgcgtatgtctgagcgggctggcaaggcgcatagnnnnn

SEQ ID NO: 276777 - DNA, 589 bp, Homo sapiens
  misc_feature: GYAE6OF01A8CD4.22.34.D01.1.454.CMB.1.raw
  modified_base (348)..(348): a, c, t, g, unknown or other
  misc_feature (348)..(348): n is a, c, g, or t
  modified_base (373)..(373): a, c, t, g, unknown or other
  misc_feature (373)..(373): n is a, c, g, or t
  modified_base (381)..(381): a, c, t, g, unknown or other
  misc_feature (381)..(381): n is a, c, g, or t
tcagacatacgcgtcacgaccggtgctcgatttagatcgtctgtgttgggtttggggggaagaggaagactgacggtcctgtcccaggtgcagctgcaggagtcgggcccaggactggtgaagccttcgggagaccctgtccctcacctgtactgtctctggtggctccgtcactggttaccactggagctggatccggcacgcccccagggaagggactggagtggattggctatatttcttacagtggccgcaccaactcccacccctccctcaagagtcgagcccaccatatcagtcgacacgtccaagaaccagttctccctagaaactgaggtctgtgaccgnagcggacacggccgtgtattactgngcgagagngtccgggtcatactcgtggccgttcgaccccgtgggccgacgggaaccctggtccaccgtctcctcacgcctccaccgacggcccacgtcggtcccttccccgtggcccgccctcgcctccgaggacgccacccgtccgacgacgccaccgcgcccggacccgtcgggcctcggccgtcggtacgaagggtccttaccgtcctaccgg

SEQ ID NO: 276778 - DNA, 630 bp, Homo sapiens
  misc_feature: GYAE6OF01DGNBO.22.34.D01.1.454.CMB.1.raw
  modified_base (376)..(376): a, c, t, g, unknown or other
  misc_feature (376)..(376): n is a, c, g, or t
tcagacatacgcgtcacgaccggtgctcgatttagatcgtctgtgttgggtttggggggaagaggaagactgacggtcctgtcccaggtgcagctgcaggagtcgggcccaggactggtgaagccttcggagaccctgtccctcacctgtactgtctctggtggctccgtcactggttaccactggagctggatccggcacgcccccgagggaagggactggagtggattggctatatttcttacagtggccgcaccaactccccacccctccctcaacgacgtcgacgccaccatactcagtcgacacgtccaagaaccagttctccctagaaactgaggtctgtcgaccgcagcggacacggccgtgtattacngtgcgagagacgtccgggcgatacgtcgtcggcccgttcggaccccgtggggcccgaacggggtaaccccgtcggtaccaccgtcctccctcgacgccctacccaacccgaacgggccccacgtcccggttcccttcccccgtcggcccgccccgtcgccctccgacggacgccacccgtccgacgacgccaccgacggcccggcccgtcgggcctcggcccgtcggtaccaaggtacctccgttccgaaccgg

SEQ ID NO: 276779 - DNA, 833 bp, Homo sapiens
  misc_feature: GYAE6OF01DNFAU.22.34.D01.1.454.CMB.1.raw
  modified_base (362)..(362): a, c, t, g, unknown or other
  misc_feature (362)..(362): n is a, c, g, or t
  modified_base (378)..(378): a, c, t, g, unknown or other
  misc_feature (378)..(378): n is a, c, g, or t
tcagacatacgcgtcacgaccggtgctcgatttagatcgtctgtgttgggtttggggggaagaggaagactgacggtcctgtcccaggtgcagctgcaggagtcgggcccaggactggtgaagcccttcggagaccctgtccctcacctttactgtctctggtgctccgtcactggttaccactggagctggatccggcacgcccccgagggaagggactggagtggattggctatatttcttacagtggccgcaccaacctcccacccctccctcaagacgtcgacgcccaaccatatcagtcgacacgtccaagaaccagttcctcctagaaactgaggtctgtcgaccgcagccggacncggccgtagtattacnggtgcgagagcggtccgggtacatacgtcgtcgggtcccgttaccggaccccgtcggggacccgtaaccggggtaaaccccgtcgggttaacccgtaccccggttcccgtacccgttaccgaccgtcccccgttacccgaaacccccgggtaaaccgggggtaccccccttaaccgggtttccccgggtttaacccccccgttttccccccccgggtttacggggaccccccggttcccccggttacccggtacccccgtttaccccgggaaccggggttaaccccggaccccgtaacccccgttaccccgggaaaccgggtaccgacccgaaccccgggaaccgggcccccgggttcccccgggtcggggtccccgtccgggtcccccggttacggggttaacccgaaacgggttacccctttaacccggttaccccgtacccgggttacccgg

SEQ ID NO: 276780 - DNA, 292 bp, Homo sapiens
  misc_feature: GYAE6OF01CX8UI.22.34.D01.1.454.CMB.1.raw
  modified_base (285)..(292): a, c, t, g, unknown or other
  misc_feature (285)..(292): n is a, c, g, or t
tcagacatacgcgtcacgaccggtgctcgatttagatcgtctgtgaccgcagcggacacggccgtgtattactgtgcgagagagtccggttccgatatctggccgttcgaccctggggccagggaaccctggtcaccgtctcctcagcctccaccaagggcccatcggtcttcccctggcgccctgctccaggagcacctccgagagcacagcggccctgggctgcctggtcaaggactacttccacgcgtatgtctggagcgggctggcaagggcgacagtagnnnnnnnn

SEQ ID NO: 276781 - DNA, 635 bp, Homo sapiens
  misc_feature: GYAE6OF01A2CWR.22.34.D01.1.454.CMB.1.raw
  modified_base (345)..(345): a, c, t, g, unknown or other
  misc_feature (345)..(345): n is a, c, g, or t
  modified_base (363)..(363): a, c, t, g, unknown or other
  misc_feature (363)..(363): n is a, c, g, or t
tcagacatacgcgtcacgaccggtgctcgatttagatcgtctgtgttgggtttggggggaagaggaagactgacggtcctgtcccaggtgcagctgcaggagtcgggcccaggactggtgaagccttcggagaccctgtccctcacctgtactgtctctggtggctccgtcactggttaccactggagctggatccggcagcccccgagggaagggactggagtggattggctatatttcttacagtggccgcaccaactcccacccctccctcaagagtcgagccacatatcagtcgacacgtccaagaaccagttcctcctagaaactgaggtctgtgaccgnagccggacaccggccgtntattactgtgcgagagacggtccgggtccgatacgtcgtcgggtcccgttccggaccccgtggggcccgaacggggtaacccctcgggtacccacccgttcctcccgtcaacgccctaccacccgaacgggcccctacgtcccggttcccttcccccgtggccccgtcccgtcgcccgtcccgagggtaccgccgacccgttccggagaccgcaccgacggcccgggccctggacctcggcccgtcggacgaacggcttaccgtccgaccgg

SEQ ID NO: 276782 - DNA, 767 bp, Homo sapiens
  misc_feature: GYAE6OF01A68HW.22.34.D01.1.454.CMB.1.raw
tcagacatacgcgtcacgaccggtgctcgatttagatcgtctgtgttgggtttggggggaagaggaagactgacggtcctgtcccaggtgcagctgcaggagtcgggcccaggactggtgaagccttcggagaccctgtccctcacctttactgtctctggtggctccgtcactggttaccactggagctggatccggcacgcccccgagggagggactggagtggattggctatattcttacagtggccgcaccaactcccacccctcctcaagacgtcgagccaccatatcagtcgacacgtccaaagaccagttcctaccctgaaacctgaggtctgtcgaccgcaggcggaccacggccgtgtacttacgtgtagacggagacggtacggtcccgggtaccgattacgtcgtacgggtcccgtttaccggacccccggttggggaccccgtaacggggaaccccgttgggtacccgtacccggttccctccgtaccgaaccgtccctacccgaaccgaaccgggcccctaacgttccccgggttacccttccccccggtcgggccccgtacccccgttccggtccccgttaccccgacgggtacccgtacccgtaaccccgttcccgggaacgaccggacccgaaccggaccgggtccccgggtaccccggttcggggtcccgtaccgggtccccggttaccggggttaacccaaaccggggttacccctttaacccgttccccgggtaacccggtacccggg

SEQ ID NO: 276783 - DNA, 628 bp, Homo sapiens
  misc_feature: GYAE6OF01AHY1S.22.34.D01.1.454.CMB.1.raw
tcagacatacgcgtcacgaccggtgctcgatttagatcgtctgtgttgggtttggggggaagaggaagactgacggtcctgtcccaggtgcagctgcaggagtcgggcccaggactggtgaagccttcggagaccctgtccctcacctgtactgtctctggtggctccgtcactggttaccactggagctggatccggcagccccagggaagggactggagtggattggctatatttctacagtggccgcaccaactcccacccctcctcaagacgtcgagccaccatatcagtcgacacgtccaagaaccagttcctccctagaaactgaggtctgtcgaccgcagcggacacggccgtgtattacgtgtcgcgagaggacggtccgggtccatacgtcgtcgggcccgttccggaccccgtggggcccaacggggtaacccctgggtacccaccgtcctcccgtcgaccgtccctacccgaacccgaacgggcccctacgttccggtcccttcccccgtggcccgcccgtgccctccgacggtacgccacccgtccgacggacgccacgacggccggcccgtcgggcctcggcccgtggtaccgaaggtccttccgtcccgtacgg

SEQ ID NO: 276784 - DNA, 771 bp, Homo sapiens
  misc_feature: GYAE6OF01CQY8U.22.34.D01.1.454.CMB.1.raw
  modified_base (277)..(277): a, c, t, g, unknown or other
  misc_feature (277)..(277): n is a, c, g, or t
tcagacatacgcgtcacgaccggtgctcgatttagatcgtctgtgttgggtttggggggaagaggaagactgacggtcctgtcccaggtgcagctgcaggagtcgggcccaggactggtgaagccttcggagaccctgtcctcacctgtactgtctctggtggctccgtcactggttaccactggagctggactccggcacgccccgagggaagggactgggagtggattggcttatatttcttacagtcggccgcaaccacctcccaccctcctanaacgacgtcgacgccaaccatactccagtacgacctaccgtaccaaacgaacctagttaccctcccgtaagtaaaacgtcggaacggttcctaggtacggaacccgcgacggaccggaaccgcgggtaccgttaggttaacgttacgttggtacggacgaaggtacggtacgggttcccgggtaccgtaagttacggttcgtccgggcccggtttaccggaccccggtcggggaccgaccgggtaacccgtcggtacccgtaacccggtctacccgtacaccggtcccttacccgaaaccgtaacccgggccctaaccggttacccgttcccttacccccggtcgcccgtccccgttaccggtaccttacccgggacggtaaccgccgtaacccggttccgaacgtccgaccgaccgccggacccgggcccggttacgggcccgttcgacccggtcggtaccgtaaaccggtccttaaccgtcccgtacccggg

SEQ ID NO: 276785 - DNA, 738 bp, Homo sapiens
  misc_feature: GYAE6OF01CMOSL.22.34.D01.1.454.CMB.1.raw
tcagacatacgcgtcacgaccggtgctcgatttagatcgtctgtgttgggtttgggggaagaggaagactgacggtcctgtcccaggtgcagctgcaggagtcgggcccaggactggtgaagccttcggagaccctcgtccctcacctgtactgtctctggtggctccgtcactggttaccacgtggagcgtggactccggcacgccccgaggggaaggacgtggaggtggtagttggcttattactttacttacgaggtcggccgaccaaccctaaccctcccccaccccttacccgtacgaaacggtacgtccgacgacccaaccaatacgtcacgtaccgaccgtaccgtaaccaaacgaacctacggttcctaccgtagaaacgtgtacgtcgtcgtacgaccgtacgacggacggaccgacggtccgtagttacttacgtgtcgacgaggtacggacggtccggtacgtagtacgtcggtcggtccggttcccgacccgggtaccggggaccgtaacgggtacccgttcgggtacccgtaccgtcctccgtaccaccgtccctacccgaaccggaccggtccctacgttcccgtcccgttccccgcgggtccctcccgtcgtccgtaccggacgtccgacccgaccgtccgacgcgaccgacggtcggcccggtcggtccgggtcctcgggaccgtaccggtaacgacccggttaacctccgtacccgtacgg

SEQ ID NO: 276786 - DNA, 354 bp, Homo sapiens
  misc_feature: GYAE6OF01D1XUG.22.34.D01.1.454.CMB.1.raw
  modified_base (334)..(334): a, c, t, g, unknown or other
  misc_feature (334)..(334): n is a, c, g, or t
  modified_base (340)..(354): a, c, t, g, unknown or other
  misc_feature (340)..(354): n is a, c, g, or t
tcagacatacgcgtcacgaccggtgctcgatttagatcgtctgtgaccgcagcggacacggccgtgtattactgtgcgagagagtccgggtccgatatctggccgttcgacccgtggggccagggaccctggtcaccgtctcctcacgcctccaccgaacgggcccagtccggtcccttcccccgtggccgccctgcctccgagggacgccacccgtccgagacgccacgaggccggtcccgtgggcctggcccgtgggtaccaaacggtaccttaaccgttcccgacggtccgttatcgtccgtggacggcgggctaggaccgaagggccganataggnnnnnnnnnnnnnnn

SEQ ID NO: 276787 - DNA, 288 bp, Homo sapiens
  misc_feature: GYAE6OF01A21GI.22.34.D01.1.454.CMB.1.raw
  modified_base (284)..(288): a, c, t, g, unknown or other
  misc_feature (284)..(288): n is a, c, g, or t
tcagacatacgcgtcacgaccggtgctcgatttagatcgtctgtgaccgcagcggacacggccgtgtattactgtgcgagagagtccgggtccgatatctggccgttcgacccctggggccagggaaccctggtcaccgtctcctcagcctccaccaagggcccatcggtcttccccctggccgccctgctccaggagcacctccgagagcacagcggccctgggctgcctggtcaaggactacttccacgcgtatgtctgagcgggctggcaaggcgcatagnnnnn

SEQ ID NO: 276788 - DNA, 622 bp, Homo sapiens
  misc_feature: GYAE6OF01EI0YR.22.34.D01.1.454.CMB.1.raw
  modified_base (353)..(353): a, c, t, g, unknown or other
  misc_feature (353)..(353): n is a, c, g, or t
  modified_base (361)..(361): a, c, t, g, unknown or other
  misc_feature (361)..(361): n is a, c, g, or t
  modified_base (377)..(377): a, c, t, g, unknown or other
  misc_feature (377)..(377): n is a, c, g, or t
  modified_base (524)..(524): a, c, t, g, unknown or other
  misc_feature (524)..(524): n is a, c, g, or t
tcagacatacgcgtcacgaccggtgctcgatttagatcgtctgtgttgggtttggggggaagaggaagactgacggtcctgtcccaggtgcagctgcaggagtcgggcccaggactggtgaagccttcggagaccctgtccctcacctgtactgtctctggtggctccgtcactggttaccactggagctggatccggcacgcccccgagggaagggactggagtggattggctatatttctacagtggccgcaccaactcccacccctcctcaagagtccgacgccaccatactcagtccgacacgtccaagaaccagttcctccctagaaactggacggtctgtcgaccgnagcggacncggccgtgtattacgngtgcgagagacggtccgggtacatactcgtcggtcccgttccggaccccgtggggacccgaacggggtacccctcgggtcccgaccgtcctacctccgacgtccctacccgacccgaacgggcccacgttcccggtcccttccccgnggcccgccctcggcctccgaggccgccaccgtccgacgcgccacgcggccggcccggtcgggcctcgccgttcggacaaggtcctcgtcccgtaacgg

SEQ ID NO: 276789 - DNA, 614 bp, Homo sapiens
  misc_feature: GYAE6OF01BM1TZ.22.34.D01.1.454.CMB.1.raw
  modified_base (503)..(503): a, c, t, g, unknown or other
  misc_feature (503)..(503): n is a, c, g, or t
tcagacatacgcgtcacgaccggtgctcgatttagatcgtctgtgttgggtttgggggaagaggaagactgacggtcctgtcccaggtgcagctgcaggagtcgggcccaggactggtgaagccttcggagaccctgtccctcacctgtactgtctctggtggctccgtcactggttaccactggagctggatccggcagcccccagggaagggactggagtggattggctatatttcttacagtgccgcaccaactcccacccctcctcaagagtcgagccaccatatcagtcgacacgtccaagaaccagttctccctagaaactgacggtctgtcgaccgcagcggacacggccgtgtacttacgtgtgcgagagacgtccgggtcagtatcgtggtccgttccggaccccgtggggacccacgggtaacccctgggtccaccgtctacctcgacgccctccgaacccgacgggccctacgttccggttccttcccccgnggcccgcccgtcgtccctccgacggacgcccgacccgtccggacgcgccaccgcgcccgggcccgtgggcctggccgtcggtacgaaacggtccttaccgtcccgtaccgg

SEQ ID NO: 276790 - DNA, 613 bp, Homo sapiens
  misc_feature: GYAE6OF01DVQFX.22.34.D01.1.454.CMB.1.raw
tcagacatacgcgtcacgaccggtgctcgatttagatcgtctgtgttgggtttggggggaagaggaagactgacggtcctgtcccaggtgcagctgcaggagtcgggccccaggactggtgaagccttcggagaccctgtccctcacctgtactgtctctggtggctccgtcactggttaccactggagctggatccggcacgcccccgagggaagggactgggagtggattggctattatttctacagtggccgcaccaactccccacccctccctcaagagtcgacgcccaaccatatcagtcgacacgtccaagaaccagttctccctagaaactgaggtctgtgaccgcgagcgacacggccgtagtatactgtgcgagagcgtcgggcatagtcgtcggtccgttcgacccgtgggccaacgggtaccctggtccaccgtctcctcacgcctccaccgacgggcccacgtccgtcccttcccccgtggccctcccgtcgtcctcccgaggaccgccaccgtaccgagaccgccacgccggccggcccggtggggccctcggaccgttcgggtaaccgaaccgggtcccttaaccgttcccgaaccggg

SEQ ID NO: 276791 - DNA, 612 bp, Homo sapiens
  misc_feature: GYAE6OF01C50G7.22.34.D01.1.454.CMB.1.raw
  modified_base (273)..(273): a, c, t, g, unknown or other
  misc_feature (273)..(273): n is a, c, g, or t
  modified_base (277)..(277): a, c, t, g, unknown or other
  misc_feature (277)..(277): n is a, c, g, or t
tcagacatacgcgtcacgaccggtgctcgatttagatcgtctgtgttgggtttggggggaagaggaagactgacggtcctgtcccaggtgcagctgcaggagtcgggcccaggactggtgaagccttcggagaccctgtccctcacctgtactgtctctggtggctccgtcactggttaccactggagctggatccggcacgcccccgagggaagggactggagtggattggctattatttcttacagtggccgcaccactcccacccctccnaagntcgacgccaccatatcagtccgacacgtccaagaaccacgttctccctagaaactggacgtctgtcgaccgcaggacggacacggccgtgtacttacgtgtgcgagagacgtccgggcatagtcgtcgggccgttccgaccccgtggggcccgaacggggtacccctgggtccctaccgtctccctacgaccgtcctacccgaaccgacgggccctacgtccgttccctccccgtcggccgtccctcgcctccgacggcgccaccgtccgagaccgcaccgacggcccggccgtggcctcggccgtcggtaccaaggtaccctcgttcccgacgg

SEQ ID NO: 276792 - DNA, 874 bp, Homo sapiens
  misc_feature: GYAE6OF01B9EGU.22.34.D01.1.454.CMB.1.raw
tcagacatacgcgtcacgaccggtgctcgatttagatcgtctgtgttgggtttgggggaagaggaagactgacggtcctgtcccaggtgcagctgcaggagtcgggcccaggactggtgaagccttcggagaccctgtccctcacctgtactgtctctggtggctccgtcactggttaccactggagctggatccggcacgccccgagggaagggactggagtggattggcttatatttcttacagtcggccgcaaccaactccccacccctccctacaagacgtcgacgccacatactcagtcgacacgtaccaaagaacctgttcctaccctagtaaaacctgacggtctacggtacgacccgcgacggaccggaaccgaccgggtccgttacgttaacgttaccgtaggtcggaccggtaaggaacggtacggtacccgggggtacctaaagttacgttccggtacggggtccccgtttacccggtaacccccggtagggggacccgtaaccgggggtaacccccgttggggtacccccgtaacccggttccttaccccgtacgtacccggtaacccccttcccggaaaccccggtaacggggtaccccctaaccggtttccccgggttaccccccgttttccccccgggtaccgggacccccgttcccccggttcggtaccccgttacccgggaaccggggtacccgacccgtaaccccccggttaccggaaccgggtaccgaaccccgtaaccgggacccgggtaccccgggtacccccgggtcggggtacccgttccggaccccggtttacggggttaaccccaaaccggggttaacccctttaccccggttacccggtaaacccggg

SEQ ID NO: 276793 - DNA, 895 bp, Homo sapiens
  misc_feature: GYAE6OF01CGIM9.22.34.D01.1.454.CMB.1.raw
tcagacatacgcgtcacgaccggtgctcgatttagatcgtctgtgttgggtttggggggaagaggaagactgacggtcctgtcccaggtgcagctgcaggagtcgggcccaggactggtgaagccttcggagaccctgtccctcacctgtactgtctctggtggctccgtcactggttaccactggagctggatccggcacgccccgagggaagggactggagtggatggctatatttcttacagtggccgcaccaacctccccaccctcctacaagagtcgacgccaacatatcagtcgacacgtaccaaagaacctagttcctacctacgaaaacctggaacggtctaggtacgacccggcacggaccggaccgaccgggtccgttagtttaattaccgtagggttacgacggaacggaacgggtacggttacccggggtaccgtaagttaacgtccgttacgggtaccccggtttacccggaacccccgggttcgggggacccggtaaccggggtaaccccgtcggggttaccccgtaacccggttcccgttccccgtaccgtaccgtccccccgtttaaccccgaaaccccggtaaacccggggtccccctaaaccgggttttcccccgggtttcccccgtttacccccccgggttccgggacccccggtccccccggttaccggtacccccggtttaccccggaaccggggttaaccccgacccccgtaaccccggttaacccgggaaccggtaaacccggtcccgaaacccgggttacccgggccccggggtaccccgggtacccggggtccgttacccgggtccccggttaccgggtaacccggtaaacccgggtttacccgttacccgttacccggtaaacccgggg

SEQ ID NO: 276794 - DNA, 685 bp, Homo sapiens
  misc_feature: GYAE6OF01EQ4LF.22.34.D01.1.454.CMB.1.raw
tcagacatacgcgtcacgaccggtgctcgatttagatcgtctgtgttgggtttggggggaagaggaagactgacggtcctgtcccaggtgcagctgcaggagtcgggcccaggactggtgaagccttcggagaccctgtccctcacctgtactgtctctggtggctccgtcactcggttaccacgtggagcgtggatccggcacgccccgaggggaaggctggagtggattggctattatttctacagtgccgacaccaacgtcccaccctccacaagactcgacgccaaccatatcacgtacgaacacgtaccaaagaccagttcctaccgtacgaactggacgtcgtacgtacgaccgcaggaccggacgaacggccgttagtacttacgtgtggacgagtacggacggttccgggtacgattacgtcgtcggtaccggttccgaccccggtgggacccgtaacggggacccttacgggacccgtaccgttctcctcaccgtccctaccgaacgacccgggcctacgtcccgggtcccttcccgacggtcccgtcccgtacgtccgtaccgacggccacgaccctacggacgtacgaccgaaccggcggaccggcccggtcgggcccgtcggtaccgttaccgaaccggtaacggtacccttaacccggtcccgtaaaccggg

SEQ ID NO: 276795 - DNA, 608 bp, Homo sapiens
  misc_feature: GYAE6OF01BMQIN.22.34.D01.1.454.CMB.1.raw
  modified_base (492)..(492): a, c, t, g, unknown or other
  misc_feature (492)..(492): n is a, c, g, or t
  modified_base (535)..(535): a, c, t, g, unknown or other
  misc_feature (535)..(535): n is a, c, g, or t
tcagacatacgcgtcacgaccggtgctcgatttagatcgtctgtgttgggtttggggggaagaggaagactgacggtcctgtcccaggtgcagctgcaggagtcgggcccaggactggtgaagccttcggagaccctgtccctcacctttactgtctctggtggctccgtcactggttaccactggagctggatccggcacgcccccgagggaagggactggagtggattggctatatttcttacagtggccgcaccaactcccacccctcctcaagagtcgagccaccatatcagtcgacacgtccaagacccagttctccctgaaacctgaggtctgtgaccgcagcggacacggcccgtgtattacgtgtagcgagagaggtccgggtccgatatcgtggcccgttcgaccccgtggggccagggaacctcggtcacccgtctcctcacgcctaccaccgaggcccagtccgtccttccccgtcggccncccgtgcctccgacggacgccacccgtccgacgacgccaccgnggcccggtcccgtacgggccttcggcccgtcgggtacctaaacgggacccttacccgttcccgacggtaccgg

SEQ ID NO: 276796 - DNA, 729 bp, Homo sapiens
  misc_feature: GYAE6OF01ACJTU.22.34.D01.1.454.CMB.1.raw
  modified_base (507)..(507): a, c, t, g, unknown or other
  misc_feature (507)..(507): n is a, c, g, or t
tcagacatacgcgtcacgaccggtgctcgatttagatcgtctgtggttagggtttgggggaagaggaagactgacggtcctgtcccaggtgcagctgcaggagtcgggcccaggactggtgaagccttcggagaccctgtccctcacctgtactgtctctggtggctccgtcactggttaccactggagctggactccggcacgccccgagggaaggacgtggagtggattggctatattctacgagtcgccgcaccaacctcccacccctcctacgaacgacgtcgacgccaccatactcagtacgaccaccgtaccaacgaacctacgttcctccctacgaactggtacggtctcgtacgacccgcgacggccggacgaccggtcgtagtattacgtggcgacggaacgacggtcggtccggtacgtatacgtcgaccgggtccctaccggtaccccgggtgggacccgaccggggtaccgttcggaccctaccgtccgtacccncgtaaccgtcccctaacccgaaccggaccggggtcccctacggttcccggttaccccgttccccggacggccccgtcccgtcgtaccggtaccgaaacgggtccgacccttaccgaccggacgaccgtccgaaccgggtcggtccggtacccgggttcgggccttacccgggacgggttaccgtaaacggaaccccgtaccgtttcccgtcggtaaccccgg

SEQ ID NO: 276797 - DNA, 792 bp, Homo sapiens
  misc_feature: GYAE6OF01D04ZT.22.34.D01.1.454.CMB.1.raw
  modified_base (618)..(618): a, c, t, g, unknown or other
  misc_feature (618)..(618): n is a, c, g, or t
tcagacatacgcgtcacgaccggtgctcgatttagatcgtctgtgttgggtttggggggaagaggaagactgacggtcctgtcccaggtgcagctgcaggagtcgggcccaggactggtgaagccttcggagaccctgtccctcacctgtactgtctcgtggtggctccgtcactcggttaccacgtggagcgtggacgtccggcacgcccccgagggaacgggactgggagtggtattggacttagttatttcttacgaggtcggccgcaccacctccccaacccctcctacaagcgtccgacgcccaacgatatcagtcgaccaccgtaccaaacgaaccacgttccaccgtagaaactggtaacgtctgtacgaccgacgacggaccggaccgaccggtccgttagtacttacgtggtacgacggagtacggtaccggttccgggacctagttacgtcgtccgggtacccggtttcccggacccgggtcggggacccgtaaccggggtaccccgtgggtccccgtaaccggttcctacccgtaccgaccgtcccctacccggaacccggtaacccggcccttaacggttccccggttacccccgttcccccgggngtaccccccgttccccgtaccgtcccgttaacccggacgggtacccaccccgtaccgtacccgggagaacccgtccgaacccgggaccggtcccggtaccccgggtcggtccccgttcccggcccggttaccggaaccgttaaaccgtccccgtttaacgtaccccggtaccgg

SEQ ID NO: 276798 - DNA, 654 bp, Homo sapiens
  misc_feature: GYAE6OF01BYG76.22.34.D01.1.454.CMB.1.raw
  modified_base (313)..(313): a, c, t, g, unknown or other
  misc_feature (313)..(313): n is a, c, g, or t
  modified_base (378)..(378): a, c, t, g, unknown or other
  misc_feature (378)..(378): n is a, c, g, or t
  modified_base (567)..(567): a, c, t, g, unknown or other
  misc_feature (567)..(567): n is a, c, g, or t
tcagacatacgcgtcacgaccggtgctcgatttagatcgtctgtgttgggtttgggggggaagaggaagactgacggtcctgtcccaggtgcagctgcaggagtcggggcccaggactgggtgaagccttcggagaccctgtccctcacctgtactgtctctggtggctccgtcactggttaccactggagctggatccggcacgcccccgaggggaagggactgggaggtggattggctattatttcttacaggtggccgcaccaacctccccacccctccctcaagacgtcgacgcccaccataccccctnacgtcgacacgtaccaacgaaccagttcctcctagaaactggaggtctgtcgaccgcaggcgacncggccgtgtatctgtgcgagacgcggtccgggcgatacgtcgtcggtccgttccgacccgtggggacccacgggacccgtggtcccaccgttcctcctcgaccgccctacccgaacccgaacgggcccctacggttcccggttcccttcccccgtcggaccccgtcccgtcgcctacccgagggtaccnccacccgtccggacgacgaccgacgaccggcccggcccggtcgggcctcggcccgtggtaccgaacggtccctaccgttcccgacgg

SEQ ID NO: 276799 - DNA, 874 bp, Homo sapiens
  misc_feature: GYAE6OF01D8GBN.22.34.D01.1.454.CMB.1.raw
  modified_base (342)..(342): a, c, t, g, unknown or other
  misc_feature (342)..(342): n is a, c, g, or t
tcagacatacgcgtcacgaccggtgctcgatttagatcgtctgtgttgggtttgggggggaagaggaagactgacggtcctgtcccaggtgcagctgcaggagtcgggcccaggactggtgaagccttcggagaccctcgtccctcacctgtactgtctctggtggctccgtcacgtggttaccacgtggagctggactccggcacggcccccgaaggggaagggactgggagtggagttggctattactttcttacgaggtcggccgcaccaacctccccacccctccctacaacgacgtcgacgacccaccatatcagtacacaccgtaccaagaacctnttcctcctacgaacgtgacgtctgtacgaccgcgacgaccggacgaccggtccgtagtaacgttacgtggttcggacgaggaacggtaccggtcccgggtaccgtattaacgtcgtaccgggtcccggttacccggacccccggtcggggaccccgtaacggggtaccccgtacgggttaccccgtaacccgttcccgttcccgtaccgtacccgtaccccgttacccccgaaacccggtaacccgggtacccccgtacggtttccccgggttacccccgtttccccccggcggggtacccccgtcccccgttcgggtacccccgttaacccgggtacgggtaaccccggtaccccgttaccccggtaacccggaacggacccgggtacccgaaacccgggtacccggggtccccgggttacccccggggtccggggtacccgtacccgggttaccccgggttaaccgggttaaccccggtaaaaccggggtttccccctttaaacccgggttcccccgttaaacccggggg

SEQ ID NO: 276800 - DNA, 598 bp, Homo sapiens
  misc_feature: GYAE6OF01AUDJ2.22.34.D01.1.454.CMB.1.raw
  modified_base (316)..(316): a, c, t, g, unknown or other
  misc_feature (316)..(316): n is a, c, g, or t
  modified_base (443)..(443): a, c, t, g, unknown or other
  misc_feature (443)..(443): n is a, c, g, or t
  modified_base (501)..(501): a, c, t, g, unknown or other
  misc_feature (501)..(501): n is a, c, g, or t
tcagacatacgcgtcacgaccggtgctcgatttagatcgtctgtgttgggtttggggggaagaggaagactgacggtcctgtcccaggtgcagctgcaggagtcgggcccaggactggtgaagccttcggagaccctgtccctcacctgtactgtctctggtggctccgtcactggttaccactggagctggatccggcagcccccagggaagggactggagtggattggctatatttcttacagtggccgcaccaactcccacccctcctcaagagtcgagccaccatatcagtcgacacgtcaagaccagttcnccctgaaactgaggtctgtgaccgcaagcggacacggcctgtacttacgtgtgcgagagagtccggggtacatatctggccgtttcgaccccgtggggccagggaaccctggtccaccgtctcctcncgcctccaccacgggcccatcggtccttccccgtggccgccctgcctcccagggtacnccacccgtccgacgtacgaccgacgacggcccggtccccgtgggaccctcggcccgttcgggtacccaaagggtacccttaccgtttcccgaacggg

SEQ ID NO: 276801 - DNA, 699 bp, Homo sapiens
  misc_feature: GYAE6OF01B6G1F.22.34.D01.1.454.CMB.1.raw
tcagacatacgcgtcacgaccggtgctcgatttagatcgtctgtgttgggtttggggggaagaggaagactgacggtcctgtcccaggtgcagctgcaggagtcgggccccaggactgggtgaagccttcggagaccctgtccctcacctgtactgtctctggtggctccgtcactggttaccactggagctggatccggcacgccccgagggaagggactggagtggattggctattatttcttacagtcggccgcacccaacctccccaccccctccctacaacgagtccgacgcccaccatactcagtccgacacgtaccaaacgaacctacgtttcctccctagaaacctggacggtctgtcgaccgcaggccggacgacggccgtgtacttactggtcgcgaggagcggtccggtacgatacgtcgtcgggtccgttccgacccggtggggaccgacggggtaacccgttgggtaccctaccggttcctcccgtcgacgtcccctacccaaccggaaccgggccccaacggtttcccggttaccccttcccccggtcgggtccccgtccccgtcggtcccgtacccgacgggtacccgccgtaacccgtccggacggaccgaccaccggacggcccggcccggtggccgtacgcccggttacggtacgaacggtacctaccgttcccgtaccgg

SEQ ID NO: 276802 - DNA, 691 bp, Homo sapiens
  misc_feature: GYAE6OF01ER3NE.22.34.D01.1.454.CMB.1.raw
  modified_base (301)..(301): a, c, t, g, unknown or other
  misc_feature (301)..(301): n is a, c, g, or t
  modified_base (371)..(371): a, c, t, g, unknown or other
  misc_feature (371)..(371): n is a, c, g, or t
tcagacatacgcgtcacgaccggtgctcgatttagatcgtctgtgttgggtttggggggaagaggaagactgacggtcctgtcccaggtgcagctgcaggagtcgggcccaggactggtgaagccttcggagaccctgtccctcacctgtactgtctctggtggctccgtcactggttaccactggagctggatccggcacgcccccgagggaagggactggagtggattggctattatttcttacagtggccgccaccaacctcccaccccctcctcgaagacgtcgacgccaccatacncagtccgaaccacgtaccaaacgaaccagtttcctaccctagaaaccttggaaggtctaggtcgacccgngacggccggaccgacgggccgttggtaattacgtggtgcgagacggtacgtccggggtaccattacgtcgtcgggcccgtttaccggaccccggtcgggacccgaacggggaccctcggtaccgtacccgtcctcctcacgccctacccaccgaacggcccactccggttcccttccccgcgcccgtccctcgcccgtccgacggcgaccctcccgtaccggacgtacgaccgtaccgacgggcccggtccccgggccgggtccgtacccggtccgtacgggtacccgaaaggtacccttaaccgtccccggtaacccgg

SEQ ID NO: 276803 - DNA, 909 bp, Homo sapiens
  misc_feature: GYAE6OF01C3W1S.22.34.D01.1.454.CMB.1.raw
tcagacatacgcgtcacgaccggtgctcgatttagatcgtctgtgttgggtttggggggaagaggaagactgacggtcctgtcccaggtgcagctgcaggagtcgggcccaggactggtgaagccttcggagaccctgtccctcacctgtactgtctctggtggctccgtcactggttaccactggagctggatccggcacgcccccgagggaagggacgtggagtggtattggctattatttcttacgagtcggccgcaacccaacctccccacccctcccctacaaaggacgtccgacggcccaacccaattactaccgaacgtccgaacctaaccgtcccaaacggaaacccctagtttaccctcccctagaaaacctggacgggttctggtacgaacccgcgacggacgggaccacgggtccgttggttaacttacgtggtcggacgtaggaacggtacggtcccgggggtaccgtaacgtaacgttccgttacggggtcccggtttacccggacccccgttacggggggaccccgtaaaccggggggtaacccccgttcggggtacccctaacccgggttccctttaccccgtaccgtaccgggtacccccttacccccgtaacccggaaacccggggtacccccttaacggttcccccggggtttcccccgttttacccccccggtcggggtacccccggttacccccggttggtaccccctcccgggaacgggtaccccggcctaacccccgttaccgggaaccggtacccggaccgaacccggtaacccggggccccgggtacccccggttcgggggacccccttcgggacccccggttacgggggttaaccccaaacggggtttaaccccttaacccgttttaacccccgggaacccggg

SEQ ID NO: 276804 - DNA, 824 bp, Homo sapiens
  misc_feature: GYAE6OF01C3J7F.22.34.D01.1.454.CMB.1.raw
  modified_base (304)..(304): a, c, t, g, unknown or other
  misc_feature (304)..(304): n is a, c, g, or t
  modified_base (335)..(335): a, c, t, g, unknown or other
  misc_feature (335)..(335): n is a, c, g, or t
  modified_base (374)..(374): a, c, t, g, unknown or other
  misc_feature (374)..(374): n is a, c, g, or t
tcagacatacgcgtcacgaccggtgctcgatttagatcgtctgtgttgggtttgggggaagaggaagactcgacggtcctgtcccaggtgcagctgcaggagtcgggcccaggactggtgaagccttcggagaccctgtccctcacctgtactgtctcgtggtggctccgtctacgtggttaccacgtggagctggactccggcacggcccccgagggaagggacgtggagtggattggcttagttatttcttacagtggccgcaccactcccaccctcctcaacgcgtccgagccaccatacncagtccgaacacgtccaaagacctagttccnccctagaaacctggaggtctggtcgaccgcagccggacncggcctgtacttactgtcgacgtaggacgtacggttcccgggaccgtatcgttcgtcggggtacccgtttccggaacccccggttagggggcccctaacgggggtaacccccttcggggtacccctaacccggttccttacccgtccgaaccgtccctacccgtaacccggaacgggtccccctaacgttcccgggttacccctttccccccggtagggccccggtacccccgttcgggtcccctaccccgggtaaacgggacccgtaccccggtaacccgttacccccgggaaaggtacccggacccgtaacccgggtaacggggacccccggggttacccccggtacggggggtaccccttacccggggacccgggttttaccggggtaaaccccgtaacccgggtttaaaccccgttaaccccgttttccccgggtaaaaccccggg

SEQ ID NO: 276805 - DNA, 886 bp, Homo sapiens
  misc_feature: GYAE6OF01CCQ1O.22.34.D01.1.454.CMB.1.raw
tcagacatacgcgtcacgaccggtgctcgatttagatcgtctgtgttgggtttgggggaagaggaagactgacggtcctgtcccaggtgcagctgcaggagtcgggtccaggactggtgaagccttcggagaccctgtccctcacctgtactgtctctggtgctccgtcactggttaccacgtggagctggactccggcacgccccgagggaaggactggagtggatggctatatttcttacgagttcggccgcaacccaacctccccacccctccctacaaacgacgtaccgacgaccaccatactcacgtcgaccacgtaccaaacgaacctgtttcctaccctagaaaccgtggaacgttcctagtacgaccgacgacggaccggaacgacggtccgttacgttaacgttaccgttgggtaccgaggaacggtaacggtaaccggttcccgggggtaaccctaagttacgttaccggttccgggtccccgtttccgggacccccgggttacgggggacccgtaaaccgggggtaaccccgtttcgggtaccccgtaaccccggtttcctacccgttaccgacccggtcccctaacccgaacccgggaaccgggtacccctaaccgggttcccggttttacccccgttacccccgtcgggtacccccgtcccccgttacgggtaccccgttaccccggaacgggtaacccggtacccgaacccccggttacccgggaacgtacccgggaaccccgaaaccggacccggggtccccggggtaccccgttttcccggggggacccctttaaaccgggtccggggttaaacccgtaaacccgggttaacccctttaaccccgggtaccggtcccgggttaaacccgg

SEQ ID NO: 276806 - DNA, 789 bp, Homo sapiens
  misc_feature: GYAE6OF01CIZ03.22.34.D01.1.454.CMB.1.raw
  modified_base (309)..(309): a, c, t, g, unknown or other
  misc_feature (309)..(309): n is a, c, g, or t
tcagacatacgcgtcacgaccggtgctcgatttagatcgtctgtgttgggtttggggggaagaggaagactgacggtcctgtcccaggtgcagctgcaggagtcggcccaggactggtgaagccttcggagaccctgtccctcacctgtactgtctctggtcggctccgtcactggttaccacgtggagctggactccggcacgccccgagggaacggctggagtggattggctattatttctacagtcggccgcacccaacctccccacccctaccctacaacggacgtacgacgccaacctataacncacgtcgaacacgtacaacggaacctaggttcctacctagaaacgttcgaacggttctagtacgaccggacacggacgaacggtacggccgtagttaacttacggtcgtagacggagacggtacggtccgggacctaagtacgtccggtacgggtcccggtttacccgacccggttcggggacccgtaaccggggtaacccgttcgggtacccgtaacccgggtccctacctaccggtacccggaccccttacccggaaacccgggaaccgggtcccccttaacggttccccgggttacccctttccccgggtcggaccccgttccccgtacgggtcccttacccgggaacggttaccgccgtaaacccggtccggtaacggaccgtaaccgaccgtaccgggtacccggtacccggtcgggtacccttcgacccgggttaggtaccccggaaggttacccttccgtaacccggtaacgg

SEQ ID NO: 276807 - DNA, 877 bp, Homo sapiens
  misc_feature: GYAE6OF01A0FV7.22.34.D01.1.454.CMB.1.raw
  modified_base (287)..(287): a, c, t, g, unknown or other
  misc_feature (287)..(287): n is a, c, g, or t
tcagacatacgcgtcacgaccggtgctcgatttagatcgtctgtgttgggtttggggggaagaggaagactgacggtcctgtcccaggtgcagctgcaggatcgggcccaggactggtgaagccttcggagaccctgtcctcacctgtactgtctctggtggctccgtcactggttaccactggagctggatccggcacgcccccagggaagggctggagtggatggctatatttctacagtggccgcaccactcccaccctcctacaagagtcgagccaccatacncagtcgaactaccgtaccaaacgaacctacgtttaccctccccgttagaaaacccttgggtaacgggttccttaggtacggacccgcgtaacggccgggaaccgtacgggtcccggttaggttaacgtttaccgtggttacgacgggtaacggaacggtaccggttcccgggggtaccaaggtttaacgttccggttccgggtaccccggtttcccgggtacccccgggtcggggacccggtaaccggggtaaccccgttcggggtacccgtaacccggttccctaccccgtttacccgaccggttacccccacccggaaaccccggtaacccggggtaccccctaaccggtttccccggttacccccgtttccccccggttccggggtcccccggtcccccggttacggtccccgttacccggaacggtaccccgcccgtaaccccggttaccgggacgacccggacccgtaacccggtaccgggtccccgggtaccccggttcgggtccccgtaccggtacccgggttacccggggttaccgaaaaccggggttccctttaaacccgggttccccggtaaacccgggg

SEQ ID NO: 276808 - DNA, 974 bp, Homo sapiens
  misc_feature: GYAE6OF01C7PCZ.22.34.D01.1.454.CMB.1.raw
  modified_base (279)..(279): a, c, t, g, unknown or other
  misc_feature (279)..(279): n is a, c, g, or t
tcagacatacgcgtcacgaccggtgctcgatttagatcgtctgtgttgggtttggggggaagaggaagactgacggtcctgtcccaggtgcagctgcagggacgtcgggcccagggacgtgggtgaagtccgttcgggagaccctgtccctcacctgtactgtctcgtggtggctccgtcacgtcggttacccagtggagcgtggactcccggcaccggcccccggaaggggaacgggacgtgggaggtgggtattggacttaattattttcgtaacgnggtcggcccgtacaacccctaaccctcccccgacccccttcccaacgaaggtacgtaccgaaccgaccaacccattacgacgaccgtaccgacctaccgtaccaaacgtacccgtcgtttaccctaccgtaagaaaccgtggtaccggttcgacggtacccggtacccgcgaaccgggaccggtaacccgggacggtacccgtttaggtttaaccgttaaacgttgggtacggacgggtaacgggtaacggacccggggtttcccggtagttaactccggtttcgtaccccggggtcccgtttacccgggacccgggttcccgggggtaaccccggaaacccggggttaccttccggggtacccccgtacccgtttaccgtaccccggtccggaacccccgtaccccggtaaccccgaaaccccggggtaacccggtccccgtttacccggtccccccggtttccccccgtttaccccgggtcccgggccccggtttacccccgtacgtccccggttaaacggcccgggtaaccctaaccccgggtcccggaacccgtaaggaccccgtccggtaacccggacccccggggcccggtttaccccggcggggttaccccgttaccgggtcccgggtttaaaccgggttaaacccggaccggtttaaccccccttcccggttacccggtacccgggg

SEQ ID NO: 276809 - DNA, 862 bp, Homo sapiens
  misc_feature: GYAE6OF01DK7RP.22.34.D01.1.454.CMB.1.raw
tcagacatacgcgtcacgaccggtgctcgatttagatcgtctgtgttgggtttggggggaagaggaagactgacggtcctgtcccaggtgcagctgcaggagtcgggcccaggactggtgaagccttcggagaccctgtccctcacctgtactgtctctggtggctccgtcactcggttaccactggagctggatccgggcagcccccgagggaaggactggaggtggattggactatatttctacagtgccgcaccaactccccacccctccacaacgagtaccgacgcctaaccatactcagtccgacaccggtaccaaagaacctaacgttcctaccccgttagaaaaccgtgaacgggttcctggttacgaacccgacgacggtacccgggaaccgaccgggtacccggttgttaacgttactacgggtacgaccgggaaggaaacggtacggttccccgggggtccgaaagttaacgttaccggttcgggtaccccggttttaccgacccccgggttacgggggaccccggtaaaccggggtaacccccgttagggtaccctacccgggtacccttacccgttaccgacccggtccccgttacccgaaccccggaaccggggtaccccctaacggtttccccgggttaccccgtttccccccggtacggggtccccggtaccccccgtttacggacccgttccccggaaccgggtaaccggtccccgtaaccccgggttaccccggaacgggacccggccgaacccggaccgggtacccgggtccccggtcgggacccggttccgacccgttacgggtaaaccctaagggtaacccttacccgtttccggaacccgg

SEQ ID NO: 276810 - DNA, 671 bp, Homo sapiens
  misc_feature: GYAE6OF01D8DOI.22.34.D01.1.454.CMB.1.raw
  modified_base (181)..(181): a, c, t, g, unknown or other
  misc_feature (181)..(181): n is a, c, g, or t
  modified_base (557)..(557): a, c, t, g, unknown or other
  misc_feature (557)..(557): n is a, c, g, or t
  modified_base (592)..(592): a, c, t, g, unknown or other
  misc_feature (592)..(592): n is a, c, g, or t
tcagacatacgcgtcacgaccggtgctcgatttagatcgtctgtgttgggtttggggggaagaggaagactgacggtcctgtcccaggtgcagctgcaggagtcgggcccaggactggtgaagccttcggagaccctgtccctcacctgtactgtctctggtgctccgtcactggttaccnctggagctggactcggcacgcccccgagggaacggactggagtggtattggctattatttacttacagtggccgacaccaacctccccaccccttccctacaacgagtaccgacgccaccatactcacgtccaacacgtaccaaacgaacctagttcctacccgtagaaactgacggttctgtacgacgcacggccggacacggtccgtagtacgttactgtcgaggtagagtcggtccggtaccgtaatcgtcgtcggtcccgttacggacccggtcgggacccgaacggggtaaccctcgggtaccctacccgtactcccgtaccgaccgccctacccgacccgacggtcccacggttccgtccccttccccgngcccgtcccgtcgtccgtccgacgcgcccgtaccnccggacgactccacgtacgggccccgtaccgtcgggtcctcgcccgttcggacgtaacgtcccttacgtcccgtaacgg

SEQ ID NO: 276811 - DNA, 769 bp, Homo sapiens
  misc_feature: GYAE6OF01BWEUI.22.34.D01.1.454.CMB.1.raw
  modified_base (314)..(314): a, c, t, g, unknown or other
  misc_feature (314)..(314): n is a, c, g, or t
  modified_base (429)..(429): a, c, t, g, unknown or other
  misc_feature (429)..(429): n is a, c, g, or t
tcagacatacgcgtcacgaccggtgctcgatttagatcgtctgtgttgggtttgggggaagaggaagactgacggtcctgtcccaggtgcagctgcaggagtcgggcccaggactggtgaagccttcggagaccctgtccctcaccgtgtactgtctcgtggtcggctccgtcacgttcggttaccacgtggacgcgtcggacgtccggcacgcccgagggacggctggagtggatggactattacttcgtacgacggtcggccgtaccgaacctaaccgtcccctaccctccctacgaacgacggtccgaacncccgaactaagtactccgaaggtccgaacgacgtaccaaacggaacctacgttcctccgtaagaaacctgacggtctggacgacgcacggcgaacgcggtccgtagtacttacgnggtacgagacggacgacgggtccgggtactagttacgtcggtccgggtaccgttcccgggacccggtcggggaacccgaacggggtaaccccgttcggtacccgacccgtttccgtaccgtacaccgtccctaccgaaccggtaccggcccttaaggtcccggtttaccccttccccggcggccccggtccccgtaggtcccctaccggagggtaccctaccgacccggtacggacggaccgtaccgaaccggtaccggccccggttacccgggtcggtcccgttaccggaccggtacgggtacccgaaacggtacccggtttaccctcgggtaacccgg

SEQ ID NO: 276812 - DNA, 874 bp, Homo sapiens
  misc_feature: GYAE6OF01CKDHT.22.34.D01.1.454.CMB.1.raw
  modified_base (244)..(244): a, c, t, g, unknown or other
  misc_feature (244)..(244): n is a, c, g, or t
  modified_base (284)..(284): a, c, t, g, unknown or other
  misc_feature (284)..(284): n is a, c, g, or t
  modified_base (475)..(475): a, c, t, g, unknown or other
  misc_feature (475)..(475): n is a, c, g, or t
  modified_base (543)..(543): a, c, t, g, unknown or other
  misc_feature (543)..(543): n is a, c, g, or t
  modified_base (713)..(713): a, c, t, g, unknown or other
  misc_feature (713)..(713): n is a, c, g, or t
tcagacatacgcgtcacgaccggtgctcgatttagatcgtctgtgttgggtttggggggaagaggaagactgacggtcctgtcccgaggtgcagctgcaggacgtcgggccccagggactgggtgtaacgtccctttcgggacgtaccctcgtcctcacctgtactgtctcgtggtcgcctccgtcacgtcggttaccacgtggacgcgtcggactccggcaccgcccggaagggacgggacgngggtacgtggtagttcggtacttattctttaccgttacgnggtccggcctacctaaccctaaccctcccctacccctaccaacgaaggtacgtaccgaacgaccctaacctaatttaccactacggttaaccgaacccgtaaccgtaaccggaaaacgtaaccccgttaccgtttcctaacccggtagtaaaaccgtcgggttaacggttcgttacggacgggtaacccgngtacccgggtaaccggggacccgttaccggggaccgttttacggaactttaacgggtcggaaccgggngtaacgggacggtaccgggttaccccggggtataacgttcggtccgttccggtaccccgtggtacccgggtacgggtaccgggaaccgggtaccgtcgggtaccccgtaccggtccgtaccgcgtaccgaccgtaacccgccgaaccggccttaccggtccgttaccccnccggttaccggccctccgtccgacttaccggacgtaccgtcccggtaaccacccgggtaacgtaccggaccgtaccgggaccgggtacccggtcccggtaccggtcccggtacggtccggtacggtaccgaaccggttccctacggttacccgtacccggg

SEQ ID NO: 276813 - DNA, 638 bp, Homo sapiens
  misc_feature: GYAE6OF01BIPGL.22.34.D01.1.454.CMB.1.raw
tcagacatacgcgtcacgaccggtgctcgatttagatcgtctgtgttgggtttggggggaagaggaagactgacggtcctgtcccaggtgcagctgcaggagtcgggcccaggactggtgaagccttcggagaccctgtccctcacctgtactgtctctggtggctccgtcactggttaccactggagctggatcccggcacgcccccgaggggaacgggactggagtggattggctatatttcttacagtggccgcaccaacctcccacccctcctcaagagtcgacgccaccatatcagtcgaccacgtaccaagaacctagttcctaccctagaaaactgaacggtctgtacgaccgcaggccggacaccggtcgtagtacttactgtcgcgagaggacgtccgggtaccattacgtctcgggtccgttccggacccgtggggaccacgggtaaccccgtggtacccaccgtctccctcgacgtccctaccgaaccgacggccctagtcccggtcccttccccgtcggcccgccctcgtcctccgaggaccgccgacccgtccggacgacgaccaaccgcggcccgtccgtcgggcctcgtccgtacggtaccgaaggtcccttcgtcctaccgg

SEQ ID NO: 276814 - DNA, 781 bp, Homo sapiens
  misc_feature: GYAE6OF01DVHJA.22.34.D01.1.454.CMB.1.raw
  modified_base (273)..(273): a, c, t, g, unknown or other
  misc_feature (273)..(273): n is a, c, g, or t
  modified_base (653)..(653): a, c, t, g, unknown or other
  misc_feature (653)..(653): n is a, c, g, or t
tcagacatacgcgtcacgaccggtgctcgatttagatcgtctgtgttgggtttgggggaagaggaagactgacggtcctgtcccaggtgcagctgcaggagtcgggcccaggactggtgaagccttcggagaccctgtccctcacctgtactgtctctggtgctcgtcactgtaccactggagctggatccggcacgccccgagggaaggactggagtggattggctattactttctacagtcgccgaccaccaacctccccacccctcctanaacgtacgtacgacgcccaacatactcgtacgtaccgaactaccggtaccaaacgaacctacgttacctacccgtaagaaacgtggacgtcgtggtacgaccgcgacggtaccggaccgacgggtccgttagttagtttacgtgggtacgacggtaaggtaaccggtaccgggttacccgggtcgtaaagttcggtaccggttacccgggttccccggttacccggaacccccggggttcgggggaccccgtaaaccggggttaccccgtcggggttaccccgtacccggttcccgtacccgtacccgtaccgtaccccctacccggaaaccggtccccggtaccctcggttacccggtcccctttccccgggcgtcccncccgtcggtccctaccggacggtacgccctaccggtaccggacgctaccgaccggtccggacccgggtccggtcgggccttccggaccgttacggtaacccgaggtaccccttccgttccggaaccgg

SEQ ID NO: 276815 - DNA, 705 bp, Homo sapiens
  misc_feature: GYAE6OF01BESUH.22.34.D01.1.454.CMB.1.raw
tcagacatacgcgtcacgaccggtgctcgatttagatcgtctgtgttgggtttgggggaagaggaagactgacggtcctgtcccaggtgcagctgcaggagtcgggcccaggactggtgaagccttcggagaccctgtccctcacctgtactgtctctggtgctccgtcactggttaccactggagctggactccggcacgccccgagggaacggacgtggacgtggagttggactattactttcttacgaggtcgccgacaaccacctcccaccctcctcaagacgtcgacgccacatactcacgtcacgtactaccaacgaaccgtacgttcctacctacggaaacgttggtacggtcgtacggtcgaccgcgacggcggaacaccggccgtagttacgttacgtcggtacgacgtaacggacgtacggtccgggtacgtacgtagtccggtcggtacccggttaccggacccggtcggggacccgtaaccgggtaccttcgggtacctacccgggtcttacccgtcgaccgtcccgtacccaacccggtaacgggccccttaacgggttcccgtacccgtttaccccggcggtaccctacccggtccgtaccgtccggaacggcgtacccgacccgtcgacggccacgaccgcgggtccgcccggtgcgtacccgcgtcggaacagtccctagtcccgacgg

SEQ ID NO: 276816 - DNA, 656 bp, Homo sapiens
  misc_feature: GYAE6OF01BJJYV.22.34.D01.1.454.CMB.1.raw
  modified_base (529)..(529): a, c, t, g, unknown or other
  misc_feature (529)..(529): n is a, c, g, or t
  modified_base (569)..(569): a, c, t, g, unknown or other
  misc_feature (569)..(569): n is a, c, g, or t
  modified_base (575)..(575): a, c, t, g, unknown or other
  misc_feature (575)..(575): n is a, c, g, or t
  modified_base (591)..(591): a, c, t, g, unknown or other
  misc_feature (591)..(591): n is a, c, g, or t
  modified_base (594)..(594): a, c, t, g, unknown or other
  misc_feature (594)..(594): n is a, c, g, or t
tcagacatacgcgtcacgaccggtgctcgatttagatcgtctgtgttgggtttgggggggaagaggaagactgacggtcctgtcccaggtgcagctgcaggagtcgggcccaggactggtgaagccttcggagaccctgtccctcacctgtactgtctctggtggctccgtcactggttaccactggagctggatccggcacgcccccgagggaagggactgggagtggattggctatactttcttacagtggccgcaccaacctccccacccctcctacaagacgtcgagcccaccatactcacgtcgactaccgtaccaaagaacctacgtttcctaccctagaaaaccttggaacggttctggtacgacccgactacggccgggaaccaccgggccgttagtaactttacgtgtcggacggaggacggtacggtcccggggtaccgaattacgtccgtcgggtcccgttaccggaccccggttggggacccaagggtacctcgttacggcctaccgtctcccgtcncgtccctaccgaccgacgggtcccagtccgtcctccccgnggcccncctcgacctcgacgcnccnccgcgagcgccagacggccgcccggtggcctcggtccgtacggacgacgtcctcctacccgg

SEQ ID NO: 276817 - DNA, 676 bp, Homo sapiens
  misc_feature: GYAE6OF01C3HXV.22.34.D01.1.454.CMB.1.raw
tcagacatacgcgtcacgaccggtgctcgatttagatcgtctgtgttgggtttggggggaagaggaagactgacggtcctgtcccaggtgcagctgcaggagtcgggcccaggactggtgaagccttcggagaccctgtccctcacctttactgtctctggtgctccgtcactggttaccactggagctggatccggcacgcccccgagggaacgggactggagtggattggctatatttctacagtcggccgcaccaacctcccacccctcctacaacgacgtccgacgcccacatatcacgtcgaccacgtccaacgaacctacgttcctcctacgaaactcgagtctgtcgaccgcgacggcggacgacggtccgtagttatttacgtggtcgacggagaggtcggtccgggtcgattagtcgtcggtcccgttccggacccgtcggggacccacgggtaacccgttcggtccacccgttcctccgtcgacgtccctccgaaccgacggccctacggttcccgtcccttccccgtcggccctcccgtcgtcctaccgacggccgaccgtacccgtaccggacgacgacccacgaccgggcccggtccgtacggggtccttccggaccgttacgggtacgaaaccggtccttacccgtacccgtacgggttccg

SEQ ID NO: 276818 - DNA, 840 bp, Homo sapiens
  misc_feature: GYAE6OF01BMJJW.22.34.D01.1.454.CMB.1.raw
  modified_base (249)..(249): a, c, t, g, unknown or other
  misc_feature (249)..(249): n is a, c, g, or t
  modified_base (336)..(336): a, c, t, g, unknown or other
  misc_feature (336)..(336): n is a, c, g, or t
tcagacatacgcgtcacgaccggtgctcgatttagatcgtctgtgttgggtttggggggaagaggaagactgacggtcctgtcccaggtgcagctgcaggagtcgggcccaggactggtgaagccttcggagaccctgtccctcacctgtactgtctctggtggctccgtcactggttaccactggagcgtggacgtccggcacgcccccgagggaaggacgtggagtggattggctagtatttcttanagtcgccgcaccaacctcccacccctcctacaagacgtcgacgccacatactcagtaccgactacgtaccaacgaacctacgttccnccgttagaacgtgacggtctggtacgaccgcgacggcggacgaccggccgttagtacttacgtgtagacggagaggtacggtccggggtacagttacgtcgttacgggtcccgttacccggtaccccgggtacggggacccgtaaccggggtaaccccttcgggttacccgtaacccgttccgtacccgtcgtacccgacccgttacccgaacccggtaccgggaccccttacggttccccggttaccccgttcccccggtacggtcccccggtccccgttaccggtaccccgtttacccgggaaccggtcccggtaaccccgtaccccggtaccgggtaaccggaccggtaacccggtaacccggtaccgggtacccccgggttaccccggggtacgggggttaccccgttacccgggttacccgggtttaacgggttaaacccccgggaaaccgggtttaacccccgttttaaccccgggttacccccggttaaacccgggg

SEQ ID NO: 276819 - DNA, 599 bp, Homo sapiens
  misc_feature: GYAE6OF01A5WG7.22.34.D01.1.454.CMB.1.raw
  modified_base (343)..(343): a, c, t, g, unknown or other
  misc_feature (343)..(343): n is a, c, g, or t
  modified_base (359)..(359): a, c, t, g, unknown or other
  misc_feature (359)..(359): n is a, c, g, or t
  modified_base (366)..(366): a, c, t, g, unknown or other
  misc_feature (366)..(366): n is a, c, g, or t
  modified_base (375)..(375): a, c, t, g, unknown or other
  misc_feature (375)..(375): n is a, c, g, or t
  modified_base (479)..(479): a, c, t, g, unknown or other
  misc_feature (479)..(479): n is a, c, g, or t
  modified_base (510)..(510): a, c, t, g, unknown or other
  misc_feature (510)..(510): n is a, c, g, or t
tcagacatacgcgtcacgaccggtgctcgatttagatcgtctgtgttgggtttgggggaaggaggaagactgacggtcctgtcccaggtgcagctgcaggagtcgggcccaggactggtgaagccttcggagaccctgtccctcacctgtactgtctctggtggctccgtcactggttaccactggagctggatccggcacgcccccagggaagggactggagtggattggctatattcttacagtggccgcaccaactcccacccctcctcaagcgtcgagccaccatatcagtcgacacgtccaagacccagttcctccctgaaactgaggtctgtgaccncagcggacacggtccngtatacngtgcgacgnagtccggtcgatatctggccgttcgaccctggggccagggaaccctggtcaccggtctcctgacgcctccgaccaacgggcccacgtcggtccctttcccccgngggtcccgccccgtagccttccacgggtacncctaaccgtcccgaagaccggccacgccggccgggtcccctaggggcctcgcccggtaaggtcaaacggtccctacgttccgaacccgg

SEQ ID NO: 276820 - DNA, 747 bp, Homo sapiens
  misc_feature: GYAE6OF01E0XRC.22.34.D01.1.454.CMB.1.raw
  modified_base (187)..(187): a, c, t, g, unknown or other
  misc_feature (187)..(187): n is a, c, g, or t
tcagacatacgcgtcacgaccggtgctcgatttagatcgtctgtgttgggtttgggggggaagaggaagactgacggtcctgtcccaggtgcagctgcaggagtcgggcccaggactggtgaagccttcggagaccctgtccctcacctgtactgtctctggtggctccgcactggttaccactggngctggatccggcacgcccccagggaaggactggagtggattggctatatttcgttacagtggccgtcaccgaactccccaccccgtccctccaagacgtccgacgcccaccgatactcacgtccgaccacgtccaaagacctagttacctcctagaaactgacggtctgtcgaccgcacgccgacacggccgtgtatacgtgtgcgtagagtacggtccgggtaccgagtacgtcgtacgggtcccgtttaccgaccccggtgggcccgaacgggtaccccgtagggtaccccgtacccgtcctcccgtaccgaccgtccctacccgtaacccgaaccgggtcccctaacggttcccggttccccgttacccccgtcggcccgacccccgttgtacccttccgaacgggaccgtacccgaacccgtaccgaccgggtacgaccctaaccggccggtaccccgggcccggtcggggtacccgttacccggtaccccgggtttaacgggtaaaacccggttaaccctttaccccggtttacccggaacccggttaacccggg

SEQ ID NO: 276821 - DNA, 903 bp, Homo sapiens
  misc_feature: GYAE6OF01C81DD.22.34.D01.1.454.CMB.1.raw
tcagacatacgcgtcacgaccggtgctcgatttagatcgtctgtgttgggtttgggggaagaggaagactgacggtcctgtcccaggtgcagctgcaggagtcgggcccaggactggtgaagccttcggagaccctgtccctcacctgtactgtctcgtggtcgctccgtcacgtggttaccactggagcgtggacgtccggcacgacccgacgggagggacgtggagtcggagttcggacgtattacgtttctacgtacgtcggccgtaccacctaacctacccctaccccctaccttaccaagtacggtaccgacggacccaaaccgtactactaccacggtccgaacgtaacccggtacctaaacgacccgttaaccgttaccgttacccgtaacgtaacggtacggttaacggttcgttacgtaccggtaacccgtacgaccggtaacggacccggtaccgggtaccgttacggttaacgtttaacgtcgggttacggaacgggtacggtaacgggtaccgggttacccgggttccgtaaacgtacggtttcccggtacccgggttaccgggttaccccgggtacccccgggtaccggggtaccccggggaaccggggtaacccggttaccgggtaccccgtacccggttccttaccccggtaccgtaccggtacccctaacccgacccggaaccggtaccccgtacggtttaccccggtaccccgtttcccccgggtaccgccccgttaccggtccgtacccgttaccggaccttaaccgggaccctacccgaccggtacgaccggtaccgaaccggacccggttcccgggacccgggttccggcgttcccggaccgtaccgggagtaaccccggtaacttcccggtccgtaacccgg

SEQ ID NO: 276822 - DNA, 664 bp, Homo sapiens
  misc_feature: GYAE6OF01DFGAM.22.34.D01.1.454.CMB.1.raw
  modified_base (371)..(371): a, c, t, g, unknown or other
  misc_feature (371)..(371): n is a, c, g, or t
  modified_base (585)..(585): a, c, t, g, unknown or other
  misc_feature (585)..(585): n is a, c, g, or t
tcagacatacgcgtcacgaccggtgctcgatttagatcgtctgtgttgggtttggggggaagaggaagactgacggtcctgtcccaggtgcagctgcaggagtcgggcccaggactggtgaagccttcggagaccctgtccctcacctgtactgtctcgtggtgctccgtcactggttaccactggagcgtggactccggcacgccccgagggaagggactggagtggattggctattatttcttacagtggccgacaccaactccccacccctcctacaagacgtcgagcccaccatactcgagtcgacaccgtacaaacgaaccacgttcctaccctagaaaacctggtaaggtctaggtcgaacccgngaacggacggacacgggtccgtggttaacttacgtgcgacgaggagacggtccggtacagttagtccgtcggccgttaccggacccgtcgggaccgacgggaacctcggtacaccgtctcctacgacgcctaccaccgaacggcccaagttccgtacccttccccgtgcccgtcccgtcgcctaccgacggacgtacccgacccgttaccgganacgaccgtaaccggacgtcccggacccggtgggcctcggccgtcgggtaaccaacggttacctacccgtcgtaacccgg

SEQ ID NO: 276823 - DNA, 712 bp, Homo sapiens
  misc_feature: GYAE6OF01E5J6O.22.34.D01.1.454.CMB.1.raw
  modified_base (260)..(260): a, c, t, g, unknown or other
  misc_feature (260)..(260): n is a, c, g, or t
  modified_base (303)..(303): a, c, t, g, unknown or other
  misc_feature (303)..(303): n is a, c, g, or t
  modified_base (367)..(367): a, c, t, g, unknown or other
  misc_feature (367)..(367): n is a, c, g, or t
  modified_base (399)..(399): a, c, t, g, unknown or other
  misc_feature (399)..(399): n is a, c, g, or t
tcagacatacgcgtcacgaccggtgctcgatttagatcgtctgtgttgggtttgggggaagaggaagactgacggtcctgtcccaggtgcagctgcaggagtcgggcccaggactgggtgaagcctttcgggacgaccctgtccctcacctgtactgtctctggtgctccgtcactcggttaccactggagctggactccggcacgcccccgaggggaaggactgggagtggattggactatatttctacgagtcggccncaccacctccccacccctcctacagacgtcgacgccacatacncagtcaacacgtaccaacgaacctgttcctaccctagtaaactggtacggttctgtacgaccgngacgcggaccacgggtccgttagtacttacgngtcgacggaggacggtaccggtccggtacgattacgtccgtcgggtacccgttccggacccggtgggacccgacgggtacccgttggtacccgtaccggtcctccgtacgaccgtcctacccaaccggaacccggccctaacggttcccggttcccgttaccccgtcggccccgtacccgttcgtccgtaccgacggtaccgcctaacccgtaccgaggtaccgaccgaccggtaccgggcccggtacccggtcgggccgtcggtcccggttacggaccgtaaccgggtacccttaccgttcccggtaaccgg

SEQ ID NO: 276824 - DNA, 956 bp, Homo sapiens
  misc_feature: GYAE6OF01ESTIA.22.34.D01.1.454.CMB.1.raw
  modified_base (514)..(514): a, c, t, g, unknown or other
  misc_feature (514)..(514): n is a, c, g, or t
tcagacatacgcgtcacgaccggtgctcgatttagatcgtctgtgttgggtttggggggaagaggaagactgacggtcctgtcccaggtgcagctgcaggagtcgggcccaggactggtgaacgccttcggacgaccctgtccctcacctgtactgtctcgtggtcgcctccgtctacgttcggttaccacgtggacgtcgtggacgtccggccaccggacccccggaaggggaacgggacgtagggaggtggtacgttggacttaacttacttttacgttacgtacggtcggcccgtaccaaacccgtaccccttaccccctaaccccccgttacccgttaacgaacggtaccgtaccggaccgtacccaaccgtaattactaccgacgtaaccgaccgtaaccgtaaccaaaccgtaaccgtacggttaccctaccggtaacgtaacgtcggtacggtcgtacggtaccgaccgtgaccggaccggacgaccggtcgttagttacgttacgnggtacggagtacggtacggtccggtccgggtactaacgttacggttcccggtaccgggttacccggttacccgggtccccgggtaaccggggtaccccggtaaccgggggtaaccccgttcccggggttaaccctaacccggttccccgttaccccggttaccgaacccggttacccccgtaaaccccggtaacccgggtaacccggtaccccggttaccgtttccccccggttccccggttacccccgggtccggttcccccggtaccccggtcgtacccccggtaaccgggtaccgggtaacccgtacccccgggtacgtacccgggtaaacgcccgggaaccgtaccccgggaccggggccccggttacgggttcggcccgttacccggtacggtaccggtaccgtaaaccggtcccttaacccggtccggttaaccgg

SEQ ID NO: 276825 - DNA, 949 bp, Homo sapiens
  misc_feature: GYAE6OF01B7UB5.22.34.D01.1.454.CMB.1.raw
  modified_base (940)..(940): a, c, t, g, unknown or other
  misc_feature (940)..(940): n is a, c, g, or t
tcagacatacgcgtcacgaccggtgctcgatttagatcgtctgtgttgggtttgggggaagaggaagactgacggtcctgtcccaggtgcagctgcaggagtcgggcccaggactggtgaagccttcggacgaccctgtccctcacctgtactgtctcgtggtcggctccgtcacgtcggttaccacgtggagcgtggactcccggacaccggacccccggaagggggaacgggacgtgggaaggtggtagttggtacttaatttactttacgttaacgagggtcggcccgtaccaaacccctaacccgtcccccctacccccgtaccctacgaaacgtacgtaccggaccgacccaacctaatactccgacggtaccgaactaccggtaaccaaacggtaacctacggtttccctacccgtaagaaaccgtggtacggttctacggccgaaccgcgtaggaccggtaacgaccggtaccgttagttaacgttaacggtgtacggacggtaaacgggtaccggtaccggggttaccgggtaacctacgttacggtccgggttaacccgggttccccggttaacccggtccccgggggttaacggggaaccccggtaaaccccgggggttacccgttaccggggtacccccgttaaccccggttacccgtacccccgtacggttaaccccccgcccgttaaaccccgggaaacccgggtacccccgggtccctaacccgggtttccccggtttccccccggttccccccggccgggttacccccgtcccggtccgtaccccgtaacccggaaggtaccccgacccgtacccgtaaccgggaaacgtacccgcctaacgggccccgggtcccggtaccgggtacggtcccgtacggtaacccggggtttaggtaaacccgtaccccgtttataaccccgggnggttaacgg

SEQ ID NO: 276826 - DNA, 833 bp, Homo sapiens
  misc_feature: GYAE6OF01BH6KI.22.34.D01.1.454.CMB.1.raw
  modified_base (373)..(373): a, c, t, g, unknown or other
  misc_feature (373)..(373): n is a, c, g, or t
tcagacatacgcgtcacgaccggtgctcgatttagatcgtctgtgttgggtttgggggaagaggaagactgacggtcctgtcccaggtgcagctgcaggagtcgggcccaggactggtgaagccttcggagaccctcgtccctctacctttactgtctctggtcggctccgtcacttggttaccacgtggagctggactccggcacgaccccgagggaacgggacgtggagtggtattggacttatatttcttacaggtcggccgaccaaccgaaccttccccaccccttcctacgaacgacgtccggacaccactatactcacgtcgacaccgtaccaagaacctacgtcctaccctagaactgtaacggtntacgtcgaccgacgaggaccggacgtaccgggtcggttacgttaacttacggtacggtacgacggtaacggtacggtaccgggtccggtaccgtaagtaccgtcggttccgggtccccggttcccggtaccccgggtcggggaccccgtaacggggtaaccccgttcgggacccgtaccccggttccttacccgacgtacccgtaccccgttaccccgaaaccggtaacccgggaccccttaccggtcccgggtttacccctcccccggttcgggcccccgttacccgtcggtaccccgttaccggaccggaacgtacccccgtaccgtaaccgggaccgtacgacccgtaaccggtacccgggtcccgggtacccgtcggggtaccctccgggtacccggttaacgggtacccgaaacccgggttaacccgttccccgtaaccggtacccgggttaccg

SEQ ID NO: 276827 - DNA, 905 bp, Homo sapiens
  misc_feature: GYAE6OF01B92O1.22.34.D01.1.454.CMB.1.raw
  modified_base (527)..(527): a, c, t, g, unknown or other
  misc_feature (527)..(527): n is a, c, g, or t
tcagacatacgcgtcacgaccggtgctcgatttagatcgtctgtgttgggtttgggggaagaggaagactgacggtcctgtcccaggtgcagctgcgaggagtcgggcccaggactgggtgaacgtccgttacggacaccctgtccctacacctgtactcgtctcgtggtgcctccgtctacttacggtaccagtaggacgcgtggacgtccggacgacccggaccccggaaggggaacgggtcgtggggaaggtggtagttcggtacttaatttacttttacgtacagggtccgacccgtacctaacccctaacccctcccccctacccctacccgtacgaaggtaccggaccgaccgaccctacctaattaccgtacgtacgtaccgaacgtaaccgtacccgaaacgtacccgttcgttaccccgtacccgtaaggtaaacggtcggtaccgttacggtacggtaccggacccggtacgaccgggaccggaacggtaccggttaccgttagtttacttacgggnggttaacggcggaaggtacggtaccgggttacgggacctgttaccgtcggtccggtacccgtaccggtaccgggtccgggaccggaccggtacggtaccgtacccgtaccgttcccgtccgtaccgtccgtacccgacccgaacccggtacccggaccccgtaccggttccccgttaccccgtccccggtacccggtccccgtacccggtaccgtaccggtacccgtaccggtacccgtacccgtacccgtaccgggaacgtacccggacccggaaccggtcccgggtacccgggtacccggttaccgggaccgttacccggtacggtaacccggtaaccggtaaccgttacccggttaacccgttcccggtaaccgg

SEQ ID NO: 276828 - DNA, 369 bp, Homo sapiens
  misc_feature: GYAE6OF01C5LH5.22.34.D01.1.454.CMB.1.raw
  modified_base (351)..(369): a, c, t, g, unknown or other
  misc_feature (351)..(369): n is a, c, g, or t
tcagacatacgcgtcacgaccggtgctcgatttagatcgtctgtgaccgcagcggacacggccgtgtattactgtgcgagagaggtccgggtccgatatctggccgttccgaccccgtgggccacgggaaccctggtcaccgtctcctcacgccctccaccgaacgggcccctagtccggttcccttcccccgtggcccgtccctcgcctcccgaggcgccacccgtccgagacgccacgacggcccggtcccgtggggcctcggccgttacggtacgaacggtaccttccttccgacgtaccgttagtgtcgtggtacggcgggtcctgggacgaaggccgtacgatagnnnnnnnnnnnnnnnnnnn

SEQ ID NO: 276829 - DNA, 935 bp, Homo sapiens
  misc_feature: GYAE6OF01AY4KC.22.34.D01.1.454.CMB.1.raw
tcagacatacgcgtcacgaccggtgctcgattttagatcgtctgtgttgggtttggggggaagaggaagactgacggtcctgtcccaggtgcagctgcaggagtcgggcccaggactggtgaagccttcggagaccctgtccctcacctgtactgtctcgtggtgctccgtcactggttaccactggacgctggactccggcacgccccgaagggaagggactggaggtggtattcgggtcttaattacttttaccgttaacgacggttcggcccgacctacccgaaacctcccccgacccccttccctaccaacggtacggtccggacgaccccaccgtattactacgacgtaccgaactaccgtaccaaacggaaccccttaggttccctccctaagtaaaccgtggtaacggtcgtcgtacgaccgacgacggtcggaccgtacgggtccgttagttaactttacccggtggtaccggacgtaacgggtaacggtacggggtttaccccggggaccgttaaagtacgttttccgtaaccggggttccccgtttaaccccgggtacccccggtggggggtaccccgtaacccgggggtaaaccccgttcgggttaaccccgtaaccccgttacccgttccgtttaacccggacccgttaccccgttaaccccggacccggtaaacccgggtcccccgttaaccggttcccgggtttaccccccgttttacccccccggttcgggtaccccggttccccccgttcggtaccccgttacccggaaccgggtaccccggtacccgtaaccccggttacccggaaccgggtacgaaccccgtaaccggtacgggcccccgggttacccggtcgggtccccgtagttccccgtacggttaacccggaacgtacccgtttaggtaccccttaaccgggg

SEQ ID NO: 276830 - DNA, 285 bp, Homo sapiens; identical to SEQ ID NO: 276758
  misc_feature: GYAE6OF02ITSCZ.22.34.D01.1.454.CMB.1.raw
  modified_base (282)..(285): a, c, t, g, unknown or other
  misc_feature (282)..(285): n is a, c, g, or t

SEQ ID NO: 276831 - DNA, 287 bp, Homo sapiens; identical to SEQ ID NO: 276765
  misc_feature: GYAE6OF02H44E6.22.34.D01.1.454.CMB.1.raw
  modified_base (283)..(287): a, c, t, g, unknown or other
  misc_feature (283)..(287): n is a, c, g, or t

SEQ ID NO: 276832 - DNA, 558 bp, Homo sapiens
  misc_feature: GYAE6OF02GGICP.22.34.D01.1.454.CMB.1.raw
tcagacatacgcgtcacgaccggtgctcgatttagatcgtctgtgttgggtttgggggaagaggaagactgacggtcctgtcccaggtgcagctgcaggagtcgggcccaggactggtgaagccttcggagaccctgtccctcacctgtactgtctctggtggctccgtcactggttaccactggagctggatccggcagcccccagggaagggactggagtggattggctatatttcttacagtggccgcaccaactcccacccctccctcaagagtcgagccaccatatcagtcgacacgtccaagaaccagttctccctgaaactgaggtctgtgaccgcagcggacacggccgtgtattactgtgcgagagagtccgggtcgatatctggccgttcgaccctgggccagggaaccctggtcaccgtctcctcagcctccaccaaggcccatccggtccttccccgtggccgccctcgcctccaggacgcacctccgagacgcacgcggccggcccgtgggcctgccctggtccaaggaccttaccttccaccgg

SEQ ID NO: 276833 - DNA, 285 bp, Homo sapiens; identical to SEQ ID NO: 276758
  misc_feature: GYAE6OF02GI5CY.22.34.D01.1.454.CMB.1.raw
  modified_base (282)..(285): a, c, t, g, unknown or other
  misc_feature (282)..(285): n is a, c, g, or t

SEQ ID NO: 276834 - DNA, 582 bp, Homo sapiens
  misc_feature: GYAE6OF02HNHIA.22.34.D01.1.454.CMB.1.raw
tcagacatacgcgtcacgaccggtgctcgatttagatcgtctgtgttgggtttgggggaagaggaagactgacggtcctgtcccaggtgcagctgcaggagtcgggcccaggactggtgaagccttcggagaccctgtccctcacctgtactgtctctggtggctccgtcactggttaccactggagctggatccggcagcccccagggaagggactggagtggattggctatatttcttacagtggccgcaccaactcccacccctccctcaagagtcgagccaccatatcagtcgacacgtccaagaaccagttctccctgaaactgaggtctgtgaccgcagcggacacggccgtgtattactgtgcgagagagtccgggtccatactcgtggccgttcgacccgtggggccacgggaaccctggtcaccgtctcctcacgcctccaccaacgggcccagtccggtccttcccccgtggccgtcccctgcctccgacggacgccaccctccgagacgcaccgaggccggcccgtgggcctgcccgtcgggtaccaagggtccttaccgttcccgaccgg

SEQ ID NO: 276835 - DNA, 654 bp, Homo sapiens
  misc_feature: GYAE6OF02J30S5.22.34.D01.1.454.CMB.1.raw
  modified_base (323)..(323): a, c, t, g, unknown or other
  misc_feature (323)..(323): n is a, c, g, or t
  modified_base (329)..(329): a, c, t, g, unknown or other
  misc_feature (329)..(329): n is a, c, g, or t
  modified_base (381)..(381): a, c, t, g, unknown or other
  misc_feature (381)..(381): n is a, c, g, or t
  modified_base (572)..(572): a, c, t, g, unknown or other
  misc_feature (572)..(572): n is a, c, g, or t
tcagacatacgcgtcacgaccggtgctcgatttagatcgtctgtgttgggtttgggggtaagaggaagactgacggtcctgtcccaggtgcagctgcaggagtcgggtccaggactggtgaagccttcggagaccctgtccctcacctgtactgtctctggtggctccgtcactggttaccactggagctggactccggcacgcccccgagggagggactgggagtggattggctatatttcttacagtcggccgcaccaacctccccacccctccctcaagacgtcgagcccacatactcagtccgacacgtccaacgaccngttccncctagaactgagtctgtcgaccgcacggcggacacggtcgtcgtattaccgngtcgacgacggacgacggttccgggacgtacttacgtccgtcgggtcccgtttaccggaccccggttcggggacccgtacgggaaccccgtcgggtaccctaccggtccttccctccgacgtccctacccgacccgaacggtccctacgtccggtcccttcccgcggcccgtccctgcctccgaggtaccnccgaccgtccgacgacgccgacgccggccgtccgtcggtaccacggtcggtacaacggtcccttaccgtccgaccgttacgg

SEQ ID NO: 276836 - DNA, 709 bp, Homo sapiens
  misc_feature: GYAE6OF02IV5YF.22.34.D01.1.454.CMB.1.raw
  modified_base (409)..(409): a, c, t, g, unknown or other
  misc_feature (409)..(409): n is a, c, g, or t
tcagacatacgcgtcacgaccggtgctcgattttagatcgtctgtgtttgggttttggggggaagaggaagactggttaccggtccttgtcccaggtttagcgagcctgcaggagtcgggcccaggactgggtgaagcctttcggagggacccgtgtccgtccactcgtacgtggtcctctaggtggtcctccgtcactggttacccactggagtctggactaccggctacgtccccccgtagggaacggacctgggacgtcggagttggcctagtacgtttacgttactaggtggccggcgacccaacttccccacccctcccctcaacgagtacgaggacccaccaatacgtccagttccgacacgtcccaacgaaccgaggttcctccctgaaacctgacggtccnggtacgacccgactagacggaaccaccggaccgttgttaacttactgtcgacgagagacgtccgggtcgagtagtctcgggaccgttcgaccccgtgggacctagggtacccttcggtccgtaccgtcgtccgtcgacgtccttaccgtaccgtaaccggtcctacgtccggtcctccccgtggtccgtcccgttcgtcccgtcccgacggccgccgaaccctccggacgaccgtcgaccgcgccggtcccgtcggaccgtcgccgtcggtcccgtacggtacccttccgtcccgtaccg

SEQ ID NO: 276837 - DNA, 595 bp, Homo sapiens
  misc_feature: GYAE6OF02I7IOG.22.34.D01.1.454.CMB.1.raw
  modified_base (372)..(372): a, c, t, g, unknown or other
  misc_feature (372)..(372): n is a, c, g, or t
  modified_base (488)..(488): a, c, t, g, unknown or other
  misc_feature (488)..(488): n is a, c, g, or t
tcagacatacgcgtcacgaccggtgctcgatttagatcgtctgtgttgggtttgggggaagaggaagactgacggtcctgtcccaggtgcagctgcaggagtcgggcccaggactggtgaagccttcggagaccctgtccctcacctgtactgtctctggtggctccgtcactggttaccactggagctggatccggcagcccccagggaagggactggagtggattggctatatttcttacagtggccgcaccaactcccacccctccctcaagagtcgagccaccatatcagtcgacacgtccaagaacccagttcctccctagaaaacctgaggtctggtcgaccgcagcggacacggcctgtattacngtgcgagagacgtccgggtcatatcgtgccgttcgacccgtgggccagggaaccctggtcaccgtctccgtcacgcctccacgaacgggcccagtccggtccttccccgtggcccncccgtgccctccgacgacgccaccgtccgacgacgaccacgacggcccggcccgtcgggaccttggcccgttcgggtaccaacgggtacctaccgttccctaaccgg

SEQ ID NO: 276838 - DNA, 558 bp, Homo sapiens
  misc_feature: GYAE6OF02GX9UJ.22.34.D01.1.454.CMB.1.raw
  modified_base (469)..(469): a, c, t, g, unknown or other
  misc_feature (469)..(469): n is a, c, g, or t
tcagacatacgcgtcacgaccggtgctcgatttagatcgtctgtgttgggtttgggggaagaggaagactgacggtcctgtcccaggtgcagctgcaggagtcgggcccaggactggtgaagccttcggagaccctgtccctcacctgtactgtctctggtggctccgtcactggttaccactggagctggatccggcagcccccagggaagggactggagtggattggctatatttcttacagtggccgcaccaactcccacccctccctcaagagtcgagccaccatatcagtcgacacgtccaagaaccagttctccctgaaactgaggtctgtgaccgcagcggacacggccgtgtattactgtgcgagagagtccggtcgatatctggccgttcgaccctggggccagggaaccctggtcaccgtctcctcagcctccaccgacggcccatccgtccttccccnggccgccctgcctccgacggcgccacctccgagacgcacgacgccggcccgtgggcctgcccgtggtaccaagggacctacgtccacgg

SEQ ID NO: 276839 - DNA, 578 bp, Homo sapiens
  misc_feature: GYAE6OF02H2AW4.22.34.D01.1.454.CMB.1.raw
tcagacatacgcgtcacgaccggtgctcgatttagatcgtctgtgttgggtttgggggaagaggaagactgacggtcctgtcccaggtgcagctgcaggagtcgggcccaggactggtgaagccttcggagaccctgtccctcacctgtactgtctctggtggctccgtcactggttaccactggagctggatccggcagcccccagggaagggactggagtggattggctatatttcttacagtggccgcaccaactcccacccctcctcaagagtcgagccaccatatcagtcgacacgtccaagaacccagttctccctgaaactgagtctgtgaccgcagcggacacggccgtgtattactgtgcgagagagtccgggtccgatatctgggcccgtttcgaccccgtggggcccagggaacccctggtccaccgtcctcctcacgccttccaccaacgggcccatccggtccttccccctcggccgcccctgcctccgacggcgccaccctccgagacgcacgacgccggcccgtgggcctcgcccgtggtccaaggacctaccgttccaccgg

SEQ ID NO: 276840 - DNA, 553 bp, Homo sapiens
  misc_feature: GYAE6OF02GRPR0.22.34.D01.1.454.CMB.1.raw
  modified_base (315)..(315): a, c, t, g, unknown or other
  misc_feature (315)..(315): n is a, c, g, or t
  modified_base (339)..(339): a, c, t, g, unknown or other
  misc_feature (339)..(339): n is a, c, g, or t
tcagacatacgcgtcacgaccggtgctcgatttagatcgtctgtgttgggtttgggggaagaggaagactgacggtcctgtcccaggtgcagctgcaggagtcgggcccaggactggtgaagccttcggagaccctgtccctcacctgtactgtctctggtggctccgtcactggttaccactggagctggatccggcagcccccagggaggactggagtggattggctatatttctacagtggccgcaccaactcccacccctcctcaagacgtcgagccaccatatcagtcgacacgtccaagaaccagttcncctgaaactgaggtctgtgaccgnagcggacacgggcctgtattactgtgcgagagagtccggggtcatatctggccgtttcgaccctggggccagggaaccctggtcaccgtctcctcagcctccaccaacgggcccatcggtccttcccctggccgccctgcctccgaggacgcacctccgagacgcacagccggccctgggctgcccttgggtccaagggacctaccttccacgg

SEQ ID NO: 276841 - DNA, 596 bp, Homo sapiens
  misc_feature: GYAE6OF02GSAI8.22.34.D01.1.454.CMB.1.raw
tcagacatacgcgtcacgaccggtgctcgatttagatcgtctgtgttgggtttggggggaagaggaagactgacggtcctgtcccaggtgcagctgcaggagtcgggcccaggactggtgaagccttcggagaccctgtccctcacctgtactgtctctggtggctccgtcactggttaccactggagctggatccggcagcccccagggaagggactggagtggattggctatatttcttacagtggccgcaccaactcccacccctcctcaagagtcgagccaccatatcagtcacacgtccaagaacccagttctccctgaaactgaggtctgtgaccgcagcggacacggccgtgtattactgtgcgagagagtccgggtccgatatcgtggccgttcgaccccgtggggccacgggaaccctggtccaccggtctccctcgacgcctccacccgaacgggcccacgtccggtccttcccccgtggcccgccctcgcctccgacgggtacgccacccgtccgagacgccacgacggccggccctcggggcctcgcccgttgggtaccgaacggaccttaccgttcccaccgg

SEQ ID NO: 276842 - DNA, 595 bp, Homo sapiens
  misc_feature: GYAE6OF02I6OTJ.22.34.D01.1.454.CMB.1.raw
tcagacatacgcgtcacgaccggtgctcgatttagatcgtctgtgttgggtttgggggaagaggaagactgacggtcctgtcccaggtgcagctgcaggagtcgggcccaggactggtgaagccttcggagaccctgtccctcacctttactgtctctggtggctccgtcactggttaccactggagctggatccggcagcccccagggaagggactggagtggattggctatatttcttacagtggccgcaccaactcccacccctccctcaagagtcgagccaccatactcagtccgacacgtccaagaaccagttcctccccgaaactgacggtctgtcgaccgcagcggacacggccgtgtattactgtgcgagagagtccgggtcgatatctggccgttcgaccccgttggggccagggaccctggtccaccgtctcctcacgcctccaccgaacggcccactccggtccttcccccgtggcccgccctcgcctccgaggacgccacccgtccgacgacgccacgacgccggcccgtgggcctcgcccgttggtaccaacgggtaccttaccgttcccgacgtcgttacg

SEQ ID NO: 276843 - DNA, 588 bp, Homo sapiens
  misc_feature: GYAE6OF02IFZEZ.22.34.D01.1.454.CMB.1.raw
  modified_base (344)..(344): a, c, t, g, unknown or other
  misc_feature (344)..(344): n is a, c, g, or t
tcagacatacgcgtcacgaccggtgctcgatttagatcgtctgtgttgggtttgggggaagaggaagactgacggtcctgtcccaggtgcagctgcaggagtcgggcccaggactggtgaagccttcggagaccctgtccctcacctgtactgtctctggtggctccgtcactggttaccactggagctggatccggcagcccccagggaagggactggagtggattggctatatttcttacagtggccgcaccaactcccacccctcctcaagagtcgagccaccatatcagtcgacacgtccaaagaacccagttctccctgaaactgaggtctgtgaccgnagcggacacggccgtgtattactgtgcgagagagtccggggtcatatctgggcccgttcgacccgtggggccacgggaaccctggtcaccgtctcctcacgcctccaccaacgggcccagtccggtccttcccccgtggccgccctgcctccgaggacgccaccctccgacgacgccaccgacggccggcccgtggggcctcggcccgtgggtccgaaacgggtaccttaccgttcccaaccgg

SEQ ID NO: 276844 - DNA, 577 bp, Homo sapiens
  misc_feature: GYAE6OF02HAAWU.22.34.D01.1.454.CMB.1.raw
  modified_base (347)..(347): a, c, t, g, unknown or other
  misc_feature (347)..(347): n is a, c, g, or t
tcagacatacgcgtcacgaccggtgctcgatttagatcgtctgtgttgggtttgggggggaaggaggaagactgacggtcctgtcccaggtgcagctgcaggagtcgggcccaggactggtgaagccttcggagaccctgtccctcacctgtactgtctctggtggctccgtcactggttaccactggagctggatccggcagcccccagggaagggactggagtggattgggctatatttcttacagtggccgcaccaactcccacccctccctcaagagtcgagccaccatatcagtcacacgtccaagaacccagttctccctgaaactgaggtctgtgaccgnagcggacacggccgtgtattactgtgcgagagagtccggtacgatactcgtcggccgttcgacccgtgggccagggtaaccctggtaccacgtctcctcacgcctccaccgtacggcccacgtccggtccttccccgtggccgcccgtgcctccgaggacgccacccgtccgacgacgcacgcggccgcccgtggcctcgccgtcggtccaaggtcctacctccgtacgg

SEQ ID NO: 276845 - DNA, 622 bp, Homo sapiens
  misc_feature: GYAE6OF02F7FA4.22.34.D01.1.454.CMB.1.raw
tcagacatacgcgtcacgaccggtgctcgatttagatcgtctgtgttgggtttggggggaagaggaagactgacggtcctgtcccaggtgcagctgcaggagtcgggcccaggactggtgaagccttcggagaccctgtccctcacctgtactgtctctggtggctccgtcactggttaccactggagctggatccggcagcccccagggaagggactggagtggattggctatatttcttacagtggccgcaccaactcccacccctccctcaagagtcgagccaccatatcagtcgacacgtccaagaaccagttctccctgaaactgaggtctgtgaccgcagcggacacggccgtgtattactgtgcgagagagtccgggtccatactctggccgttcgaccccgtgggccagggaaccctggtcaccgtctcctcacgcctccaccgacgggcccagtccggtccttccccgtggcccgtcccgtcgccctcccgacgggtacgcccgtaacccgttcccgaacggacgaccgaaccgacggcccgggtcccccggtaggggcccttcggcccgttcgggtaccgaacgggtaccttacccgttccccgtaacccgg

SEQ ID NO: 276846 - DNA, 591 bp, Homo sapiens
  misc_feature: GYAE6OF02F83FH.22.34.D01.1.454.CMB.1.raw
  modified_base (277)..(277): a, c, t, g, unknown or other
  misc_feature (277)..(277): n is a, c, g, or t
  modified_base (325)..(325): a, c, t, g, unknown or other
  misc_feature (325)..(325): n is a, c, g, or t
  modified_base (509)..(509): a, c, t, g, unknown or other
  misc_feature (509)..(509): n is a, c, g, or t
tcagacatacgcgtcacgaccggtgctcgatttagatcgtctgtgttgggtttgggggaagaggaagactgacggtcctgtcccaggtgcagctgcaggagtcgggcccaggactggtgaagccttcggagaccctgtccctcacctgtactgtctctggtggctccgtcactggttaccactggagctggatccggcagcccccagggaagggactggagtggattggctatatttcttacagtggccgcaccaactccccacccctccctcaagngtcgagcccaccatatcagtcgacacgtccaagaaccagttcctcccngaaacctgaggtctgtgaccgcagcggacacggccgtgtattactgtgcgagagagtccgggtcatatctggtccgttccgaccccgtgggcccagggaaccctggtccaccgtctcctcacgcctaccaccaacgggcccagtccggtcccttcccccgtggcccgccctgcctccgaggacnccaccgtccgagacgccacgacggccggtcccgtgggtacctcgcccgttgggtaccaacgggtacctacgttcccaaccgg

SEQ ID NO: 276847 - DNA, 669 bp, Homo sapiens
  misc_feature: GYAE6OF02ISTA0.22.34.D01.1.454.CMB.1.raw
tcagacatacgcgtcacgaccggtgctcgatttagatcgtctgtgttgggtttggggggaagaggaagactgacggtcctgtcccaggtgcagctgcaggagtcgggcccaggactggtgaagccttcggagaccctgtccctcacctgtactgtctctggtggctccgtcactggttaccactggagctggatccggcagcccccagggaagggactggagtggattggctatatttcttacagtggccgcaccaactcccacccctccctcaagagtcgagccaccatatcagtcgacacttccaagaaccagttctcctgaaactgaggtctgtgaccgcagcggacacggccgtgtattactgtgcgagagacggtccgggtcgatatcgtcggccgtttcgacccccgttggggacccaacggggtaaccccgtgggtacctacccggtcctcccgtccacgccctaccaacccgaacgggcccctaacgttccggtccctttacccccgtcgggcccgtccccgttcgcccgttcccgaacgggtaccgcccgtaacccgttcccggaacggacgaccgtaaccgacggcccggcccggtgggtcccgttcggcccgttcgggtacccgaaacgggtacccttacccgttacccgtaacccgg

SEQ ID NO: 276848 - DNA, 621 bp, Homo sapiens
  misc_feature: GYAE6OF02JP1WD.22.34.D01.1.454.CMB.1.raw
  modified_base (508)..(508): a, c, t, g, unknown or other
  misc_feature (508)..(508): n is a, c, g, or t
tcagacatacgcgtcacgaccggtgctcgatttagatcgtctgtgttgggtttggggggaagaggaagactgacggtcctgtcccaggtgcagctgcaggagtcgggcccaggactggtgaagccttcggagaccctgtccctcacctgtactgtctctggtggctccgtcactggttaccactggagctggatccggcagcccccagggaggactggagtggattggctagtatttcttacagtggtccgcaccaactcccacccctcctcaagagtcgagccaccatactcacgtcgacacgtccaagaacccagttcctccctagaaactgacgtctgtcgaccgcagcggacacggcgtagtagttaccgtgtcgacgagagtacggtaccggtccgatactcgtacggccgttccgacccgtcggggccacgggtaaccctggtccaccgtctcctcgacgcctaccgaccacggccctacgtcggtaccttccccgtggccncccgtcgtcctacccgacggcaccgtacccgtccgacggtacgccgacgaccggccggcccgttcggccgtcgacccgtcggacctaacgggcccttaccgtcccgtacccgg

SEQ ID NO: 276849 - DNA, 759 bp, Homo sapiens
  misc_feature: GYAE6OF02G2KIS.22.34.D01.1.454.CMB.1.raw
  modified_base (343)..(343): a, c, t, g, unknown or other
  misc_feature (343)..(343): n is a, c, g, or t
tcagacatacgcgtcacgaccggtgctcgatttagatcgtctgtgttgggtttgggggaagaggaagactgacggtcctgtcccaggtgcagctgcaggagtcgggccccaggactggtgaagccttcggagaccctgtccctcacctgtactgtctctggtggctccgtcactggttaccactggagctggatccggcagcccccagggaagggactggagtggattggctatatttcttacagtggccgcaccaactcccacccctcctcaagagtcgagccaccatatcagtcgacacgtccaagaaccagttctccctgaaactgagtctgtcgaccgnacgcggacaccggccgtagtacttacgtgtgacgtagacggacggttccgggtaccgaattactccgtcgggtcccgtttacccggaccccggttcgggggaccccgaaacggggtaacccccgttggggttacccctaacccgggttcccttccccgttaccgaccgtaccccttacccgaaaccccggtaaaaccggggcccccgtaacgtttcccgggttacccccttttaccccccggtcgggtacccccgtccccgttccggtccccgttacccgaacggggtacccgaccccgtaaccccgttcccgggaaggtaccgaccgaacccgaccgggcccggtccccggtacgggcccgttcggcccgttacgggtaaccgaacgggtaccctttacccttcccggtaaccgg

SEQ ID NO: 276850 - DNA, 578 bp, Homo sapiens
  misc_feature: GYAE6OF02H3Z3J.22.34.D01.1.454.CMB.1.raw
  modified_base (389)..(389): a, c, t, g, unknown or other
  misc_feature (389)..(389): n is a, c, g, or t
tcagacatacgcgtcacgaccggtgctcgatttagatcgtctgtgttgggtttgggggaagaggaagactgacggtcctgtcccaggtgcagctgcaggagtcgggcccaggactggtgaagccttcggagaccctgtccctcacctgtactgtctctggtggctccgtcactggttaccactggagctggatccggcagcccccagggaagggactggagtggattggctatatttcttacagtggccgcaccaactcccacccctccctcaagagtcgagccaccatatcagtcgacacgtccaagaaccagttctccctgaaactgaggtctgtgaccgcagcggacacggccgtgtattactgtgcgagagagtccgggtccatntctggccgttcgaccctggggccagggaaccctggtcaccgtctcctcacgcctccaccgaacgggcccagtccggtccttcccccgtggcccgccctcgcctccgacggacgccaccctccgacgacgccacgcgccggccctcgggcctcggcccgtggtccgaaggtaccttaccgttcccaccgg

SEQ ID NO: 276851 - DNA, 568 bp, Homo sapiens
  misc_feature: GYAE6OF02I79H9.22.34.D01.1.454.CMB.1.raw
  modified_base (435)..(435): a, c, t, g, unknown or other
  misc_feature (435)..(435): n is a, c, g, or t
  modified_base (483)..(483): a, c, t, g, unknown or other
  misc_feature (483)..(483): n is a, c, g, or t
  modified_base (503)..(503): a, c, t, g, unknown or other
  misc_feature (503)..(503): n is a, c, g, or t
  modified_base (508)..(508): a, c, t, g, unknown or other
  misc_feature (508)..(508): n is a, c, g, or t
  modified_base (512)..(512): a, c, t, g, unknown or other
  misc_feature (512)..(512): n is a, c, g, or t
tcagacatacgcgtcacgaccggtgctcgatttagatcgtctgtgttgggtttggggggaagaggaagactgacggtcctgtcccaggtgcagctgcaggagtcgggcccaggactgggtgaagccttcggagaccctgtccctcacctgtactgtctctggtggctccgtcactggttaccactggagctggatccggcagcccccagggaagggactggagtggattggctatatttctacagtggccgcaccaactcccacccctccctcaagagtcgagccaccatatcagtcgacgcgtaccaagaccagttcctcctgaaactgaggtctgtcgaccgcagcggacacggccgtagtattacgtgtgcgagagacggtccgggtcgatactcgtcggcccgttcgacccgtgggccacgggacctggcnccgtctctcgacgcctacaccgacggcccacgtccgtcccttccccgngccgccctgcctccgaggcncaccncgancgcacgcgccggccgcggcctcggcctcggtaccgaaggtcctaccgttccaccgg

SEQ ID NO: 276852 - DNA, 624 bp, Homo sapiens
  misc_feature: GYAE6OF02H67ZU.22.34.D01.1.454.CMB.1.raw
  modified_base (326)..(326): a, c, t, g, unknown or other
  misc_feature (326)..(326): n is a, c, g, or t
  modified_base (461)..(461): a, c, t, g, unknown or other
  misc_feature (461)..(461): n is a, c, g, or t
tcagacatacgcgtcacgaccggtgctcgatttagatcgtctgtgttgggtttggggggaagaggaagactgacggtcctgtcccaggtgcagctgcaggagtcgggcccaggactggtgaagcctttcggagaccctgtccctcacctgtactgtctctggtggctccgtcactggttaccactggagctggatccggcacgcccccaggggaagggactgggagtggattggctattatttcttacagtggccgcaccaacctccccaccccctccctcaagacgtcgacgccaccatatcagtcgacacgtaccaagaacccngttcctcctagaaactgacggtctgtcgaccgcagcggacacggccgtgtacttacgtgtgcgagagtacggtcccgggtcatgtccgtggcccgttcgacccgtgggccgaccgggaccctggtccaccgtccncctcgacgccctccaaccgacgggcccacgtccgtcccttcccgtcggccgtccctcgcctccgaggccgccgacctccgacgacgccaaccgcggcccggtcccggtcggccgtccggccgttacggaccgtaaacgggtacccttaccgtaccgtacccgg

SEQ ID NO: 276853 - DNA, 618 bp, Homo sapiens
  misc_feature: GYAE6OF02HOQOJ.22.34.D01.1.454.CMB.1.raw
  modified_base (343)..(343): a, c, t, g, unknown or other
  misc_feature (343)..(343): n is a, c, g, or t
  modified_base (465)..(465): a, c, t, g, unknown or other
  misc_feature (465)..(465): n is a, c, g, or t
  modified_base (481)..(481): a, c, t, g, unknown or other
  misc_feature (481)..(481): n is a, c, g, or t
tcagacatacgcgtcacgaccggtgctcgatttagatcgtctgtgttgggtttgggggaaggaggaagactgacggtcctgtcccaggtgcagctgcaggagtcgggcccaggactggtgaagccttcggagaccctgtccctcacctgtactgtctctggtggctccgtcactggttaccactggagctggatccggcacgcccccagggaacgggactggagtggattggctagtatttcttacagtggccgcacccaactcccacccctcctcaacgacgtcgagccaccatatcagtcgacacgtccaagaacccagttctccctagaaactgacgtcngtgaccgcacgcgacacggccgtagtattactgtcgcgtagagacggtccgggaccgatagtcgtcggacccgtttcgacccgtcgggccgacgggaaccgtcggtcaccgtctcctcgacncctccaccaggcccanccggtccttccctcggcccgtcccgtacgcctccgacggacgccacccgtaccgacgacgctaacgacggccggcccgtcgggtaccgtcggtcccgtcgggtccgaacgggtaccttaccggtacccgtaacccgg

SEQ ID NO: 276854 - DNA, 602 bp, Homo sapiens
  misc_feature: GYAE6OF02GLAQB.22.34.D01.1.454.CMB.1.raw
  modified_base (531)..(531): a, c, t, g, unknown or other
  misc_feature (531)..(531): n is a, c, g, or t
tcagacatacgcgtcacgaccggtgctcgatttagatcgtctgtgttgggtttggggggaagaggaagactgacggtcctgtcccaggtgcagctgcaggagtcgggcccaggactggtgaagccttcggagaccctgtccctcacctgtactgtctctggtggctccgtcactggttaccactggagctggatccggcagcccccagggaagggactggagtggattggctatatttcttacagtggccgcaccaactcccacccctccctcaagagtcgagccaccatatcagtcgacacgtccaagaaccagttctccctgaaactgaggtctgtgaccgcagcggacacggccgtgtattactgtgcgagagagtccgggtccgatatctgggccgttcgaccccgtggggccagggaccctggtcaccgtctccctcacgccctccaccgaacgggcccagtccggtccttcccccgtggccgccctcggcctccgacggacgccacccgtccgagcgccaaccgnggccggccccgtggggccctaggccccgttgggttacccaaacgggtacccttaccgttccctaacccggg

SEQ ID NO: 276855 - DNA, 682 bp, Homo sapiens
  misc_feature: GYAE6OF02G60NU.22.34.D01.1.454.CMB.1.raw
tcagacatacgcgtcacgaccggtgctcgatttagatcgtctgtgttgggtttggggggaagaggaagactgacggtcctgtcccaggtgcagctgcaggagtcgggcccaggactggtgaagccttcggagaccctgtccctcacctgtactgtctctggtggctccgtcactggttaccactggagctggatccggcacgcccccgagggaagggactggagtggattggctatatttctacagtgccgcaccaactcccacccctcctcaagacgtcgacgccaccatactcagtcgacaccgtaccaaacgaaccagttcctccctagaaactggaggtctgtcgaccgcacggacggacacggccgtagtacttacgtgtgcgagaggacgtccgggtacatactcgtcggtccgttccgacccgtcgggaccgaacgggtaccctcggtccaccgtcctcctcgacgccctaccgaccgaacggccctacgtcccgtcccttccccgtcggcccgtacccgtcgtcccgtaccgacggtaccgccgtaacccgtccgaacgtaccgaccgtaaccggacccgggtacccgggtcccggtacgggcccgtaccgggtacccggttacgggtaacccgtaaaccggggtacccctttacccggtacccgtaacccggg

SEQ ID NO: 276856 - DNA, 671 bp, Homo sapiens
  misc_feature: GYAE6OF02HK65D.22.34.D01.1.454.CMB.1.raw
  modified_base (278)..(278): a, c, t, g, unknown or other
  misc_feature (278)..(278): n is a, c, g, or t
tcagacatacgcgtcacgaccggtgctcgatttagatcgtctgtgttgggtttggggggaagaggaagactgacggtcctgtcccaggtgcagctgcaggagtcgggcccaggactggtgaagccttcggagaccctgtccctcacctgtactgtctctggtggctccgtcactggttaccactggagctggatccggcacgcccccgagggaagggactggagtggattggctatatttcttacagtggccgcaccaactcccacccctcctcaagngtcgagccaccatatcagtcgacacgtccaagaacccagttcctcctagaactgacggtctgtcgaccgcagccgacacggccgtgtattactgtgcgaagacggacggtcccgggtaccatacgtcgtcgggtcccgttccgaccccgtggggacccacgggtaacccctcggtccgaccgtccgtccctcgaccgtccctacccgaccgaacggccccgagttcccggtcccgtttcccccgtggccccgtcccgtcggtcctcccggacggaccgcctaacccgtccggaagaccgacccgtaaccgaccgggcccgggtaccccgtcgggcccgtcggtaccccgtagggtaccgtaaccgggtaccctttacccgttaccgtacccgg

SEQ ID NO: 276857 - DNA, 662 bp, Homo sapiens
  misc_feature: GYAE6OF02IUDZG.22.34.D01.1.454.CMB.1.raw
  modified_base (355)..(355): a, c, t, g, unknown or other
  misc_feature (355)..(355): n is a, c, g, or t
tcagacatacgcgtcacgaccggtgctcgatttagatcgtctgtgttgggtttggggggaagaggaagactgacggtcctgtcccaggtgcagctgcaggagtcgggcccaggactggtgaagccttcggagaccctgtccctcacctgtactgtctctggtggctccgtcactggttaccactggagctggatccggcagcccccagggaagggactggagtggattggctatatttcttacagtggccgcaccaactccccacccctccctacaagacgtcgacgcccaccatactcagtcgacacgtccaaagaaccagttcctccctagaaactgaggtcctgtcgaccgnacgcggacacggccgtgtaactacgtgtgacgagagacggtccgggtcatatctcgggccgttccgaccccgtcggggccaacgggaaccctcggtaccaccggtcctcctccgacgccctcccaacccgaacgggcccctaacgtcccggtacccttccccccgtggtcccgtccccgtcgcccgtaccgacggacgccctacccgtccgacgtacgaccgtaccgacggcccgggtcccggtccgggccgttcggcccggttacgggtaccgtaacgggtaccttacccgttacccgaacccggg

SEQ ID NO: 276858 - DNA, 593 bp, Homo sapiens
  misc_feature: GYAE6OF02IZZXM.22.34.D01.1.454.CMB.1.raw
  modified_base (342)..(342): a, c, t, g, unknown or other
  misc_feature (342)..(342): n is a, c, g, or t
  modified_base (365)..(365): a, c, t, g, unknown or other
  misc_feature (365)..(365): n is a, c, g, or t
tcagacatacgcgtcacgaccggtgctcgatttagatcgtctgtgttgggtttggggggaagaggaagactgacggtcctgtcccaggtgcagctgcaggagtcgggcccaggactggtgaagccttcggagaccctgtccctcacctgtactgtctctggtggctccgtcactggttaccactggagctggatccggcagcccccgagggaacgggactggagtggattggctatatttctacagtggccgcaccaactcccacccctcctcaagcgtcgagccaccatatcagtcgacacgtcaagaaccagttctcctgaaactgaggtctgtgaccgnagcgacacggccgtgtattacgngtgcgagagagtcgggtaccatatctggccgttcacccgtgggccacgggaccctggtcaccgtctcctcacgcctaccgaccaacgggccctactaccggtccttcccccgtggttccgccctgccttccgacggacgccacccgtccgacgacgcaccgtacggcccggacccgtagggcctcggtaccgtcggtaccaacgggtaccttaccgttaccaaccggg

SEQ ID NO: 276859 - DNA, 726 bp, Homo sapiens
  misc_feature: GYAE6OF02H95Y6.22.34.D01.1.454.CMB.1.raw
  modified_base (264)..(264): a, c, t, g, unknown or other
  misc_feature (264)..(264): n is a, c, g, or t
  modified_base (368)..(368): a, c, t, g, unknown or other
  misc_feature (368)..(368): n is a, c, g, or t
  modified_base (384)..(384): a, c, t, g, unknown or other
  misc_feature (384)..(384): n is a, c, g, or t
tcagacatacgcgtcacgaccggtgctcgatttagatcgtctgtgttgggtttggggggaagaggaagactgacggtcctgtcccaggtgcagctgcaggagtcgggcccaggactggtgaagccttcggagacctgtccctcacctgtactgtctctggtggctccgtcactggttaccactggagctgggactccggcacgccccagggaagggactggaggtggattggctatatttcttacagtggccgcaccaactccnccccctcctacaacgtacgtcgacgccacataactcaagtcgactacggtaccaagaaccagttcctcccctagaaactgacgtctgtcgaccgctagccgganccggcgtgtacttacnggtgacgtagacgacggtccggtacgattacgtctgggtcccttccgacccgttcgggcccggtaacgggtaccccgtacgggtacctccggttacctcccgttaccgaacgtccccgttacccgaaccccgtaacgggggacccctaacggttcccggtacccgtttcccccgtcgggcccgtacccccgttcgtcccgtacccgttacggaacccggtcctaccccggttaccgacggaccgacccgtaacggacccggacccgggtcccgtacggggacccgttggccccggttagggtacccctaacggggtaccgttaccccgttacgtaacccggg

SEQ ID NO: 276860 - DNA, 780 bp, Homo sapiens
  misc_feature: GYAE6OF02JZ6U2.22.34.D01.1.454.CMB.1.raw
  modified_base (326)..(326): a, c, t, g, unknown or other
  misc_feature (326)..(326): n is a, c, g, or t
tcagacatacgcgtcacgaccggtgctcgatttagatcgtctgtgttgggtttgggggaaggaggaagactgacggtcctgtcccaggtgcagctgcaggagtcgggcccaggactggtgaagccttcggagaccctgtccctcacctgtactgtctctggtggctccgtcactggttaccactggagctggatccggcacgccccgagggaggactggagtggattggctatatttctacagtggccgcacctaactcccaccctcctcaagactcgagccaacctatatcacgtcgacacgtccaagaacccagttccaccgtnaaacgtgtaacggtctagtcgaacccgctaggccggaacaccgggtaccgtcggttaactttaccggtaggtgaccgggaagacggtagttccccgggggtactaatacgtccgtggggttccccgttaccggtaccccggtacggggtacccgtaacggggtaaccccgtacggggttaccgtaacccggttcccgttaccctaccggaccgtaccccgttacccggaacccgtaaccggggccccctaacgttcccggtccctttcccccggttaccggacccgttccccgtaccggcccttcccggaacgggtaccggacccgtacccggttaccccggagtacccggaaccgttacccggaacgggtccccggacccggttccgggtaacgtcccggtaccggttaccgggtacgtaacccgggactttaacccggtactaaccccgggg

SEQ ID NO: 276861 - DNA, 305 bp, Homo sapiens
  misc_feature: GYAE6OF02FIHPU.22.34.D01.1.454.CMB.1.raw
  modified_base (285)..(285): a, c, t, g, unknown or other
  misc_feature (285)..(285): n is a, c, g, or t
  modified_base (290)..(305): a, c, t, g, unknown or other
  misc_feature (290)..(305): n is a, c, g, or t
tcagacatacgcgtcacgaccggtgctcgatttagatcgtctgtgaccgcagcggacacggccgtgtattactgtgcgagagagtccgggtccgatatctggccgttcgaccccgtgggccagggaaccctggtcacccgtctccctcagcctccaccaagggcccatccggtcttccccctggccgcccctgctcccaggacgccacctccgagagcacagcggccctgggcctgccctggtcaaggcctacctccacgcgtatgtctgagcggctggcaggcnatagnnnnnnnnnnnnnnnn

SEQ ID NO: 276862 - DNA, 292 bp, Homo sapiens
  misc_feature: GYAE6OF02FOC2X.22.34.D01.1.454.CMB.1.raw
  modified_base (267)..(267): a, c, t, g, unknown or other
  misc_feature (267)..(267): n is a, c, g, or t
  modified_base (283)..(292): a, c, t, g, unknown or other
  misc_feature (283)..(292): n is a, c, g, or t
tcagacatacgcgtcacgaccggtgctcgatttagatcgtctgtgaccgcagcggacacggccgtgtattactgtgcgagagagtccgggtccgatatctggccgttcgacccctggggccagggaaccctggtcaccgtctcctcagcctccaccaagggcccatcggtcttccccctggcgccctgctccaggagcacctccgagagcacagcggccctgggctgcctggtcaaggactacttccacgcgtatgtctgagcgggntggcaaggcgcatagnnnnnnnnnn

SEQ ID NO: 276863 - DNA, 614 bp, Homo sapiens
  misc_feature: GYAE6OF02I16YJ.22.34.D01.1.454.CMB.1.raw
tcagacatacgcgtcacgaccggtgctcgatttagatcgtctgtgttgggtttggggggaagaggaagactgacggtcctgtcccaggtgcagctgcaggagtcgggcccaggactggtgaagccttcggagaccctgtccctcacctgtactgtctctggtggctccgtcactggttaccactggagctggatccggcagcccccagggaagggactggagtggattggctatatttcttacagtggccgcaccaactcccacccctccctcaagagtcgagccaccatatcagtcgacacgtccaagaaccagttctccctagaaactgaggtctgtgaccgcagcggacacggccgtgtacttacgtgtcgcgagagacgtccgggtccatactcgtcggtcccgttccggaccccgtcggggcccgacgggaaccccgtgggtcctacccgtcctccctcgcgtccctccaccgacgggccccagtccggtcccttccccgtggcccgcccgtcgcctcccgaggacgccacccgtccgagacgaccacgacggccggacccgtcgggcctcggccgtcggtacgaacggtaccttacctccgtaaccgg

SEQ ID NO: 276864 - DNA, 691 bp, Homo sapiens
  misc_feature: GYAE6OF02HM8JZ.22.34.D01.1.454.CMB.1.raw
  modified_base (289)..(289): a, c, t, g, unknown or other
  misc_feature (289)..(289): n is a, c, g, or t
tcagacatacgcgtcacgaccggtgctcgatttagatcgtctgtgttgggtttggggggaagaggaagactgacggtcctgtcccaggtgcagctgcaggagtcgggcccaggactggtgaagccttcggagaccctgtccctcacctgtactgtctctggtggctccgtcactggttaccactggagctggatccggcagcccccagggaaggactggagtggattggctatatttctacagtggccgcaccaactcccacccctcctcaagagtcgagccaccatancagtcgacacgtccaagaacccagttcctcctgaaactgacggtctgtgaccgcaggcggacacggccgtgtattacgtgtgcgagaggacggtccgggtcgatactcgtcgggtcccgttccgaccccgtcggggacccgacggggaaccccgtcgggtaccacccggttccttacccgtcacgccctacccgacccgtaacgggcccctacgttccggtcccgtttccccctcggggcccgtccccgtaccgcccttacccgacgggtaccgaccctaacccgtcccggaacgacggacctaaccggaccggtcccggtaccccggtcggggacccgttccggccccggttacgggtacccgaaccgggtaacccgtttacccgttccccgtaacccggg

SEQ ID NO: 276865 - DNA, 848 bp, Homo sapiens
  misc_feature: GYAE6OF02JLI4K.22.34.D01.1.454.CMB.1.raw
  modified_base (172)..(172): a, c, t, g, unknown or other
  misc_feature (172)..(172): n is a, c, g, or t
  modified_base (187)..(187): a, c, t, g, unknown or other
  misc_feature (187)..(187): n is a, c, g, or t
  modified_base (202)..(202): a, c, t, g, unknown or other
  misc_feature (202)..(202): n is a, c, g, or t
  modified_base (222)..(222): a, c, t, g, unknown or other
  misc_feature (222)..(222): n is a, c, g, or t
  modified_base (227)..(227): a, c, t, g, unknown or other
  misc_feature (227)..(227): n is a, c, g, or t
  modified_base (250)..(250): a, c, t, g, unknown or other
  misc_feature (250)..(250): n is a, c, g, or t
  modified_base (319)..(319): a, c, t, g, unknown or other
  misc_feature (319)..(319): n is a, c, g, or t
tcagacatacgcgtcacgaccggtgctcgatttagatcgtctgtgttgggtttggggggaagaggaagactgacggtcctgtcccaggtgcagctgcaggagtcgggcccaggactggtgaagccttcggagaccctgtccctcacctgtactgtctctggtggccctctcncgttacgtacctcgngctcgtgcgtccgcncccgaccggaggaacggcgnggagngtgtcgtactattcttactacgngtccggccaccaacctacccgtaccccctacccctcctaagaacgtcgtaccgaccacccaactatacncgtacgtaccaaccttaccgaaccgaaacgacccgttacgttccctaccgaaagttaacgcggtacgttctacggtacggacccgagaccgggtacgaaccggccggtcgttaatttaactcggtcgacgggagtacggaacggttaccgggtccccggtaataattccgtccgggttccggtcccgttaaccccgtacccggggtccggaacccgggtaacccggggtacccgttccgggaacccttacccggtaccctacccgtacgtaccccggtccgaaccccggtaacccgggacccggtacccgtccgttacccggttcccccgtttcccggaccgggtcccctacccggtcgtacccgtcgggtaaccgacccgtacccgtaccccgtacggaaccgccggtaaccgaccggtaacccgggtcccccgggtaccggttacccgggacccgttcccgggtacccgggttaccggtaacccgggtaaccgttaaccccgtttaccggttacccccgggtaccgg

SEQ ID NO: 276866 - DNA, 830 bp, Homo sapiens
  misc_feature: GYAE6OF02IBY8Y.22.34.D01.1.454.CMB.1.raw
tcagacatacgcgtcacgaccggtgctcgatttagatcgtctgtgttgggtttgggggaagaggaagactgacggtcctgtcccaggtgcagctgcaggagtcgggcccaggactggtgaagccttcggagaccctgtccctcacctgtactgtctctggtggctccgtcactggttaccactggagctggatccggcacgccccgagggaagggctggagtggattggctatatttctacagtcggccgacaaccaacctcccaccccctccctacaaggtacgtaccgacgacccaaccaattatcacgtacgaccaccgtaccaaaagaaccctagttcctacccttaagaaaacttggaacggttctggtacgtaacccgatacggccgggaacccgtaccggacccggttagttaaccgttttaacgtcggttacggacggaaaccggggtaggaaaccggggtttccccggggtaacccgtaaagttaaccgtttcggttacggggtccccggtttacccgggtacccccgggtacggggggtaccccgaaacccgggggtaaaccccgttcggggttaccgtaaccccgggttcgtaaccccgttcgtacccggaccccttacccgaaacccggtaacccgggtcccttaaccgttccgggttaacccctttccccccggcgggtcccggtacccctgacccgtccggaacggtaacgcccgtaacccgttaccgacggacgaccgtaacggacggcccggacggtccgggtcctacggtccgttagggtaaccgaacggttacctacccgtccgtaaccggg

SEQ ID NO: 276867 - DNA, 797 bp, Homo sapiens
  misc_feature: GYAE6OF02H8EOP.22.34.D01.1.454.CMB.1.raw
tcagacatacgcgtcacgaccggtgctcgatttagatcgtctgtgttgggtttgggggaagaggaagactgacggtcctgtcccaggtgcagctgcaggagtcgggcccaggactggtgaagccttcggagaccctgtccctcacctgtactgtctctggtggctccgtcactggttaccactggagctggatccggcacgccccgagggaagggactggagtggattggctattatttcttacagtcggccgacaccaacctcccaccccctcctacaagacgtcgacgccaaccatactctaaggtccgaccacgtacccgaaagtaaccccgagtttccctacccgtaagaaacgttggaacggttctacggtcgaacccgcgtaacggccggaacgtaccgggccgttacgttacttaccgtggtcgtacggtaggaacggtaccgggtttccccggggaccgtagttaccttcccgggtaggggttcccccggtttacccgggtaccccgggttaccgggggaccccgggtaaccggggttaacccccgttcgggtacccggtacccggttcccgttcccgtaccgaccgtaccccgtacccgtaacccgaacgggtcccctacggttcccggtaccccgttccccggtccggtcccgtcccgtccggtcctacccggtacgaccggacccgtacccgtacgaccgacgaccgacgtccggcccggaccgtcgggtaccgtccggtccggtaccggtaccgtaaccggtaccttacccggtacccgtaccgg

SEQ ID NO: 276868 - DNA, 294 bp, Homo sapiens
  misc_feature: GYAE6OF02F5042.22.34.D01.1.454.CMB.1.raw
  modified_base (282)..(294): a, c, t, g, unknown or other
  misc_feature (282)..(294): n is a, c, g, or t
tcagacatacgcgtcacgaccggtgctcgatttagatcgtctgtgaccgcagcggacacggccgtgtattactgtgcgagagagtccgggtccgatatctggccgttcgacccctggggccagggaaccctggtcaccgtctcctcagcctccaccaagggcccatcggtcttccccctggcgccctgctccaggagcacctccgagagcacagcggccctgggctgcctggtcaaggctacttccacgcgtatgtctgaggcggctggcaaggcgcatagnnnnnnnnnnnnn

SEQ ID NO: 276869 - DNA, 611 bp, Homo sapiens
  misc_feature: GYAE6OF02FKV5B.22.34.D01.1.454.CMB.1.raw
  modified_base (254)..(254): a, c, t, g, unknown or other
  misc_feature (254)..(254): n is a, c, g, or t
  modified_base (466)..(466): a, c, t, g, unknown or other
  misc_feature (466)..(466): n is a, c, g, or t
  modified_base (473)..(473): a, c, t, g, unknown or other
  misc_feature (473)..(473): n is a, c, g, or t
  modified_base (527)..(527): a, c, t, g, unknown or other
  misc_feature (527)..(527): n is a, c, g, or t
tcagacatacgcgtcacgaccggtgctcgatttagatcgtctgtgttgggtttggggggaagaggaagactgacggtcctgtcccaggtgcagctgcaggagtcgggcccaggactggtgaagccttcggagaccctgtccctcacctgtactgtctctggtggctccgtcactggttaccactggagctggatccggcacgcccccgagggaagggactgggagtggattggcttatatttctacagtggccncaccaactccccacccctccctcaagagtccgagccaccatatcagtcgacactaccaagaacccagttcctcctagaactgacgtctgtcgaccgcagcggtacaccggccgtgtacttacgtgtgcggagagtacgtccgggtacgatactcgtcggtcccgttcgacccggtcgggaccgacgggtacctcgggtccaccggtcctccncgcgccnccacgacggcccacgtccgtcccttcccgtcgccgtccctctccgcgacgcgcncccgtaccgacgcgccacgcggcccggtcccgtcgggccgtcgtcccggtcggtaccgaacggtacctaccgttaccgtaccgg

SEQ ID NO: 276870 - DNA, 694 bp, Homo sapiens
  misc_feature: GYAE6OF02I0SNF.22.34.D01.1.454.CMB.1.raw
  modified_base (324)..(324): a, c, t, g, unknown or other
  misc_feature (324)..(324): n is a, c, g, or t
  modified_base (330)..(330): a, c, t, g, unknown or other
  misc_feature (330)..(330): n is a, c, g, or t
  modified_base (492)..(492): a, c, t, g, unknown or other
  misc_feature (492)..(492): n is a, c, g, or t
tcagacatacgcgtcacgaccggtgctcgatttagatcgtctgtgttgggtttggggggaagaggaagactgacggtcctgtcccaggtgcagctgcaggagtcgggcccaggactggtgaagcctttcggagaccctgtccctcacctgtactgtctctggtgctccgtcactggttaccactggagctggatccggcacgccccgagggaacgggactgggagtggattggctatatttcttacaggtggccgcaccaacctccccacccctcctaccaacgacgtcgacgccaccatactcagtcacacgtaccaagaccngttccncctagaaactgaggtctaggtcgaccgcagacggacaccggtcgttcgtaacttacgtcggtacgcggaagacggtaacggttcccgggtaccgaagttactccgtcgggtacccgtttccgaccccggttcggggacccgacggggtaaccctcggtaccnccggttaccttcccgtaccgacgtccctaccgacccgaacgggtaccccacgttcccggtcccgttaccccgtcggccctcccgtcggtaccctccgacggttacgccgtacccgtaccggacgccacgtaccgcggtacccggtccgtcgggtcgtccggtaccgtcgggtaccgaaccggtaccttaccgtcccgtacgg

SEQ ID NO: 276871 - DNA, 670 bp, Homo sapiens
  misc_feature: GYAE6OF02FLDWW.22.34.D01.1.454.CMB.1.raw
  modified_base (316)..(316): a, c, t, g, unknown or other
  misc_feature (316)..(316): n is a, c, g, or t
tcagacatacgcgtcacgaccggtgctcgatttagatcgtctgtgttgggtttggggggaagaggaagactgacggtcctgtcccaggtgcagctgcaggagtcgggcccaggactggtgaagccttcggagaccctgtccctcacctgtactgtctctggtgctccgtcactggttaccactggagctggatccggcacgcccccgaagggagggactggagtggattggctatatttcttacagtgccgcaccaactccccacccctcctacaagagtcgagccaccatactcagtcgacacgtccaagaaccngttctccctagaaactgaggtctgtgaccgcagcggacacggtcgtgtattaccgtgtgcgtaggagtcggtcccggtccgatacgtcgtcgggacccgttccgtaccccgtaggggcccgaacgggtaaccccgtcgggtacctacccgtaccttccgtaccgtaccgtcccgttacccgaaccgtaaccgggtaccccgtaacgttcccggttaccctttcccccgtacgggcccgtccccgtcggtcccgtccgacgggaccgactacccgttccggacgcgaaccacgacgtcccggcccgtcggccgtcggtccgtcggtaccgaggtaccttaccgtcccgtaaccgg

SEQ ID NO: 276872 - DNA, 606 bp, Homo sapiens
  misc_feature: GYAE6OF02I83JG.22.34.D01.1.454.CMB.1.raw
  modified_base (346)..(346): a, c, t, g, unknown or other
  misc_feature (346)..(346): n is a, c, g, or t
  modified_base (543)..(543): a, c, t, g, unknown or other
  misc_feature (543)..(543): n is a, c, g, or t
  modified_base (560)..(560): a, c, t, g, unknown or other
  misc_feature (560)..(560): n is a, c, g, or t
tcagacatacgcgtcacgaccggtgctcgatttagatcgtctgtgttgggtttggggggaagaggaagactgacggtcctgtcccaggtgcagctgcaggagtcgggcccaggactggtgaagccttcggagaccctgtccctcacctgtactgtctctggtggctccgtcactcggttaccacgtggacgctggactccggcacgccccgagggaaggactggagtggattggctatatttctacaggtgccgcaccaacctcccaccctcctacaagcgtccgacgccaaccatactcagtcgacacgaccaagaacctagtcctacctagaaactgacggtcngtacgccgcgacgacggacgacggtcgtacgtattacgtgacgacgagacgacggtccggacgtatacgtcgtcggtccgttccggacccgtcgggaccaacgggtaccctgtaccaccgtctcccgcgaccgcctaccacgaccggcctcggtccgtcccttcccgtcggccctccctacgcctaccggacgtccnccgtaccgcgacgtacncgacgccggtcgccgtgctcggcgtcggacacgtctaccgtcgacg

SEQ ID NO: 276873 - DNA, 765 bp, Homo sapiens
  misc_feature: GYAE6OF02H9BIG.22.34.D01.1.454.CMB.1.raw
tcagacatacgcgtcacgaccggtgctcgatttagatcgtctgtgttgggtttggggggaagaggaagactgacggtcctgtcccaggtgcagctgcaggagtcgggcccaggactggtgaagccttcggagaccctgtccctcacctgtactgtctcgtggtggctccgtcactggttaccacgtggagctggactccggcacgccccgaggggaagggacgtggagtggattggcttatatttctacaggtcggccgacaccgaacctcccctaccccctcctacgaagacgtacgacgcccacctaatactacgtacgtaccgaaccaccggtacccaaagaacccctagttcctacccgtagaaactggacggttctggtacgaccgcgaacggcggaaccgccgggtcgttagtaacgttacgtggtcggacggaggtacggaccgggttcccggggtactaagtacgtccgtacgggtcccgttcccggacccggtcggggacccgtaacgggtaccctcggtacccgtaccgtcctacccgtcgaccgtaccccttaccgaaaccggaccggtacccttacggtcccggtttaccccgttaccccggtcgggaccccgttcccgtcgtcccgtcccggtaacggaccgtcccgtaacccgttcggaccgtacgacccgacggccggtcccggaccggttcgggccttacgggccgttacgggtaaccgtaaccgggtacttacccggtaccgtaccgg

SEQ ID NO: 276874 - DNA, 610 bp, Homo sapiens
  misc_feature: GYAE6OF02HEN73.22.34.D01.1.454.CMB.1.raw
  modified_base (374)..(374): a, c, t, g, unknown or other
  misc_feature (374)..(374): n is a, c, g, or t
  modified_base (444)..(444): a, c, t, g, unknown or other
  misc_feature (444)..(444): n is a, c, g, or t
tcagacatacgcgtcacgaccggtgctcgatttagatcgtctgtgttgggtttggggggaagaggaagactgacggtcctgtcccaggtgcagctgcaggagtcgggcccaggactggtgaagccttcggagaccctgtccctcacctgtactgtctctggtggctccgtcactggttaccactggagctggatccggcagcccccagggaagggactggagtggattggctatatttcttacagtggccgcaccaactccccaccccctccctcaacgacgtcgacgccaccatatcagtcgacacgtccaagaacccagttctccctagaaactgacggtctgtgaccgcagcggacacggcgtgtattacngtgcgagagagtccgggtccgatatcgtggccgtttccgacccgtggggcccacgggaaccctgggtccnccgtcctccctcacgccctccacccgaacgggcccacgttccggtcccttccccgtcggcccgtccctgccctccgacgacgccacctccgacgacgacgacgcggccggcccgtcgggcctcggcccgttcgggtacgaaccggtacctaccgttcccgtaacgg

SEQ ID NO: 276875 - DNA, 359 bp, Homo sapiens
  misc_feature: GYAE6OF02JL9VD.22.34.D01.1.454.CMB.1.raw
  modified_base (237)..(237): a, c, t, g, unknown or other
  misc_feature (237)..(237): n is a, c, g, or t
  modified_base (279)..(279): a, c, t, g, unknown or other
  misc_feature (279)..(279): n is a, c, g, or t
  modified_base (288)..(288): a, c, t, g, unknown or other
  misc_feature (288)..(288): n is a, c, g, or t
  modified_base (323)..(359): a, c, t, g, unknown or other
  misc_feature (323)..(359): n is a, c, g, or t
tcagacatacgcgtcacgaccggtgctcgatttagatcgtctgtgaccgcagcggacacggccgtgtattactgtgcgagagagtccgggtccgatatctggccgttcgaccccgtggggccagggaccctggtcaccgtctcctcagccctccaccaagggccccagtccggtccttcccccctgggcccgcccctgccctcccgagggacgccacccgtccgagacgccaaccgngccggcccgtgggctcgccgtggtccaaggtacctactcccncggcgttangtctggaggcggctggaccaaggccgtatagtcgnnnnnnnnnnnnnnnnnnnnnnnnnnnnnnnnnnnnn

SEQ ID NO: 276876 - DNA, 726 bp, Homo sapiens
  misc_feature: GYAE6OF02I3W83.22.34.D01.1.454.CMB.1.raw
  modified_base (247)..(247): a, c, t, g, unknown or other
  misc_feature (247)..(247): n is a, c, g, or t
  modified_base (275)..(275): a, c, t, g, unknown or other
  misc_feature (275)..(275): n is a, c, g, or t
  modified_base (497)..(497): a, c, t, g, unknown or other
  misc_feature (497)..(497): n is a, c, g, or t
tcagacatacgcgtcacgaccggtgctcgatttagatcgtctgtgttgggtttgggggaagaggaagactgacggtcctgtcccaggtgcagctgcaggagtcgggcccaggactggtgaagccttcggagaccctgtccctcacctgtactgtctctggtggctccgtcactggttaccacgtggagcgtggactccggcacgccccgagggaacggactggagtggattggctagtatttctacngtggccgacaccaactcccaccctcctnaagagtcacgccaaccatactcagtccgacacgtaccaacgaacctacgttctacccgtagaaaccgtgaacgttctacgtaccgaccgacgacggtcgacgtcggtccgtagttacgttacgtggttacgacggtaacgacgtacggtcccggtacgattacgtcggtacggtcccgtaccgacccggtagggaccgaacgggtaccccgtggttaacccnccggtaccgtccgtaccgaccggtacccgtaccgaaccgtaaccgggacccttacgttccccggtacccttccccggacggtaccccgtccgtaaccgtccgtaacccggtacggacctacccgtacccgtacgtaacggccgaaccggaccggacggtcccggtaccggccggttaccgaccgttccggtaccggtaacggtaacccgtccgtttacctacggaccgg

SEQ ID NO: 276877 - DNA, 818 bp, Homo sapiens
  misc_feature: GYAE6OF02IE587.22.34.D01.1.454.CMB.1.raw
  modified_base (185)..(185): a, c, t, g, unknown or other
  misc_feature (185)..(185): n is a, c, g, or t
  modified_base (299)..(299): a, c, t, g, unknown or other
  misc_feature (299)..(299): n is a, c, g, or t
  modified_base (456)..(456): a, c, t, g, unknown or other
  misc_feature (456)..(456): n is a, c, g, or t
tcagacatacgcgtcacgaccggtgctcgatttagatcgtctgtgttgggtttgggggaagaggaagactgacggtcctgtcccaggtgcagctgcaggagtcgggcccaggactggtgaagccttcggagaccctgtccctcacctgtactgtctctggtgctccgtcactggttaccactggngctggatccggcacgcccgagggaacggacgtggagtcggatttcggcttaattacgtttacttacgacggttcgggacccgctaaccctaacctccccacccccttcccttanaaacggtacggttccgaacgcccaacctataccgttaccgacgtaccggaacttaccgaccccaaaacggtaaaccctacggtttcctaccccgtagtaaaacgtgtacggtactgtacgaccgcaacggtcgtaacgacggcttaggtacttacgngtcggacgtaggacggacggtccgggtaccattacgcgtcgggtacccgtttccggaccggttcggggacccgtaacggggtaccccgttcggtccgtaacccgttcctacccgtacggtaaccgtccccgttaaccgaaccccggtaaaccggggtcccctagttcccggtccctttacccccggccgggtacccgtaccccggtcggtacctacccggacggtaccgtacccgtccccgttaacgggaccgaccggccgaacccgtcgggtaccccggacccgtttaccggggccgtaccggttcccgggtacggtaaccgtacccgggtaaacctttccccggtaacccgtaaccgggg

SEQ ID NO: 276878 - DNA, 325 bp, Homo sapiens
  misc_feature: GYAE6OF02HCR7H.22.34.D01.1.454.CMB.1.raw
  modified_base (180)..(180): a, c, t, g, unknown or other
  misc_feature (180)..(180): n is a, c, g, or t
  modified_base (195)..(195): a, c, t, g, unknown or other
  misc_feature (195)..(195): n is a, c, g, or t
  modified_base (207)..(207): a, c, t, g, unknown or other
  misc_feature (207)..(207): n is a, c, g, or t
  modified_base (286)..(286): a, c, t, g, unknown or other
  misc_feature (286)..(286): n is a, c, g, or t
  modified_base (293)..(325): a, c, t, g, unknown or other
  misc_feature (293)..(325): n is a, c, g, or t
tcagacatacgcgtcacgaccggtgctcgatttagatcgtctgtgaccggcagcggacacggccgtgtattactggtgcgagagacgtccgggtccgatatctggccgttcgacccctggggccagggaaccctggtccaccgtctcctcagcctccatcaagggcccatcgtctccccngcgcctgctccaggngcacctccgagngcacgagccggccctgggctgcctggtacaaggtactacttccacgtctatgtctggacgcgggctgggacaacggccncaatagnnnnnnnnnnnnnnnnnnnnnnnnnnnnnnnnn

SEQ ID NO: 276879 - DNA, 857 bp, Homo sapiens
  misc_feature: GYAE6OF02HEBRC.22.34.D01.1.454.CMB.1.raw
tcagacatacgcgtcacgaccggtgctcgatttagatcgtctgtgttgggtttggggggaagaggaagactgacggtccctgtcccaggtgcagctgcaggagtcgggcccaggactggtgaagccttcggagaccctgtccctcacctgtactgtctctggtggctccgtcactggttaccatggagctggactccggcacgcccccgagggaagggactggagtggattggcttagttatttcttactaggtcgccgtccaacccaacctccccaccccctccacaagacgtcgacgccaccatactcgagtccgactaccgtaccaaaacgaaccctacgttcctacccgtaagaaacgtcggtaacggtctcggtacggacccgcgacggtaccggaaccgtccgggtaccgttagttacttacgtcggtacggacgaggtaacggtcggttacccggggtacgtacgttacgttccggtaccgggttcccggtttaccccgggaccccggttaccggggggacccggtaaaccgggggtaaccccgttcgggtaccccgtaacccggttcccgtacccgtcccggtacccgtaccccgttaccccgaacccggtacccgggtaccccgtaccggttaccccggtccccgtttccccccgtaccggtcccccggttccccgtaccggtccccgtcccgtaaccgggtacccgaccccgtaaccccgttccggaacggtacccgacccgaacccggtacccgggtccccggccccggttccgggtacccggtccggtcccggtaccgggttaccgtaacccggtaacccgtttacccgttacccggtaacccgg

SEQ ID NO: 276880 - DNA, 869 bp, Homo sapiens
  misc_feature: GYAE6OF02G3N5Z.22.34.D01.1.454.CMB.1.raw
  modified_base (315)..(315): a, c, t, g, unknown or other
  misc_feature (315)..(315): n is a, c, g, or t
  modified_base (357)..(357): a, c, t, g, unknown or other
  misc_feature (357)..(357): n is a, c, g, or t
tcagacatacgcgtcacgaccggtgctcgatttagatcgtctgtgttgggtttgggggaagaggaagactgacggtcctgtcccaggtgcagctgcaggagtcgggcccaggactggtgaagccttcggagaccctgtccctcacctgtactgtctcgtggtggctccgtcacgtggttaccacgtggagctggactccggcacgccccgagggaacgggactcggagtggtattggcttattagtttctacgagtcggccgcaccaacctccccacccctccgtacgaacgtacgtccggaacgcccaactaanactcgagtccgaacacgtaccaaaggtaaccctaggtttccncccgtagaaaccgtgaacgtccttagtacgaccgtcgaacgtacggacgtaccggcgtagttaacgttaccgttgggacgagggaacgaaggtacccgggttaccggggtcccgtaaacgttcgtccggttccgggttacccgtttccccggtaacccgggttacggggacccgggtaaccgggtaaccccggttaccgggttacccgtaaacccggttcccgttacccgtacccggtaccgtaaccccgttaccccgaaaccccggtaaacccgggtacccccgtaaggttccccccggtttacccgttaacccccccgttccgggtacccccggttcccgttaccccggtaacccgttaccccgggtaaccggacccgggacccgttaaccccgtacccggaccggtaccgccgtaaccgggtcccggacccgggtacccggtccgggtaaccgttccgggcccgtacgggtaaccgtaaccggggtaacctaccccgttacgaacccgg

SEQ ID NO: 276881 - DNA, 740 bp, Homo sapiens
  misc_feature: GYAE6OF02JVBGG.22.34.D01.1.454.CMB.1.raw
tcagacatacgcgtcacgaccggtgctcgatttagatcgtctgtgttgggtttggggggaagaggaagactgacggtcctgtcccaggtgcagctgcagggagtcgggcccaggactggtgaagccttcggagaccctgtccctcacctgtactgtctctggtggctccgtcacttcggttaccactggagctgggactccggcacggcccccgaaggggaacgggacgtgggagtggagttggcttatatttcttacagtggccgcaccaacctcccaccctcctcaagacgtcgacgccacactacacagtcgacaccgtacaacgtacctgttacctccgtacgaaacgtggaacgtctcgtacgaccgcacggtacggacacggccgtagtacttacgtgtcgacggtagacggtacgggtccggtacgattacgtcgttacgggccgttacccgtacccgggtcgggacccgtacgggtacccttcgggtacccgtaccgttccgtccgtccgtaacgccccttaacccgacccggtaaccggaccctacgtttcccggtccgttaccccgtccggtcccacccgtcgtcccgtaccgcggaccgtcccgaccgtaccggaccgtaccgtaccgaccgggtacggtcccggtacccggtggggtacccttacgggacccggttacgggtaaacccgtaaccgggttaacccttacccgggttacccttaaccggg

SEQ ID NO: 276882 - DNA, 618 bp, Homo sapiens
  misc_feature: GYAE6OF02FSM2U.22.34.D01.1.454.CMB.1.raw
  modified_base (292)..(292): a, c, t, g, unknown or other
  misc_feature (292)..(292): n is a, c, g, or t
  modified_base (349)..(349): a, c, t, g, unknown or other
  misc_feature (349)..(349): n is a, c, g, or t
  modified_base (355)..(355): a, c, t, g, unknown or other
  misc_feature (355)..(355): n is a, c, g, or t
tcagacatacgcgtcacgaccggtgctcgatttagatcgtctgtgttgggtttggggggaagaggaagactgacggtcctgtcccaggtgcagctgcaggagtcgggcccaggactggtgaagccttcggagaccctgtccctcacctgtactgtctctggtggctccgtcactggttaccactggagctggatccggcacgcccccagggaagggactggagtggattggctatatttctacagtgccgcaccaactccccacccctccctcaagagtcgagccaccatancagtcgacaccgtccaagaaccagttcctccctgaaacctgaggtctgtcgaccgcngcgacncggccgtgtattactgtgcggagagacggtccgggtccagtactcgtcggtcccggttcgaccccgtggggccctacggggacccctggtccacccgtctcccgtccgacgtccctacccgacccgaacgggtccccagtcccggtcccttcccccgcgggcccgccctcggccctccgacggtccgcctaccgtccgagaccgcacgacggcccggtcccgtgggcctcggccgttcgaccgacggaccttacgtccaccgg

SEQ ID NO: 276883 - DNA, 513 bp, Homo sapiens
  misc_feature: GYAE6OF02F6JQJ.22.34.D01.1.454.CMB.1.raw
  modified_base (292)..(293): a, c, t, g, unknown or other
  misc_feature (292)..(293): n is a, c, g, or t
  modified_base (297)..(297): a, c, t, g, unknown or other
  misc_feature (297)..(297): n is a, c, g, or t
  modified_base (314)..(314): a, c, t, g, unknown or other
  misc_feature (314)..(314): n is a, c, g, or t
  modified_base (322)..(322): a, c, t, g, unknown or other
  misc_feature (322)..(322): n is a, c, g, or t
  modified_base (325)..(325): a, c, t, g, unknown or other
  misc_feature (325)..(325): n is a, c, g, or t
  modified_base (334)..(334): a, c, t, g, unknown or other
  misc_feature (334)..(334): n is a, c, g, or t
  modified_base (337)..(337): a, c, t, g, unknown or other
  misc_feature (337)..(337): n is a, c, g, or t
  modified_base (341)..(341): a, c, t, g, unknown or other
  misc_feature (341)..(341): n is a, c, g, or t
  modified_base (343)..(343): a, c, t, g, unknown or other
  misc_feature (343)..(343): n is a, c, g, or t
  modified_base (390)..(390): a, c, t, g, unknown or other
  misc_feature (390)..(390): n is a, c, g, or t
  modified_base (396)..(396): a, c, t, g, unknown or other
  misc_feature (396)..(396): n is a, c, g, or t
  modified_base (398)..(398): a, c, t, g, unknown or other
  misc_feature (398)..(398): n is a, c, g, or t
  modified_base (400)..(400): a, c, t, g, unknown or other
  misc_feature (400)..(400): n is a, c, g, or t
  modified_base (404)..(404): a, c, t, g, unknown or other
  misc_feature (404)..(404): n is a, c, g, or t
  modified_base (414)..(414): a, c, t, g, unknown or other
  misc_feature (414)..(414): n is a, c, g, or t
  modified_base (418)..(418): a, c, t, g, unknown or other
  misc_feature (418)..(418): n is a, c, g, or t
  modified_base (431)..(431): a, c, t, g, unknown or other
  misc_feature (431)..(431): n is a, c, g, or t
  modified_base (436)..(436): a, c, t, g, unknown or other
  misc_feature (436)..(436): n is a, c, g, or t
  modified_base (452)..(452): a, c, t, g, unknown or other
  misc_feature (452)..(452): n is a, c, g, or t
tcagacatacgcgtcacgaccggtgctcgatttagatcgtctgtgaccgcagcggacacggccgtgtattactgtgcgagagagtccgggtccgatatctggccgttcgacccctgggccaggaaccctggtcaccgtctcctcagcctccaccaagggcccatcggtcttccccctggcgccctgctccaggagcacctccgagagcacagcggccctgggctgcctggtcaaggactacttccagcgtatgtctgacgtcgggactggcaaggtccgacaagtagctatnntagnacatagactctgctgancgtagctntgnttacacgcngantgananatacgagtagtagtagtacagagagacactacacgacgtacgacganacatanananatanacgagagtanaganacgtagtacacanacganactacgactacgtacncgagtcgtacgtacgactacgtactacgtacacgtacgtacactacgtacgtacgtagtac

SEQ ID NO: 276884 - DNA, 596 bp, Homo sapiens
  misc_feature: GYAE6OF02GQ3R5.22.34.D01.1.454.CMB.1.raw
  modified_base (371)..(371): a, c, t, g, unknown or other
  misc_feature (371)..(371): n is a, c, g, or t
  modified_base (496)..(496): a, c, t, g, unknown or other
  misc_feature (496)..(496): n is a, c, g, or t
tcagacatacgcgtcacgaccggtgctcgatttagatcgtctgtgttgggtttgggggggaagaggaagactgacggtcctgtcccaggtgcagctgcaggagtcgggccccaggactggtgaagccttcggagaccctgtccctcacctttactgtctctggtggctccgtcactggttaccactggagctggatccggcagccccccagggaagggactggagtggattggctatatttcttacagtggccgcaccaactccccacccctccctcaagagtccgagccaccatatcagtcgacacgtccaaagaaccagttctccctgaactgagtctgtgaccgcagcggacacggcgtgtacttacngtgcgagagagtccgggtccaatatctggccgttcgaccccgtggggtccgaacgggtaacccctggtccaccggtctccgtcacgccctccaccgaacgggcccagtccggtacctttccccgnggccgccctcgcctccgagcgcaccgtccgagacgcacgacggcggtacccgtcgggactcgcccgtggtaccgaacggtacctacttacccgacgtacg

SEQ ID NO: 276885 - DNA, 647 bp, Homo sapiens
  misc_feature: GYAE6OF02GPO9V.22.34.D01.1.454.CMB.1.raw
  modified_base (293)..(293): a, c, t, g, unknown or other
  misc_feature (293)..(293): n is a, c, g, or t
  modified_base (303)..(303): a, c, t, g, unknown or other
  misc_feature (303)..(303): n is a, c, g, or t
tcagacatacgcgtcacgaccggtgctcgatttagatcgtctgtgttgggtttggggggaagaggaagactgacggtcctgtcccaggtgcagctgcaggagtcgggcccaggactggtgaagccttcggagaccctgtccctcacctgtactgtctctggtggctccgtcactggttaccactggagctggatccggcagcccccagggaaggctggagtggattggctatatttctacagtggccgcaccaacctccccaccccctcctacaagagtcgagccaccatacncagtcgaccncgtaccaagaaccagttccacctaaaactgagtctgtcgaccgcagcggacacggccgtgtacttactgtggcgaggacgtacggtccgggtaccatacgtcgtaggtcccgttcggaccccgtaggggcccgaacgggtaacccgtcgggtccacccgtctccctcgacgccctccaccgacggcccagtcccgtccttcccccgtggcccgccctcgtccgtccgacggacgccgtacccgtccgagtaccgccaacgaccggcccggtccccgtcgggtcccgtcggtcccgttcggtaccggaacgggttaacccttaccgttccccggacgttacccgg

SEQ ID NO: 276886 - DNA, 745 bp, Homo sapiens
  misc_feature: GYAE6OF02IBPXI.22.34.D01.1.454.CMB.1.raw
  modified_base (259)..(259): a, c, t, g, unknown or other
  misc_feature (259)..(259): n is a, c, g, or t
  modified_base (287)..(287): a, c, t, g, unknown or other
  misc_feature (287)..(287): n is a, c, g, or t
  modified_base (646)..(646): a, c, t, g, unknown or other
  misc_feature (646)..(646): n is a, c, g, or t
tcagacatacgcgtcacgaccggtgctcgatttagatcgtctgtgttgggtttggggggaagaggaagactgacggtcctgtcccaggtgcagctgcaggagtcgggcccaggactggtgaagccttcggagaccctgtccctcacctgtactgtctctggtgctccgtcactggttaccactggagctggactcccggcacgcccccgagggaagggacgtggagtggagttggcttattatttcttacagtcggccnccaccaacctcccaccccctcctacaanacgtcgacgccacatatcagtccgacaccgtaccaaacgaaccctacgttccctacccttacggaaacctcggtacgttctggtcggacccgagacggccggaccacgggtccgttagttacttacgtgtcgaggtaaggaggaaccggtcccggggtacacgtacgttcgtaccgtacccggtttacccggaccccgggtcggggtacccgaacggggttaaccccgtcgggtccctaccgttccctccgtaccgaccgtccccgtacacccggaaccgggtccctacggttacccggttccccgttccccggtcggggtccccgtaccccgttccggccgtaaccggacgggtaccnccccgtaccgtccgacgaccgacctaacgcccggcccggtccggtccgggcctccggttccggacggtacccgaacggttccgtaccttaccgacccgg

SEQ ID NO: 276887 - DNA, 567 bp, Homo sapiens
  misc_feature: GYAE6OF02IUTJ9.22.34.D01.1.454.CMB.1.raw
  modified_base (181)..(181): a, c, t, g, unknown or other
  misc_feature (181)..(181): n is a, c, g, or t
  modified_base (185)..(185): a, c, t, g, unknown or other
  misc_feature (185)..(185): n is a, c, g, or t
  modified_base (199)..(199): a, c, t, g, unknown or other
  misc_feature (199)..(199): n is a, c, g, or t
  modified_base (209)..(209): a, c, t, g, unknown or other
  misc_feature (209)..(209): n is a, c, g, or t
  modified_base (280)..(280): a, c, t, g, unknown or other
  misc_feature (280)..(280): n is a, c, g, or t
  modified_base (307)..(307): a, c, t, g, unknown or other
  misc_feature (307)..(307): n is a, c, g, or t
  modified_base (309)..(310): a, c, t, g, unknown or other
  misc_feature (309)..(310): n is a, c, g, or t
  modified_base (313)..(314): a, c, t, g, unknown or other
  misc_feature (313)..(314): n is a, c, g, or t
  modified_base (321)..(321): a, c, t, g, unknown or other
  misc_feature (321)..(321): n is a, c, g, or t
  modified_base (325)..(325): a, c, t, g, unknown or other
  misc_feature (325)..(325): n is a, c, g, or t
  modified_base (328)..(328): a, c, t, g, unknown or other
  misc_feature (328)..(328): n is a, c, g, or t
  modified_base (330)..(331): a, c, t, g, unknown or other
  misc_feature (330)..(331): n is a, c, g, or t
  modified_base (337)..(337): a, c, t, g, unknown or other
  misc_feature (337)..(337): n is a, c, g, or t
  modified_base (340)..(340): a, c, t, g, unknown or other
  misc_feature (340)..(340): n is a, c, g, or t
  modified_base (345)..(345): a, c, t, g, unknown or other
  misc_feature (345)..(345): n is a, c, g, or t
  modified_base (354)..(354): a, c, t, g, unknown or other
  misc_feature (354)..(354): n is a, c, g, or t
  modified_base (362)..(362): a, c, t, g, unknown or other
  misc_feature (362)..(362): n is a, c, g, or t
  modified_base (371)..(371): a, c, t, g, unknown or other
  misc_feature (371)..(371): n is a, c, g, or t
  modified_base (375)..(375): a, c, t, g, unknown or other
  misc_feature (375)..(375): n is a, c, g, or t
  modified_base (408)..(408): a, c, t, g, unknown or other
  misc_feature (408)..(408): n is a, c, g, or t
tcagacatacgcgtcacgaccggtgctcgatttagatcgtctgtgaccgcagcggacacggccgtgtattactgtgcgagagagtccgggtccgatatctggccgttcgacccctggggccagggaaccctggtcaccgtctcctcagcctaccaccgaaggcccatccggtcttcccccnggcnccctgctccgaagncacctcgagngcacagcggccctgggcctcgaccgtggtacaacggtaccttacttccacgcgtatcgtctgcggacgggntcggcaaagggcgaccaaagtcggtananntgnncgtactncgantcnannaccgtnganagtcngactcagtntcgagtcngtacgtagncgtncgagtataacgtgtctagacgtacaacacggtnacgacgtacgtgtctagtccacggcgtcgtacgacgtacgcgacggtctacgtgacgtagccgactactacgtacgtacgtacgtactacggacggtaactaccgttaacggtcgtaaccgtaccggtacgtaacgtaaccggtaacttagtagtaccg

SEQ ID NO: 276888 - DNA, 607 bp, Homo sapiens
  misc_feature: GYAE6OF02GG0BE.22.34.D01.1.454.CMB.1.raw
tcagacatacgcgtcacgaccggtgctcgatttagatcgtctgtgttgggtttggggggaagaggaagactgacggtcctgtcccaggtgcagctgcaggagtcgggcccaggactggtgaagccttcggagaccctgtccctcacctgtactgtctctggtggctccgtcactggttaccactggagctggatccggcagcccccagggaaggactggagtggattggctatatttcttacagtggccgcaccaactcccaccccctccctcaagagtcgagccacactatcagtcgacacgtccaagaaccagttctcctgaaactgaggtctgtgaccgcagccggacacggccgtgtattactggtagcgtagagagtccgggtccgatatcgtcggccgttccggacccctggggcccaagggaacccctgggtccaccggtctccgtcacgtccctaccaccgaacgggccctagtccggtccttccccgtggaccgcccgtgcctccgaacgggtcaccaccgtccgacgagccaacgcggccggtcccgtgggcccgtgcccgtcggtaccgaacggtccgttaccgtccgtaacccgg

SEQ ID NO: 276889 - DNA, 771 bp, Homo sapiens
  misc_feature: GYAE6OF02HYEOQ.22.34.D01.1.454.CMB.1.raw
tcagacatacgcgtcacgaccggtgctcgatttagatcgtctgtgttgggtttggggggaagaggaagactgacggtcctgtcccaggtgcagctgcaggagtcgggcccaggactggtgaagccttcggagaccctgtccctcacctgtactgtctctggtgctccgtcactggttaccactggagctggatccggcacgccccagggaaggactggagtggattggctatttactttcttacaggttcggccgcaaccctaaccgtccccacccccttcctacaaacgcgtcgaacgccaaccgatatccagtccgacacgtaccaagaaccctagttcctcccctagaaaacctgacggttacctggttacgaaccgtcgaacggtccggaaccgccggtaccgtaggttacttaccgtggtcggaccggaggtaacgggaccggttccccggggtacgtaagttaccgtcgttccgggtccccggtttacccgaccccgggttcgggggacccgaaccgggtaacccgtcgggttaccctacccgggttacctccccgtcgtaccggtcccctaccggtaacccgaacggggacccctaacgggttcccggtcccttttcccccggaccggtcccgtccccgtaacgtcccgtaccgacgtacccggccctaaaccgtcccggacgccgtacgtaacccggcgggcccggtacccggttcggaaccgttcgaccgtcggaccgtaaggacccttccgtaccgtccgg

SEQ ID NO: 276890 - DNA, 295 bp, Homo sapiens
  misc_feature: GYAE6OF02GRS2F.22.34.D01.1.454.CMB.1.raw
  modified_base (284)..(295): a, c, t, g, unknown or other
  misc_feature (284)..(295): n is a, c, g, or t
tcagacatacgcgtcacgaccggtgctcgatttagatcgtctgtgaccgcagcggacacggccgtgtattactgtgcgagagagtccgggtccgatatctggccgttcgacccctggggccaggggaaccctggtcaccgtctcctcagcctccaccaagggcccatcggtcttccccctggccgccctgctccaggagccacctccgagagcacagcggccctgggctgcctggtcaaggactacttccacgctatgtctgagcggctggcaaggcgcatagnnnnnnnnnnnn

SEQ ID NO: 276891 - DNA, 822 bp, Homo sapiens
  misc_feature: GYAE6OF02F8GOE.22.34.D01.1.454.CMB.1.raw
  modified_base (480)..(480): a, c, t, g, unknown or other
  misc_feature (480)..(480): n is a, c, g, or t
tcagacatacgcgtcacgaccggtgctcgatttagatcgtctgtgttgggtttggggggaagaggaagactgacggtcctgtcccaggtgcagctgcaggagtcgggcccaggactggtgaagccttcggagaccctgtccctcacctgtactgtctcgtggtggctccgtcactggttaccactggagctggacgtccggcaccgcccccggagggtaacgggacgtggaggtggtagttaggtcttattacttttacttaacgacggtcggccggccaacctaccctacccccaccccctaccctcgaagtcgtaccgaccgacccacctaagttacctcgtacgtaccgactaacccgtaccgaaaccgtaacccgttaacgtttccccgttacctaacggaaccgttaggtacggtttcgtacgggtaccgaccgcgacgggaccggtaccgaacggtccgttagttaacttacgnggttacggagtacggacgggtcgtacccggggactacgtactcggttccggttcccggtaccggtaccccggtaggggacccggtaaccccggggtaccgtcggggtaccctcccgttacccgtccgtaccgacccggttcccacccggaaacccggaccggtacccgtcccgttcccccgtttaccccggttccccggcggtccccgtcccgtacggttccctaccggaccgggtaaccctccgacccgtacggaccgtacgaccggacccgccgggcccggttaccggcggttcccgtgacccgttgggacccttacggtacccgttacgtcccggtacc

SEQ ID NO: 276892 - DNA, 351 bp, Homo sapiens
  misc_feature: GYAE6OF02H08DQ.22.34.D01.1.454.CMB.1.raw
  modified_base (200)..(200): a, c, t, g, unknown or other
  misc_feature (200)..(200): n is a, c, g, or t
  modified_base (297)..(351): a, c, t, g, unknown or other
  misc_feature (297)..(351): n is a, c, g, or t
tcagacatacgcgtcacgaccggtgctcgatttagatcgtctgtgaccgcagcggacacggccgtgtattactgtgcgagatttgctttttggagtggttacgccgcgtttgactactggggccaggggaaccctggtcaccgtctctcagcctccaccaagggcccatccggtcttccccctggcaccctcctccaagngcacctcgtggggcacagcggccctgggctgcctggtacaacggactacttccacgcgtatgttctggagcgggtctaggacgacggcgacagtagnnnnnnnnnnnnnnnnnnnnnnnnnnnnnnnnnnnnnnnnnnnnnnnnnnnnnnn

SEQ ID NO: 276893 - DNA, 868 bp, Homo sapiens
  misc_feature: GYAE6OF02FYDN8.22.34.D01.1.454.CMB.1.raw
tcagacatacgcgtcacgaccggtgctcgatttagatcgtctgtgttgggtttgggggaagaggaagactgacggtcctgtcccaggtgcagctgcaggagtcgggcccaggactggtgaatccttcggagaccctgtcctcacctgtactgtctctggtgctccgtcactcggttaaccactggagctggactccggtcacgccccgagggaacggacgtggagtggagttggacttaattatttactacgaggtcggccgccaaccctaaccctcccccaacccccttcccctaacgtaacggacgttaccggaacgtaccccaaccgtaattaaccgtacctaacggttacccggaaccgaacccgttaaccccaaaaacggaaacccctaacggtttccctaccccgttaaggtaaaaaccgtcggtaacggttccgttacgggtaccggacccgtacgaacgggacccggtaccgaccgggtccgttaaggttacttaaccggtggtaggaccgaaggtacggtaccgggtacccgggtacgtaagttaccgttacggtcccgggtacccggtttaccggaccccgggtaggggaaccccgtaaccgggtaaccccgttcggtaccccgtaccgttacccgttaccccgtaaccgacccggtacccctaaccgacccggaaacccggtccctaacgttcccgttacccgttccccgacgggtccccgtcctaccgtccggccgtaacggcctacccgtaaccgtaccggaagtaccgaccgtaccggtccggcccggtaccggtccggtccgtccggtaccggtacggaaccgttaacggtcccctttacgcccggtaaccgg

SEQ ID NO: 276894 - DNA, 723 bp, Homo sapiens
  misc_feature: GYAE6OF02HRNAG.22.34.D01.1.454.CMB.1.raw
  modified_base (717)..(717): a, c, t, g, unknown or other
  misc_feature (717)..(717): n is a, c, g, or t
tcagacatacgcgtcacgaccggtgctcgatttagatcgtctgtgttgggtttggggggaagaggaagactgacggtcctgtcccaggtgcagctgcaggagtcgggcccaggactggtgaagccttcggagaccctgtcctcacctttactgtctctggtggctccgtcactggttaccactggagctggactccggcacgcccccgaggggaacgggacctgggagtgggattggctatatttcttacagtggcgcaccaactcccacccctcccacaacgcgtacgacgacccaacatactacagtcgaacctaccgtacgaaaccgacctacgttccctccgtaacgtaaacgtcggtagttctggttccgaccgtcgaggccggacgacggtcgtgtacttacgtggtcgacggaggaagtacgggtccgggtacgtaagtacgttcggtccggtccggttccccggtaccgggtcggggtacccggtaaccggggaacccgttcggtacccgtacccggttccttccgaccgtaccggtccctacccgaaaccggtacccgggacctaccggtttaccggttccccgttccccggacgggtccccgtacccgttcggcccgttaccggtaaccgggccgtaccctaccgaccgttacgccgtacaccggacgcccggtacgcggactcgcgtcgacgaccgacgtcaccgngtacgg

SEQ ID NO: 276895 - DNA, 793 bp, Homo sapiens
  misc_feature: GYAE6OF02JTYIX.22.34.D01.1.454.CMB.1.raw
  modified_base (225)..(225): a, c, t, g, unknown or other
  misc_feature (225)..(225): n is a, c, g, or t
tcagacatacgcgtcacgaccggtgctcgatttagatcgtctgtgttgggtttggggggaagaggaagactgacggtcctgtcccaggtgcagctgcaggagtcgggcccaggactgggtgaagccttcggagaccctgtccctcacctgtactgtctctggtgctccgtcactggttaccacgtggagcgtggactccggcacgcccccgagggaagggctggngtcgagttggctattatttctacaggtcggccgcacccaacctcccaccccctccctacgaacgacgtaccgacgccccaaccatactccgagttccggacccacggttacccaaacgtaacccgtattcccgccccttagaaccgttacggaggttccgtagtaccgacccgacgaccggtaccgggaccgtaccgggtaccgttaggttaaccttacggttagtcggaacggagtaaacgggtccgggttcccgggtaacgtcttacgtaccggtcgggtaccccgttccggacccgggtcgggacccggtacgggtacccgtccgggttacacccggttccgtacccgtcgaccggtccctaacccgacccggtaaccggtcccgtaacgttccccggttacccttaccccggtcggaccccggttccctcgaccccgtacggtacggacccgtcccgtacccggtaccgaaccggacaccggtaccggtcggtacccggtccggttccggacgtccggtaccggttcggaacccgtaacggtaccctaccggtccgtaacccgg

SEQ ID NO: 276896 - DNA, 736 bp, Homo sapiens
  misc_feature: GYAE6OF02F487O.22.34.D01.1.454.CMB.1.raw
tcagacatacgcgtcacgaccggtgctcgatttagatcgtctgtgttgggtttggggggaagaggaagactgacggtcctgtcccaggtgcagctgcaggagtcgggcccaggactggtgaagccttcggagaccctgtccctcacctgtactgtctctggtggctccgtcactggttaccactggagctggatccggcacgccccgagggaacggactggagtggattcggctatattcttacagtgccgcaccgaactccccacccctcctacaacgacgtaccgacgacccaaccaagttactcacgtcgaacaaccgtcccaaacgaaccctacgttcctacccgtagaaacctggaacggtctaggtcgaccgtcgacggcggtaccaccggaccgtgttaacttacgagttcggacgtagacggtacggtaccgggtccgtaattacgtcgtcggtcccgttcggaccccgtgggacctacgggacccgtggtaccgtacccgtctccgtacgacgtccctacccgtaccgaacggaccccgtaacgtcccggttacccgttacccccgcgggtacccgtcccgtacgtccctacccggtacggccgtacccgtacccgtaccgggacgtaccgacctaaccggaccgggttcccggaccccggttcgggacccgttccggacccgttacgggtaccgtaaccggtaccgttaccgttacccggtaacgg

SEQ ID NO: 276897 - DNA, 787 bp, Homo sapiens
  misc_feature: GYAE6OF02FJBTO.22.34.D01.1.454.CMB.1.raw
  modified_base (591)..(591): a, c, t, g, unknown or other
  misc_feature (591)..(591): n is a, c, g, or t
tcagacatacgcgtcacgaccggtgctcgatttagatcgtctgtgttgggtttggggggaagaggaagactgacggtcctgtcccaggtgcagctgctaggagtcgggcccaggactggtgaagccttcggagaccctgtccctcacctgtactgtctctggtggctccgtcactcggttaccactggagtctggatcccggacaccgcccccgaaggggaacggacgtcggaggtacggtagttcggtacttagttactttctaacgtaggtcggccgaccaacctaaccgtaccccctaccccttcctacgaacgtgtaccgacgacccactatactcgagtccaactaccgtaaccaacgtaacctcgttaccctacccgtaacgaaacgttcgggaacggttccgtaggtacgacccgacgaacggaccggaccgaccgggtcgttacgttacgtaccgttgacgcgtaaggacgtaccggttcccgggatacgttacgaccggttcggtacccgttaccggtacccggtacgggacccggtaaccgggtacccgttccggtaccgtaccggttacctcccgtaccnccggtaccctacccgaccggaaccggtacccctacgtttcccggtaccccgttcccccggtacgggtaccccctcccgttaccggtacccgtaccgtaacgggtaccgtacccttaccgggtaccgacgtagacccgacggacgtacccggccgtcggtacgcgtccgagtaccggtacgtcttaccgccgtaccg

SEQ ID NO: 276898 - DNA, 765 bp, Homo sapiens
  misc_feature: GYAE6OF02FKUP8.22.34.D01.1.454.CMB.1.raw
  modified_base (314)..(314): a, c, t, g, unknown or other
  misc_feature (314)..(314): n is a, c, g, or t
  modified_base (325)..(325): a, c, t, g, unknown or other
  misc_feature (325)..(325): n is a, c, g, or t
tcagacatacgcgtcacgaccggtgctcgatttagatcgtctgtgttgggtttggggggaagaggaagactgacggtcctgtcccaggtgcagctgcaggagtcgggcccaggactggtgaagccttcggagaccctgtccctcacctgtactgtctcgtggtggcctccgtcactggttaccactggagctggatccggcacgcccccgagggaagggctgggagtggattggcttattatttcttacaggtcggccgcacctaacctcccccaccccctccctacgaacgcgtccgacgcccaccattaacncaggtcaaccnccgtaccaaacgaaccctagttccctaacccttaaaaagtggaacggtccttagggtcgtacccgacgacggaccggaaccgtaaccgggtccgttaggttaaccttacgttcggtacgacggtaaggacggtacgggttcccgggtacgaagttacgttccgtacgggtcccgtttcccggaccccgggtacgggcccggtaaccgggtaccccgtcgggtacccgacccgtccctcccgttaccgaccgtccctaccccgaaccgaaccgggccctaccggtccgttccctttccccggcggtcccgtcccgtcgtaccgtaccggacgtaccgcccgtaccgtaccgagccgactacgaccgggcccgtacccggttcgggccgtccgtccggttacggtaccgaccggttaccttacccgttacccgacgttaccg

SEQ ID NO: 276899 - DNA, 679 bp, Homo sapiens
  misc_feature: GYAE6OF02G33GE.22.34.D01.1.454.CMB.1.raw
  modified_base (226)..(226): a, c, t, g, unknown or other
  misc_feature (226)..(226): n is a, c, g, or t
  modified_base (451)..(451): a, c, t, g, unknown or other
  misc_feature (451)..(451): n is a, c, g, or t
  modified_base (586)..(586): a, c, t, g, unknown or other
  misc_feature (586)..(586): n is a, c, g, or t
  modified_base (592)..(592): a, c, t, g, unknown or other
  misc_feature (592)..(592): n is a, c, g, or t
  modified_base (603)..(603): a, c, t, g, unknown or other
  misc_feature (603)..(603): n is a, c, g, or t
  modified_base (618)..(618): a, c, t, g, unknown or other
  misc_feature (618)..(618): n is a, c, g, or t
tcagacatacgcgtcacgaccggtgctcgatttagatcgtctgtgttgggtttggggggaagaggaagactgacggtcctgtcccaggtgcagctgcaggagtcgggcccagggactggtgaagccttcggagaccctgtccctcacctgtactcgtctctggtggactccgtcactcgttaccacgtggagctggatccggcacgcccccgagggacggactggngtaggagttcggctatatttccttacagtcggccgcaccacctccccacccctcctacgagacgtcgacgacccgaacctagtactacgacgtaccgaacgaccgttacccgaaagaaccctacgtttaccgtacccctagaaaccgtcggtacggttccgtaggtaccgacccggtagaccggccgggaccgtacggcccgttaggtactttacgtcggtacgnggacgtaggtccggtccggggtacagtcgtcggtcgtccgttccggaccgtcgggaccgacgggtacctggaccctccgtcgccgtaccgcctcctaccgaccgacgggcctacgtcccgtccctcccgcggccnccgtcncgtcgacggcncctaccgcacgcacncggtcggcctccgggatccgaccgtcggtacccgtcgaaccggtaccgttacctccgtacg

SEQ ID NO: 276900 - DNA, 846 bp, Homo sapiens
  misc_feature: GYAE6OF02FMVKN.22.34.D01.1.454.CMB.1.raw
  modified_base (201)..(201): a, c, t, g, unknown or other
  misc_feature (201)..(201): n is a, c, g, or t
  modified_base (248)..(248): a, c, t, g, unknown or other
  misc_feature (248)..(248): n is a, c, g, or t
tcagacatacgcgtcacgaccggtgctcgatttagatcgtctgtgttgggtttgggggaagaggaagactgacggtcctgtcccaggtgcagctgcaggagtcgggcccaggactggtgaagcctttcggagaccctgtccctcacctgtactgtctctggtggctccgtcactggttaccactggagctggactcccggnacgcccccgaagggaaggctggagtggattggctattatttctacgngtggccgcaccaactccccacccctcctacaagacgtcgacgcccaaccatactacagtccgaacctaccgtaccaaagtaaccccagtttcctacctagaaaacctggtaacggttcctacggttacgaacccgcgtaacggacccgggaacaaccgggtccgttaggttaactttaacgtcgtagacggaacggtaaggtaccggttcccggggtacgtaattaacgggttccgttacggggccccgtttaccgggaacccccggtttggggaccccggtaaacggggtaacccccgttacggggttaccctaacccggttcccttacccgtaacccgacgtaccccgtaccgaaccccggtaaaccggggtaccccctaacggttacccggttccccgtttacccccggttcgggccccgtaccccgttacggtcccgtaaccgtacgggacgaccctaaacccggttccgaacgaccggtaccgaaccggttaaccggccccggttaccccggtacgggtaccccgttacggtcccgtttacggggtaacccgtaaacgggttaccccgttacccgtttacccggtaaacccgg

SEQ ID NO: 276901 - DNA, 573 bp, Homo sapiens
  misc_feature: GYAE6OF01EQB5B.53.71.G05.1.454.CMB.1.raw
tcagcgcgtatacacacgaccggtgctcgatttagtgtcgtcgcaagagagagggggctgggcctaaggaagcagcactggtggtgcctcagccatggcctggaccgttctcctcctcggcctcctctctcactgcacaggctctgtgacctcctatctattgactcagccaccctcggtgtcagtggccccaggaaggacggccacgatgacctgtgcaggaaaacaacattggaaagtaaaagtgtgcactggtaccagcacaggccaggccaggcccctgcgctggtcgtctatgattatagcgacccggccctcgagggactccccgtggacgcgtattcctcgtggcctaccaacgtcgtggggaccacggcccacccgtgaccatcgagcgagggtcgaaggccggagacggacggaccgactattactgtcgaggtgtagggtaattttaagtagtgatctagttgggtgttcgggcggagggaccaaggcgtacgaccgtcgtaggtcagcccgaaggcctccgcccccgtcggtacctaccgttccgtccgttcccctaccccg

SEQ ID NO: 276902 - DNA, 561 bp, Homo sapiens
  misc_feature: GYAE6OF01DXXSJ.53.71.G05.1.454.CMB.1.raw
tcagcgcgtatacacacgaccggtgctcgatttagtgtcgtcgcaagagagagggggctgggcctaaggaagcagcactggtggtgcctcagccatggcctggaccgttctcctcctcggcctcctctctcactgcacaggctctgtgacctcctatctattgactcagccaccctcggtgtcagtggccccaggaaggacggccacgatgacctgtgcaggaaacaacattggaagtaaaagtgtgcactggtaccagcacaggccaggccaggcccctgcgctggtcgtctatgattatacgcgaccggccctcgagggactcccgtgacgcgattctcgtggcctccaactcgtggggaccacggccaccctgaccatcagcgagggtcgaacgccggaagacggaggccgatacttacgtgtcgagggtgtgggtattttaagtagtgatcgtagtttgggttgttcgggcggaggaccaagccgtagcccgtcgtaggtcgacgcccgaaggcctccgacccccgtcggtaccacctccttcgttcccctaccccg

SEQ ID NO: 276903 - DNA, 716 bp, Homo sapiens
  misc_feature: GYAE6OF01CEBCD.53.71.G05.1.454.CMB.1.raw
  modified_base (166)..(166): a, c, t, g, unknown or other
  misc_feature (166)..(166): n is a, c, g, or t
  modified_base (179)..(179): a, c, t, g, unknown or other
  misc_feature (179)..(179): n is a, c, g, or t
  modified_base (314)..(314): a, c, t, g, unknown or other
  misc_feature (314)..(314): n is a, c, g, or t
tcagcgcgtatacacacgaccggtgctcgatttagtgtcgtcgcaagagagagggggctgggcctaaggaagcagcactggtggtgcctcagccatggcctggaccgttctcctcctcggcctcctctctcactgcacaggctctgtgacctctatctattgactnagccaccctggtntcagtcggcccaggaacggacggccacgatgacctgtgacaaggaaacaacagttaggaaagtaaagtgtcggacacgtcggaacagcacgacggcacggccacggtcccctgcgcgtgggtcctgtatgattanacggccgaccggtccctggaacgggtactacccgtgaacggcgttacttcgtcgtcggtccctaccaacgtttcggtacggggaacccaccggggacccctacccgttagaaccctagtaccgacggtacggacggggtaaccggaacgggacccgggaacggacccggtaagggaccctaacgttaacttaccgttggtaccgagggttaggttagggttaattttaagtagttagtaaccttagttaggtttagggggtacggttcgggacggggtaacgggacgtaacggacttaccggtaccggttaccgaacgggtccgaaccggacccggtaacggcccgttacccggtccccgtaccgggttccaccgtttcccgtcgggttcccccttcccccg

SEQ ID NO: 276904 - DNA, 827 bp, Homo sapiens
  misc_feature: GYAE6OF01D101E.53.71.G05.1.454.CMB.1.raw
tcagcgcgtatacacacgaccggtgctcgatttagtgtcgtcgcaagagagagggggctgggcctaaggaagcagcactggtggtgcctcagccatggcctggaccgttctcctcctcggcctcctctctcactgcacaggctctgtcgacctcctatctattgactcagcccaccctcggtgtcgagtcggaccccgagggaacggaccggccacgatcgacctgtgacgaaggaaacaactagttaggaaagtaaagtgtagacgacgtaggtaccagcaacgacggccgacggccacggccccctggccgtcgtggtccgtactagtgatggtaagtcggcccggacccggtccgtacggacgggtaccttcccgtaggacggactacgttcgtcgacggtccctaccgaaccggttcgggaccggggtaacccacccggtacccaccccgtacggaaccctaggtaccgaacggtaccggtaacggggtaaccggaaccgggacccgggaacggaaccgggaaccggacccgtaaacctttacggttacttacggtacgggttaggttacgggttagggtttaacgtttttaaggacggttaggttacgttaccgggtttagggttttacgggggttaccggtttcgggggaaccggggtaaccggggaaccgtaacgggtcccggttaaccgggtaccccggttaccggtacggttaccccggaacccgggtaccccgaccggggttcccccgccccggtttaccccccgggttacggttaccccttacccggttcccccgtttacccccggttaccccccg

SEQ ID NO: 276905 - DNA, 761 bp, Homo sapiens
  misc_feature: GYAE6OF01DEFXM.53.71.G05.1.454.CMB.1.raw
  modified_base (354)..(354): a, c, t, g, unknown or other
  misc_feature (354)..(354): n is a, c, g, or t
tcagcgcgtatacacacgaccggtgctcgatttagtgtcgtcgcaagagagagggggctgggcctaaggaagcagcactggtggtgcctcagccatggcctggaccgttctcctcctcggcctcctctctcactgcacaggctctgtgacctcctatctattgactcacgcccaccctcggtgtcagtcggccccagggaaggcggccacgatgacctgtgacaaggaaacaacgattagggaaagtaaaagtgtgcacgtcggtaccagcacgacggcccaaggccacggcccctgcgcgtggtcgtctagtgtattagtacggccggacccggcctacggagggactcccgnggacgcgtatttccgtacgtcggaccctaccgaaccgtcggtacgggggaacccacccggggcccctaacccgtacgaaccctatccggaacggacggtaacggggtaccgggaacgggacccgggaacggaaccggaacgggtacccggtaacttacgttacgtcggtacggtagggtcggtttagggttaactttttaaggtaggttagtacgttacggtaggtttcgggggttagggttacggggtacggggaacgggtaccgtaacgggtaccgtaccggtaccccggttacggtaaccgggtacggaccggtaccccggtaacgggtcccgttaccccgggtcccccccggttccggttaccctacccgtttcccgttccccggttcccccgttaccccccg

SEQ ID NO: 276906 - DNA, 825 bp, Homo sapiens
  misc_feature: GYAE6OF01BEUHV.53.71.G05.1.454.CMB.1.raw
  modified_base (139)..(139): a, c, t, g, unknown or other
  misc_feature (139)..(139): n is a, c, g, or t
  modified_base (169)..(169): a, c, t, g, unknown or other
  misc_feature (169)..(169): n is a, c, g, or t
tcagcgcgtatacacacgaccggtgctcgatttagtgtcgtcgcaagagagagggggctgggcctaaggaagcagcactggtggtgcctcagccatggcctggaccgttctcctcctcggcctcctctctcactgcacnggctctgtcgacctcctatctattgactcncgccaccctcggtgtcacggtcggcccgagggaacggaccggccgacgatcgacctgtcgacgaaggaaacctagagttaggaaagtaaaggtgtgacacgtacggtaccagccacgacggacgacggccaccggtccccgtggccgtcgttacggtccgtacgtagtacgtagtacgacgtaacggtcccggacccggtcccgtacggtacgggtaccttacccggtagtacggtaccttacttccgttacgtccgggtacctaccgtaaccgtacgggtcggggaaccctacccggtccccctaccgtacgtacccgtacgtaccgacgggtaccggaagggtaccgggaaccggtaccggggaacgaaccgggtaaccggtacccgtaacgttacgttaccggtacgttaccggtaggggttacggtaagggtttaacgttaagtacggtcgtaagttaccggttagggttcggggttaccgggtcggggtaacccgggtacgggtacccgtaacggtccggttaccgtaaccccgggttacggtaaccgggtacctacccgggtccccggtaacggtcccccgtttacccgggtcccccgggttacccggtacccttacccgggttttcccccggtcccgttcccccccggg

SEQ ID NO: 276907 - DNA, 773 bp, Homo sapiens
  misc_feature: GYAE6OF01C3AX6.53.71.G05.1.454.CMB.1.raw
  modified_base (345)..(345): a, c, t, g, unknown or other
  misc_feature (345)..(345): n is a, c, g, or t
  modified_base (472)..(472): a, c, t, g, unknown or other
  misc_feature (472)..(472): n is a, c, g, or t
tcagcgcgtatacacacgaccggtgctcgatttagtgtcgtcgcaagagagagggggctgggcctaaggaagcagcactggtggtgcctcagccatggcctggaccgttctcctcctcggcctcctctctcactgcacaggctctgtcgacctcctatctattgactcacgcccaccgtcggtgtcgaggtccggaccccagggaacggaccggcccacgagtcgaccgtgtgacgaaaggaaacaactagttaggaaagtaaagtgtagcgtactacgggtaccagaccgaacgacggacccgaggacccgaccggaccccgtgccgtcgtcggtcgtactagngtagtgaacgtacggccggaccccggacccgttacggaaggtacctacccgtaggagacgtactttccgtggtccgcctaccaacgttcggacgggacccgcccggtacccgtaccccgacgaaccncgtaccgtacgacggacgggtaccggaacggacgggaacggacggacggtacccgtacgttacgttacgtcggtacgtaggtcggttaggtttaatttaagtagttgtactacgttagggtttcgggttaggtcggggtaacggtaccggtaacggtaaccggtccgtaaccgggtaccgttacccgggtacggtcccggtaaaccggtacccgggtaccggtccccggtaccccgggttcccccggttaccggttaccccgttaaccccgttccggttcccccggttttaccccccccgg

SEQ ID NO: 276908 - DNA, 677 bp, Homo sapiens
  misc_feature: GYAE6OF01BWJIC.53.71.G05.1.454.CMB.1.raw
tcagcgcgtatacacacgaccggtgctcgatttagtgtcgtcgcaagagagagggggctgggcctaaggaagcagcactggtggtgcctcagccatggcctggaccgttctcctcctcggcctcctctctcactgcacaggctctgtgacctcctatctattgactcagcccaccctcggtgtcagtcggccccaggaaggacgccacgatgacctgtgcaggaaacaacattaggaagtaaagtgtgcacgtggtaccagcacgacggccaggcctaggccccctgccgctggtctctatgtattagacgccgaccggccctacgagggactcccgtgacgccgtattcctcgtcggcctacccgtaacgtcggtacggggaccaccggccccgaccctggaaccctatcgacgacgagggtccggaaggccggaaggaccggacggaccgtaacttaacttacgtcggtacgacgggttggtagggttattttaagtagtaggtatacgtaggtttcggggttcggttacgggacggggtaacggaccgaacgggtaccgtaccggtaccggttaccgtacgggtaccgaacccggacccgtaacgggtcccgtaccccggtcccccgttccgggtacctaccctttcccggttcccgtttcccccggtcccccg

SEQ ID NO: 276909 - DNA, 817 bp, Homo sapiens
  misc_feature: GYAE6OF01CVOAS.53.71.G05.1.454.CMB.1.raw
  modified_base (364)..(364): a, c, t, g, unknown or other
  misc_feature (364)..(364): n is a, c, g, or t
  modified_base (498)..(498): a, c, t, g, unknown or other
  misc_feature (498)..(498): n is a, c, g, or t
tcagcgcgtatacacacgaccggtgctcgatttagtgtcgtcgcaagagagagggggctgggcctaaggaagcagcactggtggtgcctcagccatggcctggaccgttctcctcctcggcctcctctctcactgcacaggctctgtcgacctcctatctattgactcacgccctacccgtcggtgtacgaggtccggccccgaaggggaacggccgggaccacgatcggaccctggtcgacgaaggaaacaacgtagttaggaaagttaaagtgtcactacttcggaaccagccaacgacggcccgaacggcccgaccggcccctaggccgtccgtcgggtcggttcctaatcggtaatttanacggtccccggaaccggccccttggagggtaacctccccggtgaaccggtcgtaacctttcgtccgtacggtaccctacctaaccgttcgggtaccgggactaccccggcccctaacccggtaccaaccgtacnccgaacggaccggtacgggtaaccggaaccgggaccgggtaacggaaccggacggtaccgtaaccgttaacgttcgtacgtacggtacgtagggttagggtttaacgtttaaggtacgttagtacgttacgttaggttacgggttcggttaccggggacgggtaacgggtccggtaaacggttcccggttaccgggtaccccggttaccggttaaccgggtccggaacccggtaaccccggacggttaccccggtacccgtcccccggttccggtacccgttacccgtttcccggtccccgtttccccgggttcccccc

SEQ ID NO: 276910 - DNA, 779 bp, Homo sapiens
  misc_feature: GYAE6OF01A8ZDJ.53.71.G05.1.454.CMB.1.raw
tcagcgcgtatacacacgaccggtgctcgatttagtgtcgtcgcaagagagagggggctgggcctaaggaagcagcactggtggtgcctcagccatggcctggaccgttctcctcctcggccctcctctctcactgcacaggctctgtcgacccttcctatcttattgactcacgcccacccgtcggtgtcaggtccggccccgagggaacgggaccggccgaacgataggacctggtacgacgaaggaaaaccaactagttaaggtaaaagtaaaaggtgtacgacgtacgtacggtaacccaggaccaacggacggacccgaacgggacccgaccgggtcccccgtggcccggtcggttcgggtccttactagttagtaatttacggaccggcccggacccggtcccgtaggaacgggtacctcccgtaggacggtcctacgtttccgtcgtccggacctacccgtaacggtcggtacggggacccacccgggtccctacccgtcgaacctacgtcgaacgggaccggaacggggtaccgggaacgggacgggaacggacgggaaccggtacccgtaacttaacgttacgtgggtacggtaggggtttcggtttaggtttaatttttaaggtggtagtgttaggttagggttggggttcggtcggggacgggacgggactaggccgttacgtccgtacggtacggtcgaccggaccggtacgtccccgtcccggtccccgtcgtacccgttccgttaccctcccgtaccccctcccg

SEQ ID NO: 276911 - DNA, 724 bp, Homo sapiens
  misc_feature: GYAE6OF01A9WT3.53.71.G05.1.454.CMB.1.raw
  modified_base (375)..(375): a, c, t, g, unknown or other
  misc_feature (375)..(375): n is a, c, g, or t
tcagcgcgtatacacacgaccggtgctcgatttagtgtcgtcgcaagagagagggggctgggcctaaggaagcagcactggtggtgcctcagccatggcctggaccgttctcctcctcggcctcctctctcactgcacaggctctgtgacctcctatctattgactcagccaccctcggtgtcgagtcggcccccaggaaggaccggccgacgatcgacctgtgcgaaggaaacaacagttaggaaagtaaagtgtagcacgtggtaccagcgacacggccaggccacggcccctgcgcgtcggtcgtcctagtgtattacaggccggacccggtccctcgagggtaccgtcccgtagacgcgttacttctccgnggtctaccacgtcggtacggggacacccggcccaaccccgttcgaaccctactacaacgggtccggtacggggtaccggaacgggtaccgggaaccggaacgggaacgggtacccgtaacgttaacgtttacgtcggtacggtagggtttgggtagggtttacttttaaggtaggtacgtatacggttaggtttacggggttgggttacggggacgggaagggaccgacggtcgttcggtaccccgttccggtaacggttccgtaccggacccggtaacggtcccgtaccccgtcccccggttccggtacccctaccgttcccgttccccggttacccccttccccccg

SEQ ID NO: 276912 - DNA, 761 bp, Homo sapiens
  misc_feature: GYAE6OF01BKNVY.53.71.G05.1.454.CMB.1.raw
  modified_base (716)..(716): a, c, t, g, unknown or other
  misc_feature (716)..(716): n is a, c, g, or t
tcagcgcgtatacacacgaccggtgctcgatttagtgtcgtcgcaagagagagggggctgggcctaaggaagcagcactggtggtgcctcagccatggcctggaccgttctcctcctcggcctcctctctcactgcacgaggctctgtcgacctctatctattgactcacgcccaccgtcggtgtcagtccggacccgagggaacggccggaccacgtactcgaccgtggtcgacgtaacggaaaacaacgtaggttaggaaaagtaaaggtcgacgacgtacgttcggaacacgaccgtaacgacggaccgacggaccgtacccggtcccgtcggaccgttccggttccggttaccgtttacgttaagtttacgaacgttttacgccggaacccggtcccggcccgtacggtaacgggtacttcccggagacgtccgttcttcggtccgtacgtaccctaaccgacggtaccggtacgggacctacccgggaccctaccgtagtaccactacgacggtaaccggagggaccggaacgaccgggttacgaacggaccgttaccgaatttcgtacgtagtcggtaagggttcgtaaggtttactttaagagtcgtaaacgttcgtcggggttacggggttcggttaaccggggacggtaacgaccgtaaggtcccgtaggtaccgtacgttagggccctacgggaccgacgttcccnccccgtcccggttactacttcccctcggtttccccgccgttcccc

SEQ ID NO: 276913 - DNA, 888 bp, Homo sapiens
  misc_feature: GYAE6OF01B0W16.53.71.G05.1.454.CMB.1.raw
  modified_base (363)..(363): a, c, t, g, unknown or other
  misc_feature (363)..(363): n is a, c, g, or t
tcagcgcgtatacacacgaccggtgctcgatttagtgtcgtcgcaagagagagggggctgggcctaaaggaagcagcactggtggtgcctcagccatggcctggaccgttctcctcctcggcctcctctctcactgcacacggctctgtcgacctcctatctattgacctcacgcccacccgttcggtgtcacggtccggaccccgaagggaaacggaccggccaacggtactacggaccgttgtacgaacgaaacggaaaacctaactaaggttaaggtaaaaggttaaaacggttggtacggaccttacggtacgtaaccgagaccgaacgacggaccgacggtcccgaccggtcccccgnggtaccgtacggttcgggtaccgttacgtaagtaggacgtggtaacgtaccgggtcccggaaccggtccccgtacgggacgggtacctccgagggacgtaccgtacgtttccgtacgtcggtacctaccgtaccggttacgggacggaccgaccggtacccaaccgtacgaacctagtaccgacggtacgggaccgggtaacgaaccgggaccgggaaacgtaccgggacggtaccgtaaacgttacggttaccgtacgggtaaccggttagggttagggttaacgggtttaattttaacgtacggttaggtaacggttacggttacgggttttgggggttccgggttaacggggtaccggggtaacggtaaccggtaccgttccgggtaacccgtaaccggggttaacccgtttacgggtaacccggacccgggtaacccggaacggttcccccggttacccggggttacccccgttagggttaccccgtaaccgtttccccggttaccccggtttacccccgg

SEQ ID NO: 276914 - DNA, 533 bp, Homo sapiens
  misc_feature: GYAE6OF02HKC95.53.71.G05.1.454.CMB.1.raw
tcagcgcgtatacacacgaccggtgctcgatttagtgtcgtcgcaagagagagggggctgggcctaaggaagcagcactggtggtgcctcagccatggcctggaccgttctcctcctcggcctcctctctcactgcacaggctctgtgacctcctatctattgactcagccaccctcggtgtcagtggccccaggaaggacggccacgatgacctgtgcaggaaacaacattggaagtaaaagtgtgcactggtaccagcacaggccaggccaggccccctgcgctggtcgtctatgatgatagccgaccggccctgagggactccctgacgcgtattctctggctccaactcgtggggaccacggccaccctgaccatcagcgagggtcgaaggccggagacggacggccgactattactgtcgaggtgtgggtaattttaagtagtgatctagttgggtgttcggcgggaggacagctagaccgtccgtaggtcacgcccaggcctcgccccgtggtccactctccgtccc

SEQ ID NO: 276915 - DNA, 707 bp, Homo sapiens
  misc_feature: GYAE6OF02JVHQ5.53.71.G05.1.454.CMB.1.raw
  modified_base (356)..(356): a, c, t, g, unknown or other
  misc_feature (356)..(356): n is a, c, g, or t
tcagcgcgtatacacacgaccggtgctcgatttagtgtcgtcgcaagagagagggggctgggcctaaggaagcagcactggtggtgcctcagccatggcctggaccgttctcctcctcggcctcctctctcactgcacaggctctgtgacctcctatctattgactcagcccaccctcggtgtcagtcggccccaggaacggacggccacgatgacctgtgacaggaaacaacattaggaaagtaaaagtgtacgcacgtggtaccagcacaggaccaggcccagtccccctgccgtcgtcggtcgtctatagtattagtacggccgtacccggccctacggacgggacctcccgngaacgtcgtacttcgtcgtcggctaccaacgtcggtacggggaccaccggtcccacccgtacgaccacgtcgacgtcgacgggtacggaacggccggacggacggacggaccgtaacgtacttacgtcggtacgtaagggttggttacggttaattttaacgtaggttagtacttacggttaggtttcggggtttacgggttacggggaccgggtaacgggtaacccgtaagggtccgttacggtacccggttacgttaacggccgtaaccggtacccggtaaccggttcccgacccggtacccccggtccggtacctacccggtttccgttccccggttcccgtcccccg

SEQ ID NO: 276916 - DNA, 570 bp, Homo sapiens
  misc_feature: GYAE6OF02F38ZB.53.71.G05.1.454.CMB.1.raw
tcagcgcgtatacacacgaccggtgctcgatttagtgtcgtcgcaagagagagggggctgggcctaaggaagcagcactggtggtgcctcagccatggcctggaccgttctcctcctcggcctcctctctcactgcacaggctctgtgacctcctatctattgactcagccaccctcggtgtcagtggccccaggaaggacggccacgatgacctgtgcaggaaacaacattggaagtaaaagtgtgcactggtaccagcacaggccaggccaggccccctgcgcgtggtcgtctatgatgatagccgaccggccctcgacgggactccccgtgacgcgattctcgtggcctaccaactcgtacggggaccaccggcccacccgtgaccatcagcgagggtacgaacgccgggagacggacggccgactattactgtcagggtggtaggtattttaagtagtgatgtagttgggtgttcgggacggacgggaccgaagcgtacgaccgtcgtaggtcaccggcccgtaacggccgtccgtccccgtcggtactccgtccgtccgtccccg

SEQ ID NO: 276917 - DNA, 748 bp, Homo sapiens
  misc_feature: GYAE6OF02H2M38.53.71.G05.1.454.CMB.1.raw
tcagcgcgtatacacacgaccggtgctcgatttagtgtcgtcgcaagagagagggggctgggcctaaggaagcagcactggtggtgcctcagccatggcctggaccgttctcctcctcggcctcctctctcactgcacaggctctgtgacctcctatctattgactcacgccaccctcggtgtcagtcggcccaggaggacggccacgatgacctgtgcaggaaaacaacgattaggaaagtaaaagtgtacgacacgtggtaacccagacgacacgggccaacggccgaacggcccccgtgccgcgtggtacgtctagtgatgataggccgaccggcctcgaggactccgtgacgcgtattcctcgtggcctaccaacgtcggtacggggaccaccgggaccctaacccgtggacccaacgtcgacggcggtaacggggtccgaaacggcccgggaaggaccggaacgggaccctaaagttacgtttaaccgtgggttaccgtaggggtttaggttaacggggtttaaacttttaaacggtagggttacgttaacgttcggtaacgggtttttgggggttacggttacggggaccgggggtaaacggtaaccctaagggtcccggttacggtaaccccgggtttaccggtaacgggttaccaacgggttaccccgaacgggtcccgttaccccgggtcccccttacgggttaccccacgttttaccccggtccctttaacccccccg

SEQ ID NO: 276918 - DNA, 572 bp, Homo sapiens
  misc_feature: GYAE6OF02IZWKX.53.71.G05.1.454.CMB.1.raw
  modified_base (304)..(304): a, c, t, g, unknown or other
  misc_feature (304)..(304): n is a, c, g, or t
  modified_base (456)..(456): a, c, t, g, unknown or other
  misc_feature (456)..(456): n is a, c, g, or t
tcagcgcgtatacacacgaccggtgctcgatttagtgtcgtcgcaagagagagggggctgggcctaaggaagcagcactggtggtgcctcagccatggcctggaccgttctcctcctcggcctcctctctcactgcacaggctctgtgacctcctatctattgactcagccaccctcggtgtcagtggccccaggaaggacggccacgatgacctgtgcaggaaacacattggaaagtaaaagtgtgcatggtaccagcacaggccaggccaggccccctgccgctggtcgtctagtgtattanaggcgacccggccctcgacggggacttcccctgagcgtattctctggcctaccaactcgtcggggaccaccggccaccctgacctatcacgcgagggtaccgaaggccggaagaccggaggccatatactgtcagggtgtgggtatttaagngtgatcgtaggttgggttggtcggggcggggtacagcgtgtaccgtcgtaggtcgacggacccgaaggtcctaccgccccgtggtacctccgtctccggttccccacccgttcccg

SEQ ID NO: 276919 - DNA, 797 bp, Homo sapiens
  misc_feature: GYAE6OF02HQA6V.53.71.G05.1.454.CMB.1.raw
tcagcgcgtatacacacgaccggtgctcgatttagtgtcgtcgcaagagagagggggctgggcctaaggaagcagcactggtggtgcctcagccatggcctggaccgttctcctcctcggccctcctctctcactgacacgacgctctgtcgacctctatctattcgactcacgcctaccgtcggtgtcaggtccggacccgaggaacggaccgcctacgatcgaccgtgtcgacgaacgaaaacaatacgttaggaaaagttaaagtggtacgactacgttacggtaacccagacctaacgacggaccgacggacccgtacggtcccccgtggccgtacggtcgggttacctacttagtacggataccggtatacggcccggaacccggtccacggtagggaccttccgggtagacgtacgtattccgtcgtacggaccttaccgaaccgtttacgggcgggggaacaaccccgggtccctacccggttacggaaacctacggttaccgacggacgggaacgggtaccggaaaccgggacggaacgtacggaccggttacgtaaaccgttaacgttacgacgtacggaggggttaggttaggttttaactttaaggtacgttagaaacttcggtacgggtttagggttcggttacgggaccggggttaagaaccggtagtcgtaccgggttcccggtagttaccggtaccggaccgtaaaccccgggaggtaccccttccgggtacccccgttacgtacccgtttaacccgttccgggttacccgttccccccggg

SEQ ID NO: 276920 - DNA, 704 bp, Homo sapiens
  misc_feature: GYAE6OF02GLJCU.53.71.G05.1.454.CMB.1.raw
tcagcgcgtatacacacgaccggtgctcgatttagtgtcgtcgcaagagagagggggctgggcctaaggaagcagcactggtggtgcctcagccatggcctggaccgttctcctcctcggcctcctctctcactgcacaggctctgtgacctctatctatgactcagccacctcggtgtcagtcgcccaggaaggacggccacgatgacctgtgcaggaaacaacattggaagtaaaagtgtagcacgtgtaccagcacaggccaggccacggcccctgccgcgtgggtccgtcttatgtattagtacggccgaccggtccctcgacggggtactccctaggacgcgtacttccgtcgtcggccttaccgaactccggtacgggggaccaccgggaccctacccgtcgaaccctacgtcgacgacgacgggtacgaacggcgggacgacggacggaccgtaacttacgttacgtcgttacgtaggttcgggtagggttaattttaagtaggttagtacgttagttaggttttcggggttaggtttccggggacgggtacgggtaaacccgaaacggtcggttaccggtacccgtttcccggtagggtacccgaaccggtacccggaaccgggtcccgtacccggtaccccccggttcggtaccccgtacccgtttccgttaccccgtttacccccgtacccccg

SEQ ID NO: 276921 - DNA, 729 bp, Homo sapiens
  misc_feature: GYAE6OF02HQH5B.53.71.G05.1.454.CMB.1.raw
  modified_base (218)..(218): a, c, t, g, unknown or other
  misc_feature (218)..(218): n is a, c, g, or t
tcagcgcgtatacacacgaccggtgctcgatttagtgtcgtcgcaagagagagggggctgggcctaaggaagcagcactggtggtgcctcagccatggcctggaccgttctcctcctcggcctcctctctcactgcacaggctctgtgacctcctatctattgactcacgcccaccctcggtgtcagtcggcccagggaggacgccacgatgacctgngcaggaaacacagttaggaagtaaagtgtgcacgtcggtaccagcacacggacgacggccgacggccctcgcgcgtcggtcgtctacgtgacgtgagtacgccgaccctcccggggggggggggtaccacgggtactacccgtacggacgtacgtacttccgttacgtcggtacctaccgtaaccgtccggtacgggaccgtacccggcccgtacccgtacggaccacgtacgacgtaccggaacgggtaccggaacggaccgggaacggaccgggacgggaccgtaacgtacgtttaacgtggttacggtaggttacggttaagggttactttaaggttagttacgtagttacgtaggtttcgggttcgggttacgggtacggggtacggaaccggtacgtccggttacgggtaccgttaccggttacggtaccgtaaccggtaccggaccggtacccgtcccggttaccccggtccggttacccgtaccgttcccgtcccgttcccccg

SEQ ID NO: 276922 - DNA, 919 bp, Homo sapiens
  misc_feature: GYAE6OF02JLL5L.53.71.G05.1.454.CMB.1.raw
tcagcgcgtatacacacgaccggtgctcgatttagtgtcgtcgcaagagagagggggctgggcctaaggaagcagcactggtggtgcctcagccatggcctggaccgttctcctcctcggcctcctctctcactgcacaggctctgtgacctcctatctattgactcagccaccctcggtgtcagtcggccccaggaaggacggccacgatgacctgtcgcaggaaacaacattggaagtaaaagtgtgcactggtaccaggcacaggccaggccaggcccctgccgcttggccgtctatgatgtagtacgcgaccggccctacgagggactcccgtagcgaccgtactttcgtactcggtcctacccgtaactccgggtaggggtaacccaccggggtccccctaaccccgttacggaccccttaacgtacccggtaacggtacccggtaacgggggttaaccggaaaccggggtaccccggggtaaaaccggggacccgggtaaacccggggtacccggttaaacccgtttaaccggttttaacccggttacgggttaacccggtttacgggggtacgggtttaccgggggttttaaacgtttttttaaacgggttacggggttaacgtttaaccggtttacccgggtttaaggggttttaccggggggttttaccggggttttacccggggggaagggggttaaaccccggggggtaaacccgttaacgggggttacccggttttaccgggtaaccccgggttaccccgggttaaccgggggttaaccctaacccgggggttacccccggtaaacggggtccccgtttaacccccggggttaccccccggggtttacccggttaccccggttaccccgttttaccccgggtttaccccgggtttaacccccccccg

SEQ ID NO: 276923 - DNA, 696 bp, Homo sapiens
  misc_feature: GYAE6OF02IDC8Q.53.71.G05.1.454.CMB.1.raw
  modified_base (308)..(308): a, c, t, g, unknown or other
  misc_feature (308)..(308): n is a, c, g, or t
tcagcgcgtatacacacgaccggtgctcgatttagtgtcgtcgcaagagagagggggctgggcctaaggaagcagcactggtggtgcctcagccatggcctggaccgttctcctcctcggcctcctctctcactgcacaggctctgtgacctcctatctattgactcagccaccctcggtgtcagtcggccccaggaacggacggccacgatgacctgtcgacaggaaacaacagttaggaaagtaaaagtgtgctacgtggtaaccagacacgacggccaggccgacggccctgcgcgtggtccgtntatgtattagacgccgccggccctacgaggggacctcccgtgacgcgtattcctcgtcgcctaccgaactcggacggggaccaccgggtacccctacccgtcgaaccctacgtccgaggaccggacggggtaccggaacggaccgggacgacgggaccggaccggtaacgttacttacgtacggttacgtagggttgggttagggttaagttttaacgaggttagtacgttaggttaggttacggggttcgggttacggggtacgggtaacgggaacgtacgtcgtaccggtacccggttacggtacggtacgtaccggtacccggtacgtcccgttcccgccccggttcgtcccgttaccgtccgttaccccgtacccctacccccg

SEQ ID NO: 276924 - DNA, 858 bp, Homo sapiens
  misc_feature: GYAE6OF02FSB30.53.71.G05.1.454.CMB.1.raw
tcagcgcgtatacacacgaccggtgctcgatttagtgtcgtcgcaagagagagggggctgggcctaaggaagccagcgacctggtggtgcctcagccatggcctgggaccgttcgtcctcctcggtccgtcctcgtctcactgccacaggctctggtcgaccgtcctattctattcgactcgacgccctacccgtggtgtcgagtcggccccgaggtaggcgccgagacgtcgtaccgtggtgaccgaacggtaaaccaacgtagttacggtaaacgttaaagtgtagccattcgggtacctaggacgactacgggcccacgggtccccgacgggtcccccgtggccggtcgttacggggttccgtccgttagtagggtatttacgaaccggtccccggtaccccgggtccctacgggtacgggtacccttccgggtacggtacggtccgttaactttccggtacggttccggggtacccttacccgtaaacggttccgggtaaccggggggaacctacccccgggtaaccccttaaccccggggttaccgtaacccggtacttccggaaccggtacggtaccggggtaaccgaccggtacccgggacggaccggacggtcccgtaacgttactaccggtacggtacggtacgggttaggtacggtttaattagtacgggtgtaactcgtagggtttgggttacgggtcgggtacggtacggtaaccgtagggccgttaccgggtaccctaggttacccggtacgtacccggtaacccggtccggttaccccttaccgggaccccgtttcgggtaaccccttccgggtaccgttttccccggtaccccgtttaccccg

SEQ ID NO: 276925 - DNA, 660 bp, Homo sapiens
  misc_feature: GYAE6OF02FW8AA.53.71.G05.1.454.CMB.1.raw
  modified_base (182)..(182): a, c, t, g, unknown or other
  misc_feature (182)..(182): n is a, c, g, or t
tcagcgcgtatacacacgaccggtgctcgatttagtgtcgtcgcaagagagagggggctgggcctaaggaagaagcactggtggtgcctcagccatggcctggaccgttctcctcctcggcctcctctctcactgcacaggctctgtgacctcctatctattgactcagcccaccctcggtntcagtcggccccaggaaggacggccacgatgacctgtgcaggaaacaacattaggaagtaaaagtgtcgcacgtggtaccagacacgaggccacggccacggcccctggcgtcgtggtcgtctactgattatacggccgaccggtccctgacgggacttcccgtgacgtcgtacttctcgtgctacactgtcgggactaccggccctacccgtgacctatacacggcgtacgggcgaaccggccgggaacgacggacggtaccgtacgttaagttcgtacgtacgagggttggttagggttaattttaagtaggtggtacttacggtagttcggggttcggtcgggacgggtaccgggaaccgtaacgtccgttacggtacccgttcggttacggtaccgtaccggaccgtaacgggccttacccggtcccccgttacggtccttaaccgtccgttcccgttcccctaccgttccccg

SEQ ID NO: 276926 - DNA, 718 bp, Homo sapiens
  misc_feature: GYAE6OF02FJB0E.53.71.G05.1.454.CMB.1.raw
tcagcgcgtatacacacgaccggtgctcgatttagtgtcgtcgcaagagagagggggctgggcctaaggaagcagcactggtggtgcctcagccatggcctggaccgttctcctcctcggcctcctctctcactgcacaggctctgtgacctcctatctattgactcagccaccctcggtgtcagtcggcccaggaacggacggccacgatgacctgtgcaaggaaacaacagttaggaacgtaaaaggtgtgcactggtaccagcacaggccaggccacggccctgcgctggtcgtctagtgtattactacggcgaccggccctacgacgggctccctgacgtcgtattctcgcggcctcaacgttcgtacggggaccaccggaccctacccgtcgtaacccacgttaccgagtaccggaacggggttaccgaaacgggaccgggaacgggtaccgggaaccgggtacccggtaaccgtttaacggttaccgttacgggtccgttaaggggttacgggttacgggttaaagttttttaacgtagggtttacgttaacttaccgttaggtttcgggggttacggtttcgggaacggggtacggaacccgtaagtccgtacggtacccgtaccgtacggtccgaaccggaccggtaacggccgttacccgccccgttaccgggtaccctccgttaccgtcccggtttaccccgtccccg

SEQ ID NO: 276927 - DNA, 740 bp, Homo sapiens
  misc_feature: GYAE6OF02GBIN0.53.71.G05.1.454.CMB.1.raw
  modified_base (182)..(182): a, c, t, g, unknown or other
  misc_feature (182)..(182): n is a, c, g, or t
  modified_base (566)..(566): a, c, t, g, unknown or other
  misc_feature (566)..(566): n is a, c, g, or t
tcagcgcgtatacacacgaccggtgctcgatttagtgtcgtcgcaagagagagggggctgggcctaaggaagcagcactggtggtgcctcagcccatggcctggaccgttctcctcctcggcctcctctctcactgcacaggctctgtgacctcctatctattgactcagccaccctcggtntcagtcggccccaggaaggaccggccacgatcgacctgtgcaaggaaacaactagttaggaaagtaaaagtgtagactactcggtaccagcacgacggccaggccacgcccgtgcgctcggtcgtactagtgtatgaacgtcgaccgacccggtcccttaggaacgggtccttcccgtggacggtcgtactttccgacgttcggacccttaaccgtacgtccgggttaccgggggaaccctacccggggtaaccccctacccgtacggaaccctacgtaccgacggtaaccgggtaacgggtacgaacgggacccgggaagtaccggacgacccgtacgttacttaccgtaggtcgtaggggttcgttaggtttaactttaagnggttaagaccgttagttagttggggttaccgttcgggacggtaaacggaaccgttaggccgttaccggtaccggttacgttacggaaccgtacccgggaacccgttaagggttcccttaaccccgggtccccgttaacggtacccgtcccgttacgtcccccgttaaccccccg

SEQ ID NO: 276928 - DNA, 512 bp, Homo sapiens
  misc_feature: GYAE6OF01BAOVM.13.3.A03.1.454.CMB.1.raw
  modified_base (430)..(430): a, c, t, g, unknown or other
  misc_feature (430)..(430): n is a, c, g, or t
  modified_base (491)..(491): a, c, t, g, unknown or other
  misc_feature (491)..(491): n is a, c, g, or t
tcagtcacgtactacacgaccggtgctcgatttagagagcgtcacaggggggtcacaagaggcagcgctctcgggacgtctccaccatggcctgggctctgctgctcctcactctcctcactcaggacacagggtcctgggcccagtctgccctgactcagcctgcctccatgtctgggtctcctggacagtcgatcaccatctcctgcactggaaatagcagtgatgttgggacttatgaccttgtctcctggtaccgacaacacccaggcaaagcccccaaactcattatttacggggtcaataagcggccctcagggctttctgatcgcttctctggctccaagtctggcaacacggcctcctgacaatctctggactccaggccgaggacgaggctgatttttactgttgttcatatgcaggaagngtgattagtgttcttggaagtggacaaggtcaccgtcttggtcagcccaaggcccaacccnctcgtcactctgttcccgccc

SEQ ID NO: 276929 - DNA, 511 bp, Homo sapiens
  misc_feature: GYAE6OF01A9GUQ.13.3.A03.1.454.CMB.1.raw
  modified_base (368)..(368): a, c, t, g, unknown or other
  misc_feature (368)..(368): n is a, c, g, or t
  modified_base (504)..(504): a, c, t, g, unknown or other
  misc_feature (504)..(504): n is a, c, g, or t
tcagtcacgtactacacgaccggtgctcgatttagagagcgtcacagggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaacagcagtgatcttgggacttatagacttgtctcctggtaccaacaccacccaggcaaggcccccagagtcatcatttatgggggcaagtaggcggccgtcagggatttccactcgcttctctggctccaagtctggcaacacggcctccngacaatctctggtctccaggctgaggacgaggctgcctatactgctgctcatatgcaggtttcttctgtggttcttcgggcggtaggtccaaagtgaccgtctaggtcagcccaacggtctacgcccctcggtccncgttccg

SEQ ID NO: 276930 - DNA, 591 bp, Homo sapiens
  misc_feature: GYAE6OF01C9451.13.3.A03.1.454.CMB.1.raw
  modified_base (228)..(228): a, c, t, g, unknown or other
  misc_feature (228)..(228): n is a, c, g, or t
  modified_base (375)..(375): a, c, t, g, unknown or other
  misc_feature (375)..(375): n is a, c, g, or t
tcagtcacgtactacacgaccggtgctcgatttagagagcgtcacagagaggaagggggcaggagtcagacccactcaggacacagcatggacatgagggtccccgctcagctcctggggctcctgctgctctggctcccaggtgccagatgtgccatccagatgacccagtctccatccctccctgtctgcatctgtaggagacagagtcaccatcacttgccgggnaagtcagggcattagaaatgatttaggctggtatcagcagaaaaccgaggaaacgcccctaagctctgatctatggtgcataccagtttaaaagtgggtacccatacaaggttcagcggcaggtgatctggcacgagacttcattcncacccatcagcagcctgcacgcctagaagtattttgacctaaactttattaccttgttactaacgaagtaacttacaactaaatttactacccgttggggtaacccggtttaccgggaacccggtaaacgggggtaccccgtaaaaaggggttaacgggtaaaacgttaaccgtaaaaaccggtaaaccgtttacgggtgggtacccgttaacggg

SEQ ID NO: 276931 - DNA, 557 bp, Homo sapiens
  misc_feature: GYAE6OF01A1WJA.13.3.A03.1.454.CMB.1.raw
  modified_base (213)..(213): a, c, t, g, unknown or other
  misc_feature (213)..(213): n is a, c, g, or t
  modified_base (329)..(329): a, c, t, g, unknown or other
  misc_feature (329)..(329): n is a, c, g, or t
  modified_base (360)..(360): a, c, t, g, unknown or other
  misc_feature (360)..(360): n is a, c, g, or t
tcagtcacgtactacacgaccggtgctcgatttagagagcgtcacagggggggtcacaagaggcagcgctctcgggacgtctccaccatggcctgggctctgctcctcctcagcctcctcactcagggcacaggatcctgggctcagtctgccctgactcagcctcgctcagtgtccgggtctcctggacagtcagtcaccatctcctgcacnggttaaccagcagtgatgttgggacttatgaccttgtctcctggtaccgacaacacccaggcaaacgcccccaaactcattattacgggtcaataagcggccctcgagggctttcngatcgcttctctggctccaagtctggcaacncggcctcctgacatctctcgactccgaggccgaggacgaggtctgtacttttacgtgttgttctatatgacaggaaggtgtagatttagtgttcgtttagggagtcgggaacctagggtccaccggttcctttagggtccacggacccaacggccccaaaccccgcgttcgtaccaccttccgtcgttcccctaccc

SEQ ID NO: 276932 - DNA, 589 bp, Homo sapiens
  misc_feature: GYAE6OF01CW8MU.13.3.A03.1.454.CMB.1.raw
  modified_base (543)..(543): a, c, t, g, unknown or other
  misc_feature (543)..(543): n is a, c, g, or t
tcagtcacgtactacacgaccggtgctcgatttagagagcgtcacaggggggggtcacaagaggcagcgctctcgggacgtctccaccatggcctgggctctgctgctcctcactctcctcactcaggacacagggtcctgggcccagtctgccctgactcagcctgcctcatgtctgggtctcctggacagtcgatcaccatctcctgcactggaaatagcagtgatgttggacttatgaccttgtctcctggtaccgacaacaccaggacaaacgcccccaaatcattattacggggtcaataagcggccctcagggctttctgatcgcttctctgctcaagtctgcacacgcctcctgacatctctcgactccaggccgaggacgaggtctgtatttttactgttgttcatatgacgagggtaaggtagtagtatttagtgttcgtttagggaaggtcgggaacctaaagggttcctaacccggtttccgtttacggggtaccacggtacccccgaaaggacccccctaaaaccccccgngttaccggtaccctaacttcccgtccgtttcccccctaaccccccg

SEQ ID NO: 276933 - DNA, 646 bp, Homo sapiens
  misc_feature: GYAE6OF01D5H8C.13.3.A03.1.454.CMB.1.raw
tcagtcacgtactacacgaccggtgctcgatttagagagcgtcacagagaggaagggggcaggagtcagacccactcaggacacagcatggacatgagggtccccgctcagctcctggggctcctgctgctctggctcccaggtgccagatgtgccatccagatgacccagtctccatcctccctgtctgcatctgtaggagacagagtcaccatcacttgccgggcaagtcaggcattagaaatgtatttaggctggtatcagcaagaaaccgagggtaaagcccctaagctcttgatctatggtgctaatacctaaaggtttaaaaaggtcggggtacccaagtcgaaaggtttcaaggccggcaggtaggatcgtcggacaactagtacctttctaactttcctacaaccctagtccaagtccacggcccttggaccagcctaggaaagttcttttagaacttaaacttttattaacccttgtaccttaacgaaagtaactacctaaactaaactttagtaccccggttaggggttaacccggtttccgggaaccgtaaacgggggtaaacccgtaaaaggggttacggaaaaaacctttaccggaaaaaccggtaacgtttagggtaccgggtctaaccggg

SEQ ID NO: 276934 - DNA, 599 bp, Homo sapiens
  misc_feature: GYAE6OF01BXBD8.13.3.A03.1.454.CMB.1.raw
  modified_base (221)..(221): a, c, t, g, unknown or other
  misc_feature (221)..(221): n is a, c, g, or t
tcagtcacgtactacacgaccggtgctcgatttagagagcgtcacaggggggggtcacaagaggcagcgctctcgggacgtctccaccatggcctgggctctgctgctcctcactctcctcactcaggacacagggtcctgggcccagtctgccctgactcagcctgcctccatgtctgggtctcctggacagtcgatcaccatctcctgcactggaaacngcagtgatcgttgggacttatagacttgtctcctgtaccaacaccaccaggcaacggccccagacgtcatctatttagtgggggacaagtacgggcggccgtcgagggtactttccgactcgtcttctcgtcggcctaccgaagtctcggaccaaccgaccggccctcccgtagacctaactcctcgtcggtcctccgaggtctggacggacgaggctcgtccttattacgtgtctgcctcgatagtgcgtacggttcttcgtggttcggttccgttcgggacggtacgggttaccgtaaaggtccgtacccgttccgttacgggtccgtaccggacccgtaacggtccctcccggtcccccgttcggtccctacccg

SEQ ID NO: 276935 - DNA, 652 bp, Homo sapiens
  misc_feature: GYAE6OF01EI7GA.13.3.A03.1.454.CMB.1.raw
  modified_base (312)..(312): a, c, t, g, unknown or other
  misc_feature (312)..(312): n is a, c, g, or t
  modified_base (323)..(323): a, c, t, g, unknown or other
  misc_feature (323)..(323): n is a, c, g, or t
tcagtcacgtactacacgaccggtgctcgatttagagagcgtcacaggggggggtcacaagaggcagcgctctcgggacgtctccaccatggcctgggctctgctgctcctcactctcctcactcaggacacagggtcctgggcccagtctgccctgactcagcctgcctcatgtctgggtctcctggacagtcgatcaccatctcctgcactggaaatgcagtgattggttggacttatgaccttgtctcctggtaccgacaacaccaggcaaacgcccccaaatcattattacggggcaatacgcgcctnagggtctttcngatcgcttctctggctaccaagtctggacaacgacggcctcccgtgaaccaacttctcgtcggaccttccgaacggtccgaagggacgaaggtcttggttaactttttaccgtggtttcgttctaagttatggacgaagggtaaacggtggttagtaattttagtaggtttaccgttttaagggacggttacggggaacccgtaagggttccgtaacccggtttccgtttagggtaccctaacggaccccgtaaacgggaccccctaaacccccgtaacggttcgttaaccctacccgtttcccgttccggttcccccgttaccccccg

SEQ ID NO: 276936 - DNA, 571 bp, Homo sapiens
  misc_feature: GYAE6OF01CP93N.13.3.A03.1.454.CMB.1.raw
  modified_base (329)..(329): a, c, t, g, unknown or other
  misc_feature (329)..(329): n is a, c, g, or t
  modified_base (341)..(341): a, c, t, g, unknown or other
  misc_feature (341)..(341): n is a, c, g, or t
  modified_base (365)..(365): a, c, t, g, unknown or other
  misc_feature (365)..(365): n is a, c, g, or t
  modified_base (396)..(396): a, c, t, g, unknown or other
  misc_feature (396)..(396): n is a, c, g, or t
  modified_base (439)..(439): a, c, t, g, unknown or other
  misc_feature (439)..(439): n is a, c, g, or t
  modified_base (539)..(539): a, c, t, g, unknown or other
  misc_feature (539)..(539): n is a, c, g, or t
tcagtcacgtactacacgaccggtgctcgatttagagagcgtcacgagggggggtcacaagaggcagcgctctcgggacgtctccaccatggcctgggctctgctgctcctcactctcctcactcaggacacagggtcctgggcccagtctgccctgactcagcctgcctcatgtctgggtctcctggacagtcgatccaccatctcctgcactggaaatagcagtgatggttgggacttatggaccttgtctccgtaggtaccgacaaccacccaggacaaacgcccccaaaactcaattagtttacggggacaaatagccggccctnacgggtctttcngatcgcttctctgctccaagttcnggaccaacacggccctccctgactaatctcncggactccgaggccgaaggacacggtcttagttatttttacgngtttagtctatatgacaagggtaaggataggtatttagcgtttgttaggaaggtcggaactaggctccgttctggtactcgacccaaggccccaaacccnttacgtaccacgttcctcggttccccgtaccc

SEQ ID NO: 276937 - DNA, 535 bp, Homo sapiens
  misc_feature: GYAE6OF01C5N47.13.3.A03.1.454.CMB.1.raw
  modified_base (322)..(322): a, c, t, g, unknown or other
  misc_feature (322)..(322): n is a, c, g, or t
  modified_base (360)..(360): a, c, t, g, unknown or other
  misc_feature (360)..(360): n is a, c, g, or t
tcagtcacgtactacacgaccggtgctcgatttagagagcgtcacaggggggggtcacaagaggcagcgctctcgggacgtctccaccatggcctgggctctgctgctcctcactctcctcactcaggacacagggtcctgggcccagtctgccctgactcagcctgcctccatgtctgggtctcctggacagtcgatcaccatctcctgcactggaaatgcagtgatgttggacttatgaccttgtctcctggtaccgacaacaccaggcaaagcccccaaatcattattacggggtcaataagcggccctcagggtcttntgatcgcttctctgctcaagtctggcaacacgcctccngacaatctctggactccaggccgagacgagctgtattttactgttgttcattatgacaggaagagtgtatttagtgtcgtttggtaagtgggaacctaaggtccaccgtcgttaggtccagtacccaagaccctaaaccccacgttcgactacctcttccgttccccgtaccccg

SEQ ID NO: 276938 - DNA, 639 bp, Homo sapiens
  misc_feature: GYAE6OF01BMTHD.13.3.A03.1.454.CMB.1.raw
  modified_base (225)..(225): a, c, t, g, unknown or other
  misc_feature (225)..(225): n is a, c, g, or t
tcagtcacgtactacacgaccggtgctcgatttagagagcgtcacaggggggggtcacaagaggcagcgctctcgggacgtctccaccatggcctgggctctgctgctcctcactctcctcactcaggacacagggtcctgggcccagtctgccctgactcagcctgcctcatgtctgggtctcctggacagtcgatcaccatctcctgcactggaaatgcagtnatgttggacttatgacttgtctccgtggtaccgacaacaccaggacaaacgcccccaatctattagttacgggtacaagtacgccggacctcgacggtctttctgactcgtcttctctgctcagtctggacaacgcgcctcctgacatctctcgactccgaggccgaaggacgtaggcttagttactttttacgtggtttcgttactattacgtgacggtaagggtaacggtagttagtaagtttacgttaggtttaccgtttagggaacggttacgggaaccgttaacgggttacccgtacccggtttaccgtttagggtaccctaaccgggaccccgtaacgggtaccccctaaaccccgtaccgttaccggttaccctacccgttccgttcccggttccccccgtaccccg

SEQ ID NO: 276939 - DNA, 731 bp, Homo sapiens
  misc_feature: GYAE6OF01COLWU.13.3.A03.1.454.CMB.1.raw
  modified_base (249)..(249): a, c, t, g, unknown or other
  misc_feature (249)..(249): n is a, c, g, or t
tcagtcacgtactacacgaccggtgctcgatttagagagcgtcacagagaggaagggggcaggagtcagacccactcaggacacagcatggacatggacgggtccccgctcagctccgtggggctcctgctgctctggcctcccgaggtcgccagatgtgccatccagatcgacccagtcctccactccctccctgtctgcatcgtgtaggagacagacgtcaacctatcctacgttcggacccggganaacgtcgaggactaagttaagaatgtagttaggctggtatacgagacgaacggaaaccgaacggaaccgtccctaagtctacttagattacgtagtggtacactacgttaaccgtaaaggtttaaaacggtcggtaccaagttacgtaacggtacgacggcggtacgtaggtacggacgtacggtacggaccaacgttacgtaccctttactacttccctaaccgtacctaacgtaccgaacggaccaccgtaccgtacgaccgtacgtaccgttaaggtaacgtttacttttaccgaacgtttaaacctttaacgttacgttaacctaccgttaaactaagtaccttacctaaacttaaccgtttaccggttaccgggttaccgggtaaccggttccgggaaacccgtaaacggggtaaccgtaaaggggtaaacgaaaccgtaaaccgtaaacggtactacgggttccgcggttaacccg

SEQ ID NO: 276940 - DNA, 702 bp, Homo sapiens
  misc_feature: GYAE6OF01EUWCU.13.3.A03.1.454.CMB.1.raw
  modified_base (207)..(207): a, c, t, g, unknown or other
  misc_feature (207)..(207): n is a, c, g, or t
tcagtcacgtactacacgaccggtgctcgatttagagagcgtcacagagaggaagggggcaggagtcagacccactcaggacacagcatggacatgagggtccccgctcagctcctggggctcctgctgctctggcctcccaggtgccagatgtgccatccagtatcgacccagtctccactcctccctgtctgcattctgtagganacagacgtcaccatccacgttggcccgggataagtcgaggctaattaagaaatgtaactttagggcttaggtactacgagacaacgaaaaccgaagggtaaaacctccccgtaaagtccttacgttagtacttacttagttacggtgtactagtaccgtaaaggtttaaacggtcgggtaccctaagttaccgtaagggttccaagggtccggtacgagggtacggtataccgtcggtaccacgttacgtaacttcgtaactttccactaccatacagactacgtcctcgactacgtctaacggtaagtttactttacggaacctttaattactttacccgtagttaccttaaacgagttaacctaacgtaaacttaacgttaccgtaccgggtaaccgggttaccggtacccgggtaacggtaaacggaaacccggttaagggtaagggtaaactaacccgggtaaactacggtttacggtccggaccgttacg

SEQ ID NO: 276941 - DNA, 668 bp, Homo sapiens
  misc_feature: GYAE6OF01DEYI2.13.3.A03.1.454.CMB.1.raw
  modified_base (228)..(228): a, c, t, g, unknown or other
  misc_feature (228)..(228): n is a, c, g, or t
tcagtcacgtactacacgaccggtgctcgatttagagagcgtcacgagggggggtcacaagaggcagcgctctcgggacgtctccaccatggcctgggctctgctgctcctcactctcctcactcaggacacagggtcctgggcccagtctgccctgactcagcctgcctcgtgtctgggtcctccgtggaccagtcgatccaccatcctcctgacacgtaggaaacngcagtgatcgtgggacttagagtcttgtacctcgtacggtaacccaactacccaccaggaccgaacggcccccagtacgtactactaccgtagtttacggtcggggactaaacggtacgggccgtccgtacgtacgggtacctttaccgaccgttcgtccttcgtcgtacggtcctaaccgtaacggtccgttacgggacctaacgacccggtccctacgtacgactactctcgtcgtactcccgagctaggacgacgacggcacggtacctattaccgcgtctcggtaccttagacgtacgtcgtacgttgtttccgtcgttggttcggtcgttacgggtacgggttacgaaccgttaaggtacccggtacccgtacggttacgtacgaaccgtacccgtaacgtccgtccccgtcccgttacccgcgtccgttccccg

SEQ ID NO: 276942 - DNA, 762 bp, Homo sapiens
  misc_feature: GYAE6OF01EAUW9.13.3.A03.1.454.CMB.1.raw
tcagtcacgtactacacgaccggtgctcgatttagagagcgtcacagagaggaagggggcaggagtcagacccactcaggacacagcatggacatgagggtccccgctcagctccgtggggctcctgctgctctggcctcccaggtgccagatgtgccatccagatgacccagtctccactcctccctgtctgcactctggtaggagacagacgtcactatcgacttggaccgggacaagtcgaagggactaattaagaatgtagtttaggcttaggtactacgagaccgaaggaaaccgaagggaaacgacccgtaagtccgttacttgtactcgtaagtggtgacctaacgttaccgtaaacggtttaaaacgggtcgggttaccctaacgtaccgtaaacgggttcgaacgggtaccggtagtacggtacgggtaacgtcggtacggtaccgtaacgtacgtaacctttactacgttaccttaccctaacccgtaacttaccgaacggacctaccggtaccgtcggtacccgtaacgtacccgttaaggtaacgtttacgtttacgttaaccgttaaacttttacgtttaacctcggtttaaccttaaactaaacgtacttaccgtaaacttaaacgtttaccgtacccgggttaacgggtacccgggtttaacggaaccccgggaaacggtaaaccggtaaacggggtaacgtaaaacgtaaccgaaaaacggttacgtcgggttaccgcgttaaccg

SEQ ID NO: 276943 - DNA, 741 bp, Homo sapiens
  misc_feature: GYAE6OF01B1T5W.13.3.A03.1.454.CMB.1.raw
tcagtcacgtactacacgaccggtgctcgatttagagagcgtcacgaggggggggtcacaagaggcagcgctctcgggacgtctccaccatggcctgggctctgctgctcctcactctcctcactcaggacacagggtcctgggcccagtctgccctgactcacgcctcgcctccattgtccgtgggtctccgtggacagtcgatccaccatcctcctgcactaggaaaatgcagtgagttggttggtacttagtcgtaccttcgtccttccgtcggtaacccacaaccacccgaaggaccaaaccgacccccaaactcgtaactttacgttacggggtactaaacgtacggccggtaccctacgtacgggtctttcgtacgtacgtccgtccttctcgtcggtcctaccgtaacgtcgtacggaccaacgtcccgggtaccccttccgtacgtaacctacttccgtaccgtacgaccgtacccggacggggtaccggacggacgggacggtacctttagtttacgtttttacgttgtttcgttactacttacggtcggtaacggagggtaaggtagttaggttaatttagttgggtttacggtttaagggaacgggttaccgggtaaccgtaccggttaccgtaccggttccggtttaccggtccgtacccggaacccgtaccggacccctaacccgtacgtcgttaccctaccttccgttcccgttaccccgtaccccg

SEQ ID NO: 276944 - DNA, 766 bp, Homo sapiens
  misc_feature: GYAE6OF01EFDNU.13.3.A03.1.454.CMB.1.raw
tcagtcacgtactacacgaccggtgctcgatttagagagcgtcacgaggggggggtcacaagaggcagcgctctcgggacgtctccaccatggcctgggctctgctgctcctcactctcctcactcaggacacagggtcctgggcccagtctgccctgactcagcctgcctccatgtctgggtctccgtgacagtcgatccaccatctcctgcacgtggaaaatgcagtgatggttggacttatgtaccttgtccttccgtacggtaccgaacaaccaacccgacggaccaaaccgaccccctaaactactaacgtttacgtttaacggggtactaagtaacgccggtcccgtacgtacgggttctttacgtacgtactcgtccttccgtcgtacggtcctaccgtaacgttcgtacggacctaaccgacccggtccctacccgtacaaccgtaactccgttcgtacggtaccctaccggaacgggtaccggaacggacggtacggtactttacggtttaacgtttttacgttacggtttactttacgtaactttacgtacggtaacggtaagggtaacggttaggttaacgtttaacgtttagttacggtttacggtttaagggtaacgggttacgggaaccgtaacgggttcccgttaacccgttggtttacggtaccgtaaccggacccggaaaccgtaaccccgtaaaccccgtcgtaaccggttacctacccgtttccgttcccgtaccccgttaccccgg

SEQ ID NO: 276945 - DNA, 781 bp, Homo sapiens
  misc_feature: GYAE6OF01DOJOF.13.3.A03.1.454.CMB.1.raw
tcagtcacgtactacacgaccggtgctcgatttagagagcgtcactttagagaggaagggggcaggagtcagacccactcaggacacagcatggacatgagggtccccgctcagctccgtggggctcctgctgctcgtggctcccgaggtgccagatgtgccatccagactcgacccagtcctccatccctccctgtctgcatcgtgtaggagacagagtcaaccactctacgttcggaccgggacaacggtacggaggggtacctaagttaaggaaattaggtaaggttttacgggacgttagggttaactacgaacggaccgaaacggaaaaccggaaacggggaaaaccgtacccccgtaaaggtccgttaccgttagtacttacgttagtcgggtacgacctaacgttaaccgttaaaaggtttaaaacgggttcccgggtaacctaagttaaccggtaacggtacgtaggccggtacgtaaggtggtacgtcggtacgacgtaaccgagttaccttaacttcttaccgtacaacctacgtccaaggctaccgtccgtggacctaggtaccgttaagtaacggtttctttacgaaaccgtttaaacttttagtaccgttagttaacctaaacgaacgtacttaccgttaaacgttaaacctttccggtaccgggtttaacggggcccggttaacggaaccggggaaacggttaaacccgtaggtaaaacgtaaaaccgtaacggtaaaaccgttcgggacggttaagcggtaacccg

SEQ ID NO: 276946 - DNA, 654 bp, Homo sapiens
  misc_feature: GYAE6OF01BZ1O7.13.3.A03.1.454.CMB.1.raw
  modified_base (151)..(151): a, c, t, g, unknown or other
  misc_feature (151)..(151): n is a, c, g, or t
  modified_base (155)..(155): a, c, t, g, unknown or other
  misc_feature (155)..(155): n is a, c, g, or t
  modified_base (159)..(159): a, c, t, g, unknown or other
  misc_feature (159)..(159): n is a, c, g, or t
  modified_base (212)..(212): a, c, t, g, unknown or other
  misc_feature (212)..(212): n is a, c, g, or t
  modified_base (246)..(246): a, c, t, g, unknown or other
  misc_feature (246)..(246): n is a, c, g, or t
  modified_base (533)..(533): a, c, t, g, unknown or other
  misc_feature (533)..(533): n is a, c, g, or t
tcagtcacgtactacacgaccggtgctcgatttagagagcgtcacagagaggaagggggcaggagtcagacccactcaggacacagcatggacatggacgggtcccccgctcagcctccgtggggcctcctgctgctctggctcccaggtncagntgtnccatccagatcgacccagtcctccactccctcctgtctgctatcgtgtagganacgagacgtcacctatctacgttcggacccgganaacggtcgaggtactaagttaagaattggtaagttacggcttaggtactacgacggacgtaaacggaaaccggaagggaacccgtcccgtaagtcttacgtagtacttcgtagtcggactaccgtaacgtaacggttaaacggtttaaacgggcggtaaccctagtaaccggtaaggtacgacggaccggtaacgtacggtacggtacgtcggtacggactacgtacgttactcgtaactccgacacactacgacgctacgctacgacgtacgtacgtagtactttntaccgtaacttacgttacttcgagtaaccagtaactgtacctagtacgttacgtaccggtaggtaccgtacggaaccgaacggacggtaaagtacaacgtaacctaggatcgtagcgtacg

SEQ ID NO: 276947 - DNA, 664 bp, Homo sapiens
  misc_feature: GYAE6OF01E0XEQ.13.3.A03.1.454.CMB.1.raw
tcagtcacgtactacacgaccggtgctcgatttagagagcgtcacgaggggggggtcacaagaggcagcgctctcgggacgtctccaccatggcctgggctctgctgctcctcactctcctcactcaggacacagggtcctgggcccagtctgccctgactcagcctgcctccatgtctgggtctccgtggacagtcgatcaccatctctgcacgtaggaaatgcaggtgtagttcggttagggtacttagtacgtacctttcgtccttccgtacggttacccgaacaaccgacccaaggaccaaaccgaccccctaaactcctaacgtttacgtttaccggggtactaagtaacgccggtccctacggcgttcgttgagtactcgtcttcgtcgtcgtacctacgtacgtcgtcgacgaaccgccgtaccctccgtacgactactcgtacgtcgacctacggaccggcgacggacgtacgtcgttagtttacgtttacttgttatactagtcgtgacgaggtagtgtagtagtttagtcgtttacggtaggtacggtacgtacggtacgtaccgttacggtcgttacggtaccgtaaccggaccgtaccgaacccgtacccgtacgtccttaccgtaccttccgttcccgtccccgttacccg

SEQ ID NO: 276948 - DNA, 868 bp, Homo sapiens
  misc_feature: GYAE6OF01D42MH.13.3.A03.1.454.CMB.1.raw
tcagtcacgtactacacgaccggtgctcgatttagagagcgtcacagagaggaagggggcaggagtcagacccactcaggacacagcatggacatgagggtccccgctcagctcctggggctcctgctgctctggctcccaggtgccagatgtgccatccagatcgacccagtctccatccctcctgtctgactactcgtggtaggagtacaagtacgtaccaacctactcctaacggttcgggacccgggtactaaaggttccgaaggggtaccttaaagttaaaggtaaaaatttaagtttacgggtacgttacgggttaactacgaacggaaccgaaaccggaaaacccggaaacgggggtaaaacccgtacccccgttaaagtcctttacggttagacgtttacgtaaggttagggtactaccgtaacgttaaacccggttaaaaggtttaaaaaccgggtccggggttaaccctaacgttaacggttaaacgggttcgaacggtaccggtacgtaaggttcggtaacgtcgtacggaacctacgtaacgttcctttacgactttcccgactacctaacgtcgacgtctaaccgtcgtacgactaccggtaccgtaagttaacgtttacgtttactaacgtttaaccgttttaagtttaccggttaacgttaaccgttaaaccgtaacgttaaccttaaccgtaaacgtttaacgtttaccggtacccgggtttacgggttaccccgggttaacgggtaaaccgggtaaaaccgggaacgggttaaacggggtaaaccgtaaaaccgttaaacccggtaaacggttaacgtaccgggttaaccggtccgtacggttaaaccccg

SEQ ID NO: 276949 - DNA, 785 bp, Homo sapiens
  misc_feature: GYAE6OF01CPSB1.13.3.A03.1.454.CMB.1.raw
  modified_base (776)..(776): a, c, t, g, unknown or other
  misc_feature (776)..(776): n is a, c, g, or t
tcagtcacgtactacacgaccggtgctcgatttagagagcgtcacagagaggaagggggcaggagtcacgacccactcaggacacagcatggacatggacgggtccccgctcagcctccgtggggctcctgctgctcgtggcctcccgaggtcgccagattggtcgcctactccgaagactcgaccctacgtcctccctacttccccgttccctgtctcgactacgtcgtaggtaagggacaacgtagtaccgtaccacctactcgtaaccgttccgggacccggacgtaacggtagacgggtactaagttaaagtaaagttggttaagtttacggcgttaggtaactaccgacgaccgaaaacggaaaaccggaacggtaaacccgtacccgtaagtccctttgttaacgtacgtttaccgttaggtacggtactaaccgtaacgttaaaccgtttaaaaagggtttaaaccggggttccggtaaaccctaggttaaccggtaacggttcgaacggccgggtacgtaggtacggtacgtcgtaggtaccaagttacgtacttacttaccgttacctacctaccgatcacgcaccgtcgagaccgtacgtcgtacgttaatttacttacctaattaactttaccgttatacgttaccaataacgtactacgttaacttacgttcggttaccgggtaaccggttaccggtcggaaacggacggttaaacgggtaaggtaaacgtaaacgtaaccgtaaacggtacggttacggtacncgttaaccg

SEQ ID NO: 276950 - DNA, 909 bp, Homo sapiens
  misc_feature: GYAE6OF01BBFI4.13.3.A03.1.454.CMB.1.raw
  modified_base (163)..(163): a, c, t, g, unknown or other
  misc_feature (163)..(163): n is a, c, g, or t
  modified_base (171)..(171): a, c, t, g, unknown or other
  misc_feature (171)..(171): n is a, c, g, or t
tcagtcacgtactacacgaccggtgctcgatttagagagcgtcacagagaggaagggggcaggagtcagacccactcaggacacagcatggacatggacgggtcccccgctcagccttccgtggggcctcctgcctgctcgtcggcctcccgaggtcgccagngtcggtcncctactccgagactaccaacccgtcgtcctcctaccttcccgtcccttggtctcgactacgttacggttaggaacgggaacgtaacgaacgtaccggttaccaacctaccgtaccgttacggttaccgggcccggtaaaccggtaggttaccggaaggggtaaccttaaaggttaaaacgttaagttagttaacggtttacgtaccggtaggttaacaccgaacggaaaaccgtaaccgggaaccgggaaaaccgtaaccccggtaaccctggttccctttacggtactcggttacgtaggcggtaactacgtaaccggtttaaacgttaaaacgggttaacggtcccgtaactaacggttacggtaacgtaaccggtcggacggggtttaacttcgggtaccggagttaccggtacaaccttaccgggtatttaacccgttattacctttaccgaccgtactaactaccgcgtaccgaccggtacgtcgtaacgtacgtaccggtttaacgtaacgtttaaccgtaactttaacgtttaacccgtttagtttaacccgttaaccgttaccgtaaacttaacgttaaaccctaacgtttaaacccgtacgttaccggttaaccgggttacccggttaccggggtaaaccgttacccggggtaaaccggtaaacggtaacggtaaaacgtaaccgttaaaccggtacgttaagggttaccggaccttacgggtaacccg

SEQ ID NO: 276951 - DNA, 682 bp, Homo sapiens
  misc_feature: GYAE6OF01A13PB.13.3.A03.1.454.CMB.1.raw
tcagtcacgtactacacgaccggtgctcgatttagagagcgtcacagagaggaagggggcaggagtcagacccactcaggacacagcatggacatgagggtccccgctcagctcctggggcctcctgctgctctggctcccgaggtcgccagatgtgccatccagatcgaccccagtcctccactccctccctgtctgcctatcgtggtaaggagacgagataccaaccatcctacgttcggccgggacaacggtcgagggtactaagttaagaatggtagtttacggcgttagtactcgaagtacaaacggaaaccggaaggaaccgtacccggtaagtctacttacgtatacgtagtcggtactacgtaacttaacggttaaaggtttaaaccgggtcggtacctagtacgtaaggtcgaacggtccgagtacggtaggtagtcgtcgggactacgtacgttccttactacttacccgtaacctacctacgtcgacgtaccgtaccgtccgagtcctacgtaccgtagttaacgttactttaagtacttaactttagtacgttcttaactaactaacgacttaacaacttataccggttcggtaacggttacccggtacggaacccgaacggtacggaaggtaacgtaaacaaccggaagttacgaggccgtacgtaccg

SEQ ID NO: 276952 - DNA, 780 bp, Homo sapiens
  misc_feature: GYAE6OF01EGGDH.13.3.A03.1.454.CMB.1.raw
  modified_base (193)..(193): a, c, t, g, unknown or other
  misc_feature (193)..(193): n is a, c, g, or t
  modified_base (582)..(582): a, c, t, g, unknown or other
  misc_feature (582)..(582): n is a, c, g, or t
tcagtcacgtactacacgaccggtgctcgattttagagagcgtcacgaggggggggtcacaagaggcagcgctctcgggacgtctccaccatggcctgggctctgctgctcctcactctcctcactcaggacacgagggtcctgggcccagtctgccctgactcagcctgcctcatgtctggtctcgtggacngtcgatcacctatcctcctgccacgtaggaaaatcgactaggtgtagttgggtttacgggaactttacgttcgtaccgtttcgtccgttcccgtacggtaacccgaacctaaccgaacccgaaggaacccaaaacccgacccccctaaaacgttcgttaacgtttaacggtttaaccggggtaacctaaacggtaacggcccggtaccctacggtacgggttacctttcgtacgttacgtccgttccttcgtcgttacggacctacgtacgttcgacggtaccaacccggtaccgtccctaccgtacgaacttacgtccgtacgtaccgtaccgtccgacgggtacggacgaacggtacgtacgttagtttacgtttttctacggtttntacgtagtagtcggagtaagggtagtcgtagttacgttagttacgttacgggttggtaacggtaccgggtaacgttaccggtaccttacccggtttcgtacgggtaccgaacccggttaacccggaacccgtaacccctaacccggttaccgttcctacccgttaccgtttccccggttcccgttaccccgtaccccg

SEQ ID NO: 276953 - DNA, 818 bp, Homo sapiens
  misc_feature: GYAE6OF01AEU2V.13.3.A03.1.454.CMB.1.raw
  modified_base (140)..(140): a, c, t, g, unknown or other
  misc_feature (140)..(140): n is a, c, g, or t
  modified_base (178)..(178): a, c, t, g, unknown or other
  misc_feature (178)..(178): n is a, c, g, or t
  modified_base (187)..(187): a, c, t, g, unknown or other
  misc_feature (187)..(187): n is a, c, g, or t
  modified_base (235)..(235): a, c, t, g, unknown or other
  misc_feature (235)..(235): n is a, c, g, or t
  modified_base (258)..(258): a, c, t, g, unknown or other
  misc_feature (258)..(258): n is a, c, g, or t
  modified_base (271)..(271): a, c, t, g, unknown or other
  misc_feature (271)..(271): n is a, c, g, or t
  modified_base (320)..(320): a, c, t, g, unknown or other
  misc_feature (320)..(320): n is a, c, g, or t
tcagtcacgtactacacgaccggtgctcgatttagagagcgtcacagagaggaagggggcaggagtcagacccactcaggacacagcatggacatgacgggtccccgctcacgcttccgtggggctcccgtgctgctcgnggcctcccgaggtcgccaggtctggtcccagtccagtntccgaaccncgtctaccacttccctcccgtgtcctgactcttgtaggtagacgaacngtagaccacctctacccgttcgnggccccgggtaanaacgtcgggaggtacctaaaggttagaaacgttgtaggttttaccgggnttacgtcgaacgagaacgaaacggaaaaccgggacgggaaacccgttacccgtaaccgtggttactaccggtaacttccgggttaattccgggactaccttaaacgttaacgtttaaaacggggttaaaaccggttccggaaccccttaggtacgaaccgggtttaacgacggtccgtaggtaacgttgggtaacttacggtccccaaggggtaacctttaccgggtacctttaaccgtctttaccgtacctaacccgggtacttaccggaactcgtaccgtccgttacgacctacgggtactagtttaacggtacttaacggttaccttaacgtttcggttactacttacgtaactaggtaacttacgaaagtttaccgtaccgttaacggttacggttaccggtaacccggtcgggtaaaaccggttacgggaacgggtttaaaacggaacgttaaaccccgacggtttacggacggtaaacgtccgggtaacccg

SEQ ID NO: 276954 - DNA, 738 bp, Homo sapiens
  misc_feature: GYAE6OF01AZUB1.13.3.A03.1.454.CMB.1.raw
  modified_base (172)..(172): a, c, t, g, unknown or other
  misc_feature (172)..(172): n is a, c, g, or t
  modified_base (218)..(218): a, c, t, g, unknown or other
  misc_feature (218)..(218): n is a, c, g, or t
  modified_base (614)..(614): a, c, t, g, unknown or other
  misc_feature (614)..(614): n is a, c, g, or t
tcagtcacgtactacacgaccggtgctcgatttagagagcgtcacagagaggaagggggcgaggagtcagacccactcaggacacagcatggacatggacgggtccccgctcgacgctccgtggggctcctgctcgctctcggcctcccgaggtcgcccaaggtgtcggtcncctactccagactccgaccctgtcctacctctcccgtcctgtctcnctagttcgaggtggacacgtacgactaccactcgtaccgacgttcggaccgggactaaggcgtaggactaagttaagaagttacgtagttttacggcgttacggttacgaacgacggactaaccgggaaacggaaccgggtaaccacccgtagtcctacgtagtctacgtagtacgtacgtacgttaacttaccggtaaaaggttaccggggtaacggtaccccgttaagtaacgggttaccgtaacggtcggcccgggtaaggtcgtagggtaccgttcggacgtacgaaccgtcgttaactacctacgttacaccgtactactaggacctcgtccacggtctaacgccgtagttacgtagttctacgtaatacgtttacctagtcctaaacgtntaaccgtataacccttagaactttaccggaccgggttacgtttaacccggccggggtaaacgaccgggttaacgtaaaggtaaccgtaaacgttaaacaggttccggaacggtcggtcccgaac

SEQ ID NO: 276955 - DNA, 731 bp, Homo sapiens
  misc_feature: GYAE6OF01C9GEW.13.3.A03.1.454.CMB.1.raw
  modified_base (332)..(332): a, c, t, g, unknown or other
  misc_feature (332)..(332): n is a, c, g, or t
  modified_base (357)..(357): a, c, t, g, unknown or other
  misc_feature (357)..(357): n is a, c, g, or t
tcagtcacgtactacacgaccggtgctcgatttagagagcgtcacagggggggtcacaagaggcagcgctctcgggacgtctccaccatggcctgggctctgctgctcctcactctcctcactcaggacacagggtcctgggcccagtctgccctgactcagcctgcctccatgtctgggtctccgtggacagtcgactcaccatctcctgcacgtggaaatagcagtgatggttggacttatgtaccttgtcctctggtaccgacaaccaccagacaaacgcccccaaatcattagttacgggtacataagccggcctcgacggtctttcngactcgtcttctcgtgctacagtcnggacaacgaccggcccttcctaggacctaatccttcgtacggtacctccggacggaccggaagggaccgtaggtcgttaaggttacttttttaacgtcgtttacggtttaccaagtttacgttacggaccggtaaaggggttaacgggtaaggtttaccggttaaagttttaacgttcgggttttaccggttttaaggggtaacgggtttaccgggggtaaacccgttaaaccgggttaccccgtaaccccgggttttccgttacgggtttaccccgaaccggttaccccccggaaaacgggttcccccctaaacccccgtacgttccgttacccgtacccgttaccgttccccggttccccccggttaccccc

SEQ ID NO: 276956 - DNA, 925 bp, Homo sapiens
  misc_feature: GYAE6OF01E5ARR.13.3.A03.1.454.CMB.1.raw
  modified_base (486)..(486): a, c, t, g, unknown or other
  misc_feature (486)..(486): n is a, c, g, or t
tcagtcacgtactacacgaccggtgctcgatttagagagcgtcacgaggggggggtcacaagaggcagcgctctcgggacgtctccacatggcctgggctctgctgctcctcactctcctcactcaggacacgagggtcctgggcccagtctgccctgactcacgcctcgccctccatcggtcgtcgggtctccgtaggacgtacggttcgactccaacctacttcctccgtgacctaacgtaagggaaaactcggctaaggtgtaggtttacgggtttacgggtaacttttaggtccgttacccgtttacggtcccttacccgggtacggtaaacccaaccaaccgaccccgtaaggaaccaaaccccgtaccccctaaagttacttaacggtttaacggtttaaccggggaacctaaaagtacccgggtccgtaccccgtagggttacgttccgtttctacggtacgttccggttacctttccncggttacgacctttaccgtaaggtttcccgaacgtacccgtaaccgtcccgggttaccccctaacgtacggtaacctaccttccgttaccggtacgacccggtaccgaccggggaccgggtaacgggtaaccggtcggttacttaggttttttaaccgttttacgggttcggtttaactttaccgtaggttacgtccgggaacgggtaaagggtcggtaagtttacgggttaactttccgggtttaaggtttaccggggtttaagggtaaccggggttaccggggtaacccgtacccggggtttaaaccttcccggttaccgggttacgggtaccccgtaccccgaaacccgggttacccggaaacccctttaaccccgtacgtttcccggaaccccgttaccgtttccccgttaacccggttacccccccggttcccg

SEQ ID NO: 276957 - DNA, 566 bp, Homo sapiens
  misc_feature: GYAE6OF02HIFB5.13.3.A03.1.454.CMB.1.raw
tcagtcacgtactacacgaccggtgctcgatttagagagcgtcacagggggggtcacaagaggcagcgctctcgggacgtctccaccatggcctgggctctgctgctcctcactctcctcactcaggacacagggtcctgggcccagtctgccctgactcagcctgcctccatgtctgggtctcctggacagtcgatcaccatctcctgcactggaaatagcagtgatgttgggacttatgaccttgtctcctggtaccgacaacacccaggcaaacgcccccaaactcattattacggggtcaataagcggccctcagggctttctgatcgcttctctggctcaagtctggcaacacgcctcctgacaatctctggactccgaggccgaggacgaggctgtatttttactgttgttcattatgcagggaaggtagtgtatttagtgttcgtttgggaaggtcgggaacctaagggtcctaccgttccgtttggctacggtacccaacgggaccccaaaccccgtcttacggtcctaaccgttcttaccggttccccctaaccccg

SEQ ID NO: 276958 - DNA, 511 bp, Homo sapiens
  misc_feature: GYAE6OF02FVPDJ.13.3.A03.1.454.CMB.1.raw
  modified_base (418)..(418): a, c, t, g, unknown or other
  misc_feature (418)..(418): n is a, c, g, or t
  modified_base (429)..(429): a, c, t, g, unknown or other
  misc_feature (429)..(429): n is a, c, g, or t
  modified_base (488)..(488): a, c, t, g, unknown or other
  misc_feature (488)..(488): n is a, c, g, or t
tcagtcacgtactacacgaccggtgctcgatttagagagcgtcacagggggggtcacaagaggcagcgctctcgggacgtctccaccatggcctgggctctgctgctcctcactctcctcactcaggacacagggtcctgggcccagtctgccctgactcagcctgcctccatgtctgggtctcctggacagtcgatcaccatctcctgcactggaaatagcagtgatgttgggacttatgaccttgtctcctggtaccgacaacacccaggcaaagcccccaaatcattattacggggtcaataagcggccctcagggctttctgatcgcttctctggctcaagtctggcaacacggcctcctgacaatctctggactccaggccgaggacgaggctgtattttactgttgttcatntgcaggaaggngtgattagtgtcgtttaggaagtggacaaggtcacgtctggtcagccaaggccaacccntcgtaccactctcgtcccgtccc

SEQ ID NO: 276959 - DNA, 516 bp, Homo sapiens
  misc_feature: GYAE6OF02G91VP.13.3.A03.1.454.CMB.1.raw
  modified_base (221)..(221): a, c, t, g, unknown or other
  misc_feature (221)..(221): n is a, c, g, or t
  modified_base (410)..(410): a, c, t, g, unknown or other
  misc_feature (410)..(410): n is a, c, g, or t
  modified_base (418)..(418): a, c, t, g, unknown or other
  misc_feature (418)..(418): n is a, c, g, or t
tcagtcacgtactacacgaccggtgctcgatttagagagcgtcacaggggggggtcacaagaggcagcgctctcgggacgtctccaccatggcctgggctctgctgctcctcactctcctcactcaggacacagggtcctgggcccagtctgccctgactcagcctgcctccatgtctgggtctcctggacagtcgatcaccatctcctgcactggaaacngcagtgatcttgggacttatagacttgtctcctggtaccaacaccacccaggcaacggccccagagtcatcatttagtgggggcaagtaggcggccgtcgagggtactttccactcgcttctctggctcagtctgcaacacgcctcctgacatctctgtctcgagctgaggacgaggctgcctattacngctgctanatatgctaggttcttcgtgtcgtcgttcgggcggtacggtaccaaggtcgaccgtcgtaggtcacgacccgtaggcctcggcccccttggtcctaccg

SEQ ID NO: 276960 - DNA, 511 bp, Homo sapiens
  misc_feature: GYAE6OF02JF882.13.3.A03.1.454.CMB.1.raw
  modified_base (417)..(417): a, c, t, g, unknown or other
  misc_feature (417)..(417): n is a, c, g, or t
  modified_base (432)..(432): a, c, t, g, unknown or other
  misc_feature (432)..(432): n is a, c, g, or t
tcagtcacgtactacacgaccggtgctcgatttagagagcgtcacagggggggtcacaagaggcagcgctctcgggacgtctccaccatggcctgggctctgctgctcctcactctcctcactcaggacacagggtcctgggcccagtctgccctgactcagcctgcctccatgtctgggtctcctggacagtcgatcaccatctcctgcactggaaatagcagtgatgttgggacttatgaccttgtctcctggtaccgacaacacccaggcaaagcccccaaactcattattacggggtcaataagcggccctcagggctttctgactcgtcttctctggctccaagtctggcaacacggcctccctgacaatctctggactccaggccgaggacgaggctgatttttactgttnttcatatgcaggagngtgattatgttacttgaagttggaccaggtcacgtctgtcagccaaggcccaacccgatcgcactcctcgttcccgccc

SEQ ID NO: 276961 - DNA, 531 bp, Homo sapiens
  misc_feature: GYAE6OF02IWUSU.13.3.A03.1.454.CMB.1.raw
  modified_base (428)..(428): a, c, t, g, unknown or other
  misc_feature (428)..(428): n is a, c, g, or t
  modified_base (501)..(501): a, c, t, g, unknown or other
  misc_feature (501)..(501): n is a, c, g, or t
tcagtcacgtactacacgaccggtgctcgatttagagagcgtcacagggggggtcacaagaggcagcgctctcgggacgtctccaccatggcctgggctctgctgctcctcactctcctcactcaggacacagggtcctgggcccagtctgccctgactcagcctgcctccatgtctgggtctcctggacagtcgatcaccatctcctgcactggaaatagcagtgatgttgggacttatgaccttgtctcctggtaccgacaacacccagcaaacgcccccaaactcattatttacggggcaataagcggccctcagggctttctgatcgcttctctgctcaagtctgcaacacgcctcctgacatctctgactcgaggccgaggcgaggctgtactttttactgtttctcattatgcagggaaggngttagtattatgttcgtttaggagttcggacctaaggtcctaccgtcttggcacgacccgaagccccaacccncgttcgtaccactccttcgttccccgtccc

SEQ ID NO: 276962 - DNA, 560 bp, Homo sapiens
  misc_feature: GYAE6OF02IEK7O.13.3.A03.1.454.CMB.1.raw
tcagtcacgtactacacgaccggtgctcgatttagagagcgtcacaggggggggtcacaagaggcagcgctctcgggacgtctccaccatggcctgggctctgctcctcctcagcctcctcactcagggcacaggatcctgggctcagtctgccctgactcagcctcgctcagtgtccgggtctcctggacagtcagtcaccatctcctgcactggaaccagcagtgatgttggtgttatactatgtctctgtaccaacaccaccagcaacgccccagagtcatcatttagtggggacaagtaggcggccgtcgaggtactttccactcgcttcgtctcggtctccaagtctcggacaaccacggtccctcctgacaactctctggtcctccgacggtctggacgggacgaggtctcgtaccttatacgttgcgtgctacatagtcgtctaggtttcttcttggttcggtcgttcgggacgtacgggtacctaaacggtcgtacccggttctacggtaccgacgacccgaaggccgttccggccccgttcggtcctaccg

SEQ ID NO: 276963 - DNA, 568 bp, Homo sapiens
  misc_feature: GYAE6OF02FTEYE.13.3.A03.1.454.CMB.1.raw
  modified_base (411)..(411): a, c, t, g, unknown or other
  misc_feature (411)..(411): n is a, c, g, or t
tcagtcacgtactacacgaccggtgctcgatttagagagcgtcacaggggggggtcacaagaggcagcgctctcgggacgtctccaccatggcctgggctctgctgctcctcactctcctcactcaggacacagggtcctgggcccagtctgccctgactcagcctgcctccatgtctgggtctcctggacagtcgatcaccatctcctgcactggaaatagcagtgatggttggacttatgaccttgtctcctggtaccgacaacacccaggcaaacgcccccaaactcattattacgggtcaataagcggcctcagggtctttctgatcgcttctctggctcaagtctggcaacacgcctccctgacatctctggactccgaggccgaggacgaggctgtatttttacngtttgtcattgtgcgaaggaggagtgtatttagttgttcgtttagggaagttcgggaacctaagggtcctaccggttccgttgggtcctacggtccccgaacggtacccctaaccccgtacgttcgtacctaaccgtccgttccggtcccctccccg

SEQ ID NO: 276964 - DNA, 538 bp, Homo sapiens
  misc_feature: GYAE6OF02IV8DY.13.3.A03.1.454.CMB.1.raw
  modified_base (392)..(392): a, c, t, g, unknown or other
  misc_feature (392)..(392): n is a, c, g, or t
tcagtcacgtactacacgaccggtgctcgatttagagagcgtcacaggggggggtcacaagaggcagcgctctcgggacgtctccaccatggcctgggctctgctgctcctcactctcctcactcaggacacagggtcctgggcccagtctgccctgactcagcctgcctccatgtctgggtctcctggacagtcgatcaccatctcctgcactggaaacagcagtgatcttgggacttatagacttgtctcctggtaccaacaccacccaggcaacggcccccagacgtcatcatttagtgggggacaagtagggcggccgtcgagggtactttccactcgcttctctggctccaagtctggcaacacgcctcctgacatctctgtctcgngctgaggacgaggctgcctattactgctgctcatatgacgtagtttcttgttggtcggttcgttcgggacgggtacgggtacctaaggtcgtacccgtcgtacggtcgacgtacccgaggtccgtccgccccgttcggtcctaccg

SEQ ID NO: 276965 - DNA, 610 bp, Homo sapiens
  misc_feature: GYAE6OF02GNVJW.13.3.A03.1.454.CMB.1.raw
  modified_base (324)..(324): a, c, t, g, unknown or other
  misc_feature (324)..(324): n is a, c, g, or t
  modified_base (355)..(355): a, c, t, g, unknown or other
  misc_feature (355)..(355): n is a, c, g, or t
tcagtcacgtactacacgaccggtgctcgatttagagagcgtcacagggggggtcacaagaggcagcgctctcgggacgtctccaccatggcctgggctctgctgctcctcactctcctcactcaggacacagggtcctgggcccagtctgccctgactcagcctgcctccatgtctgggtctcctggacagtcgatcaccatctcctgcactggaaatagcagtgatgttgggacttatgaccttgtctcctggtaccgacaacacccaggcaaacgcccccaaactcattattacgggtcaataagcgcctcagggctttcngatcgcttctctggctccaagtctggcaacncgcctccctgacatctctggactccgaggccgaggacgaggtctgtatttttacgtgtttgtcattatcgactagggaaggtagtagtacttttagtcgttcgttttagggaagttcggggaaaccctaagggttccctaacccggttcccgtttaggggtccctaacggtaccccgtaaacggggccccctaaaacccccgttacgttccggttacccaaccgtttccgttccgggttaccccccgttcccccg

SEQ ID NO: 276966 - DNA, 620 bp, Homo sapiens
  misc_feature: GYAE6OF02HVHRU.13.3.A03.1.454.CMB.1.raw
  modified_base (206)..(206): a, c, t, g, unknown or other
  misc_feature (206)..(206): n is a, c, g, or t
tcagtcacgtactacacgaccggtgctcgatttagagagcgtcacagggggggtcacaagaggcagcgctctcgggacgtctccaccatggcctgggctctgctgctcctcactctcctcactcaggacacagggtcctgggcccagtctgccctgactcagcctgcctccatgtctggtctcctggacagtcgatcaccatctcngcactggaaatgcagtgatggttacgggattagtgtaccttgtcctcgtcggtaccacaaccaccaggacaaacgaccccaaactcgtattacgtttacgggtacaaataagccgccctagacgggtctttctgtatcgtcttctctcggtctccgtaatcgttcggacaaaccgtccggtaccctccctagactaactcgtaccgttaggccttaccgacggacccggtaggaacggtacgtacgttagtacgttttttacgtagttcgtttacagttagcgtacggaaggaaggtagtaggttattgttacgttcgtttgaacgtggaacctagcgtaaccgttcgttggtaccgtacgacccgaacggtacccaaccctagcctacgtaccctctaccggttccccacccg

SEQ ID NO: 276967 - DNA, 790 bp, Homo sapiens
  misc_feature: GYAE6OF02GU560.13.3.A03.1.454.CMB.1.raw
  modified_base (208)..(208): a, c, t, g, unknown or other
  misc_feature (208)..(208): n is a, c, g, or t
tcagtcacgtactacacgaccggtgctcgatttagagagcgtcacagagaggaagggggcaggagtcagacccactcaggacacagcatggacatgagggtccccgctcagctcctggggcctcctgctgctctggcctcccaggtgccagactgtcgccatccagatgacccagtcctaccatcctccctgtctgcatctgtagganacagacgtcaccatctacgttcggccgggacaaggtccgagggactattagaatgtatttaggcgttggtatcgagtctacggaaaccgaagggaaaccgtaccctaacgcttccgtagtacttacgtaggttgtcgactaacttacccggttaaagtttaaaacgggtccgggtacctaacgtaccggttaaggtttaccgacggtaccggagtacgggtacggttaaggttccggtaagggggtaacctaacgggttaacttaccgtaacctttacctaaccgtaaactaacgttaccgaacgtaccgtaaccgggtcccttaggaaccgaccgtaccggttaaggtacgttttaacggttttacaacccgtttaaagtttacctttaactccggttaaactaaaccgttagttttaaacctttaaacggttacccgtttaacccgtaccgtttaccgtaccgggttttaccgggggaacccgggtaaacggggtaaccggtaaacggggttaccggtaaacggttaagtaaacccgtaacggtaaccggtttcggtaacggtcgttacccggtaacccg

SEQ ID NO: 276968 - DNA, 543 bp, Homo sapiens
  misc_feature: GYAE6OF02F0N2A.13.3.A03.1.454.CMB.1.raw
  modified_base (264)..(264): a, c, t, g, unknown or other
  misc_feature (264)..(264): n is a, c, g, or t
  modified_base (283)..(283): a, c, t, g, unknown or other
  misc_feature (283)..(283): n is a, c, g, or t
tcagtcacgtactacacgaccggtgctcgatttagagagcgtcacagagaggaagggggcaggagtcagacccactcaggacacagcatggacatgagggtccccgctcagctccgtggggctcctgctgctctggctcccaggtgccagatgtgccatccagatgacccagtctccatcctccctgtctgcatctgtaggagacagagtcaccatcacttgccgggcaagtcagggcattagaaatgatttaggctaggtatnagcagaaaccagggaaacnccctaagctcttgatctatggtgcatcctaagtttaaaaaggtcgggtacccatacaaggttcagcggacaggtgatcgtggcacagacttctattctacacatcagtcagccctgcagactagagtatttgactaacgtttatactgttactaacgtaagactacaactaattactccgtagggtaacgttccggacgtaaacgggtacccgaagggtacgaaactaccgaaaaccgtagttacgggtagactaaccgg

SEQ ID NO: 276969 - DNA, 662 bp, Homo sapiens
  misc_feature: GYAE6OF02IUV8Z.13.3.A03.1.454.CMB.1.raw
  modified_base (319)..(319): a, c, t, g, unknown or other
  misc_feature (319)..(319): n is a, c, g, or t
  modified_base (537)..(537): a, c, t, g, unknown or other
  misc_feature (537)..(537): n is a, c, g, or t
tcagtcacgtactacacgaccggtgctcgattttagagagcgtcacgaggggggggtcacaagaggcagcgctctcgggacgtctccaccatggcctgggctctgctgctcctcactctcctcactcaggacacgagggtcctgggcccagtctgccctgactcagcctgcctccatgtctgggtctccgtggacagtcgatcacatctcctgcacgtaggaaatagcagtgagtaggttggacttagtcgtacctgtctacgtacgtacgaacaaccaccgagaccaacgccccaaatctagtttacgttacgggtanaaagtacgaccgcctacgacgggtcttgtacgatcgtcttctcgtgtcctactagtcgtagacctaacgacggtaccttcccgtaagacctacttccgtacgtacgtaccgcgaacgggtcgacggtacggacgtcgttaagttacttttacgtgttttacgtactagtattacggacgtaaagggaacggtagttattaagtttagtttacgggttntttaacgggaaggtaaccggtacgtaacgtcgtaccgttcgtaggtaccctaccgaaccggtaaccgtaccccgtaaacccgtcgtaccgtacctaccgttccggttaccccttcccgtaacccg

SEQ ID NO: 276970 - DNA, 614 bp, Homo sapiens
  misc_feature: GYAE6OF02JX9IV.13.3.A03.1.454.CMB.1.raw
  modified_base (609)..(609): a, c, t, g, unknown or other
  misc_feature (609)..(609): n is a, c, g, or t
tcagtcacgtactacacgaccggtgctcgatttagagagcgtcacagagaggaaggggcaggagtcagacccactcaggacacagcatggacatgagggtccccgctcagctcctggggctcctgctgctctggcctcccgaggtgccagtatgtgccatcccagactgacccagcttcccatccctccctgtctagcatcctgtaggagcaagcgtccaccatccacgttgccggggacaagtcgaggcattagaatagattggactggtatcgtacgacacgtaaacgaggtaaacgccctaagactaccttgactacttacgtaggtcgcacgtacgtaaggtttaaaaggtcgggtaccagtacgtaagttacgaacggtcggtacaggtgacgtacgtggacacgagtacctacgtacttactcgtaactataccgagccgtactaccgcgtcaccgtacgtacgaagttacttacggacttaactttacgttacttagtaacttacgaaagtactacaattaacgttacttcggtacggttaccggttacgaccgaacggtaacgaacggttacgaacttacgaaccgtaacgtcggtacgtnaaccg

SEQ ID NO: 276971 - DNA, 811 bp, Homo sapiens
  misc_feature: GYAE6OF02H9F25.13.3.A03.1.454.CMB.1.raw
tcagtcacgtactacacgaccggtgctcgatttagagagcgtcacagggggggttcacgaagaggcagcgctctcgggacgttctccaccatggcctgggctctgctgctcctcactcgtcctcactcaggacacgagggtcctgggcccagtctgccctgactcagcctgcctccatgtctgggtctcctggactagtcgatcaccatctctggcacgtaggaaatgcagtgagtgttggacttatcgacttgtctctggtaccgacaacgacccaggacaacggcccctaaatcaacgtttacgtttaacggggcaaggtaacgccggtccctacgacgggtaccttttctacgtacttccggaccttacgtaccgtacggtaccttaccaaggttccttacgggaccgtaaacctacccggggtacccctttaccccgtacggtaaaccctaacgtttcccgttaccggttaccgggtaacccgtttacccggaaaccggggtccccgggaaacggggtaacccggtacgggtacctttaggtttaaccgttttttttaaccgtcggttttacgttaccgttaagttacgttcggtacggtaagggaacgggttaggttacgttaacgtttacgttcggtttaccggtttagggtaaacggttcggggaaaccttaacggggtcctacccggtttacccggttttagggtacccgtaaccgggtaccctaaaccgggtcccctaaaccccggttacgtacggttacccgacctttacccggtttacccggttaccccttaacccccgg

SEQ ID NO: 276972 - DNA, 761 bp, Homo sapiens
  misc_feature: GYAE6OF02HKSSJ.13.3.A03.1.454.CMB.1.raw
  modified_base (202)..(202): a, c, t, g, unknown or other
  misc_feature (202)..(202): n is a, c, g, or t
  modified_base (237)..(237): a, c, t, g, unknown or other
  misc_feature (237)..(237): n is a, c, g, or t
  modified_base (324)..(324): a, c, t, g, unknown or other
  misc_feature (324)..(324): n is a, c, g, or t
tcagtcacgtactacacgaccggtgctcgatttagagagcgtcacaggggggggtcacaagaggcagcgctctcgggacgtctccaccatggcctgggctctgctgctcctcactctcctcactcaggacacagggtcctgggcccagtctgccctgactcagcctgcctcatgtctgggtctcctggacagtcgatcaccntcctctgcacgtcggaacccacagtgactgttggnaattataattatgtctccgtaggtaccaacgtagtcgcccgaggaccaaaccgacccccaaaattctaattttaaactttttaccgngttacctaagtctacgttccgggcccttgtacggggtttcaggtactcgtctttctacgtcggcctcgtaagtcgtacggacaaccgtaccggtccctacccgtagaacctaacgttccttacgtacggtaccctcccggaacgggacccggaagggtaccggtaggtccgttagtttacgtttttacgtggttttaccgttactaagttacgtcggaacggtaaaggggtaacggttaggttagttacgtttacgttggtttaaccggtttagggaaacgggttacgggaacccgttagggtttccccgtacccgggtttacggtttaccgggtaacccgtaacccgggtacccccggtaaacggtaccccccgttaaaccccgttacggttacccgggtttaccccttaccggtttaccccggtttaaccccccg

SEQ ID NO: 276973 - DNA, 777 bp, Homo sapiens
  misc_feature: GYAE6OF02GHT9S.13.3.A03.1.454.CMB.1.raw
  modified_base (228)..(228): a, c, t, g, unknown or other
  misc_feature (228)..(228): n is a, c, g, or t
tcagtcacgtactacacgaccggtgctcgatttagagagcgtcacaggggggggtcacgaagaggcagcgctctcgggacgtctccaccatggcctgggctctgctgctcctcactctcctcactcaggacacagggtcctgggcccaggtctgccctgactcagcctgcctcatgtctgggtctcctggacagtcgatcaccatctcctgcactggaaatgctagtntagttaggttggacttatcgtaccttgtctccgtacggtaccgaccaacctacccgaaggaccaaaccggtacccctaaactctaacgtttaacgtttacggggtactaagtaacggaccggtacccgtacgacgggttacttttcgtacgtacttcgtccttccgttcgtacgtccttaccgtaacgttccgtacggaccgtaaccgtacccggtacccttacccgtacgaacctaacgttccgtacgtaccggtaacctacccggaacgggtaccgtaacggggtaccgtacgggtacgtttacggtttaactttttaccggttggttttacgttaccttaagttagttacgggaacgtaagggtaacggttaggtacgttaaggtttacgttcggtttaccggtttaagggaacggttaccgggaaccgttacgggtaccctaccggtttccgttacggtaccgtaccggtacccgtaacggtacccctaacccgtacgttaccggttaccctaccgtttaccgttaccccttaccccgtaccccg

SEQ ID NO: 276974 - DNA, 782 bp, Homo sapiens
  misc_feature: GYAE6OF02HN903.13.3.A03.1.454.CMB.1.raw
tcagtcacgtactacacgaccggtgctcgatttagagagcgtcacaggggggggtcacaagaggcagcgctctcgggacgtctccaccatggcctgggctctgctgctcctcactctcctcactcaggacacagggtcctgggcccagtctgccctgactcagcctgcctccatgtctgggtctcctggacagtcgatcaccatctcctgcactaggaaatgcagtgatgttgggacttatcgtaccttgtccttccgtcggtaacccgaacaaaccacccgacggaccaaaccgaccccccaaactactagtttacgtttaccggggtacaaagtaacggccggtccccgtcgtacgggtctttacgtgtactcgtctttcctcgtcggtcctaccgaacgttcgtacggaccaaccgtaccgggtcccttacccgtacgtaaccctaactttcccgtcgtaccgggtaccgttacccggaacgggacccgggaacgggaaccgggtacggtccgttaggttttaacttttttacgttacggtttacgtttacgtacgtttacggtcgtacggtaagggtaaacgggtagttaaggttaagtttagttcggtttacggttttaggggtaacgggttacgggtaaaccgtaacgggttcccgttacccggtttccggtttacgggtaccgtaaccggtaaccccggaaccggtacccccaaacccccggtagttaccggtacccttacccgttacccgttcccgtttacccccctaaccccg

SEQ ID NO: 276975 - DNA, 738 bp, Homo sapiens
  misc_feature: GYAE6OF02HPI2I.13.3.A03.1.454.CMB.1.raw
  modified_base (166)..(166): a, c, t, g, unknown or other
  misc_feature (166)..(166): n is a, c, g, or t
  modified_base (210)..(210): a, c, t, g, unknown or other
  misc_feature (210)..(210): n is a, c, g, or t
  modified_base (232)..(232): a, c, t, g, unknown or other
  misc_feature (232)..(232): n is a, c, g, or t
  modified_base (469)..(469): a, c, t, g, unknown or other
  misc_feature (469)..(469): n is a, c, g, or t
  modified_base (478)..(478): a, c, t, g, unknown or other
  misc_feature (478)..(478): n is a, c, g, or t
  modified_base (556)..(556): a, c, t, g, unknown or other
  misc_feature (556)..(556): n is a, c, g, or t
tcagtcacgtactacacgaccggtgctcgatttagagagcgtcacagggggggtcgacgaagaggcgagcgctctcgggacgtctccaccatggcctgggctctgctgctcctcactctcctcactcaggacacgaggtcctcgggcccagtcctgccctgactcngcctcgcctcgtgtcgtggtcctcctggacacgtcgactcaccntcctctgctacctaggaaaccnggctaagtggtacttcgttaggggtaaccttataaggtccttcggttctaccgtacggtaacctaaaccaccccgaaccccgtaaggacccaaaccgggcccccaacgtaggtacccagttactaagttttacggacggggtcctaaaaggtacggcccgggtacctagggaaccggttacgtttcccaacggttccgtcttacccgtgtcgtccaccggtaatcggcgacgaaccncggttcccnccttggaacctaacgttcctcgtcggtcctacccgtgcgtaggacggacgtccgtacgtcgtaccgtaccgtttaccnggtaccgtcgtcaccgtaaagttccgtgtaccgtttaggttccttcgttcgggttcgttacggtccgggttacgggtacggtaccgtaaacggtcgtaacccggttcgttacggacccggtaccgtaccggtaccgtcccggttaccccgcccccgggtacgtacccgttaccgtaccccgg

SEQ ID NO: 276976 - DNA, 651 bp, Homo sapiens
  misc_feature: GYAE6OF02HGO7L.13.3.A03.1.454.CMB.1.raw
  modified_base (222)..(222): a, c, t, g, unknown or other
  misc_feature (222)..(222): n is a, c, g, or t
tcagtcacgtactacacgaccggtgctcgatttagagagcgtcacaggggggggtcacaagaggcagcgctctcgggacgtctccaccatggcctgggctctgctgctcctcactctcctcactcaggacacagggtcctgggcccagtctgccctgactcagcctgcctccatgtctgggtctcctggacagtcgatcaccatctcctgcactaggaaacngcagtgatcgttgggactttagtagtacttcgtctccgtggtaaccaaccaccacccgaggaccaacggccccagatcatctagtttaggcggggactaagtgggcggtccgtacgagggtacttccacgtcgtcttcgtcgtcggtctaccgtaacgtcgtacggacaaccgtacccgggtccctacccgtagaacctacgttccttccggttcggttaccttaccggacgggtcgtacgggaacgggaccgggtaacggttcctacggtacctttacgttacgtcggtcgtcgtcctactaagttacgtcgtcgttacggtttcttcgttggttcggttcggtcgggtacggtacggtacgtaaggtcgtacccggtcgtacggccgacgacccgtacggtccttcccgggccccttggtacctccg

SEQ ID NO: 276977 - DNA, 898 bp, Homo sapiens
  misc_feature: GYAE6OF02JJXO2.13.3.A03.1.454.CMB.1.raw
tcagtcacgtactacacgaccggtgctcgatttagagagcgtcacaggggggggtcacaagaggcagcgctctcgggacgtctccaccatggcctgggctctgctgctcctcactctcctcactcaggacacagggtcctgggcccagtctgccctgactcagcctgcctccatgtctgggtctccgtggacagtcgatccaccatcctcctgcacgtggaaatgcagtgattggttagggtacttaacgtcgtaccttcgttcctaccgtacggtaacccgaaccaaccgaaccccgaaggaacccaaaaccggtaccccccctaaaaacttacccgttaacgtttttaaacggttttaaccgggggtaacctaaaacgtaaacgggtcccgggtacccccgtaacggtacggggttacccttttacggtcggttaacgttccggttcctttccttccggttcggtacccgttaacccgtaaacggttccgttacgggaacctaaaccgggtaccccgttaccccgtaccccgttacgaaaccgttaacctccgttaccgtaccggtacccgtacccggaaccgggtaaccggaaccgggtacgtacggggggggggtacttacggtttaccgttttacgtttcgtttacgttacgttacgttacgttacgtacggtaacgggtaacggttacggtaacggttagtttacgtttacggtttacggtttaacgggttaacgggttaacgggtaaccggtaacgggttacccggttaccggttaccggttaccgggtaccggtaacccggtaacccggtaacccggtaaccccgtaaccccgtaaccgttaccggttaccgttacccgttacccggttcccggttaccccgttaccccg

SEQ ID NO: 276978 - DNA, 701 bp, Homo sapiens
  misc_feature: GYAE6OF02F8EJ6.13.3.A03.1.454.CMB.1.raw
  modified_base (204)..(204): a, c, t, g, unknown or other
  misc_feature (204)..(204): n is a, c, g, or t
  modified_base (273)..(273): a, c, t, g, unknown or other
  misc_feature (273)..(273): n is a, c, g, or t
tcagtcacgtactacacgaccggtgctcgatttagagagcgtcacagggggggtcacaagaggcagcgctctcgggacgtctccaccatggcctgggctctgctgctcctcactctcctcactcaggacacagggtcctgggcccagtctgccctgactcagcctgcctccatgtctgggtctcctggaccagtcgatccaccntcctccgtgcactaggaaactagcagtgattgttggacttatgaccttgtctccgtggtaccgacaacnccctaggacaaccgcccccaaactctaagttattaacgggtcaatagccggtccctagacgggtctttcctgtactcgtcttcctcgtcggtctacccaagttctacggtacaaaccgtcggtcccttacccgtgtaaccaacgttctacgtacggacctccgaaggccgaagggaccgaggtactggttactttttaccgtagtttccgtactagttagtcgacggtaacgggaaaggtcgtagtacgtttagttacgggttacgtttaggggaacgttacggggaaccttaacgggttaccgttacccggttaccggttaggttaccccggaaggtaacccccgtaaacggtacccccgtaaaccccgtacccgttcggtacccttaccccgtttcccgtttacccgttacccccttaacccccgg

SEQ ID NO: 276979 - DNA, 823 bp, Homo sapiens
  misc_feature: GYAE6OF02F0OCS.13.3.A03.1.454.CMB.1.raw
  modified_base (163)..(163): a, c, t, g, unknown or other
  misc_feature (163)..(163): n is a, c, g, or t
  modified_base (213)..(213): a, c, t, g, unknown or other
  misc_feature (213)..(213): n is a, c, g, or t
  modified_base (224)..(224): a, c, t, g, unknown or other
  misc_feature (224)..(224): n is a, c, g, or t
tcagtcacgtactacacgaccggtgctcgatttagagagcgtcacagagaggaagggggcaggagtcagacccactcaggacacagcatggacatggacgggtccccgctccagctccgtgggggcctccgtgctgctctggcctcccgaggtgccagatcgngtccatcccagactacgaccccagttcctaccgaactccctccctgtacncgcaacttcgnggtaagggacaccgagtaccgtcacccaattccgtacgtcgggacccgggtataacggacgtacggactaaagttaaggaactaggtaagttacggtcgttaggtactagacgaccgtaaagaaacccggtaagggaaccgtacccgtaagtcctacgtacgtaacgtttccgtagttacgggtacaccgttaacgttaaccgtttaaaaagggtttaaaaccggggttccgggtacccctaaggtttaaaccggtaaccggtttacgggaccggtaaccgggtaccgtaagggttaccgggttaaccttacgggtacccggactaacctaaccggttacccgttacgttacctttaccgaccgtaacccacggttaccgaccgtaacgtcccgtaacgtccggtacgtaacgtccgttaagtacgtttacggttaactacgtttaacctaagtttcgtacgttaacgtactaacgtaacgtccgttaaataaccgttcgtaacggttcccggagggtttacccggaaggtaaaccgggtaacgtaaggtaaacgtaaccggtaacgaaacccggttataagggtcccgttacgaaccg

SEQ ID NO: 276980 - DNA, 564 bp, Homo sapiens
  misc_feature: GYAE6OF02G7YHK.13.3.A03.1.454.CMB.1.raw
  modified_base (391)..(391): a, c, t, g, unknown or other
  misc_feature (391)..(391): n is a, c, g, or t
  modified_base (443)..(443): a, c, t, g, unknown or other
  misc_feature (443)..(443): n is a, c, g, or t
  modified_base (452)..(452): a, c, t, g, unknown or other
  misc_feature (452)..(452): n is a, c, g, or t
  modified_base (474)..(474): a, c, t, g, unknown or other
  misc_feature (474)..(474): n is a, c, g, or t
  modified_base (483)..(483): a, c, t, g, unknown or other
  misc_feature (483)..(483): n is a, c, g, or t
  modified_base (489)..(489): a, c, t, g, unknown or other
  misc_feature (489)..(489): n is a, c, g, or t
  modified_base (533)..(533): a, c, t, g, unknown or other
  misc_feature (533)..(533): n is a, c, g, or t
tcagtcacgtactacacgaccggtgctcgatttagagagcgtcacgaggggggggtcacaagaggcagcgctctcgggacgtctccaccatggcctgggctctgctgctcctcactctcctcactcaggacacgagggtcctgggcccagtctgccctgactcacgcctgccctccatgtcgtgggtcctcgtggacagtcgatccacattctcctgcagtacggaaatgcaggtgagttggttaggacttatgtaccttgtcctccgtgtacccgacaaaccacccgaggaccaaaccgccccaaactctattacgttacgggtacaatacggccgccctagtacggtctttcgtagtactccgtcttctcgtgtcctacgtaacgttcncggacaaccgtccgcccttccgtagactactctcgtcgctcgacggcagcgngtctagttnttacgtgttatcatcagtcagngatgtattntggttntaggtgcggaatcgtacgcgtcgtacgcacggaccgcgaacccnccgtctacgtctaccgcgtccctacctcccg

SEQ ID NO: 276981 - DNA, 736 bp, Homo sapiens
  misc_feature: GYAE6OF02FN984.13.3.A03.1.454.CMB.1.raw
  modified_base (102)..(102): a, c, t, g, unknown or other
  misc_feature (102)..(102): n is a, c, g, or t
  modified_base (222)..(222): a, c, t, g, unknown or other
  misc_feature (222)..(222): n is a, c, g, or t
  modified_base (228)..(228): a, c, t, g, unknown or other
  misc_feature (228)..(228): n is a, c, g, or t
tcagtcacgtactacacgaccggtgctcgatttagagagcgtcacaggggggggtcacaagaggcagcgctctcgggacgtctccaccatggcctgggctcngctgctcctcactctcctcactcaggacacagggtcctgggcccagtctgccctgactcagcctgcctccgtgtctgggtctccgtggacagtcgatcaccatctcctgcactggaaacngcagtnatcgttggaacttagagtacttgtctccgtcggttaccaacaccaccaggccaacggtcccccagacgtacactacctatttaggcgggggtacaaacggttacggcgggtaccggtacgtacggggtaactttaccgaaccgttcgtaccgttttcgtccgttcgggtacctacccgtaaacggtccgttacgggaccgtaaaccgtaacccgggtccccttaacccgttacggtaacctaacgttccttaccggtttacgggtacccttaccgaacggtcccgttagggaacgggtaccggaccgttcggtaccgtacttaacgttccgtcggtctcgtcttaccgattacggattccgttaacgtttccgtttgttacggttccggttcgttacggggtacggtacgggtaccgtaaacggttcggtaacccgttaccggttaccggtatacccgtaccgtacggtacccttacccggtccccggtacggttcctacctttcccg

SEQ ID NO: 276982 - DNA, 725 bp, Homo sapiens
  misc_feature: GYAE6OF02I5QFE.13.3.A03.1.454.CMB.1.raw
  modified_base (211)..(211): a, c, t, g, unknown or other
  misc_feature (211)..(211): n is a, c, g, or t
  modified_base (383)..(383): a, c, t, g, unknown or other
  misc_feature (383)..(383): n is a, c, g, or t
  modified_base (602)..(602): a, c, t, g, unknown or other
  misc_feature (602)..(602): n is a, c, g, or t
tcagtcacgtactacacgaccggtgctcgatttagagagcgtcacgaggggggggtcacaagaggcagcgctctcgggacgtctccaccatggcctggctctgctgctcctcactctcctcactcaggacacgagggtcctcgggcccagtctgccctgactcagcctgcctcatcgtctgggtctcgtggacagtcgctcaccatctccngactacgtggaaactcgctaagtgtagtaggttacgggaacttagacgtaccgttgtccgttccgtagggtaaccaactaaaccgacccgtaggaacctaaaccgcccctaaaacttaccagtttacgttacgggtacaaagtaccggccgtcctagaccgggtcccagtanacgtctctaccgtcgtacccgtacgtaagtccgtaacggtacgaaccgtaccggtccctacccgacgaacctacgtccgttacggtcgggtaccctaaccgtgggtactaacgggtaaggtacgttaggaacgttaccgtaggttaaacgtttaaccgtttacgtaccgttcgttcgtaacctacgtaacgataccggaggaacggtaccgtaaccggnttaacctaggtaacgttacgttacgggtaccggggagggtaacggaccggttaaacgtccggtaacccgtacgtaccggttacgacgaccgttaccggaacgcccgttaccgccccggtaacg

SEQ ID NO: 276983 - DNA, 257 bp, Homo sapiens
  misc_feature: GYAE6OF01BHYLD.29.35.D02.1.454.CMB.1.raw
  modified_base (256)..(257): a, c, t, g, unknown or other
  misc_feature (256)..(257): n is a, c, g, or t
tcagatagagtactcacgaccggtgctcgatttagcacacgatagttgggtttgggacagacttcactctcaccatcagccgcctagagcctgaggattctgccgtttattattgtcttgggcgtagcaactggcctcccgtcacttttggccaggggaccaagctggagatcagacgaactgtggctgcaccatctgtcttcatcttcccgccatctgaagtactctatctgagcgggctggcaaggcgcatagnn

SEQ ID NO: 276984 - DNA, 257 bp, Homo sapiens; identical to SEQ ID NO: 276983
  misc_feature: GYAE6OF01BGVDE.29.35.D02.1.454.CMB.1.raw
  modified_base (256)..(257): a, c, t, g, unknown or other
  misc_feature (256)..(257): n is a, c, g, or t

SEQ ID NO: 276985 - DNA, 502 bp, Homo sapiens
  misc_feature: GYAE6OF01CHIEL.29.35.D02.1.454.CMB.1.raw
tcagatagagtactcacgaccggtgctcgatttagcacacgatagttgggtttggggaggaactgctcagttaggacccagacggaaccatggaagccccagctcagcttctcttcctcctgctactctggctcccagataccagcggagagattgtgttgacacagtctccagccaccctgtctttgtctccgggagaaagagccaccctctcctgcagggccagtcagagtgttaacaactacttggcctggttccaacagaaacctggccaggctcccaggctcctcatctatgatgcatccaacagggccactggcatcccagccaggttcagtggcagtgggtctggggacagacttcactctcaccatcagccgcctagagcctgaggattctgccgtttattattgtcttgggcgtagcaactggcctcccgtcactttggccaggggaccagctggagatcagacgaatggtggctgcaccatctgtcttctac

SEQ ID NO: 276986 - DNA, 259 bp, Homo sapiens
  misc_feature: GYAE6OF01BUI2X.29.35.D02.1.454.CMB.1.raw
  modified_base (256)..(259): a, c, t, g, unknown or other
  misc_feature (256)..(259): n is a, c, g, or t
tcagatagagtactcacgaccggtgctcgatttagcacacgatagttgggtttgggacagacttcactctcaccatcagccgcctagagcctgaggattctgccgtttattattgtcttgggcgtagcaactggcctcccgtcacttttggccaggggaccaagctggagatcagacgaactgtggctgcaccatctgtcttcatcttcccgccatctgaagtactctatctgagcgggctggcaaggcgcatagnnnn

SEQ ID NO: 276987 - DNA, 505 bp, Homo sapiens
  misc_feature: GYAE6OF01BADKC.29.35.D02.1.454.CMB.1.raw
  modified_base (204)..(204): a, c, t, g, unknown or other
  misc_feature (204)..(204): n is a, c, g, or t
tcagatagagtactcacgaccggtgctcgatttagcacacgatagttgggtttgggggaggaactgctcagttaggacccagacggaaccatggaagccccagctcagcttctcttcctcctgctactctggctcccagataccagcggagagattgtgttgacacagtctccagccaccctgtctttgtctccgggagaaagngccaccctctcctgcagggccagtcagagtgttaacaactacttggcctggttccaacagaaacctggccaggctcccaggctcctcatctatgatgcatccaacagggccactggcatcccagccaggttcagtggcaggtgggtctgggacagacttcactctcaccatcagccgcctagagcctgaggattctgtccgtttattattgtcgttggcgtagcaactggcctcccgtctacgtttggccagggaccagcgtggagatcgagacgagtggtgctgctacatctgtctctac

SEQ ID NO: 276988 - DNA, 501 bp, Homo sapiens
  misc_feature: GYAE6OF01BTL80.29.35.D02.1.454.CMB.1.raw
  modified_base (490)..(490): a, c, t, g, unknown or other
  misc_feature (490)..(490): n is a, c, g, or t
tcagatagagtactcacgaccggtgctcgatttagcacacgatagttgggtttggggaggaactgctcagttaggacccagacggaaccatggaagccccagctcagcttctcttcctcctgctactctggctcccagataccagcggagagattgtgttgacacagtctccagccaccctgtctttgtctccgggagaaagagccaccctctcctgcagggccagtcagagtgttaacaactacttggcctggttccaacagaaacctggccaggctcccaggctcctcatctatgatgcatccaacagggccactggcatcccagccaggttcagtggcagtgggtctgggacagacttcactctcaccatcagccgcctagagcctgaggattctgccgtttattattgtcttgggcgtagcaactggcctcccgtcacgtttggccagggaccagctggagatcagacgaatgtggctgcaccatntcgtcttctac

SEQ ID NO: 276989 - DNA, 516 bp, Homo sapiens
  misc_feature: GYAE6OF01BZA46.29.35.D02.1.454.CMB.1.raw
tcagatagagtactcacgaccggtgctcgatttagcacacgatagttgggtttgggggaggaactgctcagttaggacccagacggaaccatggaagccccagctcagcttctcttcctcctgctactctggctcccagataccagcggagagattgtgttgacacagtctccagccaccctgtctttgtctccgggagaaagagccaccctctcctgcagggccagtcagagtgttaacaactacttggcctggttccaacagaaacctggccaggctcccaggctcctcatctatgatgcatccaacagggccactggcatcccagccaggttcagtgcagtgggtctgggacagacttcactctcaccatcagccgcctagacgccgtgagattctgtcgtttattattgttcgttggcgtagcaacgtggcctcccgtctacgttttggccgtagggaccaggctggacgatcgacgacgaactggtcggctcgctaccatctgtcttctac

SEQ ID NO: 276990 - DNA, 256 bp, Homo sapiens
  misc_feature: GYAE6OF01B3KKQ.29.35.D02.1.454.CMB.1.raw
  modified_base (256)..(256): a, c, t, g, unknown or other
  misc_feature (256)..(256): n is a, c, g, or t
tcagatagagtactcacgaccggtgctcgatttagcacacgatagttgggtttgggacagacttcactctcaccatcagccgcctagagcctgaggattctgccgtttattattgtcttgggcgtagcaactggcctcccgtcacttttggccaggggaccaagctggagatcagacgaactgtggctgcaccatctgtcttcatcttcccgccatctgaagtactctatctgagcgggctggcaaggcgcatagn

SEQ ID NO: 276991 - DNA, 513 bp, Homo sapiens
  misc_feature: GYAE6OF01D0WHU.29.35.D02.1.454.CMB.1.raw
  modified_base (310)..(310): a, c, t, g, unknown or other
  misc_feature (310)..(310): n is a, c, g, or t
  modified_base (506)..(506): a, c, t, g, unknown or other
  misc_feature (506)..(506): n is a, c, g, or t
  modified_base (510)..(510): a, c, t, g, unknown or other
  misc_feature (510)..(510): n is a, c, g, or t
tcagatagagtactcacgaccggtgctcgatttagcacacgatagttgggtttgggggaggaactgctcagttaggacccagacggaaccatggaagccccagctcagcttctcttcctcctgctactctggctcccagataccagcggagagattgtgttgacacagtctccagccaccctgtctttgtctccgggagaaagagccaccctctcctgcagggccagtcagagtgttaacaactacttggcctggttccaacagaaacctggccaggctcccaggctcctcatctatgatgcatccaacngggccactggcatcccagccaggttcagtggcagtgggtctgggacagacttcactctcaccatcagccgcctagagcctgaggattcgtgtccgtttattatttgttcgttgggtcgtagcacgtggccctcccgtctacgtttcggccgaggggaccaagcgtggagatcgagacgatggtggctgcacatctntctntac

SEQ ID NO: 276992 - DNA, 507 bp, Homo sapiens
  misc_feature: GYAE6OF01CZBDK.29.35.D02.1.454.CMB.1.raw
  modified_base (504)..(504): a, c, t, g, unknown or other
  misc_feature (504)..(504): n is a, c, g, or t
tcagatagagtactcacgaccggtgctcgatttagcacacgatagttgggtttggggaggaactgctcagttaggacccagacggaaccatggaagccccagctcagcttctcttcctcctgctactctggctccagataccagcggagagattgtgttgacacagtctccagccaccctgtctttgtctccgggagaaagagccacctctcctgcagggccagtcagagtgttaacaactacttggcctggttccaacagaaacctggccaggctcccaggctcctcatctatgatgcatccaacagggccactggcatcccagccaggttcagtggcagtgggctgggacagacttcactctcaccatcagccgcctagacgcctgagattctgtccgtttattattgttcgttggtcgtagcaactggcctcccgtctacgtttcggccgagggaccagcgtggagactacgagacgaatgtggctgcaccatctgtcttntac

SEQ ID NO: 276993 - DNA, 505 bp, Homo sapiens
  misc_feature: GYAE6OF01CK65L.29.35.D02.1.454.CMB.1.raw
  modified_base (262)..(262): a, c, t, g, unknown or other
  misc_feature (262)..(262): n is a, c, g, or t
  modified_base (498)..(498): a, c, t, g, unknown or other
  misc_feature (498)..(498): n is a, c, g, or t
  modified_base (502)..(502): a, c, t, g, unknown or other
  misc_feature (502)..(502): n is a, c, g, or t
tcagatagagtactcacgaccggtgctcgatttagcacacgatagttgggtttgggggaggaactgctcagttaggacccagacggaaccatggaagccccagctcagcttctcttcctcctgctactctggctcccagataccagcggagagattgtgttgacacagtctccagccaccctgtctttgtctccgggagaaagagccaccctctcctgcagggccagtcagagtgttaacaactacttggcctggttccaanagaaacctggccaggctccaggctcctcatctatgatgcatccaacagggccactggcatcccagccaggttcagtggcagtgggtctgggacagacttcactctcaccatcagccgcctagacgcctgaggattctgtccgtttattattgtcttgggcgtagcaactcggcctccgtctactttggccgaggggaccagcgtggagatcgagacgaatggtggctgcacatctntctntac

SEQ ID NO: 276994 - DNA, 518 bp, Homo sapiens
  misc_feature: GYAE6OF01BSPW2.29.35.D02.1.454.CMB.1.raw
tcagatagagtactcacgaccggtgctcgatttagcacacgatagttgggtttggggaggaactgctcagttaggacccagacggaaccatggaagccccagctcagcttctcttcctcctgctactctggctcccagataccagcggagagattgtgttgacacagtctccagccaccctgtctttgtctccgggagaaagagccaccctctcctgccagggccagtcagagtgttaacaactacttggcctggttccaacagaaacctggccaggctcccaggctcctcatctatgatgcatccaacagggccactggcatccccagccaggttcagtgcaggtggctgggacaggacttcgactctcacccatcagccgcctagacgcctggagtattctgtccgtttattattgtcttgggcgtagcaactggccctccgtctactttcggccgagggacccagcgtggagatcaagacgaactggtggctgcctaccattcctgtcttctacg

SEQ ID NO: 276995 - DNA, 498 bp, Homo sapiens
  misc_feature: GYAE6OF01AHTCG.29.35.D02.1.454.CMB.1.raw
  modified_base (495)..(495): a, c, t, g, unknown or other
  misc_feature (495)..(495): n is a, c, g, or t
tcagatagagtactcacgaccggtgctcgatttagcacacgatagttgggtttgggggaggaactgctcagttaggacccagacggaaccatggaagccccagctcagcttctcttcctcctgctactctggctcccagataccagcggagagattgtgttgacacagtctccagccaccctgtctttgtctccgggagaaagagccaccctctcctgcagggccagtcagagtgttaacaactacttggcctggttccaacagaaacctggccaggctcccaggctcctcatctatgatgcatccaacagggccactggcatcccagccaggttcagtggcagtgggtctgggacagacttcactctcaccatcagccgctagagcctgaggattctgtccgtttattattgtcttggcgtagcaactgcctcccgtctactttggccagggaccagcgtggagatcagacgagtgtgctgcacatctgtcttntac

SEQ ID NO: 276996 - DNA, 524 bp, Homo sapiens
  misc_feature: GYAE6OF01BLNRP.29.35.D02.1.454.CMB.1.raw
tcagatagagtactcacgaccggtgctcgatttagcacacgatagttgggtttgggggaggaactgctcagttaggacccagacggaaccatggaagccccagctcagcttctcttcctcctgctactctggctcccagataccagcggagagattgtgttgacacagtctccagccaccctgtctttgtctccgggagaaagagccaccctctcctgcagggccagtcagagtgttaacaactacttggcctggttccaacagaaacctggccaggctcccaggctcctcatctatgatgcatccaacagggccactggcatcccagccaggttcagtggcagtgggtctgggacagacttcactctcaccatcagccgctagagcctgaggattctgtccgtttattatttgtcgttgggtcgtagcaacgtcggtcccgttcccgtctacgttttcggaccgtacggggaccgaacgcgtggagagtcagacgaacgtgtggctgcacatctcgtctctac

SEQ ID NO: 276997 - DNA, 517 bp, Homo sapiens
  misc_feature: GYAE6OF01CNO08.29.35.D02.1.454.CMB.1.raw
  modified_base (204)..(204): a, c, t, g, unknown or other
  misc_feature (204)..(204): n is a, c, g, or t
tcagatagagtactcacgaccggtgctcgatttagcacacgatagttgggtttgggggaggaactgctcagttaggacccagacggaaccatggaagccccagctcagcttctcttcctcctgctactctggctcccagataccagcggagagattgtgttgacacagtctccagccaccctgtctttgtctccgggagaaagngccaccctctcctgcagggccagtcagagtgttaacaactacttggcctggttccaacagaaacctggccaggctcccaggctcctcatctatgatgcatccaacagggccactggcatcccagccaggttcagtggcaggtgggtctgggacagacttcactctcaccatcagccgcctagacgcctgaggattctgtccgtttattattgtcgttgggcgtagcaacgtcggtcctcccgtctacgtttggccgtaggggaccagcgtggagatcgagacgaactggtggcgtgcaccatctgtcttctac

SEQ ID NO: 276998 - DNA, 257 bp, Homo sapiens; identical to SEQ ID NO: 276983
  misc_feature: GYAE6OF01DT9G3.29.35.D02.1.454.CMB.1.raw
  modified_base (256)..(257): a, c, t, g, unknown or other
  misc_feature (256)..(257): n is a, c, g, or t

SEQ ID NO: 276999 - DNA, 503 bp, Homo sapiens
  misc_feature: GYAE6OF01C71S1.29.35.D02.1.454.CMB.1.raw
  modified_base (263)..(263): a, c, t, g, unknown or other
  misc_feature (263)..(263): n is a, c, g, or t
tcagatagagtactcacgaccggtgctcgatttagcacacgatagttgggtttgggggaggaactgctcagttaggacccagacggaaccatggaagccccagctcagcttctcttcctcctgctactctggctcccagataccagcggagagattgtgttgacacagtctccagccaccctgtctttgtctccgggagaaagagccaccctctcctgcagggccagtcagagtgttaacaactacttggcctggttccaaanagaaacctggccaggctcccaggctcctcatctatgatgcatccaacagggccactggcatcccagccaggttcagtggcagtgggtctgggacagacttcactctcaccatcagccgcctagagcctgaggattctgccgtttattattgtcttgggcgtagcaactggcctcccgtcacttttgcagggaccaagctggagatcagacgaactgtggctgcaccaatctgtcttctac

SEQ ID NO: 277000 - DNA, 514 bp, Homo sapiens
  misc_feature: GYAE6OF01EAQMK.29.35.D02.1.454.CMB.1.raw
  modified_base (203)..(203): a, c, t, g, unknown or other
  misc_feature (203)..(203): n is a, c, g, or t
tcagatagagtactcacgaccggtgctcgatttagcacacgatagttgggtttggggaggaactgctcagttaggacccagacggaaccatggaagccccagctcagcttctcttcctcctgctactctggctcccagataccagcggagagattgtgttgacacagtctccagccaccctgtctttgtctccgggagaaagngccaccctctcctgcagggccagtcagagtgttaacaactacttggcctggttccaacagaaacctggccaggctcccaggctcctcatctatgatgcatccaacagggccactggcatcccagccaggttcagtggcaggtgggtctgggacagacttcactctcaccatcagccgctagagcctgaggattctgtaccgtttatttattgttcgttgggcgttagctaactcggcctcccgtctacgtttcggccgtagggaccagcgtggagatacgagacgaatgtcgctgctacatctgtctctac

SEQ ID NO: 277001 - DNA, 255 bp, Homo sapiens
  misc_feature: GYAE6OF01AJEOL.29.35.D02.1.454.CMB.1.raw
tcagatagagtactcacgaccggtgctcgatttagcacacgatagttgggtttgggacagacttcactctcaccatcagccgcctagagcctgaggattctgccgtttattattgtcttgggcgtagcaactggcctcccgtcacttttggccaggggaccaagctggagatcagacgaactgtggctgcaccatctgtcttcatcttcccgccatctgaagtactctatctgagcgggctggcaaggcgcatag

SEQ ID NO: 277002 - DNA, 523 bp, Homo sapiens
  misc_feature: GYAE6OF01AZ05I.29.35.D02.1.454.CMB.1.raw
tcagatagagtactcacgaccggtgctcgatttagcacacgatagttgggtttgggggaggaactgctcagttaggacccagacggaaccatggaagccccagctcagcttctcttcctcctgctactctggctcccagataccagcggagagattgtgttgacacagtctccagccaccctgtctttgtctccgggagaaagagccaccctctcctgcagggccagtcagagtgttaacaactacttggcctggttccaacagaaacctggccaggctcccaggctcctcatctatgatgcatccaacagggccactggcatcccagccaggttcagtggcagtgggtctgggacagacttcactctcaccatcagccgcctagacgcctgaggattctgtccgtttattattgttcgttgggtcgttagctaacgtcggccctcccgtctacgttttcggccgtacggggaccaacgcgtggagagtcgagacgactggtggctgcacatctgtcttctac

SEQ ID NO: 277003 - DNA, 505 bp, Homo sapiens
  misc_feature: GYAE6OF01ENQPI.29.35.D02.1.454.CMB.1.raw
tcagatagagtactcacgaccggtgctcgatttagcacacgatagttgggtttggggaggaactgctcagttaggacccagacggaaccatggaagccccagctcagcttctcttcctcctgctactctggctcccagataccagcggagagattgtgttgacacagtctccagccaccctgtctttgtctccgggagaaagagccaccctctcctgcagggccagtcagagtgttaacaactacttggcctggttccaacagaaacctggccaggctcccaggctcctcatctatgatgcatccaacagggccactggcatcccagccaggttcagtggcagtgggtctgggacagacttcactctcaccatcagccgcctagagcctgagattctgtccgtttattattgtcttggcgtagcaacgtggcctcccgtctacgtttcggcctaggggaccaagcgtggagatcgagacgaatgtggctgcacatctgtctctac

SEQ ID NO: 277004 - DNA, 513 bp, Homo sapiens
  misc_feature: GYAE6OF01DQ9V2.29.35.D02.1.454.CMB.1.raw
  modified_base (262)..(262): a, c, t, g, unknown or other
  misc_feature (262)..(262): n is a, c, g, or t
tcagatagagtactcacgaccggtgctcgatttagcacacgatagttgggtttggggaggaactgctcagttaggacccagacggaaccatggaagccccagctcagcttctcttcctcctgctactctggctcccagataccagcggagagattgtgttgacacagtctccagccaccctgtctttgtctccgggagaaagagccaccctctcctgcagggccagtcagagtgttaacaactacttggcctggttccaaanagaaacctggccaggctcccaggctcctcatctatgatgcatccaacagggccactggcatcccagccaggttcagtgcagtgggtctgggacagacttcactctcaccatcagccgcctagagcctgaggtattctgtccgtttattattgtcgttgggcgtagctaacgtcggccttcccgtctacgttttcggccgagggaccagcgtggagatcgagacgaatggtgctgcaccatctgtcttctac

SEQ ID NO: 277005 - DNA, 545 bp, Homo sapiens
  misc_feature: GYAE6OF01CS8ZB.29.35.D02.1.454.CMB.1.raw
  modified_base (312)..(312): a, c, t, g, unknown or other
  misc_feature (312)..(312): n is a, c, g, or t
  modified_base (358)..(358): a, c, t, g, unknown or other
  misc_feature (358)..(358): n is a, c, g, or t
tcagatagagtactcacgaccggtgctcgatttagcacacgatagttgggtttgggggaggaactgctcagttaggacccagacggaaccatggaagccccagctcagcttctcttcctcctgctactctggctcccagataccagcggagagattgtgttgacacagtctccagccaccctgtctttgtctccgggagaaagagccaccctctcctgcagggccagtcagagtgttaacaacttacttggcctggttaccaaacagaaacctggccaggctcccaggctcctcatctatgatgcatccaangggccactggcatccagccaggttcagtggcagtgggtctgggacngcttcactctcacatcacgccgctagacgcctagaggtattcgtcgtccgtttattacgtttgttcgttcgggtcgtacgctaacgtcggtccgtcccgtcgtaccgttttcggaccgtacggggtaccagtcgtggagactcgagacgtaacgtggtcggctggcacctataccgtgtcttctacg

SEQ ID NO: 277006 - DNA, 502 bp, Homo sapiens
  misc_feature: GYAE6OF01BFK5N.29.35.D02.1.454.CMB.1.raw
  modified_base (499)..(499): a, c, t, g, unknown or other
  misc_feature (499)..(499): n is a, c, g, or t
tcagatagagtactcacgaccggtgctcgatttagcacacgatagttgggtttgggggaggaactgctcagttaggacccagacggaaccatggaagccccagctcagcttctcttcctcctgctactctggctcccagataccagcggagagattgtgttgacacagtctccagccaccctgtctttgtctccgggagaaagagccaccctctcctgcagggccagtcagagtgttaacaactacttggcctggttccaacagaaacctggccaggctcccaggctctcatctatgatgcatccaacagggccactggcatcccagccaggttcagtggcagtgggtctggggacagacttcactctcaccatcagccgcctagagcctgaggattctgtccgtttattattgtcttgggcgtagcaactgcctccgtcactttggccagggaccaagctggagagtcagacgaatggtggctgcaccatctgtcttntac

SEQ ID NO: 277007 - DNA, 502 bp, Homo sapiens
  misc_feature: GYAE6OF01AIIT5.29.35.D02.1.454.CMB.1.raw
tcagatagagtactcacgaccggtgctcgatttagcacacgatagttgggtttggggaggaactgctcagttaggacccagacggaaccatggaagccccagctcagcttctcttcctcctgctactctggctcccagataccagcggagagattgtgttgacacagtctccagccaccctgtctttgtctccgggagaaagagccaccctctcctgcagggccagtcagagtgttaacaactacttggcctggttccaacagaaacctggccaggctcccaggctcctcatctatgatgcatccaacagggccactggcatcccagccaggttcagtggcagtgggtctgggacagacttcactctcaccatcagccgcctagagcctgaggattctgtccgtttattattgtcgttggcgtagcactcggcctccgtctacgtttggccagggaccagctggagatcagcgaactgtggctgctaccatctgtcttctac

SEQ ID NO: 277008 - DNA, 767 bp, Homo sapiens
  misc_feature: GYAE6OF01C0VKH.29.35.D02.1.454.CMB.1.raw
  modified_base (224)..(224): a, c, t, g, unknown or other
  misc_feature (224)..(224): n is a, c, g, or t
  modified_base (268)..(268): a, c, t, g, unknown or other
  misc_feature (268)..(268): n is a, c, g, or t
tcagatagagtactcacgaccggtgctcgatttagcacacgatagtgggttggggaggactgctcagttaggacccagacggaaccatggaaacgcccagctcagtcttctcttcctcctgctactcgtggcctccgagataccaagcggagaagtattgtgtcgacacagtcaccgagccctacctgttcttgtccaccggggaagaaagcgcccacctctcngcaggccagtcaagagtataacaatacttggacctggtaccaanacgtaaaccgtggaccaggctaccgacggctccctacgactcctaagttcgaatcgactaatccgaaacgaggggccccaacgtagggacccaacgtcccgaacgccgtaacggttacaacggtacgggtacctaaaggggttcggggtacctagggggaacgtacggtacggtttaaccaaacgttccttaccgaaacctacttaccgaacgacccgtaccgttaagacgaccgttaggaacgggtactttacgtacggtaaccggttttaatttaacgttcgttacggtttacgggtacgttaacgtacgtaaaccgttcgggaccccttaccggttacgttaaccgttttacgggacccgtaacggggtaaccctaaggtccggttagggacgtaaacggtaccggtaaacgggtaaacggtaaacgttacgggtaacgggtaccgtcggtaacgtaacccgttacgtaccgtaacggttaaccttcgttaacccg

SEQ ID NO: 277009 - DNA, 506 bp, Homo sapiens
  misc_feature: GYAE6OF01CTUEN.29.35.D02.1.454.CMB.1.raw
  modified_base (204)..(204): a, c, t, g, unknown or other
  misc_feature (204)..(204): n is a, c, g, or t
  modified_base (261)..(261): a, c, t, g, unknown or other
  misc_feature (261)..(261): n is a, c, g, or t
  modified_base (356)..(356): a, c, t, g, unknown or other
  misc_feature (356)..(356): n is a, c, g, or t
  modified_base (496)..(496): a, c, t, g, unknown or other
  misc_feature (496)..(496): n is a, c, g, or t
tcagatagagtactcacgaccggtgctcgatttagcacacgatagttgggtttgggggaggaactgctcagttaggacccagacggaaccatggaagccccagctcagcttctcttcctcctgctactctggctcccagataccagcggagagattgtgttgacacagtctccagccaccctgtctttgtctccgggagaaagngccaccctctcctgcagggccagtcagagtgttaacactacttggcctggttccaanagaaacctggccaggctcccaggctcctcatctatgatgcatccaacagggccactggcatcccagccaggttcagtggcagtgggtctgggacngacttcactctcaccatcagccgcctagacgcctgaggtattctgtcccgtttattattgtcttgggtcgtagcaactggcctcccgtctactttggccaggggaccagctggagatcagacgatggtcgctgcaccatntgtcttctac

SEQ ID NO: 277010 - DNA, 512 bp, Homo sapiens
  misc_feature: GYAE6OF01DGWW9.29.35.D02.1.454.CMB.1.raw
tcagatagagtactcacgaccggtgctcgatttagcacacgatagttgggtttgggggaggaactgctcagttaggacccagacggaaccatggaagccccagctcagcttctcttcctcctgctactctggctcccagataccagcggagagattgtgttgacacagtctccagccaccctgtctttgtctccgggagaaagagccaccctctcctgcagggccagtcagagtgttaacaactacttggcctggttccaacagaaacctggccaggctcccaggctcctcatctatgatgcatccaacagggccactggcatcccagccaggttcagtggcagtgggtctgggacagacttcactctcacatcagccgcctagagcctgaggtattctgtccgtttattattgttcttgggtcgtagctaacgtggcctcccgtctacgtttggccgacggggaccagcgtggagatcagacgactgtggctgctaccatctgtcttctac

SEQ ID NO: 277011 - DNA, 261 bp, Homo sapiens
  misc_feature: GYAE6OF01CORZI.29.35.D02.1.454.CMB.1.raw
  modified_base (259)..(261): a, c, t, g, unknown or other
  misc_feature (259)..(261): n is a, c, g, or t
tcagatagagtactcacgaccggtgctcgatttagcacacgatagttgggtttgggacagacttcactctcaccatcagccgcctagagcctgaggattctgccgtttattagttgtcttgggcgtagcaacgtggcctcccgtcacttttggccaggggaccaagctggagatcagacgaactgtggctgcaccatctgtcttcatcttcccgccatcgtgaagtactctatctgagcgggctggcaaggcgcatagnnn

SEQ ID NO: 277012 - DNA, 514 bp, Homo sapiens
  misc_feature: GYAE6OF01B03VS.29.35.D02.1.454.CMB.1.raw
  modified_base (309)..(309): a, c, t, g, unknown or other
  misc_feature (309)..(309): n is a, c, g, or t
tcagatagagtactcacgaccggtgctcgatttagcacacgatagttgggtttggggaggaactgctcagttaggacccagacggaaccatggaagccccagctcagcttctcttcctcctgctactctggctcccagataccagcggagagattgtgttgacacagtctccagccaccctgtctttgtctccgggagaaagagccaccctctcctgcagggccagtcagagtgttaacaactacttggcctggttccaacagaaacctggccaggctcccaggctcctcatctatgatgcatccaacngggccactggcatcccagccaggttcagtggcagtgggtctgggacagacttcactctcaccatcagccgcctagagcctgaggattctgtccgtttattattgtcgttgggcgtagcaacgtggcctcccgtctacgtttcggccgtaggggaccaggcgtaggagatcgagacgtatggtggctgctacatctgtcttctacg

SEQ ID NO: 277013 - DNA, 544 bp, Homo sapiens
  misc_feature: GYAE6OF01ENP9X.29.35.D02.1.454.CMB.1.raw
tcagatagagtactcacgaccggtgctcgatttagcacacgatagttgggtttgggggaggaactgctcagttaggacccagacggaaccatggaagccccagctcagcttctcttcctcctgctactctggctcccagataccagcggagagattgtgttgacacagtctccagccaccctgtctttgtctccgggagaaagagccaccctctcctgcagggccagtcagagtgttaacaactacttggcctggttccaacagaaacctggccaggctcccaggctcctcatctatgatgcatccaacagggccactggcatccccagccaggttcagtggcaggtgggtctgggacagacttcactctcaccatcagccgcctagacgcctgaggattctcgtccgtttattattgttcgttgggtcgtagcaactcggccctcccgtcgtaccgttttcggccgtacggggaccaacggcgtcggagagtacgaggaccgtaaacgtggtcggcgtgccaccgtatctcgttcttctaccg

SEQ ID NO: 277014 - DNA, 566 bp, Homo sapiens
  misc_feature: GYAE6OF01CO32P.29.35.D02.1.454.CMB.1.raw
tcagatagagtactcacgaccggtgctcgatttagcacacgatagttgggtttgggggaggaactgctcagttaggacccagacggaaccatggaagccccagctcagcttctcttcctcctgctactctggctcccagataccagcggagagattgtgttgacacagtctccagccaccctgtctttgtctccgggagaaagagccaccctctcctgcagggccagtcaagagtgttaacaactacttggcctggttccaacagaaacctggccaggctccaggctctcatctatgatgcatccaacagggccactggcatcccagccaggtcagtgcagtgggctgggacagacttcactctacaccatcagcccgactagagcctaggaggtattctacgtccgtttatttacttgtcgttgggcgttagctaacgtcggcccttcccggttctaaccgttttcgggacccgtaaggggtaacccaagggtccttagggacgattccaagggtaccgaagtggtggaccgttggacctaaccattcttcgtcctttcgtaccg

SEQ ID NO: 277015 - DNA, 513 bp, Homo sapiens
  misc_feature: GYAE6OF01EIWK2.29.35.D02.1.454.CMB.1.raw
  modified_base (504)..(504): a, c, t, g, unknown or other
  misc_feature (504)..(504): n is a, c, g, or t
tcagatagagtactcacgaccggtgctcgatttagcacacgatagttgggtttgggggaggaactgctcagttaggacccagacggaaccatggaagccccagctcagcttctcttcctcctgctactctggctcccagataccagcggagagattgtgttgacacagtctccagccaccctgtctttgtctccgggagaaagagccaccctctcctgcagggccagtcagagtgttaacactacttggcctggtccaacagaaacctggccaggctcccaggctcctcatctatgatgcatccaacagggccactggcatcccagccaggttcagtggcagtgggtctgggacagacttcactctcaccatcagccgcctagacgcctgagattctgtccgtttattattgttcgttgggcgtagctaacgtggccctcccgtctacgttttggcctaggggaccagtcgtaggagactcagacgtaatggtggctgcacatntgtctgtac

SEQ ID NO: 277016 - DNA, 514 bp, Homo sapiens
  misc_feature: GYAE6OF01CBQYM.29.35.D02.1.454.CMB.1.raw
tcagatagagtactcacgaccggtgctcgatttagcacacgatagttgggtttgggggaggaactgctcagttaggacccagacggaaccatggaagccccagctcagcttctcttcctcctgctactctggctcccagataccagcggagagattgtgttgacacagtctccagccaccctgtctttgtctccgggagaaagagccaccctctcctgcagggccagtcagagtgttaacaactacttggcctggttccaacagaaacctggccaggctcccaggctcctcatctatgatgcatccaaacagggccactggcatcccagccaggttcagtggcagtgggtctgggacagacttcactctcaccatcagccgcctagacgcctgaggtattctgtccgtttattattgtcgttgggtcgtagcaacgtcggcctcccgtctactttcggccaggggaccagcgtggagatcgagacgactggtgctgcaccatctcgtcttctac

SEQ ID NO: 277017 - DNA, 501 bp, Homo sapiens
  misc_feature: GYAE6OF01BDLQH.29.35.D02.1.454.CMB.1.raw
tcagatagagtactcacgaccggtgctcgatttagcacacgatagttgggtttggggaggaactgctcagttaggacccagacggaaccatggaagccccagctcagcttctcttcctcctgctactctggctcccagataccagcggagagattgtgttgacacagtctccagccaccctgtctttgtctccgggagaaagagccaccctctcctgcagggccagtcagagtgttaacaactacttggcctggttccaacagaaacctggccaggctcccaggctcctcatctatgatgcatccaacagggccactggcatcccagccaggttcagtggcagtgggtctgggacagacttcactctcaccatcagccgcctagagcctgaggattctgccgtttattattgtcttgggcgtagcaactggcctcccgtcactttggccaggggaccagctggagatcagacgaactgtggctgcaccatctgtcttctac

SEQ ID NO: 277018 - DNA, 530 bp, Homo sapiens
  misc_feature: GYAE6OF01B56OZ.29.35.D02.1.454.CMB.1.raw
tcagatagagtactcacgaccggtgctcgatttagcacacgatagttgggtttgggggaggaactgctcagttaggacccagacggaaccatggaagccccagctcagcttctcttcctcctgctactctggctcccagataccagcggagagattgtgttgacacagtctccagccaccctgtctttgtctccgggagaaagagccaccctctcctgcagggccagtcagagtgttaacaactacttggcctggttccaacagaaacctggccaggctcccaggctcctcatctatgatgcatccaacgagggccacgtggcactcccagccaggttcagtggcaggtgggtctgggacagacttcactctcaccatcacgccgcctagacgctgagtattctcgtcgtttattattgtcgttggcgtagctaacgtcggtcctcccgtctacgtttcggccgtacggggaccagcgtggagagtacgagacgtaagtggtcgcgtgccgacactctcgttcttctacg

SEQ ID NO: 277019 - DNA, 510 bp, Homo sapiens
  misc_feature: GYAE6OF01C3ZW3.29.35.D02.1.454.CMB.1.raw
  modified_base (478)..(478): a, c, t, g, unknown or other
  misc_feature (478)..(478): n is a, c, g, or t
  modified_base (500)..(500): a, c, t, g, unknown or other
  misc_feature (500)..(500): n is a, c, g, or t
  modified_base (502)..(502): a, c, t, g, unknown or other
  misc_feature (502)..(502): n is a, c, g, or t
tcagatagagtactcacgaccggtgctcgatttagcacacgatagttgggtttgggggaggaactgctcagttaggacccagacggaaccatggaagccccagctcagcttctcttcctcctgctactctggctcccagataccagcggagagattgtgttgacacagtctccagccaccctgtctttgtctccgggagaaagagccaccctctcctgcagggccagtcagagtgttaacaactacttggcctggttccaacagaaacctggccaggctcccaggctcctcatctatgatgcatccaacagggccactggcatcccagccaggttcagtggcagtgggctgggacagacttcactctcacatcagccgcctagacgcctgaggtattctgtccgtttattattgttcgttgggtcgtagcaacgtcggcctcccgtctacgtttggccgtagggaccagctggagatnagacgaatgtggctgcaccatntntcttctac

SEQ ID NO: 277020 - DNA, 540 bp, Homo sapiens
  misc_feature: GYAE6OF01BHGQE.29.35.D02.1.454.CMB.1.raw
tcagatagagtactcacgaccggtgctcgatttagcacacgatagttgggtttgggggaggaactgctcagttaggacccagacggaaccatggaagccccagctcagcttctcttcctcctgctactctggctcccagataccagcggagagattgtgttgacacagtctccagccaccctgtctttgtctccgggagaaagagccaccctctcctgcagggccagtcagagtgttaacaactacttggcctggttccaacagaaacctggccaggctcccaggctcctcatctatgatgcatccaacagggccactggcatcccagccaggtcagtggcagtgggtctgggacagactcactctcaccatcagccgcctagacgcctgaggtattcgtgtccgtttattatttgttcgtttgggcgtagctaacgtcggcccttcccgtctaccgttttcggccgtacggggaccaacggcgtggagtatcgagtatagaaacgtggtggcgtcgccacctatcgttgttccttaccg

SEQ ID NO: 277021 - DNA, 506 bp, Homo sapiens
  misc_feature: GYAE6OF01AD7FC.29.35.D02.1.454.CMB.1.raw
  modified_base (490)..(490): a, c, t, g, unknown or other
  misc_feature (490)..(490): n is a, c, g, or t
  modified_base (499)..(500): a, c, t, g, unknown or other
  misc_feature (499)..(500): n is a, c, g, or t
tcagatagagtactcacgaccggtgctcgatttagcacacgatagttgggtttggggggaactgctcagttaggacccagacggaaccatggaagccccagctcagcttctcttcctcctgctactctggctcccagataccagcggagagattgtgttgacacagtctccagccaccctgtctttgtctccgggagaaagagccaccctctcctgcagggccagtcagagtgtaacaactacttggcctggttccaacagaaacctggccaggctcccaggctcctcatctatgatgcatccaacagggccactggcatcccagccaggttcagtggcagtgggtctgggacagacttcactctcaccatcagccgcctagagcctgaggattctgtccgttttattattgttcttgggcgtagcaactcggcctccgtcactttggccgagggaccaagctggagatcagacgactgtggctgcactntctgtcttnnttcccg

SEQ ID NO: 277022 - DNA, 507 bp, Homo sapiens
  misc_feature: GYAE6OF01AM8P3.29.35.D02.1.454.CMB.1.raw
  modified_base (500)..(500): a, c, t, g, unknown or other
  misc_feature (500)..(500): n is a, c, g, or t
tcagatagagtactcacgaccggtgctcgatttagcacacgatagttgggtttgggggaggaactgctcagttaggacccagacggaaccatggaagccccagctcagcttctcttcctcctgctactctggctcccagataccagcggagagattgtgttgacacagtctccagccaccctgtctttgtctccgggagaaagagccaccctctcctgcagggccagtcagagtgttaacaactacttggcctggttccaacagaaacctggccaggctcccaggctcctcatctatgatgcatccaacagggccactggcatcccagccaggttcagtggcagtgggtctgggacagacttcactctcaccatcagccgcctagagcctgagattctgtccgtttattattgtcgttggcgtagcaacgtcggcctcccgtctacgtttcggccgaggggacccagcgtggagagtcagacgatgtggctgcacatctntctctac

SEQ ID NO: 277023 - DNA, 506 bp, Homo sapiens
  misc_feature: GYAE6OF01BE7LR.29.35.D02.1.454.CMB.1.raw
  modified_base (199)..(199): a, c, t, g, unknown or other
  misc_feature (199)..(199): n is a, c, g, or t
  modified_base (204)..(204): a, c, t, g, unknown or other
  misc_feature (204)..(204): n is a, c, g, or t
  modified_base (262)..(262): a, c, t, g, unknown or other
  misc_feature (262)..(262): n is a, c, g, or t
  modified_base (497)..(497): a, c, t, g, unknown or other
  misc_feature (497)..(497): n is a, c, g, or t
  modified_base (503)..(503): a, c, t, g, unknown or other
  misc_feature (503)..(503): n is a, c, g, or t
tcagatagagtactcacgaccggtgctcgatttagcacacgatagttgggtttgggggaggaactgctcagttaggacccagacggaaccatggaagccccagctcagcttctcttcctcctgctactctggctcccagataccagcggagagattgtgttgacacagtctccagccaccctgtctttgtctccggganaaagngccaccctctcctgcagggccagtcagagtgttaaacactacttggcctggttccaanagaaacctggccaggctcccaggctcctcatctatgatgcatccaacagggccactggcatcccagccaggttcagtgcagtgggtctgggacagacttcactctcaccatcagccgctagacgcctgagattctgtccgtttattattgtcttgggcgtagcaactcggcctcccgtctactttcggaccagggaccaggctggagagtacgagtacgaatgtggctgcacatntctctntac

SEQ ID NO: 277024 - DNA, 571 bp, Homo sapiens
  misc_feature: GYAE6OF01DEKFG.29.35.D02.1.454.CMB.1.raw
  modified_base (260)..(260): a, c, t, g, unknown or other
  misc_feature (260)..(260): n is a, c, g, or t
tcagatagagtactcacgaccggtgctcgatttagcacacgatagttgggtttgggggaggaactgctcagttaggacccagacggaaccatggaagccccagctcagcttctcttcctcctgctactctggctcccagataccagcggagagattgtgttgacacagtctccagccaccctgtctttgtctccgggagaaagagccaccctctcctgcagggccagtcagagtgttaacactactggcctggttccaanagaaacctggccaggctcccaggctcctcatctatgatgcatccaacagggccactggcatcccagcccaggttccagtggcaggtgggtctgggacaggacttcactctcaccatcagccgcctagagcctgaggtattcgtgtcccgtttatttagtttgttcgttgggtcgtagcctaaccgtcggtacccttccccggttcttaccgtttttcgggcccgtaacggggaccctaacggcgttacgggagtacgtaccgaggaacgtaacgtggtggacctgacctaccattcttcgtccttcgtacc

SEQ ID NO: 277025 - DNA, 537 bp, Homo sapiens
  misc_feature: GYAE6OF01DQJNK.29.35.D02.1.454.CMB.1.raw
  modified_base (310)..(310): a, c, t, g, unknown or other
  misc_feature (310)..(310): n is a, c, g, or t
tcagatagagtactcacgaccggtgctcgatttagcacacgatagttgggtttgggggaggaactgctcagttaggacccagacggaaccatggaagccccagctcagcttctcttcctcctgctactctggctcccagataccagcggagagattgtgttgacacagtctccagccaccctgtctttgtctccgggagaaagagccaccctctcctgcagggccagtcagagtgttaacaactacttggcctggttccaacagaaacctggccaggctcccaggctcctcatctatgatgcatccaacngggccactggcactcccagccaggttcagtggcaggtgggtctgggacagacttcactctcaccatcagccgcctagacgcctgaggtattctgtccgttttattatttgttcgttgggtcgttagcgtaacgtcggtcccttcccgtcgtaccgttttcggaccgtacggggacccaggtcgtggagatacgagacgtaatggtggctgcaccatctgtcttctac

SEQ ID NO: 277026 - DNA, 552 bp, Homo sapiens
  misc_feature: GYAE6OF01DYRX1.29.35.D02.1.454.CMB.1.raw
  modified_base (310)..(310): a, c, t, g, unknown or other
  misc_feature (310)..(310): n is a, c, g, or t
tcagatagagtactcacgaccggtgctcgatttagcacacgatagttgggtttgggggaggaactgctcagttaggacccagacggaaccatggaagccccagctcagcttctcttcctcctgctactctggctcccagataccagcggagagattgtgttgacacagtctccagccaccctgtctttgtctccgggagaaagagccacctctcctgcagggccagtcagagtgttaacaactacttggcctggttaccaacagaaacctggccaggctcccaggctcctcatctatgatgcatccaacngggccacgtcggcactcccagccaggttcagtggcaggtgggtctgggacagcttcactctcaccatccagccgctagacgctgaggtattcgtgtccgtttattagttgttcgttgggcgtagtctaacgtcggtcccttcccgtctaccgttttcggaccgtacggggaccaaggcgtaggacgtacgtacgaggaccgtaagtggtcggactcgcctaccatccttcgttcttctaccg

SEQ ID NO: 277027 - DNA, 505 bp, Homo sapiens
  misc_feature: GYAE6OF01D8KPS.29.35.D02.1.454.CMB.1.raw
  modified_base (496)..(496): a, c, t, g, unknown or other
  misc_feature (496)..(496): n is a, c, g, or t
tcagatagagtactcacgaccggtgctcgatttagcacacgatagttgggtttggggaggaactgctcagttaggacccagacggaaccatggaagccccagctcagcttctcttcctcctgctactctggctcccagataccagcggagagattgtgttgacacagtctccagccaccctgtctttgtctccgggagaaagagccaccctctcctgcagggccagtcagagtgttaacaactacttggcctggttccaacagaaacctggccaggctcccaggctcctcatctatgatgcatccaacagggccactggcatcccagccaggttcagtggcagtgggtctgggacagcttcactctcaccatcagccgcctagagcctgaggattctgtccgtttattattgtcttggtcgtagcaactcggcctccgtctacttttggcctaggggaccaagcgtggagatacagacgaatggtgctgctacatntgtctctac

SEQ ID NO: 277028 - DNA, 522 bp, Homo sapiens
  misc_feature: GYAE6OF01DCB13.29.35.D02.1.454.CMB.1.raw
  modified_base (263)..(263): a, c, t, g, unknown or other
  misc_feature (263)..(263): n is a, c, g, or t
  modified_base (513)..(513): a, c, t, g, unknown or other
  misc_feature (513)..(513): n is a, c, g, or t
  modified_base (518)..(518): a, c, t, g, unknown or other
  misc_feature (518)..(518): n is a, c, g, or t
tcagatagagtactcacgaccggtgctcgatttagcacacgatagttgggtttgggggaggaactgctcagttaggacccagacggaaccatggaagccccagctcagcttctcttcctcctgctactctggctcccagataccagcggagagattgtgttgacacagtctccagccaccctgtctttgtctccgggagaaagagccaccctctcctgcagggccagtcagagtgttaacaactacttggcctggttccaaanagaaacctggccaggctcccaggctcctcatctatgatgcatccaacagggccactggcatcccagccaggttcagtggcaggtgggtctgggacagacttcactctcacatcagccgcctagacgcctgaggtattctcgtccgtttatttagttgttcgttgggtcgtagtctaacgtcggtcctcccgtctacgtttgccgtagggaccagcgtggagatcgagacgatggtggcgtgctacatctntcttntacc

SEQ ID NO: 277029 - DNA, 522 bp, Homo sapiens
  misc_feature: GYAE6OF01ACSVJ.29.35.D02.1.454.CMB.1.raw
tcagatagagtactcacgaccggtgctcgatttagcacacgatagttgggtttgggggaggaactgctcagttaggacccagacggaaccatggaagccccagctcagcttctcttcctcctgctactctggctcccagataccagcggagagattgtgttgacacagtctccagccaccctgtctttgtctccgggagaaagagccaccctctcctgcagggccagtcagagtgttaaacaactacttggcctggttccaaacagaaacctggccaggctcccaggctcctcatctatgatgcatccaacagggccactggcatcccagccaggttcagtggcaggtggtctgggacagacttcactctcaccatcacgccgcctagacgcctgagtattctcgtccgtttattattgtcgttgggtcgtagcaacgtcggcctcccgtctacgtttcggccgtacgggaccagcgtaggagatcgagacgaactggtcggctgcacatctcgttctctac

SEQ ID NO: 277030 - DNA, 651 bp, Homo sapiens
  misc_feature: GYAE6OF01DBN7V.29.35.D02.1.454.CMB.1.raw
tcagatagagtactcacgaccggtgctcgatttagcacacgatagttgggtttgggggaggaactgctcagttaggacccagacggaaccatggaagcccagctcagcttctcttcctcctgctactctggctcccagataccagcggagagatttgtgttgacacagtctccagccaccctgtctttgtcgtccggagaaagacgccaccctctcctgcagggccagtcagtagttgttaaccaactacgttggccttggttaccaacgagaaacctcggccaggcctcccaggctcctcactctatgatcgactactacccaacggacgggaccacggtcgacacctaccgacgaccgtaggttaccgaggtcggcgtagggttcgggttcggtacgggaacgtaacggttacctaccgtacctcctacccaaccgtactacggacccggcccgtaagtacggaccgtcgtaagggtacgtttacttcggtcggttttactttagtttacgttcgtttcgggtcggttacgcgtacctacggtccgttcccgtccgtacgttttcggttaccgcgggtaacgacgacgttggagacgtcaggacgactaggtcggctcgcaccctatcttacggttcttcgtcttcccg

SEQ ID NO: 277031 - DNA, 587 bp, Homo sapiens
  misc_feature: GYAE6OF01CNC4R.29.35.D02.1.454.CMB.1.raw
tcagatagagtactcacgaccggtgctcgatttagcacacgatagttgggtttgggggaggaactgctcagttaggacccagacggaaccatggaagccccagctcagcttctcttcctcctgctactctggctcccagataccagcggagagattgtgttgacacagtctccagccaccctgtctttgtctccgggagaaagacgccaccctctcctgcagggccagtcagagtgttaacaactacttggcctggttaccaacagaaacctggccaggctcccgggctccgtcatctatgatgcatccaacgaggccactggcatcccagccaggttcaggtggcagtgggtctgggacagacttcactctcaccatcagccgcctagacgccgtagaggtacttcgtcgttccgtttatttagtttcgttcgttgggtcgtacgtctaacgttcggtcccttcccgtccgttacgttttcgggccgtacggggacctaaggcgtacggagtactcgtaagaacggtaacgtggtacggcgttcgacctacccgtacgttcgttagtttccttcgtactttccccg

SEQ ID NO: 277032 - DNA, 509 bp, Homo sapiens
  misc_feature: GYAE6OF01A6MKS.29.35.D02.1.454.CMB.1.raw
  modified_base (500)..(500): a, c, t, g, unknown or other
  misc_feature (500)..(500): n is a, c, g, or t
tcagatagagtactcacgaccggtgctcgatttagcacacgatagttgggtttgggggaggaactgctcagttaggacccagacggaaccatggaagccccagctcagcttctcttcctcctgctactctggctcccagataccagcggagagattgtgttgacacagtctccagccaccctgtctttgtctccgggagaaagagccaccctctcctgcagggccagtcagagtgttaacaactacttggcctggttccaacagaaacctggccaggctcccaggctcctcatctatgatgcatccaacagggccactggcatcccagccaggttcagtggcagtgggtctgggacagactcactctcaccatcagccgcctagacgcctgaggattctgtccgtttattattgtcgttgggcgtagcaacgtggtcctccgtctacgtttcggccgtagggaccagcgtggagatcgagacgatggtggctgacacatntgtctctac

SEQ ID NO: 277033 - DNA, 564 bp, Homo sapiens
  misc_feature: GYAE6OF01CQCND.29.35.D02.1.454.CMB.1.raw
  modified_base (202)..(202): a, c, t, g, unknown or other
  misc_feature (202)..(202): n is a, c, g, or t
  modified_base (314)..(314): a, c, t, g, unknown or other
  misc_feature (314)..(314): n is a, c, g, or t
tcagatagagtactcacgaccggtgctcgatttagcacacgatagttgggtttgggggaggaactgctcagttaggacccagacggaaccatggaagccccagctcagcttctcttcctcctgctactctggctccagataccagcggagagattgtgttgacacagtctccagccacctgtctttgtctccgggagaaagngccaccctctcctgcgaggggccgtcagagtgttaaacactacttggcctggttaccaaacagaaacctggccaggctccgaggctcctcatctatgatgacatccaaacgngggccagtcggcactccccagccctaagggttcaggtggcaggtcgggtctgggacagtacttcacttctcaaccatcacgccgcctagacgccgtgagtacttcgtcgtaccgtttattagttgttcgttggtcgtacgcgacgtcgccttccgtctacgtttcggaccgtacgggacgaacgcgtaggagacgtcgaacgaacgtaacgtggtcggctcgcaccgtcttctgttccttctacttcccg

SEQ ID NO: 277034 - DNA, 513 bp, Homo sapiens
  misc_feature: GYAE6OF01B0NFF.29.35.D02.1.454.CMB.1.raw
tcagatagagtactcacgaccggtgctcgatttagcacacgatagttgggtttgggggaggaactgctcagttaggacccagacggaaccatggaagccccagctcagcttctcttcctcctgctactctggctcccagataccagcggagagattgtgttgacacagtctccagccaccctgtctttgtctccgggagaaagagccaccctctcctgcagggccagtcagagtgttaacaactacttggcctggttccaacagaaacctggccaggctcccaggctcctcatctatgatgcatccaacagggccactggcatcccagccaggttcagtggcagtgggtctgggacagacttcactctcaccatcagccgcctagagcctgaggattctgtccgtttattattgttcgttgggcgtagctaacgtcggccctccgtctacgtttcggccgtacgggaccagcgtggagatacgagacgatggtggctgcacatctgtctctac

SEQ ID NO: 277035 - DNA, 545 bp, Homo sapiens
  misc_feature: GYAE6OF01AEVPV.29.35.D02.1.454.CMB.1.raw
  modified_base (310)..(310): a, c, t, g, unknown or other
  misc_feature (310)..(310): n is a, c, g, or t
tcagatagagtactcacgaccggtgctcgatttagcacacgatagttgggtttgggggaggaactgctcagttaggacccagacggaaccatggaagccccagctcagcttctcttcctcctgctactctggctcccagataccagcggagagattgtgttgacacagtctccagccaccctgtctttgtctccgggagaaagagccaccctctcctgcagggccagtcagagtgttaacaactacttggcctggttccaacagaaacctggccaggctcccaggctcctcatctatgatgcatccaacngggccactggcatcccagccaggttcagtggcaggtgggtctgggacagacttcactctcaccatcagccgcctagacgcctgaggattcgtgtccgtttattattgtcgttgggtcgtagctaacgtcggtcctcccgtctacgtttcggccgtacggggaccagcgtaggacgtacgtcgacgtacgtaacgtggtcggtcgtcgactaccgtacttctcgttcttcgtaccg

SEQ ID NO: 277036 - DNA, 498 bp, Homo sapiens
  misc_feature: GYAE6OF01BVKEU.29.35.D02.1.454.CMB.1.raw
  modified_base (310)..(310): a, c, t, g, unknown or other
  misc_feature (310)..(310): n is a, c, g, or t
tcagatagagtactcacgaccggtgctcgatttagcacacgatagttgggtttgggggaggaactgctcagttaggacccagacggaaccatggaagccccagctcagcttctcttcctcctgctactctggctcccagataccagcggagagattgtgttgacacagtctccagccaccctgtctttgtctccgggagaaagagccaccctctcctgcagggccagtcagagtgttaacaactacttggcctggttccaacagaaacctggccaggctcccaggctcctcatctatgatgcatccaacngggccactggcatcccagccaggttcagtgcagtgggtctgggacagacttcactctcaccatcagccgcctagagcctgaggattctgccgtttattattgtcttgggcgtagcaacgtgcctccgtcacgtttggccagggaccagctggagatcagacgaatggtgctgcacatctgtcttctac

SEQ ID NO: 277037 - DNA, 498 bp, Homo sapiens
  misc_feature: GYAE6OF01CRKLD.29.35.D02.1.454.CMB.1.raw
  modified_base (197)..(197): a, c, t, g, unknown or other
  misc_feature (197)..(197): n is a, c, g, or t
  modified_base (202)..(202): a, c, t, g, unknown or other
  misc_feature (202)..(202): n is a, c, g, or t
  modified_base (261)..(261): a, c, t, g, unknown or other
  misc_feature (261)..(261): n is a, c, g, or t
  modified_base (306)..(306): a, c, t, g, unknown or other
  misc_feature (306)..(306): n is a, c, g, or t
  modified_base (348)..(348): a, c, t, g, unknown or other
  misc_feature (348)..(348): n is a, c, g, or t
  modified_base (376)..(376): a, c, t, g, unknown or other
  misc_feature (376)..(376): n is a, c, g, or t
  modified_base (489)..(489): a, c, t, g, unknown or other
  misc_feature (489)..(489): n is a, c, g, or t
tcagatagagtactcacgaccggtgctcgatttagcacacgatagttgggtttggggaggaactgctcagttaggacccagacggaaccatggaagccccagctcagcttctcttcctcctgctactctggctccagataccagcggagagattgtgttgacacagtctccagccaccctgtctttgtctccggganaaagngccacctctcctgcagggccagtcagagtgttaacaactacttggcctggttaccaaanagaaacctggccaggctccaggctctcatctatgatgcatccaanggcactgcatcccagccaggtcagtggcagtggtctgggacngacttcactctcaccatcagccgctagngcctgaggtattctgtccgtttaattagttgtcgttgggcgtagcaacgtggcctccgtctacgtttggcctagggactaagctggagagtcagacgaactgtgctgcacatntgtctgtac

SEQ ID NO: 277038 - DNA, 512 bp, Homo sapiens
  misc_feature: GYAE6OF01DPSXR.29.35.D02.1.454.CMB.1.raw
  modified_base (310)..(310): a, c, t, g, unknown or other
  misc_feature (310)..(310): n is a, c, g, or t
tcagatagagtactcacgaccggtgctcgatttagcacacgatagttgggtttgggggaggaactgctcagttaggacccagacggaaccatggaagccccagctcagcttctcttcctcctgctactctggctcccagataccagcggagagattgtgttgacacagtctccagccaccctgtctttgtctccgggagaaagagccaccctctcctgcagggccagtcagagtgttaacaactacttggcctggttccaacagaaacctggccaggctcccaggctcctcatctatgatgcatccaacngggccactggcatcccagccaggttcagtggcagtgggtctgggacagacttcactctcaccatcagccgcctagagcctgagattctgtccgtttattattgtcgttgggtcgtagctaactggcctcccgtctacgtttcggccgaggggaccaagcgtggagatacagacgaatgtggctgcaccattctcgtctctac

SEQ ID NO: 277039 - DNA, 257 bp, Homo sapiens; identical to SEQ ID NO: 276983
  misc_feature: GYAE6OF01AZ2TC.29.35.D02.1.454.CMB.1.raw
  modified_base (256)..(257): a, c, t, g, unknown or other
  misc_feature (256)..(257): n is a, c, g, or t

SEQ ID NO: 277040 - DNA, 521 bp, Homo sapiens
  misc_feature: GYAE6OF01CO1R9.29.35.D02.1.454.CMB.1.raw
  modified_base (261)..(261): a, c, t, g, unknown or other
  misc_feature (261)..(261): n is a, c, g, or t
  modified_base (356)..(356): a, c, t, g, unknown or other
  misc_feature (356)..(356): n is a, c, g, or t
tcagatagagtactcacgaccggtgctcgatttagcacacgatagttgggtttgggggaggaactgctcagttaggacccagacggaaccatggaagccccagctcagcttctcttcctcctgctactctggctccagataccagcggagagattgtgttgacacagtctccagccaccctgtctttgtctccgggagaaagagccaccctctcctgcagggccagtcagagtgttaacaactacttggcctggttccaanagaaacctggccaggctccaggctcctcatctatgatgcatccaacagggccactggcatccccagccaggttcagtggcagtgggtctgggacngacttcactctcaccatcacgccgcctagacgctgagattcgtgtccgtttattagttgttcgttggtcgtagctaacgtcggtcctccgtctacgtttcggccgtaggggaccagcgtaggagatcgacgaacgaagtggtggctgcaccatctgtcttctacg

SEQ ID NO: 277041 - DNA, 525 bp, Homo sapiens
  misc_feature: GYAE6OF01ATRKW.29.35.D02.1.454.CMB.1.raw
  modified_base (358)..(358): a, c, t, g, unknown or other
  misc_feature (358)..(358): n is a, c, g, or t
tcagatagagtactcacgaccggtgctcgatttagcacacgatagttgggtttgggggaggaactgctcagttaggacccagacggaaccatggaagccccagctcagcttctcttcctcctgctactctggctcccagataccagcggagagattgtgttgacacagtctccagccaccctgtctttgtctccgggagaaagagccaccctctcctgcagggccagtcagagtgttaacaactacttggcctggttccaacagaaacctggccaggctcccaggctcctcatctatgatgcatccaacagggccactggcatcccagccaggttcagtggcaggtgggtctgggacngacttcactctcaccatcagccgcctagagcctgaggattctgtccgtttattattgttcttgggcgtaggcaacgtcggcctcccgttcgacgttttcggccgtacggggaccgagcgtggagagtcaggacgacgtgtcggctgctaccatctgtcgttctaccg

SEQ ID NO: 277042 - DNA, 542 bp, Homo sapiens
  misc_feature: GYAE6OF01CP7AZ.29.35.D02.1.454.CMB.1.raw
  modified_base (261)..(261): a, c, t, g, unknown or other
  misc_feature (261)..(261): n is a, c, g, or t
tcagatagagtactcacgaccggtgctcgatttagcacacgatagttgggtttggggaggaactgctcagttaggacccagacggaaccatggaagccccagctcagcttctcttcctcctgctactctggctcccagataccagcggagagattgtgttgacacagtctccagccaccctgtctttgtctccgggagaaagagccaccctctcctgcagggccagtcagagtgttaacaactacttggcctggttccaanagaaacctggccaggctcccaggctcctcatctatgatgcatccaacagggccactggcatcccagccaggttcagtggcaggtgggtctgggacagcttcactctcacatcacgccgcctagacgcctgagtattctgtccgtttattacgttgttcgttgggtcgttacgctaacgttcggtcccttcccgtctaccgttttcgggccgtacggggtaccaacggcgtaggagactcgaagacggtaatggtcggcgtgcctacatctcgtcttcgtac

SEQ ID NO: 277043 - DNA, 545 bp, Homo sapiens
  misc_feature: GYAE6OF01A0LVC.29.35.D02.1.454.CMB.1.raw
  modified_base (310)..(310): a, c, t, g, unknown or other
  misc_feature (310)..(310): n is a, c, g, or t
tcagatagagtactcacgaccggtgctcgatttagcacacgatagttgggtttgggggaggaactgctcagttaggacccagacggaaccatggaagccccagctcagcttctcttcctcctgctactctggctcccagataccagcggagagattgtgttgacacagtctccagccaccctgtctttgtctccgggagaaagagccaccctctcctgcagggccagtcagagtgttaacaactacttggcctggttccaacagaaacctggccaggctcccaggctcctcatctatgatgcatccaacngggccactggcatcccagccaggttcagtggcaggtgggtctgggacagacttcactctcaccatcacgccgcctagacgcctgaggtacttcgtcgtccgtttattagttgtcgttgggtcgtagctaacgtcggtccctcccgtctacgttttcggccgtacggggaccacgcgtggagtactacgacggacgtacgtggtcggctcgacctacctactctgttcttcgtacc

SEQ ID NO: 277044 - DNA, 518 bp, Homo sapiens
  misc_feature: GYAE6OF01B5LAX.29.35.D02.1.454.CMB.1.raw
tcagatagagtactcacgaccggtgctcgatttagcacacgatagttgggtttgggggaggaactgctcagttaggacccagacggaaccatggaagccccagctcagcttctcttcctcctgctactctggctcccagataccagcggagagattgtgttgacacagtctccagccaccctgtctttgtctccgggagaaagagccaccctctcctgcagggccagtcagagtgttaacaactacttggcctggttccaacagaaacctggccaggctcccaggctcctcatctatgatgcatccaacagggccactggcatcccagccaggttcagtggcagtgggtctgggacagacttcactctcaccatcagccgcctagagcctgaggattcgtgtccgtttattattgttcgttggtcgtagcaactcggcctcccgtctacgttttcggccgtaggggaccgagcgtggagagtacagacgaatggtggctgcaccatctcgtcttctac

SEQ ID NO: 277045 - DNA, 511 bp, Homo sapiens
  misc_feature: GYAE6OF01C9OKV.29.35.D02.1.454.CMB.1.raw
  modified_base (262)..(262): a, c, t, g, unknown or other
  misc_feature (262)..(262): n is a, c, g, or t
tcagatagagtactcacgaccggtgctcgatttagcacacgatagttgggtttgggggaggaactgctcagttaggacccagacggaaccatggaagccccagctcagcttctcttcctcctgctactctggctcccagataccagcggagagattgtgttgacacagtctccagccaccctgtctttgtctccgggagaaagagccaccctctcctgcagggccagtcagagtgttaacaactacttggcctggttccaanagaaacctggccaggctcccaggctcctcatctatgatgcatccaacaggccactggcatcccagccaggttcagtgcagtgggtctgggacagacttcactctcaccatcagccgcctagacgcctgaggtattctgtccgtttattattgtcgttgggtcgtagcaacgtggccttcccgtctacgttttcggccgtagggaccagcgtggagatcgagacgatggtgctgcacatctgtcttctac

SEQ ID NO: 277046 - DNA, 255 bp, Homo sapiens
  misc_feature: GYAE6OF01ELR82.29.35.D02.1.454.CMB.1.raw
  modified_base (254)..(255): a, c, t, g, unknown or other
  misc_feature (254)..(255): n is a, c, g, or t
tcagatagagtactcacgaccggtgctcgatttagcacacgatagttgggtttgggacagacttcactctcaccatcagccgcctagagcctgaggattctgccgtttattattgtcttggcgtagcaactggcctcccgtcacttttggccaggggaccaagctggagatcagacgaactgtggctgcaccatctgtcttcatcttcccgcatctgaagtattctatctgagcgggctggcaaggcgcatagnn

SEQ ID NO: 277047 - DNA, 581 bp, Homo sapiens
  misc_feature: GYAE6OF01CUVMZ.29.35.D02.1.454.CMB.1.raw
tcagatagagtactcacgaccggtgctcgatttagcacacgatagttgggtttgggggaggaactgctcagttaggacccagacggaaccatggaagccccagctcagcttctcttcctcctgctactctggctcccagataccagcggagagattgtgttgacacagtctccagccaccctgtctttgtctccgggagaaagagccaccctctcctgcagggccagtcagagtgttaaacaactacttggcctggttccaacagaacctggccaggctcccaggcctcctcatctatgactgcatccaacacgggcccactggacactccccagccgaggtcagtggcaggtgggtctgggacagacttcactcacaccatccacgcccgcctagacgccgtagagtacttcgtgtccggtttattagtttcgttcgttgggtcgtagtctaacgtcggtcccttcccgtacgtaccgtttcggaccgtacggggaacctaggccgttagggacggtacgtcgaacggtaaccgaacgttggtcggccgtcgccaaccgtactcctcgttcctcgtaccg

SEQ ID NO: 277048 - DNA, 575 bp, Homo sapiens
  misc_feature: GYAE6OF01DLMRY.29.35.D02.1.454.CMB.1.raw
tcagatagagtactcacgaccggtgctcgatttagcacacgatagttgggtttgggggaggaactgctcagttaggacccagacggaaccatggaagccccagctcagcttctcttcctcctgctactctggctcccagataccagcggagagattgtgttgacacagtctccagccaccctgtctttgtctccgggagaaagagccaccctctcctgcagggccagtcagagtgttaacaactacttggcctggttccaacagaaacctggccaggctcccaggctcctcatctatgatgcatccaacagggccactggcactcccagccaggtcagtggcagtgggctgggacagacttcactctcaccatcagccgcctagacgcctgaggtattcgtgtccgtttattatttgttcgttgggtcgtagctaacgtcggtcccttcccgttctaccgttttcgggacccgtacggggacccaaggccgtaggacgagttacgaacggtaaccggtaacgtcggttcgggccttaggcccgtaacctacttccgtttcgttccttccgtaccg

SEQ ID NO: 277049 - DNA, 561 bp, Homo sapiens
  misc_feature: GYAE6OF01C3THE.29.35.D02.1.454.CMB.1.raw
tcagatagagtactcacgaccggtgctcgatttagcacacgatagttgggtttgggggaggaactgctcagttaggacccagacggaaccatggaagccccagctcagcttctcttcctcctgctactctggctcccagataccagcggagagattgtgttgacacagtctccagccaccctgtctttgtctccgggagaaagagccaacctctcctgcagggccagtcagagtgttaaacaactacttggcctggttccaacagaaacctggccaggctcccaggctcctcatctatgatgcataccaacagggccactggcatcccagccaggttcagtggcaggtgggtctgggacaggacttcactctcaccatcgacgaccgcctagacgcctagaggtacttcgtcgtccgttttattagttcgttcgttgggtcgtagctaacgtcggtaccctccctatcgtaccgtttcggaccgtacggggaccaaggtcgtaggacgtagtcgacgaacgtaacgtggtacggctacgtccacctatcgtgttcttaccg

SEQ ID NO: 277050 - DNA, 538 bp, Homo sapiens
  misc_feature: GYAE6OF01BIZDB.29.35.D02.1.454.CMB.1.raw
  modified_base (260)..(260): a, c, t, g, unknown or other
  misc_feature (260)..(260): n is a, c, g, or t
tcagatagagtactcacgaccggtgctcgatttagcacacgatagttgggtttggggaggaactgctcagttaggacccagacggaaccatggaagccccagctcagcttctcttcctcctgctactctggctcccagataccagcggagagattgtgttgacacagtctccagccaccctgtctttgtctccgggagaaagagccaccctctcctgcagggccagtcagagtgttaacaactattggcctggttccaanagaaacctggccaggctcccagctctcatctatgatgcatccaacaggccactggcatcccagccaggttcagtggcagtgggtctggggacagacttcactctcaccatcagccgcctagagcctgaggattctgtccgtttattattgttcttggtcgtagctaactggtaccctcccgttctaccgttttcggtaccgtacggggacccgtaacgcgtaggagagtacacggacgtaacgtggtcggcgtgactaccactactcgttcttctacg

SEQ ID NO: 277051 - DNA, 506 bp, Homo sapiens
  misc_feature: GYAE6OF01C74FE.29.35.D02.1.454.CMB.1.raw
  modified_base (262)..(262): a, c, t, g, unknown or other
  misc_feature (262)..(262): n is a, c, g, or t
  modified_base (357)..(357): a, c, t, g, unknown or other
  misc_feature (357)..(357): n is a, c, g, or t
tcagatagagtactcacgaccggtgctcgatttagcacacgatagttgggtttgggggaggaactgctcagttaggacccagacggaaccatggaagccccagctcagcttctcttcctcctgctactctggctcccagataccagcggagagattgtgttgacacagtctccagccaccctgtctttgtctccgggagaaagagccaccctctcctgcagggccagtcagagtgttaacaactacttggcctggttccaanagaaacctggccaggctcccaggctcctcatctatgatgcatccaacagggccactggcatcccagccaggttcagtggcagtgggtctgggacngacttcactctcaccatcagccgcctagagcctgaggattctgtccgtttattagttgtcgttgggcgtagcaactggcctccgtctacgtttggccgagggaccagcgtggagatcagacgatggtggctgcaccatctgtcttctac

SEQ ID NO: 277052 - DNA, 577 bp, Homo sapiens
  misc_feature: GYAE6OF01C5NEP.29.35.D02.1.454.CMB.1.raw
  modified_base (565)..(565): a, c, t, g, unknown or other
  misc_feature (565)..(565): n is a, c, g, or t
tcagatagagtactcacgaccggtgctcgatttagcacacgatagttgggtttgggggaggaactgctcagttaggacccagacggaaccatggaagccccagctcagcttctcttcctcctgctactctggctcccagataccagcggagagattgtgttgacacagtctccagccaccctgtctttgtctcgggagaaagagccaccctctcctgcagggccagtcagagtgttaacaactacttggcctggttccaacagaaacctggccaggcctcccaggcctcctcatctatgatgcatccaacgagggcccacgtggacactccccagccagggttcaggtggacgtaggtgggtcgtgggaacacggtacttcactctcaccatcacgccgcctagacgccgtgaggtacttcgtcgttccgtttatttacgtttggttcgttgggtacgtacgtcgtaactcggtcccgttcccgttcgttaccgttttcggccgtacggggtacctacgcgtaggagacgtacgacggtaacgacgtggtggcgtgctactactntcgtcttctacc

SEQ ID NO: 277053 - DNA, 542 bp, Homo sapiens
  misc_feature: GYAE6OF01CRPG0.29.35.D02.1.454.CMB.1.raw
tcagatagagtactcacgaccggtgctcgatttagcacacgatagttgggtttgggggaggaactgctcagttaggacccagacggaaccatggaagccccagctcagcttctcttcctcctgctactctggctcccagataccagcggagagattgtgttgacacagtctccagccaccctgtctttgtctccgggagaaagagccaccctctcctgcagggccagtcagagtgttaacaactacttggcctggttccaacagaaacctggccaggctcccaggctcctcatctatgatgcatccaacgacgggccactggcactcccagccaggttcaggtggcaggtgggtctgggacagacttcactctcaccatcacgccgcctagacgccgtgaggtacttcgtcgtccgttttattagtttcgttcgttgggtcgttagctaacgtcggtccctcccgtcttaccgttttcggaccgtacggggaccacgcgtggagagtcgagacgatggtcggctgcacatctcgtcttctac

SEQ ID NO: 277054 - DNA, 263 bp, Homo sapiens
  misc_feature: GYAE6OF01D9D27.29.35.D02.1.454.CMB.1.raw
  modified_base (257)..(263): a, c, t, g, unknown or other
  misc_feature (257)..(263): n is a, c, g, or t
tcagatagagtactcacgaccggtgctcgatttagcacacgatagttgggtttgggacagacttcactctcaccatcagccgcctagagcctgaggattctgtccgtttattattgtcttgggcgtagcaactggcctcccgtcacttttggccaggggaccaagctggagatcagacgaactgtggctgcaccatctgtcttcatccttcccgcatctgaagtactctatctgagcgggctggcaaggcgcatagnnnnnnn

SEQ ID NO: 277055 - DNA, 570 bp, Homo sapiens
  misc_feature: GYAE6OF01D3Z6G.29.35.D02.1.454.CMB.1.raw
  modified_base (262)..(262): a, c, t, g, unknown or other
  misc_feature (262)..(262): n is a, c, g, or t
tcagatagagtactcacgaccggtgctcgatttagcacacgatagttgggtttgggggaggaactgctcagttaggacccagacggaaccatggaagccccagctcagcttctcttcctcctgctactctggctcccagataccagcggagagattgtgttgacacagtctccagccaccctgtctttgtctccggggagaaagagccaccctctcctgcagggccagtcagagtgttaaacactacttggcctggtccaanagaacctggccaggctcccaggctctcatctatgatgcatccaacagggccactggcatcccagccaggttcagtgcagtgggtctgggacagacttcactctcacatcagccgcctagacgctagaggtattctgtccgtttatttagtttgttcgttgggtcgtacgtactaacgtcggtcccgttccccgtctaccgttttcggccgtaacggggaccgaacgtcgtaggaacgacgtacgaagtaacggtaacgttaggtcggaccgttcggacctaccgtacttcttacggttcttcctaccg

SEQ ID NO: 277056 - DNA, 584 bp, Homo sapiens
  misc_feature: GYAE6OF01CT203.29.35.D02.1.454.CMB.1.raw
tcagatagagtactcacgaccggtgctcgatttagcacacgatagttgggtttgggggaggaactgctcagttaggacccagacggaaccatggaagccccagctcagcttctcttcctcctgctactctggctcccagataccagcggagagattgtgttgacacagtctccagccaccctgtctttgtctccgggagaaagagccaccctctcctgcagggccagtcagagtgttaacaactacttggcctggttccaacagaaacctggccaggctcccaggctcctcatctatgatgcatccaacagggccactggcactcccagccaggttcagtggcaggtgggtctgggacagacttcactctcaccatcacgccgcctagacgcctggacggtattctcgtccgttttatttagtttcgttcgtttgggtcgtagctaacgtcggtcccgttcccgttccgtaccgttttcggcccgtacggggaacccgacggtcgtaggtacgtacgtcgaacggtaaccgaacgttggtcggtccgtcggacctacctacttccttcgttccttcgtaacccg

SEQ ID NO: 277057 - DNA, 525 bp, Homo sapiens
  misc_feature: GYAE6OF01D2RHW.29.35.D02.1.454.CMB.1.raw
tcagatagagtactcacgaccggtgctcgatttagcacacgatagttgggtttgggggaggaactgctcagttaggacccagacggaaccatggaagccccagctcagcttctcttcctcctgctactctggctcccagataccagcggagagattgtgttgacacagtctccagccaccctgtctttgtctccgggagaaagagccaccctctcctgcagggccagtcagagtgttaacaactacttggcctggttccaacagaaacctggccaggctcccaggctcctcatctatgatgcatccaacagggccacgtggcatcccagccaggttcagtgcagtgggtctgggacagactcactctcaccatcagccgcctagacgctgaggtacttctcgtccgtttattagtttgttcgttgggcgtagctaacgtcggccctcccgtctacgttttcggccgacggggaccaggcgtggagatcgagacgactggtcggctgacacatctgttctcgtacg

SEQ ID NO: 277058 - DNA, 616 bp, Homo sapiens
  misc_feature: GYAE6OF01DUXB7.29.35.D02.1.454.CMB.1.raw
  modified_base (195)..(195): a, c, t, g, unknown or other
  misc_feature (195)..(195): n is a, c, g, or t
  modified_base (200)..(200): a, c, t, g, unknown or other
  misc_feature (200)..(200): n is a, c, g, or t
tcagatagagtactcacgaccggtgctcgatttagcacacgatagttgggtttggggaggaactgctcagttaggacccagacggaaccatggaagccccagctcagcttctcttcctcctgctactctggctcccagataccagcggagagattgtgttgacacagtctccagccacctgtctttgctcggganaaagngccacctctcctgcagggccagtcagagttacgttaaacaacttacgttggccttgggttacccaaacaggaaaaccctggacccaggcctcccaggcctcctcatctatgatgctataccaagacgggccactggcaacgtcccagccaaggttcagtggcaggtgggtctgggacagtacttcactcacaccatcacgccgcctagacgcctgagtacttcgtcgtccgtttattacgtttgttacgttcgggtcgtacgtcgtaacgtcggtacccgttcccgttacgtaccgttttcgggacccgtaacggggtacccgtaacggtccgtacgggtacgtacgtacgaacggtaacgtaaacgtgggtcggccgtacgacgtacctacgttaccttcggttccttcgtaccg

SEQ ID NO: 277059 - DNA, 689 bp, Homo sapiens
  misc_feature: GYAE6OF01CTUF3.29.35.D02.1.454.CMB.1.raw
tcagatagagtactcacgaccggtgctcgatttagcacacgataggttgggtttgggggaggaactgctcaggttaggacccagaccggaaccgattggaagcccctagcttcagcttctcttcctcctagctactctaggcctcccagagtaccgtaggcgagagagttgtgtttgacacgagtcttaccgagcccacctgtcttgtctccgggagaagagccaccgtctcctggccgacggggccagtccagacgtgttaacaacttacttggcctggttaccaagagaaaccctggaccaggcctacccaggcctcctcgatctatgactgccactaccgaacgagggccacgtggccactcccgagccgtaggttcaggtgaccgtaggtcgggtcgtaggggactacgtaccgtttacgacgttccgacctacccaatccgtaacgcccgtaccgttacggaccgtaccgtaggacggtactttcgtacgttaccgttttagttaagtttcgttcgttacgggtccgttacgaccgtaacgttccggtcccgttacccggttcgtaccgttttcggaccgtacgggtaaccgtaggtacgtagggtacgtacgtacgacggtaccgtaagttcggtcggtacctcggacctaccgtacgtccgttccgttcgttccgttacccg

SEQ ID NO: 277060 - DNA, 580 bp, Homo sapiens
  misc_feature: GYAE6OF01DTFYW.29.35.D02.1.454.CMB.1.raw
  modified_base (266)..(266): a, c, t, g, unknown or other
  misc_feature (266)..(266): n is a, c, g, or t
tcagatagagtactcacgaccggtgctcgatttagcacacgatagttgggtttgggggaggaactgctcagttaggacccagacggaaccatggaagccccagctcagcttctcttcctcctgctactctggctcccagataccagcggagagattgtgttgacacagtctccagccaccctgtctttgtctccgggagaaagagcccaccctctcctgcagggccagtcagagtagttaaacaactacttggcctggttaccaanagaaacctggccaggctcccaggctcctcatctatgatgcatccaacagggccactggcatcccagccaggttcagtggcagtgggtctgggacagacttcgactctacaccatcacgccgcctagacgccgtagacggtattcgtgtccgttttattactttgttcgttgggtcgttagctaacgtcggcccttcccgtctacgttttcggccgtaggggaccgaaggcgttacggagtacgtacgaacggaccggtaacgtaggttcggtacgtcggacctaaccctacgtccgttcgttccttcttacccg

SEQ ID NO: 277061 - DNA, 522 bp, Homo sapiens
  misc_feature: GYAE6OF01CQZOM.29.35.D02.1.454.CMB.1.raw
  modified_base (514)..(514): a, c, t, g, unknown or other
  misc_feature (514)..(514): n is a, c, g, or t
tcagatagagtactcacgaccggtgctcgatttagcacacgatagttgggtttgggggaggaactgctcagttaggacccagacggaaccatggaagccccagctcagcttctcttcctcctgctactctggctcccagataccagcggagagattgtgttgacacagtctccagccaccctgtctttgtctccgggagaaagagccaccctctcctgcagggccagtcagagtgttaacaactacttggcctggttccaacagaaacctggccaggctcccaggctcctcatctatgatgcatccaacagggccactggcatcccagccaggttcagtggcagtgggtctgggacagacttcactctcaccatcacgccgcctagacgcctgaggtatttctgtccgtttattagttgttcgttgggcgttagctaacgtcggtccctcccgtctacgttttcggccgtaggggaccagcgtaggagatcagacgatggtgctgcaccatctntcttctac

SEQ ID NO: 277062 - DNA, 615 bp, Homo sapiens
  misc_feature: GYAE6OF01BW81G.29.35.D02.1.454.CMB.1.raw
tcagatagagtactcacgaccggtgctcgatttagcacacgatagttgggtttggggaggaactgctcagttaggacccagacggaaccatggaagccccagctcagcttctcttcctcctgctactctggctcccagataccagcggagagattgtgttgacacagtctccagccaccctgtctttgtctccgggagaaagagccaccctctcctgcagggccagtcagagtgttaacaactacttggcctggttccaacagaaacctggccaggctcccaggctcctcatctatgatgcatccaacagggccactggcatcccagccaggttcagtggcaggtgggtctgggacagtacttcactctcacctatcacgcccgctacgacgtccgtaggagtacttcgtcgttaccgttttatttacgtttcggttcggtttacgggcgttacgtaccgtaacgtccggtccccttcccgttcgtttacgttttccgggacccgtacggggaaccaacggtcgtagggtacgtacgtaccgaacggtaaccggtaacgtgggttcggacttacggaccctaccgttacttccgttcgttccgttccgttacccg

SEQ ID NO: 277063 - DNA, 666 bp, Homo sapiens
  misc_feature: GYAE6OF01AE482.29.35.D02.1.454.CMB.1.raw
  modified_base (198)..(198): a, c, t, g, unknown or other
  misc_feature (198)..(198): n is a, c, g, or t
  modified_base (203)..(203): a, c, t, g, unknown or other
  misc_feature (203)..(203): n is a, c, g, or t
tcagatagagtactcacgaccggtgctcgatttagcacacgatagttgggtttgggggaggaactgctcagttaggacccagacggaaccatggaagccccagctcagcttctcttcctcctgctactctggctcccagataccagcggagagattgtgttgacacagtctccagccacctgtctttgtctccggganaaagngccacctctcctgcagggccagtcagagtgttaacaactacttggcctggttccaacagaaacctggccaggctcccaggctcctcatctatgatcgcactaccaacgacgggccacgtcggcacgtcccagccgaggttccgaggtcggcgaggtcgggtcgtaggggacacggtacttccacgtctaccgaacctataccacggcccgaccgtacgacgtccgtagtacggtacttcgttcggttaccgttttagtttacgtttcgttcgtttcgggtccgttacggtccgtaacgttcggtacccttcccggttacgttaccggtttttcgggaccgtacgggggtaaccctaacggtccgtagggtacgtacgtaccgaacggtaaccgtaacgttcgggtcgggtaccgttcggacccgtaacccgtagtttaccgtcgtttccgtttccgttacccg

SEQ ID NO: 277064 - DNA, 501 bp, Homo sapiens
  misc_feature: GYAE6OF01BCQP4.29.35.D02.1.454.CMB.1.raw
tcagatagagtactcacgaccggtgctcgatttagcacacgatagttgggtttggggaggaactgctcagttaggacccagacggaaccatggaagccccagctcagcttctcttcctcctgctactctggctcccagataccagcggagagattgtgttgacacagtctccagccaccctgtctttgtctccgggagaaagagccaccctctcctgcagggccagtcagagtgttaacaactacttggcctggttccaacagaaacctggccaggctccaggctcctcatctatgatgcatccaacagggccactggcatcccagccaggttcagtggcagtgggtctgggacagacttcactctcaccatcagccgctagagcctgagattctgtccgtttattattgtcttggcgtagcaactggcctccgtcacttttcggcctacgggaccagcgtggagagtcagacgaactgtgctgcaccatctgtcttctac

SEQ ID NO: 277065 - DNA, 554 bp, Homo sapiens
  misc_feature: GYAE6OF01EGWYN.29.35.D02.1.454.CMB.1.raw
tcagatagagtactcacgaccggtgctcgatttagcacacgatagttgggtttggggaggaactgctcagttaggacccagacggaaccatggaagccccagctcagcttctcttcctcctgctactctggctcccagataccagcggagagattgtgttgacacagtctccagccaccctgtctttgtctccgggagaaagagccaccctctcctgcagggccagtcagagtgttaacactacttggcctggttccaacagaaacctggccaggctcccaggctcctcatctatgatgcatccaacgagggccacgtggcactcccagccaggttcagtggcaggtgggtctgggacagtactcactctcaccatcacgcccgcctagacgcctagaggtattcgtgtccgtttattagtttcgtcgtttgggcgtagactaacgtcggcccttcccgtcgttaccgttttcggaccgacggggtacccagcgtaggacgatacgacgaacgtagtggtcggctcgacctacctatcttcggttcttcgtacg

SEQ ID NO: 277066 - DNA, 608 bp, Homo sapiens
  misc_feature: GYAE6OF01C05Q4.29.35.D02.1.454.CMB.1.raw
  modified_base (195)..(195): a, c, t, g, unknown or other
  misc_feature (195)..(195): n is a, c, g, or t
tcagatagagtactcacgaccggtgctcgatttagcacacgatagttgggtttgggggaggaactgctcagttaggacccagacggaaccatggaagccccagctcagcttctcttcctcctgctactctggctccagataccagcggagagattgtgttgacacagtctccagccacctgtctttgctcggganaaagacgccacctctcctgcagggccagtcagagtgttaacaactacttggcctggttaccaaacagaaacctggccaggcctccaggctacctcatctatgatgacataccaacgacgggccacgtggacaactcccgacgccgtagggttcaggttcggacgagggttcggggtcgtaggggaacaggtactttcactcctcaacctatcacgccgtcctagacgcgtagacggtacttcgtcgttacgttttagtttacgtttgttcgttacgggtcgttacgacgtaacgtcgggtcccttcccggttcgttacggttttcggaccgtacgggtaaccgtaacgtcgtaggacgagtacgacgacggtaagtggtcggctggaccacgtactacttcgtcgttctaccg

SEQ ID NO: 277067 - DNA, 560 bp, Homo sapiens
  misc_feature: GYAE6OF01D2WM4.29.35.D02.1.454.CMB.1.raw
  modified_base (261)..(261): a, c, t, g, unknown or other
  misc_feature (261)..(261): n is a, c, g, or t
tcagatagagtactcacgaccggtgctcgatttagcacacgatagttgggtttgggggaggaactgctcagttaggacccagacggaaccatggaagccccagctcagcttctcttcctcctgctactctggctcccagataccagcggagagattgtgttgacacagtctccagccaccctgtctttgtctccgggagaaagcgcccaccctctcctgcagggccagtcagagtgttaacaactcttggcctggtccaanagaaacctggccaggctcccaggctcctcatctatgatgcatccaacgagggccacgtggcatcccagccaggttcagtggcagtgggtctgggacagcttcactctcacatcacgccgcctacgacgcgtcgtaggtacttcgtcgtccgttttattacgtttgttcgttgggtcgtacgtctaacgtcggtcccgtcccgttcgtaccgttttcggccgtacggggaccgaacggtcgtgggagacgtcgacggacgtaacgtggtggcgtcgccactactcgtcgtcttcgtaccg

SEQ ID NO: 277068 - DNA, 556 bp, Homo sapiens
  misc_feature: GYAE6OF01CMRU2.29.35.D02.1.454.CMB.1.raw
  modified_base (374)..(374): a, c, t, g, unknown or other
  misc_feature (374)..(374): n is a, c, g, or t
tcagatagagtactcacgaccggtgctcgatttagcacacgatagttgggtttgggggaggaactgctcagttaggacccagacggaaccatggaagccccagctcagcttctcttcctcctgctactctggctcccagataccagcggagagattgtgttgacacagtctccagccaccctgtctttgtctccgggagaaagagcccaccctctcctgcagggccagtcagagtgttaacaactacttggcctggttccaaacagaaacctggccaggcctccgaggctcctcatctatgatgcatccaaacagggtccactggacactcccagccaggttcagtggcaggtgggctgggacagcttcactcncaccatcacgccgctacgacgcctagaggtattcgtgtcgtttattatttgttcgttgggtacgtagactaacgtcggcctccgtctacgttttcggccgtacgggaccagcgtaggagacgtcgaacgacggtaacgtggtcggcgtcgaccgtaccacttcgttcgttcttcgtaacccg

SEQ ID NO: 277069 - DNA, 717 bp, Homo sapiens
  misc_feature: GYAE6OF01ADR7X.29.35.D02.1.454.CMB.1.raw
  modified_base (199)..(199): a, c, t, g, unknown or other
  misc_feature (199)..(199): n is a, c, g, or t
  modified_base (204)..(204): a, c, t, g, unknown or other
  misc_feature (204)..(204): n is a, c, g, or t
  modified_base (294)..(294): a, c, t, g, unknown or other
  misc_feature (294)..(294): n is a, c, g, or t
tcagatagagtactcacgaccggtgctcgatttagcacacgatagttgggtttgggggaggaactgctcagttaggacccagacggaaccatggaagccccagctcagcttctcttcctcctgctactctggctcccagataccagcggagagattgtgttgacacagtctccagccaccctgtctttgtctccggganaaagngcccacctctcctgcagggccagtcagagtgtaacactacttggcctggttaccaacagaaacctggccaggcctcccgaggtcctcctnatctatgatgcactccaacgacgggccagtcggccacgtcccagccgtaggttcaggtcggcgtagggtgggtctaggggactacggtactttcgaacttcctaccgaaccacgttccgaccgtcccgtaccgtacggacgtccgtaggacggttacttccggtacgtttacccgttttaagtttacgtttacggttccggtttacggggtaccggttaacgtaccgtaaccggttccggttaccccgtttaccccggttaccgtttaccgggttttaccgggacccgggttaacggggaacccgtaacggtccgttagggaacgtacgtaccgtaaccggtaaccggtaaccgttgggtcggtacccgtacggtaacccgtaaccgttacgttacccgttacgtttcccgttcgttaccccg

SEQ ID NO: 277070 - DNA, 520 bp, Homo sapiens
  misc_feature: GYAE6OF01A3EPT.29.35.D02.1.454.CMB.1.raw
tcagatagagtactcacgaccggtgctcgatttagcacacgatagttgggtttggggaggaactgctcagttaggacccagacggaaccatggaagccccagctcagcttctcttcctcctgctactctggctcccagataccagcggagagattgtgttgacacagtctccagccaccctgtctttgtctccgggagaaagagccaccctctcctgcagggccagtcagagtgttaacaactacttggcctggttccaacagaaacctggccaggctcccaggctcctcatctatgatgcatccaacagggccactggcatcccagccaggttcagtgcagtgggtctgggacagacttcactctcaccatcacgccgcctagacgcctgaggattctgtccgtttattattgtcgttgggcgtacgctaacgtcggcctcccgtctacgttttcggccgtaggggaccagctgggagacgtcgagtacgatggtggctgcaccatctcgtcttctacg

SEQ ID NO: 277071 - DNA, 507 bp, Homo sapiens
  misc_feature: GYAE6OF01A9HCO.29.35.D02.1.454.CMB.1.raw
tcagatagagtactcacgaccggtgctcgatttagcacacgatagttgggtttgggggaggaactgctcagttaggacccagacggaaccatggaagccccagctcagcttctcttcctcctgctactctggctcccagataccagcggagagattgtgttgacacagtctccagccaccctgtctttgtctccgggagaaagagccaccctctcctgcagggccagtcagagtgttaacaactacttggcctggttccaacagaaacctggccaggctcccaggctcctcatctatgatgcatccaacagggccactggcatcccagccaggttcagtggcagtgggtctgggacagacttcactctcaccatcagccgcctagagcctgaggattctgtccgtttattagttgtcgttggcgtagcaactcggcctccgtctacgtttggccgtagggaccagcgtggagatcgagacgaactggtgctgcacatctgtctctac

SEQ ID NO: 277072 - DNA, 573 bp, Homo sapiens
  misc_feature: GYAE6OF01DRX9K.29.35.D02.1.454.CMB.1.raw
  modified_base (262)..(262): a, c, t, g, unknown or other
  misc_feature (262)..(262): n is a, c, g, or t
tcagatagagtactcacgaccggtgctcgatttagcacacgatagttgggtttggggaggaactgctcagttaggacccagacggaaccatggaagccccagctcagcttctcttcctcctgctactctggctcccagataccagcggagagattgtgttgacacagtctccagccaccctgtctttgtctccgggagaaagagccaccctctcctgcagggccagtcagagtgttaaacaactacttggcctggttccaanagaaacctggccaggctcccaggctcctcatctatgatcgcactccaaacgacgggccaacgtcggccactccccagccgtaggttcaggtggcaggtgggtctggggacagacttcactcacaccatccacgccgcctagacgcgtaggagtattctcgttccgtttatttagtttcgttcgttgggtcgtacgctaacgtcggtcccttcccgtcttacgtttcggaccgtacggggaccaggtcgtaggacgagtacgaacgacgtaacgtggtcggctgacctacctactcttcgttcttcgtaccg

SEQ ID NO: 277073 - DNA, 510 bp, Homo sapiens
  misc_feature: GYAE6OF01ACVYY.29.35.D02.1.454.CMB.1.raw
tcagatagagtactcacgaccggtgctcgatttagcacacgatagttgggtttggggaggaactgctcagttaggacccagacggaaccatggaagccccagctcagcttctcttcctcctgctactctggctcccagataccagcggagagattgtgttgacacagtctccagccaccctgtctttgtctccgggagaaagagccaccctctcctgcagggccagtcagagtgttaacaactacttggcctggttccaacagaaacctggccaggctcccaggctcctcatctatgatgcatccaacagggccactggcatcccagccaggttcagtgcagtggtctgggacagacttcactctcaccatcagccgcctagacgcctgaggtattctgtccgtttattattgtcgttgggcgtagcaactcgcctcccgtctacttttcggccgtaggggaccacggctggagatcagacgaactggtggctgcacatctgtcttctac

SEQ ID NO: 277074 - DNA, 545 bp, Homo sapiens
  misc_feature: GYAE6OF01DXOQO.29.35.D02.1.454.CMB.1.raw
  modified_base (262)..(262): a, c, t, g, unknown or other
  misc_feature (262)..(262): n is a, c, g, or t
tcagatagagtactcacgaccggtgctcgatttagcacacgatagttgggtttgggggaggaactgctcagttaggacccagacggaaccatggaagccccagctcagcttctcttcctcctgctactctggctcccagataccagcggagagattgtgttgacacagtctccagccaccctgtctttgtctccgggagaaagagccaccctctcctgcagggccagtcagagtgttaacaactacttggcctggttccaanagaaacctggccaggctcccaggctcctcatctatgatgcatccaacgacgggccacgtggccatcccagccaggttcagtggcaggtgggtctgggacagacttcactctcaccatcacgccgcctagacgcctagaggtattcgtgtccgtttattagttgttcgttgggtcgtagctacgtcggtcctcccgtctacgtttcggccgtacgggaccaggcgtggagacgtacgacggacgtaacgtggtcggcgtgacctacctatcttcgtcttctacc

SEQ ID NO: 277075 - DNA, 605 bp, Homo sapiens
  misc_feature: GYAE6OF01ASB5W.29.35.D02.1.454.CMB.1.raw
  modified_base (203)..(203): a, c, t, g, unknown or other
  misc_feature (203)..(203): n is a, c, g, or t
tcagatagagtactcacgaccggtgctcgatttagcacacgatagttgggtttggggaggaactgctcagttaggacccagacggaaccatggaagccccagctcagcttctcttcctcctgctactctggctcccagataccagcggagagattgtgttgacacagtctccagccaccctgtctttgtctccgggagaaagngccaccctctcctgcagggccagtcagagtgttaacaactacttggcctggttccaacagaaacctggccaggctcccaggcctcctcatctatgatgcatccaacgagggcccacgtcggcactccccaagccaggttcaggtcggctaggttcgggtcgtgggacagtaccttcacttctaccaccatcacgcccgctacgacgccgtggaggtacttcgtcgttaccgttttatttagtttcgttcgtttgggcgttacgctaaccgtcggtcccgttcccgtcttaccgttttcgggaccgtacggggaccgtaacgcgtagggacgtacgtacgaacggaccggtaacgtcggtcggcgtcgaccgtacctacttaccgttcgttccttcgtacccg

SEQ ID NO: 277076 - DNA, 518 bp, Homo sapiens
  misc_feature: GYAE6OF01BXSS5.29.35.D02.1.454.CMB.1.raw
tcagatagagtactcacgaccggtgctcgatttagcacacgataggttagggtttgggggaggaactgctcagttaaggtacccagacggaaccatggaagccccagctcagcttctcttcctcctgctactctggctcccagataccagcggagagattgtgttgacacagtctccagccaccctgtctttgtctccgggagaaagagccaccctctcctgcagggccagtcagagtgttaacaactacttggcctggttccaacagaaacctggccaggctcccaggctcctcatctatgatgcatccaacagggccactggcatcccagccaggttcagtggcaggtgggtctggggacagtacttcactctcaccatccagcccgcctagacgcctgaggattctgtccgttttattatttgtcttgggctagcaactggccctccgtctacgtttggccaggggaccagctggagatcagacgaacgtgtcggctgctacatctgtctcgtac

SEQ ID NO: 277077 - DNA, 258 bp, Homo sapiens
  misc_feature: GYAE6OF01BI075.29.35.D02.1.454.CMB.1.raw
  modified_base (254)..(258): a, c, t, g, unknown or other
  misc_feature (254)..(258): n is a, c, g, or t
tcagatagagtactcacgaccggtgctcgatttagcacacgatagttgggtttgggacagacttcactctcaccatcagccgcctagagcctgaggattctgccgtttattattgtcttgggcgtagcaactggcctcccgtcacttttggccaggggaccaagctggagatcagacgaactgtggctgcaccatctgtcttcatcttcccgcatctgaagtactctatctgagcggctggcaaggcgcatagnnnnn

SEQ ID NO: 277078 - DNA, 548 bp, Homo sapiens
  misc_feature: GYAE6OF01B5H6E.29.35.D02.1.454.CMB.1.raw
tcagatagagtactcacgaccggtgctcgatttagcacacgatagttgggtttgggggaggaactgctcagttaggacccagacggaaccatggaagccccagctcagcttctcttcctcctgctactctggctcccagataccagcggagagattgtgttgacacagtctccagccaccctgtctttgtctccgggagaaagagccacctctcctgcagggccagtcagagtgttaacaactacttggcctggttccaacagaaacctggccaggctcccaggctcctcatctatgatgcatccaacagggccactggcatcccagccaggttcagtgcaggtgggtctgggacagacttcactctacaccatcgacgccgcctacgacgccgtgaggacttcgtcgtaccgtttatttatttgttcgttcgggtcgtagctaacgtcggcccttcccgtccgtacgttttcggaccgtacgggaccgaagcgtggagacgtacgacgacgtaacgtggtggcgtgcctacatcttcgtcttctacc

SEQ ID NO: 277079 - DNA, 517 bp, Homo sapiens
  misc_feature: GYAE6OF01BNCQL.29.35.D02.1.454.CMB.1.raw
  modified_base (501)..(501): a, c, t, g, unknown or other
  misc_feature (501)..(501): n is a, c, g, or t
tcagatagagtactcacgaccggtgctcgatttagcacacgatagttgggtttgggggaggaactgctcagttaggacccagacggaaccatggaagccccagctcagcttctcttcctcctgctactctggctcccagataccagcggagagattgtgttgacacagtctccagccaccctgtctttgtctccgggagaaagagccaccctctcctgcagggccagtcagagtgttaacaactacttggcctggttccaacagaaacctggccaggctcccaggctcctcatctatgatgcatccaacagggccactggcatcccagccaggttcagtggcagtggtctgggacagacttcactctcaccatcagccgcctagagcctgaggattctcgccgtttattattgttcttgggcgttagcgtaactcggcctcccgtctacttttggccgtacggggaccgagcgtggagtatcgagacgaatggtggctgcnccatctgtcttctacg

SEQ ID NO: 277080 - DNA, 740 bp, Homo sapiens
  misc_feature: GYAE6OF01ACTF0.29.35.D02.1.454.CMB.1.raw
tcagatagagtactcacgaccggtgctcgatttagcacacgatagttgggtttgggggaggaactgctcagttaggacccagacggaaccatggaagccccagctcagcttctcttcctcctgctactctggcctccagataccagcggagagattgtgttgacacagtcctccagcccacccttgtctttgctaccgggagaaacgcgccacctctcctgcagggtccagtcagtagtagttaacaacttcgttggcctggttaccaaacacgaaacccgtggacccaggcctaccgacggtcctcctcatctatgatcgacactaccaacgacgggtcccacgtcggaccacgtccccgaggtcccgtaggttcaacggttcggacgtagggttcggggtacgtagggaacctacggtactttaccaaccttccctaccaaacccgtagtaccgaacggtaccgtaacgggtaccggttacgggggtaccttaagggaaacgtacgtacgtaccgtaagttaccgttaaggttacgttaacgtttaccgtagttaacctaagttaaccgttaaagtttcgtttaccggtttacctttaccgttacggttttcccgtaccgtttacccggtaacccggttaccggaaccggtaaacgggtaacctaacgggtacgtaacggtaaacttaaacgttaaaccggtacgtcggtacgtactacgacctacctgttccgttac

SEQ ID NO: 277081 - DNA, 677 bp, Homo sapiens
  misc_feature: GYAE6OF01C3FXT.29.35.D02.1.454.CMB.1.raw
  modified_base (203)..(203): a, c, t, g, unknown or other
  misc_feature (203)..(203): n is a, c, g, or t
  modified_base (310)..(310): a, c, t, g, unknown or other
  misc_feature (310)..(310): n is a, c, g, or t
tcagatagagtactcacgaccggtgctcgatttagcacacgatagttgggtttggggaggaactgctcagttaggacccagacggaaccatggaagccccagctcagcttctcttcctcctgctactctggctcccagataccagcggagagattgtgttgacacagtctccagccaccctgtctttgtctccgggagaaagngccaccctctcctgcagggccagtcagagtagtaacaactacttggcctggttaccaacagaaacctggccaggcctcccaggcctcctcatcatgatgcatccaangggccacgtggacactcccagccctaggttcaggtggcaggtcgggtctggggaactacggactttcaacttcctaccgaacccattccacgccgacctaggacgccgtgacggtattccgtcggttaccgttttatttacgtttggttcgttacggggtcgttaacggaccgtaacgttcgggtaccctttaccccggttcttaaccggtttttccgggacccggtaaacggggggtaacccctaacgggtaccgttacggggtaacggtaaacgttccggaaacgggttaaaccggtaaacggttcgggtacggtccgttacggaccgtaaccctagttaccgttcggttccttaccgttacccg

SEQ ID NO: 277082 - DNA, 535 bp, Homo sapiens
  misc_feature: GYAE6OF01CQ49B.29.35.D02.1.454.CMB.1.raw
  modified_base (202)..(202): a, c, t, g, unknown or other
  misc_feature (202)..(202): n is a, c, g, or t
  modified_base (262)..(262): a, c, t, g, unknown or other
  misc_feature (262)..(262): n is a, c, g, or t
tcagatagagtactcacgaccggtgctcgatttagcacacgatagttgggtttgggggaggaactgctcagttaggacccagacggaaccatggaagccccagctcagcttctcttcctcctgctactctggctccagataccagcggagagattgtgttgacacagtctccagccacctgtctttgtctccgggagaaagngccacctctcctgcagggccagtcaagagtgttaacaactacttggcctggttaccaaanagaaacctggccaggctcccaggctcctcatctatgatgcatccaacagggccatggcactcccagccaggttcagtggcaggtgggtctgggacagtacttcactctcacatcacgccgcctagacgcctaggagtacttcgtgtccgttttatttagtttgttcgttggtcgtagctaacgtcggtccctccgtctacgtttcggacgacgggaccaggcgtggacgatacgaggacgtaagtggtggctgctacctatctgtcttctacg

SEQ ID NO: 277083 - DNA, 526 bp, Homo sapiens
  misc_feature: GYAE6OF01BCUER.29.35.D02.1.454.CMB.1.raw
tcagatagagtactcacgaccggtgctcgatttagcacacgatagttgggtttgggggaggaactgctcagttaggacccagacggaaccatggaagccccagctcagcttctcttcctcctgctactctggctcccagataccagcggagagattgtgttgacacagtctccagccaccctgtctttgtctccgggagaaagagccaccctctcctgcagggccagtcagagtgttaacaactacttggcctggttccaacagaaacctggccaggctcccaggctcctcatctatgatgcatccaacagggccactggcatcccagccaggttcagtggcagtgggtctgggacagacttcgactctcacatcacgccgcctagagcctgagattctgtccgtttattagttgttcttgggcgtagcaacgtcggcctcccgttctacgttttcggccgtacggggaccgagccgtggagtagtcaggacgaacgtgtggctgcaccatctcgttcgtctaccg

SEQ ID NO: 277084 - DNA, 523 bp, Homo sapiens
  misc_feature: GYAE6OF01B59V6.29.35.D02.1.454.CMB.1.raw
  modified_base (197)..(197): a, c, t, g, unknown or other
  misc_feature (197)..(197): n is a, c, g, or t
  modified_base (202)..(202): a, c, t, g, unknown or other
  misc_feature (202)..(202): n is a, c, g, or t
tcagatagagtactcacgaccggtgctcgatttagcacacgatagttgggtttggggggaactgctcagttaggacccagacggaaccatggaagccccagctcagcttctcttcctcctgctactctggctcccagataccagcggagagattgtgttgacacagtctccagccaccctgtctttgtctccggganaaagngccaccctctcctgcagggccagtcagagtgttaaacaactacttggcctggttccaacagaaacctggccaggctcccaggctcctcatctatgatgcatccaacagggccactggcatcccagccaggttcagtggcagtgggtctgggacagacttcactctcacatcagccgctagacgcctgaggtattctgtccgtttattattgtcttgggcgtagcaacgtgcctccgtctacgtttcggccgtacgggaccagcgtggagtactcaggacgtaacgtgtcggctgcacctatctgttccttctacttccccg

SEQ ID NO: 277085 - DNA, 648 bp, Homo sapiens
  misc_feature: GYAE6OF01AW5B3.29.35.D02.1.454.CMB.1.raw
  modified_base (203)..(203): a, c, t, g, unknown or other
  misc_feature (203)..(203): n is a, c, g, or t
  modified_base (307)..(307): a, c, t, g, unknown or other
  misc_feature (307)..(307): n is a, c, g, or t
tcagatagagtactcacgaccggtgctcgatttagcacacgatagttgggtttggggaggaactgctcagttaggacccagacggaaccatggaagccccagctcagcttctcttcctcctgctactctggctcccagataccagcggagagattgtgttgacacagtctccagccaccctgtctttgtctccgggagaaagngccacctctcctgcagggccagtcagagtgttaacactacttggcctggttccaacagaaacctggccaggctcccaggctcctcatctatgatgcatccaacngggccacgtggcatccccagccaggttcaggtggcaggtgggtctgggacagtactcactctacaccatcacgcccgtcctagacgtccgtagacggtacttcgtcgttacccgttttaatttacgtttggttcgtttcggggtacgttacgtccgtaaccgttcggtcccttacccggttcgttaaccgttttccgggacccggtaacgggggtaacccgtaaacggtccggttagggtaacggtacgtaccgtaaacgggtaaccggtaaacgttcgggtcggtaccgtacggacccgtaaccgttacgttaccgttcgtttccgttccgttaaccccg

SEQ ID NO: 277086 - DNA, 553 bp, Homo sapiens
  misc_feature: GYAE6OF01ASXSN.29.35.D02.1.454.CMB.1.raw
tcagatagagtactcacgaccggtgctcgatttagcacacgatagttgggtttgggggaggaactgctcagttaggacccagacggaaccatggaagccccagctcagcttctcttcctcctgctactctggctcccagataccagcggagagattgtgttgacacagtctccagccaccctgtctttgtctccgggagaaagacgccaccctctcctgcagggccagtcagagtgttaacaactacttggcctggttccaacagaaacctggccaggctcccaggctcctcatctatgatgcatccaacagggccactggcatcccagccaggttcagtggcagtgggtctggggacagacttcactctcaccatcacgccgcctagacgcctgaggattctgtccgtttattattgtcttgggcgtagcaactggcctccgtctacgtttcggaccgtacggggaccaagccgtaggacgtagtaccaaggtaaccgaacgttggtcgggctacggccctaaaccgacttctcggttccctttcgtacccg

SEQ ID NO: 277087 - DNA, 600 bp, Homo sapiens
  misc_feature: GYAE6OF01BA9ZI.29.35.D02.1.454.CMB.1.raw
tcagatagagtactcacgaccggtgctcgatttagcacacgatagttgggtttgggggaggaactgctcagttaggacccagacggaaccatggaagccccagctcagcttctcttcctcctgctactctggctcccagataccagcggagagattgtgttgacacagtctccagccaccctgtctttgtctccgggagaaagagccaccctctcctgcagggccagtcagagtgttaacaactacttggcctggtccaacagaacctggccaggctccaggctcctcatctatgatgccatcccaacgacgggccacgtcggccactccccagccctagggttccaggttcggctaggtgggtctaggggacaggtacttcactctcacctatccacgccgcctacgacgcctaggaggtcttcgtcgtaccgtttattacgtttgttcgttgggcgttacgactaacgtcggcccttccggtctacgtttcggaccgtacggggaccgacggtcgtagggacgtacgtacgaacggaccgtaacgttgggttcggccgtaggacccgtacctacgttccgttcgttccgttctacccg

SEQ ID NO: 277088 - DNA, 794 bp, Homo sapiens
  misc_feature: GYAE6OF01DQJP4.29.35.D02.1.454.CMB.1.raw
tcagatagagtactcacgaccggtgctcgatttagcacacgatagttgggtttgggggaggaactgctcagttaggacccagacggaaccatggaagccccagctcagcttctcttcctcctgctactctggctccagataccagcggagagattgtgttgacacagtcctcagccacctgttctttgtccgtccgggaagaaagacgccctacctctcctgcgacgggccagtcgagtagttacgtaaacaacttacgttcggccgttcggttaccaaagaacgaaaccgtcggaccgaaggtccctacccgacggtccttcctactacttaccttagtacgtacgttcgacctaaccgtaacccgaaacggaccgggaccctaacggttcggacctaacccgtcccgacgaccggtaacggttcgagggtttgggttacgggttcggggttacgtacggggaacctaacggttaccttacctaaccttccgtaacccaacctactaccgaacccggtcccgtaaccgttaacggaccgtaccgtaggtaacggttactttccgtacgtttaccgttttaatttagtttcggtttcggttcgggtacgttacgtaccgtaacggttccgtacccgttcccggttacgtttaccggttttacgggtaccgggtaacggggtaacctaacggtcggtaacggtacgtacgtacggtaacggtaaccggtacgttgggtacgtacgtaccgaaccgtaccttacgttcgttacgtttccttacgtccgtttccccg

SEQ ID NO: 277089 - DNA, 512 bp, Homo sapiens
  misc_feature: GYAE6OF01C4WKU.29.35.D02.1.454.CMB.1.raw
  modified_base (380)..(380): a, c, t, g, unknown or other
  misc_feature (380)..(380): n is a, c, g, or t
tcagatagagtactcacgaccggtgctcgatttagcacacgatagttgggtttgggggaggaactgctcagttaggacccagacggaaccatggaagccccagctcagcttctcttcctcctgctactctggctcccagataccagcggagagattgtgttgacacagtctccagccaccctgtctttgtctccgggagaaagagccaccctctcctgcagggccagtcagagtgttaacaactacttggcctggttccaacagaaacctggccaggctcccaggctcctcatctatgatgcatccaacagggccactggcatcccagccaggttcagtggcagtgggtctgggacagacttcactctcaccatcagccncctagagcctgaggattctgtccgtttattattgtcttgggtcgtagctaacgtcgcctcccgtctacgtttggccgacgggaccagcgtggagatcgagacgaatggtggctgctaccatctctcttctac

SEQ ID NO: 277090 - DNA, 533 bp, Homo sapiens
  misc_feature: GYAE6OF01AVRRQ.29.35.D02.1.454.CMB.1.raw
tcagatagagtactcacgaccggtgctcgatttagcacacgatagttgggtttgggggaggaactgctcagttaggacccagacggaaccatggaagccccagctcagcttctcttcctcctgctactctggctcccagataccagcggagagattgtgttgacacagtctccagccaccctgtctttgtctccgggagaaagagccaccctctcctgcagggccagtcagagtgttaacaactacttggcctggttccaacagaaacctggccaggctcccaggctcctcatctatgatgcatccaacagggccatggcatcccagccaggttcagtggcaggtgggtctgggacagacttcactctcaccatcagccgcctagacgcctgagattctgtccgtttattattgttcgttgggtcgtagcctaacgtcggcctcccgttctaccgttttcggccgtacggggaccaagccgtggagactacacggtacgaacgtggtcggctgacaccatctgtcgttctacg

SEQ ID NO: 277091 - DNA, 609 bp, Homo sapiens
  misc_feature: GYAE6OF01DXGAQ.29.35.D02.1.454.CMB.1.raw
  modified_base (203)..(203): a, c, t, g, unknown or other
  misc_feature (203)..(203): n is a, c, g, or t
  modified_base (290)..(290): a, c, t, g, unknown or other
  misc_feature (290)..(290): n is a, c, g, or t
  modified_base (308)..(308): a, c, t, g, unknown or other
  misc_feature (308)..(308): n is a, c, g, or t
  modified_base (372)..(372): a, c, t, g, unknown or other
  misc_feature (372)..(372): n is a, c, g, or t
tcagatagagtactcacgaccggtgctcgatttagcacacgatagttgggtttgggggaggaactgctcagttaggacccagacggaaccatggaagccccagctcagcttctcttcctcctgctactctggctcccagataccagcggagagattgtgttgacacagtctccagccaccctgtctttgctccgggagaaagngccacctctcctgcagggccagtcagagtgttaacaactacttggcctggttccaaacagaaacctggccaggcctccaggctcctnatctatgatgcatccaanaggccactggcactcccagccagttcagtggcaggtggtctgggacagacttcacgtctcaccnctcacgccgacgtagacgccgtggagtacgttcgtgtccgtttattacgtttcgttcgttcgggtcgtacgtctaacgtccggtacccttcccggtccgttacgttttaccggaccggtaacggggtaacccgaaggtccgtagggtaacgtacgttaccgaacgggtaaccggtaacggttcggtacggtccgtcgacccgtacctacgttcccttacggtttcctcgttaccccg

SEQ ID NO: 277092 - DNA, 525 bp, Homo sapiens
  misc_feature: GYAE6OF01ATNW2.29.35.D02.1.454.CMB.1.raw
tcagatagagtactcacgaccggtgctcgatttagcacacgatagttgggtttgggggaggaactgctcagttaggacccagacggaaccatggaagccccagctcagcttctcttcctcctgctactctggctcccagataccagcggagagattgtgttgacacagtctccagccaccctgtctttgtctccgggagaaagagccaccctctcctgcagggccagtcagagtgttaacaactacttggcctggttccaacagaaacctggccaggctccaggctcctcatctatgatgcatccaacagggccactggcatcccagccaggttcagtggcaggtgggtctgggacagacgttcactctcaccatcagccgcctagagcctgagtattcgtgtccgtttattattgtcttgggcgtagctaacgtggtccctcccgtcctacgttttcggaccgtaggggaccacgctggagacgtcagacgtaagtgtggctggccaccatctgtccttctacg

SEQ ID NO: 277093 - DNA, 582 bp, Homo sapiens
  misc_feature: GYAE6OF01CQ3QB.29.35.D02.1.454.CMB.1.raw
  modified_base (262)..(262): a, c, t, g, unknown or other
  misc_feature (262)..(262): n is a, c, g, or t
tcagatagagtactcacgaccggtgctcgatttagcacacgatagttgggtttgggggaggaactgctcagttaggacccagacggaaccatggaagccccagctcagcttctcttcctcctgctactctggctcccagataccagcggagagattgtgttgacacagtctccagccaccctgtctttgtctccgggagaaagagccaccctctcctgcagggccagtcagagtgttaacaactacttggcctggttccaanagaaacctggccaggctcccaggctcctcatctatgatgcatccaacagggccacgtggcatcccagccaggttcagtggcaggtgggtctgggacagacttcactctcaccatcacgccgcctacgacgccgtgaggtacttcgttcgtccgttttatttacgtttgttcgttgggtcgttagacctaacgtcggtcccttcccggttacgtaccgttttcggaccgtacggggaccaacggtcgtagggagacgtacgaaggaccgtaacgttcggtggtccgtcgacctacctacttcctcgttccgttcttacccg

SEQ ID NO: 277094 - DNA, 521 bp, Homo sapiens
  misc_feature: GYAE6OF01DTD1O.29.35.D02.1.454.CMB.1.raw
  modified_base (199)..(199): a, c, t, g, unknown or other
  misc_feature (199)..(199): n is a, c, g, or t
  modified_base (262)..(262): a, c, t, g, unknown or other
  misc_feature (262)..(262): n is a, c, g, or t
tcagatagagtactcacgaccggtgctcgatttagcacacgatagttgggtttgggggaggaactgctcagttaggacccagacggaaccatggaagccccagctcagcttctcttcctcctgctactctggctcccagataccagcggagagattgtgttgacacagtctccagccaccctgtctttgtctccggganaaagagccaccctctcctgcagggccagtcagagtgttaacaactacttggcctggttccaanagaaacctgccaggctcccaggctctcatctatgatgcatccaacagggccacgtcggcactcccagccaggttccagtggcaggtggtcgtgggacaggactcactctcaccatcagccgcctagacgcctgagtattctgccgttttattacttgttcgttggtcgtagcaactcgtcctccgtctacgtttcggccgtacgggaccacgcgtaggagatcgaggacgaatggtgctgactacatctcgtcttctac

SEQ ID NO: 277095 - DNA, 530 bp, Homo sapiens
  misc_feature: GYAE6OF01BC44H.29.35.D02.1.454.CMB.1.raw
tcagatagagtactcacgaccggtgctcgatttagcacacgatagttgggtttgggggaggaactgctcagttaggacccagacggaaccatggaagccccagctcagcttctcttcctcctgctactctggctcccagataccagcggagagattgtgttgacacagtctccagccaccctgtctttgtctccgggagaaagagccaccctctcctgcagggccagtcagagtgttaacaactacttggcctggttccaacagaaacctggccaggctcccaggctcctcatctatgatgcatccaacagggccactggcatcccagccaggttcagtggcaggtgggtctgggacagacttcactctcaccatcacgccgcctagacgcctgagtattcgtcgtccgtttattattgttcgttggcgtagctaacgtcggcctcccgtctacgtttcggccgtacggggaccaacgcgtggagtatcgagacgaacgtggtcggctgcacctatctcgttctcgtacc

SEQ ID NO: 277096 - DNA, 658 bp, Homo sapiens
  misc_feature: GYAE6OF01CVDL8.29.35.D02.1.454.CMB.1.raw
  modified_base (196)..(196): a, c, t, g, unknown or other
  misc_feature (196)..(196): n is a, c, g, or t
  modified_base (201)..(201): a, c, t, g, unknown or other
  misc_feature (201)..(201): n is a, c, g, or t
tcagatagagtactcacgaccggtgctcgatttagcacacgatagttgggtttggggaggaactgctcagttaggacccagacggaaccatggaagccccagctcagcttctcttcctcctgctactctggctcccagataccagcggagagattgtgttgacacagtctccagccacctgtcttgtctccggganaaagngccacctctcctgcagggccagtcagagtgttaacactacttggcctggttccaaacagaaacctggccaggcctccgaggcctcctcatctatgatcgcactaccaacgacgggccacgtcggacactcccagccgtaggttcagtggcgtaggtgggtctgggactacggacttcactctcaccatcacgccgaccgtacgacgtccgtaggtagtactttcgtcgtccgttttaatttagtttgttcgttcgggtcgttacgtacgtaaccgtcgggtacccttcccggttaccgttaccggttttcgggacccggtaacggggtaaccctaacggtccggttagggtaacgtacgttaccgaacgggtaaccggtaaacgttcgggttcgggtaccgttacggtacccgtaacccgtaacgttccgttacgttccgtttaccgttaaccccgg

SEQ ID NO: 277097 - DNA, 601 bp, Homo sapiens
  misc_feature: GYAE6OF01E1BJV.29.35.D02.1.454.CMB.1.raw
  modified_base (206)..(206): a, c, t, g, unknown or other
  misc_feature (206)..(206): n is a, c, g, or t
  modified_base (211)..(211): a, c, t, g, unknown or other
  misc_feature (211)..(211): n is a, c, g, or t
  modified_base (271)..(271): a, c, t, g, unknown or other
  misc_feature (271)..(271): n is a, c, g, or t
tcagatagagtactcacgaccggtgctcgatttagcacacgatagtgggttcggggaggaactgcgtcagttaggaccagacggaaccatggaaggccccagctcagcttctcgtcctcctgctactctggctcccagatccaggcggagagattgtggttcgactacagtcctccagtcccaccctgtcctttgtctccgggganaaagngccaccctctcctgccagggcccagtcagagtgttaaaccatacttggccttgttccaanagaacctggccaggctcccaggctcctcatctatgactgccaactccaaacgacgggcccaactggcaacttcccagtcccgaggttccaggtggcctaagtcgggtctgggacacgtacttctactctcacctatcgacgccgcctacgagtcctggtaggtaacttcgtgtccgtttattagttgtacgttcggtcgtagtcgtaacgtcggtccgtcccgttcgtaccgttttagggacgtacgggaccaagtcgtacggacgtacgtacgaggtacgtaagtcggtcggacgtagccgtaccgtacgtcttcgtccgttccgtacg

SEQ ID NO: 277098 - DNA, 522 bp, Homo sapiens
  misc_feature: GYAE6OF01EB6D9.29.35.D02.1.454.CMB.1.raw
tcagatagagtactcacgaccggtgctcgatttagcacacgatagttgggtttggggaggaactgctcagttaggacccagacggaaccatggaagccccagctcagcttctcttcctcctgctactctggctcccagataccagcggagagattgtgttgacacagtctccagccaccctgtctttgtctccgggagaaagagccaccctctcctgcagggccagtcagagtgttaacaactacttggcctggttccaacagaaacctggccaggctcccaggctcctcatctatgatgcatccaacagggccactggcatcccagccaggttcagtggcagtgggtctgggacagacttcactctcaccatcagccgcctagacgcctgaggattctgtccgtttattattgttcgttgggcgtagctaacgtcggcccttcccgtctaccgttttggccgtacggggaccagcgtaggagatcgagacgtaactggtggctgcacatctgtcttctacc

SEQ ID NO: 277099 - DNA, 606 bp, Homo sapiens
  misc_feature: GYAE6OF01AXZHA.29.35.D02.1.454.CMB.1.raw
tcagatagagtactcacgaccggtgctcgatttagcacacgatagttgggtttggggggaactgctcagttaggacccagacggaaccatggaagccccagctcagcttctcttcctcctgctactctggctcccagataccagcggagagattgtgttgacacagtctccagccaccctgtctttgtctccgggagaaagagccaccctctcctgcagggccagtcagagtgtaacaactacttggcctggttccaacagaaacctggccaggctcccaggctcctcatctatgatgcatccaacagggccactggcatcccagccaggttcaggtggcaggtgggtctgggacagtactcactctcaccatcacgccgcctagacgccgtgacggtattcgtcggtacccgttttagttacgtttgttcgttgggtcggttacgtacgtaacgtcggtcccttccccggttccttaccgtttttgggacccgtacgggggtacccgaacggtccgtagggacgtacgtaccgaacggaaccggtaacgttgggtcgggtccgttcgaccacccgtacttccttgttcctttcgtacgttccccg

SEQ ID NO: 277100 - DNA, 835 bp, Homo sapiens
  misc_feature: GYAE6OF01DHBHU.29.35.D02.1.454.CMB.1.raw
  modified_base (222)..(222): a, c, t, g, unknown or other
  misc_feature (222)..(222): n is a, c, g, or t
tcagatagagtactcacgaccggtgctcgatttagcacacgatagttgggtttgggggaggaactgctcagttaggacccagaccggaaccatggaagcccctagcttcagcttctcttcctcctgctactctggctcccagactaccagacggtaggagattggtgtttggtacctactagtcctcctaaggccctaccctgtctttggtctaccgggganaaaagtgcccacctcggtcctgcgacggccaggtcagagtgttaacaactcgttggacctggttaccaaagagtaaaccgtggcccaaggcctacccgaggtctcctcatcgtagtcgatacgctactaaccgaaaggtcggggtccaacgttgggacctaaccgtaccccgaacgtaccccgtaagggttttccaaaggggttcggtacgaaaggggtttcggggaccttacgggggtaaacacggggttacccgtttaccctaaccgtttcccgtaccggaaacccgtaccttaccgaaccgacccgtaccgttaacggaacccggtacccggaacgggtaaccgttttaccgttacggttaaccgtttttaaatttaaccgtttggtttaccggtttagggttaccggttacggtaaccgtaacgttccgggtacccttacccggttccgttaaccggtttttccgggaacccggtaacggggtaacccgtaacgggtaccgtacgggtacgtaacgtacgtaacggtaaccgttaaacggtcggttacgggtaccgttacggactaaccgttacgttacgttacgttccgttaccgtccgtttaccccg

SEQ ID NO: 277101 - DNA, 583 bp, Homo sapiens
  misc_feature: GYAE6OF01COXK3.29.35.D02.1.454.CMB.1.raw
  modified_base (362)..(362): a, c, t, g, unknown or other
  misc_feature (362)..(362): n is a, c, g, or t
tcagatagagtactcacgaccggtgctcgatttagcacacgatagttgggtttggggaggaactgctcagttaggacccagacggaaccatggaagccccagctcagcttctcttcctcctgctactctggctcccagataccagcggagagattgtgttgacacagtctccagccaccctgtctttgtctccgggagaaagagccaccctctcctgcagggccagtcagagtgttaacaactacttggcctggttccaacagaaacctggccaggctcccaggcctcctcatctatgatgcatccaacacgggccactggcactccccagccaggttcagtcggcaggtgggtctgggacngacttcactctcacctatcacgccgcctagacgccgtgaggtacttcgtcgtaccgttttatttagtttggttcgttgggtcgttacgcgtaacgtcggtcccttcccggttcgtaccgttttcggaccgtacggggtaccgaggtcgtggacgacgtcgaacggtacgaacgttcggtcggtacgtcgaccgtaccgtacttcgttcgtcgttcgtaccg

SEQ ID NO: 277102 - DNA, 554 bp, Homo sapiens
  misc_feature: GYAE6OF01BCFHQ.29.35.D02.1.454.CMB.1.raw
  modified_base (205)..(205): a, c, t, g, unknown or other
  misc_feature (205)..(205): n is a, c, g, or t
  modified_base (262)..(262): a, c, t, g, unknown or other
  misc_feature (262)..(262): n is a, c, g, or t
tcagatagagtactcacgaccggtgctcgatttagcacacgatagttgggtttgggggaggaactgctcagttaggacccagacggaaccacggaagccccagctcagcttctcttcctcctgctactctggctcccagataccagcggagagattgtgttgacacagtctccagccaccctgtctttgtctccggggagaaagngccaccctctcctgcagggccagtcagagtgttaacaactacttggcctggtccaanagaaacctggccaggctcccaggctcctcatctatgatgcatccaacagggccatggcatcccagccaggttcagtggcaggtgggtcgtgggacagacttcactctcaccatcgacgccgacctacgacgcctgaggtattcgtcgtacgtttattagtttgttcgttgggtcgtagctaacgtcggtcctccgtctacgtttcggccgacgggtaccagtcgtggagactcgaacggacgtacgtggtcggtcgtcgactaccgtactcgttgttcttcgactttccccg

SEQ ID NO: 277103 - DNA, 544 bp, Homo sapiens
  misc_feature: GYAE6OF01BAOAP.29.35.D02.1.454.CMB.1.raw
tcagatagagtactcacgaccggtgctcgatttagcacacgatagttgggtttgggggaggaactgctcagttaggacccagacggaaccatggaagccccagctcagcttctcttcctcctgctactctggctcccagataccagcggagagattgtgttgacacagtctccagccaccctgtctttgtctccgggagaaagagccaccctctcctgcagggccagtcagagtgttaacaactacttggcctggttccaacagaaacctggccaggcctcccaggctcctcatctatgatgcatccaacgagggccacgtggcactccccagccaggttccaggtggcaggtgggtctgggacagacttcactctcaccatcacgccgcctagacgcctggaggtacttcgtgtccgtttattagttgttcgttgggcgtagctacgtcggccttcccgtctaccgtttcggccgacggggtaccagcgtgggacgacgtacgaggacgaagtcggtggctgactacactctgtcttcgtacc

SEQ ID NO: 277104 - DNA, 582 bp, Homo sapiens
  misc_feature: GYAE6OF01EBFLT.29.35.D02.1.454.CMB.1.raw
  modified_base (204)..(204): a, c, t, g, unknown or other
  misc_feature (204)..(204): n is a, c, g, or t
tcagatagagtactcacgaccggtgctcgatttagcacacgatagttgggtttgggggaggaactgctcagttaggacccagacggaaccatggaagccccagctcagcttctcttcctcctgctactctggctcccagataccagcggagagattgtgttgacacagtctccagccaccctgtctttgtctccgggagaaagngccaccctctcctgcagggccagtcagagtgttaacactacttggcctggttccaacagaaacctggccaggcctcccaggcctcctcatctatgatgcatccaacgacgggccacgtggcatcccagcctaggttcagtcggctagggtgggtctgggacagtacttcactctcaccatcacgccgcctagacgcctagacggtacttcgtgtccgttttattagtttgttcgttgggcgtagacctaacgtcggtcccttcccgttctaccgtttcgggaccgtaggggtacccaaggtcgtaggagtactacgaacggaaccgtaacgtggtcggccgtcgaccgtaccctagttccttcgttccttccgtaccg

SEQ ID NO: 277105 - DNA, 523 bp, Homo sapiens
  misc_feature: GYAE6OF01CGNRU.29.35.D02.1.454.CMB.1.raw
  modified_base (199)..(199): a, c, t, g, unknown or other
  misc_feature (199)..(199): n is a, c, g, or t
  modified_base (204)..(204): a, c, t, g, unknown or other
  misc_feature (204)..(204): n is a, c, g, or t
  modified_base (518)..(518): a, c, t, g, unknown or other
  misc_feature (518)..(518): n is a, c, g, or t
tcagatagagtactcacgaccggtgctcgatttagcacacgatagttgggtttgggggaggaactgctcagttaggacccagacggaaccatggaagccccagctcagcttctcttcctcctgctactctggctcccagataccagcggagagattgtgttgacacagtctccagccaccctgtctttgtctccggganaaagngccaccctctcctgcagggccagtcagagtgttaacaactacttggcctggttccaacagaaacctggccaggctcccaggctcctcatctatgatgcatccaacagggccactggcactcccagccaggttcagtggcagtgggtctgggacagacttcactctcaccatcagccgcctagacgcctgaggattcgtgtcccgtttattagttgttcgttgggcgtagcaacgtggccctcccgtcgtactttggcctagggaccaggcgtggagagtcagacgatgtcggctgacacctactctacgtcttntaccg

SEQ ID NO: 277106 - DNA, 520 bp, Homo sapiens
  misc_feature: GYAE6OF01ACJCX.29.35.D02.1.454.CMB.1.raw
  modified_base (371)..(371): a, c, t, g, unknown or other
  misc_feature (371)..(371): n is a, c, g, or t
tcagatagagtactcacgaccggtgctcgatttagcacacgatagttgggtttggggaggaactgctcagttaggacccagacggaaccatggaagccccagctcagcttctcttcctcctgctactctggctcccagataccagcggagagattgtgttgacacagtctccagccaccctgtctttgtctccgggagaaagagccaccctctcctgcagggccagtcagagtgttaacaactacttggcctggttccaacagaaacctggccaggctcccaggctcctcatctatgatgcatccaacagggccactggcatcccagccaggttcagtggcagtgggtctgggacagacttcactctcacntcagccgcctagagcctgaggtattctgtccgtttattatttgtcgttgggcgttagctaacgtcggtcctcccgtctacgttttcggccgtacgggaccgagcgtggagagtcgacgtacgatggtcgctgcacatctcgtcttctac

SEQ ID NO: 277107 - DNA, 618 bp, Homo sapiens
  misc_feature: GYAE6OF01D8JKN.29.35.D02.1.454.CMB.1.raw
tcagatagagtactcacgaccggtgctcgatttagcacacgatagttgggtttgggggaggaactgctcagttaggacccagacggaaccatggaagccccagctcagcttctcttcctcctgctactctggctcccagataccagcggagagattgtgttgacacagtctccagcccaccctgtctttgtctccgggagaaagcggcccaccctctcctgcgagggccagtcagagtgttaacaactacttggccttggttaccaacagaaacctggccaggcctcccgaggcctcctcattctatgatcgaccactacccaacgacgggcccacgtggcactccccagtccaggttcagtcggctaggtgggtctgggacaggtacctcgactctacacctatccacgcccgactacgacgtccgtaggtagtacttcgttgtacccgttttattacgtttgtcgttgggcgtagactacgtcgtcccgttcccgtcgttaccgtttcggaccggtacggggaacctacggcgtacggagtactacgacggtaaccgtagttcgggtcggaccgtcgacccgtactacgttcgttaccgtttcgttccttaccccg

SEQ ID NO: 277108 - DNA, 554 bp, Homo sapiens
  misc_feature: GYAE6OF01DT13Y.29.35.D02.1.454.CMB.1.raw
tcagatagagtactcacgaccggtgctcgatttagcacacgatagttgggtttggggaggaactgctcagttaggacccagacggaaccatggaagccccagctcagcttctcttcctcctgctactctggctcccagataccagcggagagattgtgttgacacagtctccagccaccctgtctttgtctccgggagaaagagccaccctctcctgcagggccagtcagagtgttaacaactacttggcctggttccaacagaaacctggccaggctcccaggctcctcatctatgatgcatccaacgacgggccacgtggcactcccagccaggttcaggtggctaggtgggtctgggacaggacttcactctcaccatcagccgcctacgacgcctagagtattcgtcgtccgtttatttatttgttcgttgggtcgttagtacgtaacgtcggtccgttcccgttctacgttttcggaccgtaggggaccagcgtaggacgtacgtcgacgacggtatggtcggcgtgacacctactactcgtcttctac

SEQ ID NO: 277109 - DNA, 560 bp, Homo sapiens
  misc_feature: GYAE6OF01A73QA.29.35.D02.1.454.CMB.1.raw
  modified_base (203)..(203): a, c, t, g, unknown or other
  misc_feature (203)..(203): n is a, c, g, or t
  modified_base (308)..(308): a, c, t, g, unknown or other
  misc_feature (308)..(308): n is a, c, g, or t
tcagatagagtactcacgaccggtgctcgatttagcacacgatagttgggtttggggaggaactgctcagttaggacccagacggaaccatggaagccccagctcagcttctcttcctcctgctactctggctcccagataccagcggagagattgtgttgacacagtctccagccaccctgtctttgtctccgggagaaagngccaccctctcctgcagggccagtcagagtgtaacaactacttggcctggttccaacagaaacctggccaggctcccaggctcctcatctatgatgcatccaacngggccactggcatccccagccaggttcagtggcaggtgggtctgggacagacttcacttcctcaccctatccacgcccgcctacgacgccgtagaggtattcttgtccgtttatttagtttcgttcgttgggtcgtagtactaacgtcggtcccttcccgttctaccgttttcggccgtacggggaccgacgcgtgggtacgtagtcgagacgtacgtggtcggcgtcgactacactactcgtcgttctacc

SEQ ID NO: 277110 - DNA, 532 bp, Homo sapiens
  misc_feature: GYAE6OF01EX09S.29.35.D02.1.454.CMB.1.raw
tcagatagagtactcacgaccggtgctcgatttagcacacgatagttgggtttgggggaggaactgctcagttaggacccagacggaaccatggaagccccagctcagcttctcttcctcctgctactctggctcccagataccagcggagagattgtgttgacacagtctccagccaccctgtctttgtctccgggagaaagagccaccctctcctgcagggccagtcagagtgttaaacaactacttggcctggttccaacagaaacctggccaggctcccaggctcctcatctatgatgcatccaacagggccactggcatcccagccaggttcagtggcagtgggtctgggacagacttcactctcaccatcacgccgcctagacgccgtgaggtattctgtaccgtttattattgttcgttgggtcgtagtcaacgtcggtccctcccgtcctacgttttcggccgtacggggaccaaggctgggagatacgagacgaatggtggctgcaccatctcgttcttctac

SEQ ID NO: 277111 - DNA, 1145 bp, Homo sapiens
  misc_feature: GYAE6OF01BP2HM.29.35.D02.1.454.CMB.1.raw
tcagatagagtactcacgaccggtgctcgatttagcacacgatagttggggtttggggaggaactcgctcaggttaggacccagacggaaccagtggaagccccaggcctcagcttctccttccgtcctcgctactctggcctcccgagactaccgagccggagagtatttggtcgttagaccaacgagttcctaccccaaggtcccctaaccccttgttcccttttcggtaccgttcccgggggaagtaaaacggccgtacccctaaccccgttcgttacccggtaggaccgaacgggggccctagtaccaaggtacgttacggtttaaaccaaccggttactttacgggccccgttaggggttaccccaaaacgtaacggaaaaaccctttggggacccttaacggggccctttacccccggtaagggtcccttacccgttaccaaacgttaaccccgttaaaggtaaccggacctttcggacctactttaccccgaaacgtacggggtacccctaacgttcgggaccctaacgttacccccgaaccgttaccccgttaaggggtttaacccgtaggggttaccggtacccgtaagggtttcgggggttaacccggttacgggggaaacccgtaacgggtaaccgttttaccggaaccgtttacccgttacccgtaaccccgtaacgtttaccgaaccgggtaccccgttacccgttaaacggttaccggtaccccgttaacgggtaaaccgggttaccgttttaccggttaccgggtttaacccggttttttaacgtttttaaccggttttaccgggtttacccgggttttacgggggttacccgggtttaaacgggttacccgtttaaacccgggtttcccgggttaacccccgtttttaacccccgggtttacccgttttaaccccgggtttttttaccggggaaccccgggttaaacggggggttaaaccccttaacccgggttaccggtttaaccggggtaacggttaaccgggtttacccggaaaccggggtaaccgggttaaacccgttcggggttaccgggtaccgttaccggaaccccgttaaacccgtaacggtttacccggtttaccgtttccggttacccgttaaccccgg

SEQ ID NO: 277112 - DNA, 701 bp, Homo sapiens
  misc_feature: GYAE6OF01A6S09.29.35.D02.1.454.CMB.1.raw
tcagatagagtactcacgaccggtgctcgatttagcacacgatagttgggtttgggggaggaactgctcagttaggacccagacggaaccatggaagccccagctcagcttctcttcctcctgctactctggctcccagataccagcggagagattgtgttgacacagtctccagccaccctgtctttgtctccgggagaaagagcccaccctctcctgcagggccagtcagagtgttaacaactacttggcctggctaccaacacgaaacctggccaggcctcccaggcctcctcatctatgatgcatccaacgacgggccacgtggcactcccgagccgaggttcgaggtggctaggtgggtctgggactaggtacttcgacttctaccaccatccacgcccgacctagacgtcccgtaggtacggtactttccgttacggttacccgtttttaagtttacgttttcggtttacggtttcggggtaccggtttaacggtaccgtaaaccggtttccgggtaccccctttcccccggttacgtttacccggtttttcggggaccccggtaacggggggtaacccctaaagggtcccggttaagggacggtaacgttaccggaacggtaaccgggtaaacgttcgggtacgggtaccgttacggaccctaaccgttacttccgttccggttcctttacccg

SEQ ID NO: 277113 - DNA, 545 bp, Homo sapiens
  misc_feature: GYAE6OF01EZ67J.29.35.D02.1.454.CMB.1.raw
tcagatagagtactcacgaccggtgctcgatttagcacacgatagttgggtttgggggaggaactgctcagttaggacccagacggaaccatggaagccccagctcagcttctcttcctcctgctactctggctcccagataccagcggagagattgtgttgacacagtctccagccaccctgtctttgtctccgggagaaagagccaccctctcctgcagggccagtcagagtgttaaacaactacttggcctggttccaacagaaacctggccaggctcccaggctcctcatctatgatgcatccaacgagggccacgtggcatcccagccaggttcagtggcaggtgggtctgggacagacttcactctcaccagtccggccgcctacgacgccgtgacggtattcgtgtccgttttattatttgttcgttgggtcgtagctaacgtcgccctccgtctacgtttggccgtacgggacaacgcgtggagactcgacgacgtacgtggtggcgtcgcaccgtactcttgtcttcgtcttcccg

SEQ ID NO: 277114 - DNA, 574 bp, Homo sapiens
  misc_feature: GYAE6OF01ATBIV.29.35.D02.1.454.CMB.1.raw
tcagatagagtactcacgaccggtgctcgatttagcacacgatagttgggtttggggaggaactgctcagttaggacccagacggaaccatggaagccccagctcagcttctcttcctcctgctactctggctcccagataccagcggagagattgtgttgacacagtctccagccaccctgtctttgtctccgagagaaagagccaccctctcctgcagggccagtcagagtgttaacactacttggcctggttccaacagaaacctggccaggcctccgagctcctcatctatgatgcactaccaacgacgggccacgtcggacactccccagccgaggttcagtcggcgtaggtggtcgtagggacagtaccttcactctaccacctatcgacgccgaccgtagacgtcccgtaggaggtcttcgtcgttaccgtttatttagttcgttcgttgggtcgtagactacgtcggacccttccgtcttacgtttcggaccgtacggggaccaacgtcgtaggagtacgtacgacggtacgacgtggtcggctacgccactattctgttcttacg

SEQ ID NO: 277115 - DNA, 601 bp, Homo sapiens
  misc_feature: GYAE6OF01EM8KO.29.35.D02.1.454.CMB.1.raw
tcagatagagtactcacgaccggtgctcgatttagcacacgatagttgggtttgggggaggaactgctcagttaggacccagacggaaccatggaagccccagctcagcttctcttcctcctgctactctggctcccagataccagcggagagattgtgttgacacagtctccagccaccctgtctttgtctccgggagaaagagccaccctctcctgcagggccagtcagagtgttaacaactacttggcctggttccaacagaaacctggccaggctcccaggctcctcatctatgatgcatccaacagggccactggcatcccagccaggttcagtggcaggtgggtcgtgggacagtacttcactctccacctatccgacgcccgacctagacgcctaggaggtacttcgtgttccgttttatttagtttcgttcgtttcgggtcgttacggacctaaccgttcggcccttcccggttaccgttaccgttttcgggacccgtaacgggggacctaacggtcgtaggaacgtacgtacgaacggaaccgtaagttcggtcggacgtcgacctacctacttcttcgttccttctacccg

SEQ ID NO: 277116 - DNA, 533 bp, Homo sapiens
  misc_feature: GYAE6OF01A5YNA.29.35.D02.1.454.CMB.1.raw
  modified_base (525)..(525): a, c, t, g, unknown or other
  misc_feature (525)..(525): n is a, c, g, or t
tcagatagagtactcacgaccggtgctcgatttagcacacgatagttgggtttgggggaggaactgctcagttaggacccagacggaaccatggaagccccagctcagcttctcttcctcctgctactctggctcccagataccagcggagagattgtgttgacacagtctccagccaccctgtctttgtctccgggagaaagagccaccctctcctgcagggccagtcagagtgttaacaactacttggcctggttccaacagaaacctggccaggctcccaggctcctcatctatgatgcatccaacagggccactggcatccccagccaggttcagtggcaggtgggtctggggacaggactcactctcaccatcagccgcctagacgcctgaggtattcgtcgtccgtttatttattgttcgttgggtcgtagcgtaacgtcggtccctcccgtctacgttttcggccgtaggggtacccaggcgtggagatcgagacgtactggtggcgtgccacatctntcttctac

SEQ ID NO: 277117 - DNA, 647 bp, Homo sapiens
  misc_feature: GYAE6OF01C61ZR.29.35.D02.1.454.CMB.1.raw
  modified_base (199)..(199): a, c, t, g, unknown or other
  misc_feature (199)..(199): n is a, c, g, or t
  modified_base (262)..(262): a, c, t, g, unknown or other
  misc_feature (262)..(262): n is a, c, g, or t
  modified_base (290)..(290): a, c, t, g, unknown or other
  misc_feature (290)..(290): n is a, c, g, or t
tcagatagagtactcacgaccggtgctcgatttagcacacgatagttgggtttgggggaggaactgctcagttaggacccagacggaaccatggaagccccagctcagcttctcttcctcctgctactctggctcccagataccagcggagagattgtgttgacacagtctccagccaccctgtctttgtctccggganaaagagcccacctctcctgcagggccagtcagagtgttaacactacttggcctggttaccaanagaaacctggccaggctcccaggctccncatctatgatgcactccaacgcgggccacgtcggacactcccagccgtaaggttcaggtggcgtagggttgggtcgtggggaactacggacctttcgaccttcctaccacctatccgacgcccgtaccgtacggacgtccgtaggaggtacttcgttacgttaccgttttatttagtttcggttcgttgggtacgttacgctaaccgttcggtcccttacccggttaccgttaccggttttcggacccggtaacggggtaacccgacggtccggtaggaacgtacgtacgaacggtaacgaacgttaggtcggtccgtcgaccgtaccgtacttcgttccgttccttccgttacccg

SEQ ID NO: 277118 - DNA, 605 bp, Homo sapiens
  misc_feature: GYAE6OF01ERJLF.29.35.D02.1.454.CMB.1.raw
  modified_base (312)..(312): a, c, t, g, unknown or other
  misc_feature (312)..(312): n is a, c, g, or t
tcagatagagtactcacgaccggtgctcgatttagcacacgatagttgggtttgggggaggaactgctcagttaggacccagacggaaccatggaagccccagctcagcttctcttcctcctgctactctggctcccagataccagcggagagattgtgttgacacagtctccagccaccctgtctttgtctccgggagaaagagccacctctcctgcagggccagtcagagtgttaacaactacttggcctggttccaacagaaacctggccaggcctcccaggctcctcatctatgatgcataccaacgngggccacgtggcactccccagccaggttcaggtggcaggtggggtctgggacaggtacttcacctctcacctatcacgccgcctagacgcctaggagtacttcgtgtccgttttattacgtttggttcgttggggtcgtagacctaacgtcgggtcccttcccgtcttaccgtttcgggaccgaacggggacccaaggtcgtagggaagtacgtacgacggtaaaccgtaagttgggtcgggtaccgtgacccgtaaccgtaacttccgttacggtttcccttccgtaacccg

SEQ ID NO: 277119 - DNA, 742 bp, Homo sapiens
  misc_feature: GYAE6OF01CRJDG.29.35.D02.1.454.CMB.1.raw
  modified_base (263)..(263): a, c, t, g, unknown or other
  misc_feature (263)..(263): n is a, c, g, or t
tcagatagagtactcacgaccggtgctcgatttagcacacgatagttgggtttgggggaggaactgctcagttaggacccagacggaaccatggaagccccagctcagcttctcttcctcctgctactctggctcccagataccagcggagagattgtgttgacacagtctcagccacctgtctttgtctccgggagaaagacgccaccctctcctgcacgggccagtcagagtagttaacaactacttggcctggttccaanagaacctgccaggctccaggctcctacatctatgatcgcatacccaacgacgggccaacgtcgggaccaactccccgagacccgtagggttcaaggtggaccgtaaggttcggggtacgtcggggaactaggtacctttcgaccttccgtaccaaccgtataccgacgtacccgtaccttacggaccgtccgtagggaacggtactttacgtacggttacccgttttaattaacgtttcggttaccggtttacggggtaccggttaacggtaccgtaaaccgttccggggtaccccgttaccccggtttaccgtttaacccgggtttttccgggacccggtaacggggggttaaccccgaacggttaccggtacgggtaacggtacgtaccggaacggtaaccggtaaccgttacggtaccggtaccgtacgtacccgtaacccgtacttaccgttacggttcccttaccgttaacccg

SEQ ID NO: 277120 - DNA, 526 bp, Homo sapiens
  misc_feature: GYAE6OF01CMCJ8.29.35.D02.1.454.CMB.1.raw
  modified_base (261)..(261): a, c, t, g, unknown or other
  misc_feature (261)..(261): n is a, c, g, or t
  modified_base (522)..(522): a, c, t, g, unknown or other
  misc_feature (522)..(522): n is a, c, g, or t
tcagatagagtactcacgaccggtgctcgatttagcacacgatagttgggtttggggaggaactgctcagttaggacccagacggaaccatggaagccccagctcagcttctcttcctcctgctactctggctcccagataccagcggagagattgtgttgacacagtctccagccaccctgtctttgtctccgggagaaagagccaccctctcctgcagggccagtcagagtgttaacaactacttggcctggttccaanagaaacctggccaggctcccaggctcctcatctatgatgcatccaacagggcccacgtggcatccccagccaggttcagtggcaggtgggtctggggacagcttcactctcaccatcacgccgcctagacgcctgaggattctgtccgttttattatttcgttcgttgggcgttagctaacgtcggcccttcccgtctacgtttggccgaggggaccagcgtggagagtcagacgatggtcggctcgcaccatctgtcttntccg

SEQ ID NO: 277121 - DNA, 504 bp, Homo sapiens
  misc_feature: GYAE6OF01BXOWH.29.35.D02.1.454.CMB.1.raw
tcagatagagtactcacgaccggtgctcgatttagcacacgatagttgggtttgggggaggaactgctcagttaggacccagacggaaccatggaagccccagctcagcttctcttcctcctgctactctggctcccagataccagcggagagattgtgttgacacagtctccagccaccctgtctttgtctccgggagaaagagccaccctctcctgcagggccagtcagagtgttaacaactacttggcctggttccaacagaaacctggccaggctcccaggctcctcatctatgatgcatccaacagggccactggcatcccagccaggttcagtggcagtgggtctgggacagacttcactctcaccatcagccgcctagagcctgaggattctgccgtttattattgtctttgggcgtagcaactggcctcccgtcacttttggcctaggggaccaagctggagatcagacgaatgtggctgcacatctgtcttctac

SEQ ID NO: 277122 - DNA, 722 bp, Homo sapiens
  misc_feature: GYAE6OF01CB1UJ.29.35.D02.1.454.CMB.1.raw
  modified_base (266)..(266): a, c, t, g, unknown or other
  misc_feature (266)..(266): n is a, c, g, or t
tcagatagagtactcacgaccggtgctcgatttagcacacgatagttgggtttgggggaggaactgctcagttaggacccagacggaaccatggaagccccagctcagcttctcttcctcctgctactctggctccagataccagcggagagattggtgttgacacagtctccagccaccttgtctttgtcgtccgggagaaagacgccacctctcctgcagggccagtcagagtagttaacactacgttggccttggttaccaanagaaacctggccaggctcccgaggcctcctcatctatgatgcatccaacgacgggccactgggccactccccaagcctaggttcaggtggcgaggttgggtctggggacacggtacttcacgtctaccgaacctatccgacgcccgaccgtacgacgtccgtaggtacggtaacgtttccgttacggtacccgtttttaagtttacgttttcggtttaccgtttacggggttaccggttaacggtaccgttaaaccgttccgggtcccccgtttaccccggtttacccgttaccgttttttaccggggacccggtaaccgggggtaacccgtaacggtaccggttacgggtaacggtacgttaccggaacgggtaaccgggtaacgtacgggttacgggtcccgttacggacctaacccgttacgttaccgtttacggttccctttccgttacccg

SEQ ID NO: 277123 - DNA, 514 bp, Homo sapiens
  misc_feature: GYAE6OF01CKPM6.29.35.D02.1.454.CMB.1.raw
  modified_base (262)..(262): a, c, t, g, unknown or other
  misc_feature (262)..(262): n is a, c, g, or t
tcagatagagtactcacgaccggtgctcgatttagcacacgatagttgggtttgggggaggaactgctcagttaggacccagacggaaccatggaagccccagctcagcttctcttcctcctgctactctggctcccagataccagcggagagattgtgttgacacagtctccagccaccctgtctttgtctccgggagaaagagccaccctctcctgcagggccagtcagagtgttaacaactacttggcctggttccaanagaaacctggccaggctcccaggctcctcatctatgatgcatccaacagggccactggcatcccagccaggtcagtggcagtgggtctgggacaggacttcactctcaccatcagccgcctagacgcctgaggattctgtccgtttattattgtcgttgggcgtagcaacgtcggcctcccgtcacgttttggccgtagggaccagctggagagtcgagacgaagtggtggctgcacatctgtcttctaccg

SEQ ID NO: 277124 - DNA, 518 bp, Homo sapiens
  misc_feature: GYAE6OF01CNRBS.29.35.D02.1.454.CMB.1.raw
tcagatagagtactcacgaccggtgctcgatttagcacacgatagttgggtttgggggaggaactgctcagttaggacccagacggaaccatggaagccccagctcagcttctcttcctcctgctactctggctcccagataccagcggagagattgtgttgacacagtctccagccaccctgtctttgtctccgggagaaagagccaccctctcctgcagggccagtcagagtgttaacaactacttggcctggttccaacagaaacctggccaggctcccaggctcctcatctatgatgcatccaacagggccactggcactcccagccaggttcagtggcaggtgggtctgggacagacttcactctcaccatcagccgcctacgacgcctagagtattcgtgtccgtttattattgtcgttgggtcgtagcaacgtcggtcctcccgtctacgtttcggccgagggaccagcgtggagatcgagacgatgtcggctgcaccatctgtcttctac

SEQ ID NO: 277125 - DNA, 544 bp, Homo sapiens
  misc_feature: GYAE6OF01CDOO1.29.35.D02.1.454.CMB.1.raw
  modified_base (318)..(318): a, c, t, g, unknown or other
  misc_feature (318)..(318): n is a, c, g, or t
tcagatagagtactcacgaccggtgctcgatttagcacacgatagttgggtttgggggaggaactgctcagttaggacccagacggaaccatggaagccccagctcagcttctcttcctcctgctactctggctcccagataccagcggagagattgtgttgacacagtctccagcccaccctgtctttgtctccgggagaaagcgccaccctctcctgcagggccagtcagagtagttaaacaacttacttggcctggttccaacagaaaacctggccaggcctcccgaggcctcctcatctatgatgcatccaacngggccactggcatcccagccaggttcaggtggcaggtgggtcgtgggacaggacttcactctcaccatcagccgctacgacgcctagagtattcgtgtaccgtttattagttcgttcgttgggcgtagctacgtcggccctccgtctcgtttggccgtacgggaccaagctggagtatacgacgacgtaactggtcggcgtcgaccactacttctcgttcttctcc

SEQ ID NO: 277126 - DNA, 837 bp, Homo sapiens
  misc_feature: GYAE6OF01ELDLS.29.35.D02.1.454.CMB.1.raw
tcagatagagtactcacgaccggtgctcgatttagcacacgatagttgggggttggggaggaactcgctcagttagggaccctacggacggaacctactggtaacggccccagctcagctttctacttcctccgtggccttactcctggcgtcccgttaggacttaccgaaggccgggtaggttacgtagttttggtcgttttagtaaccaaacgtgttcctaccgaggccacccgttgtcctttggtccttccggggagaaagacgccgaacccgtctcccttgctacggggccacggttcggacgagtgttaaaccaacttccttgggcctggttaccaactacgtaaaccgttcggccctaggctacccgacggactcctcactctactggactcgcactcccgaaggacggggccacgtggcgaactcccagtaccgtaggtttcaggttcggtcgtaacgtgggttacgtacgggtaaccgaacggtaccgttcctaaccgttcgttaccggaccctaactttaccgaaccgtcccggtacccttacggaacgtacccgtacgtaacggtaacttacgtacgtaccggttttaagtttactttcgttaccgtttagggtacggttaacgaccgtaaccgttcgggacccgttacccggttaccgtacgtttttaccgggacccgttaaccgggggtaccccgtaaagggttccgttacgggtacggtacgttacggtaaggtaaccgtaaacgttacgggttaccggaacgttccgggaccggtaacccctaacgttaaccgtttcggttacccgttaccggttaacccggg

SEQ ID NO: 277127 - DNA, 678 bp, Homo sapiens
  misc_feature: GYAE6OF01CSM7H.29.35.D02.1.454.CMB.1.raw
  modified_base (263)..(263): a, c, t, g, unknown or other
  misc_feature (263)..(263): n is a, c, g, or t
tcagatagagtactcacgaccggtgctcgatttagcacacgatagttgggtttgggggaggaactgctcagttaggacccagacggaaccatggaagccccagctcagcttctcttcctcctgctactctggctcccagataccagcggagagattgtgttgacacagtctccagcccaccctgtcttgtctccgggagaaagcgccaccctctcctgcagggccagtcagagtgttaacaacttactggctggttaccaaanacgaaacctggccaggcctcccgaggcctcctcatctatgatgcatccaaacgacgggcccacgtcggaccactaccccagccctaggttcgaaggtcggcgagggttcgggtcgtggggaacctacggtaccttcgaccttccgtaccaacactaccgacgtacccgaccgtaggaccgtccgtaggtacggtactttcgtacggttccgttttaatttacgttggttccgttgggtccgttagtacgtaaccgtccgggtaccccttcccggttacctttaccggttttaccgggacccggtaaacggggtacccgtaaggtccggtagggtacgtacgtacgaacggtaaacggtaacgtcgggtcggtcccgtagtaccctaccgtacttccgttcttccgtttcgtaccg

SEQ ID NO: 277128 - DNA, 720 bp, Homo sapiens
  misc_feature: GYAE6OF01CPQQ6.29.35.D02.1.454.CMB.1.raw
  modified_base (262)..(262): a, c, t, g, unknown or other
  misc_feature (262)..(262): n is a, c, g, or t
tcagatagagtactcacgaccggtgctcgatttagcacacgatagttgggtttgggggaggaactgctcagttaggacccagacggaaccatggaagccccagctcagcttctcttcctcctgctactctggctcccagataccagcggagagattgtgttgacacagtctccagcccaccctgtctttgtcctccgggagaaagacgcccaccctctcctgcagggccagtcagagtgtaacactactggcctggtccaanagaaacctggcaggcctcccaggctcctcatctatgatcgacactccaacgacgggccactggccactccccagccgtaggttcaggtcggacgtaggtcggggtcgtggggaacagtaccttcgacctctaccgacacgtaccgacgcccgtaccgtacggacgaccgtaggtacggtactttccgttacggtttaccgttttaagtttaacgttttcgggttaccggttttacggggtaccggtttacgtaccgttaacccggttccgggttacccccgtttaccccgggtttcccgtttaaccggtttttcccggggacccgggttaaccgggggtaacccgtaacgggtccggtaagggtacggtaaccgtaccggtaaacggaaccggttaacgttcgggtcggtccgtacggacctaacccgtagttacccttcgttccgttccgttacccg

SEQ ID NO: 277129 - DNA, 554 bp, Homo sapiens
  misc_feature: GYAE6OF01B7KAL.29.35.D02.1.454.CMB.1.raw
  modified_base (259)..(259): a, c, t, g, unknown or other
  misc_feature (259)..(259): n is a, c, g, or t
  modified_base (391)..(391): a, c, t, g, unknown or other
  misc_feature (391)..(391): n is a, c, g, or t
  modified_base (503)..(503): a, c, t, g, unknown or other
  misc_feature (503)..(503): n is a, c, g, or t
tcagatagagtactcacgaccggtgctcgatttagcacacgatagttgggtttgggggaggaactgctcagttaggacccagacggaaccatggaagccccagctcagcttctcttcctcctgctactctggctccagataccagcggagagattgtgttgacacagtctccagccaccctgtctttgtctccgggagaaagagccacctctctgcagggccagtcagagtgttaacaactacttggcctggttccaanagaaacctggccaggctccaggctcctcatctatcgatgcactccaacagggccactggcactcccgagcctaggttcaggtcggcgaggtgggtctggggactaggctttcactctacaccatcgacgccncgtagacgcctgaggtacttcgtgtccgttttattagttgtacgttcgggacgtacgctaacgtcggtcccttcccgtcttacgtttcggccgtaagggaccagcgtagganacgtacgagacgtacgtggtggcgtgactacctatcgttcgtcgttctacg

SEQ ID NO: 277130 - DNA, 563 bp, Homo sapiens
  misc_feature: GYAE6OF01D6Y1G.29.35.D02.1.454.CMB.1.raw
  modified_base (265)..(265): a, c, t, g, unknown or other
  misc_feature (265)..(265): n is a, c, g, or t
tcagatagagtactcacgaccggtgctcgatttagcacacgatagttggggtttgggggaggaactgctcagttaggacccagacggaaccatggaagccccagctcagcttctcttcctcctgctactctggctcccagataccagcggagagattgtgttgacacagtctccagccaccctgtctttgtctccggggagaaagcgccaccctctcctgcagggccagtcagagtgttaacaactacttggcctggttaccaanagaaacctggccaggctcccaggctcctcatctatgatgcatccaacgcgggccacgtggcactcccagccagttcagtggcaggtgggtctgggacagctcactctcaccatcacgccgctacgacgtctgtaggtacttcgttgtacccgttttatttacgttcgtcgtttgggaccgtagcaacgtcggcccttcccgtctccgtttcggccgtacgggaccgaggtcgtgggagacgtacgacgacgtaagtggtcggcgtagacctaccgtactcttcgttccttcgtacccg

SEQ ID NO: 277131 - DNA, 510 bp, Homo sapiens
  misc_feature: GYAE6OF01E5PNG.29.35.D02.1.454.CMB.1.raw
tcagatagagtactcacgaccggtgctcgatttagcacacgatagttgggtttgggggaggaactgctcagttaggacccagacggaaccatggaagccccagctcagcttctcttcctcctgctactctggctcccagataccagcggagagattgtgttgacacagtctccagccaccctgtctttgtctccgggagaaagagccaccctctcctgcagggccagtcagagtgttaacaactacttggcctggttccaacagaaacctggccaggctcccaggctcctcatctatgatgcatccaacagggccactggcatccccagccaggttcagtggcagtgggtctgggacagacttcactctcaccatcagccgcctagacgctgaggtattctgtccgtttattattgtcttgggcgtagctaactcggcctcccgtctacgtttggccgtagggaccagcgtggagatacgagacgatggtggctgcacatctgtctctac

SEQ ID NO: 277132 - DNA, 571 bp, Homo sapiens
  misc_feature: GYAE6OF01DECGJ.29.35.D02.1.454.CMB.1.raw
  modified_base (259)..(259): a, c, t, g, unknown or other
  misc_feature (259)..(259): n is a, c, g, or t
  modified_base (381)..(381): a, c, t, g, unknown or other
  misc_feature (381)..(381): n is a, c, g, or t
tcagatagagtactcacgaccggtgctcgatttagcacacgatagttgggtttgggggaggaactgctcagttaggacccagacggaaccatggaagccccagctcagcttctcttcctcctgctactctggctccagataccagcggagagattgtgttgacacagtctccagccaccctgtctttgtctccgggagaaagcgccaccctctcctgcagggccagtcagagtgtaacaactcttggcctggttccaanagaaacctggccaggcctcccaggctcctcatctatgatgcatccaacagggccactggcactcccagccgtaggttcagtcggcgtaggtcgggtcgtggggacacggtacttcgacttcnccaccatccacgccgccgtagacgcgtagaggtacttcgtgtccgtttattattgtcgttggtcgtacgtctaacgtcggtcctccgtcgtacgttttcggccgtacggggacctaggtcgtaggagtacgtcgaacggtacgaagttcggtcggcgtcgaccgtaccgtactcttcgttcgttctaccg

SEQ ID NO: 277133 - DNA, 548 bp, Homo sapiens
  misc_feature: GYAE6OF01D3HG2.29.35.D02.1.454.CMB.1.raw
  modified_base (397)..(397): a, c, t, g, unknown or other
  misc_feature (397)..(397): n is a, c, g, or t
tcagatagagtactcacgaccggtgctcgatttagcacacgatagttgggtttgggggaggaactgctcagttaggacccagacggaaccatggaagccccagctcagcttctcttcctcctgctactctggctcccagataccagcggagagattgtgttgacacagtctccagccaccctgtctttgtctccgggagaaagagccaccctctcctgcagggccagtcagagtgttaacaactacttggcctggttccaacagaaacctggccaggcctcccaggctcctcatctatgatgcatccaacgacgggccagtggcatcccagccagtcagtgcagtgggtctgggacagtcttcgactctcacatcacgccgactagacgcctgagtnttcgtcgtccgtttattagttgtcgttggtcgtagacgtacgtcggtcctccgttcgtacgtttcggaccgtacgggaccaggcgtggagacgtacgaacggacgtaacgtggtcggctcgaccgtacctacgtcttcgttcgttctaccg

SEQ ID NO: 277134 - DNA, 534 bp, Homo sapiens
  misc_feature: GYAE6OF01EK4H4.29.35.D02.1.454.CMB.1.raw
tcagatagagtactcacgaccggtgctcgatttagcacacgatagttgggtttgggggaggaactgctcagttaggacccagacggaaccatggaagccccagctcagcttctcttcctcctgctactctggctcccagataccagcggagagattgtgttgacacagtctccagccaccctgtctttgtctccgggagaaagagccaccctctcctgcagggccagtcagagtgttaaacaactacttggcctggttccaacagaaacctggccaggctcccaggctcctcatctatgatgcatccaacagggccactggcatcccagccaggttcaggtggcagtggtctgggacagactcactctcaccatcacgccgcctagacgcctgagtacttctgtaccgtttattattgttcgttgggcgtagctaacgtcggcccttcccgtctaccgttttggccgtaggggacccaagcgtaggagactacaggacgtaacgtggtggctgcctacactctgttcttctacc

SEQ ID NO: 277135 - DNA, 632 bp, Homo sapiens
  misc_feature: GYAE6OF01ACDLM.29.35.D02.1.454.CMB.1.raw
  modified_base (196)..(196): a, c, t, g, unknown or other
  misc_feature (196)..(196): n is a, c, g, or t
  modified_base (209)..(209): a, c, t, g, unknown or other
  misc_feature (209)..(209): n is a, c, g, or t
tcagatagagtactcacgaccggtgctcgatttagcacacgataggttgggtttggggaggaactgctcagttaggacccagacggaaccatggaagcccagctcagcttctcttcctcctgctactctggcctcccagataccagcggagagattgtgttgacacagtctccagccacctgtcttgcgtcggganaaagcgccacctnctgcaggccagtcagtagtagttaaacacttacgttcgggccttggttaccaaacgtaacgaaacccgtggggacccaacggcctacccgacggtcctcctacatctatgatcgacaactaccgaacgcgggaccacgtcggcaactcccgaagccgtaaggttcgaggtcgacgtagggtcgggtcgtagggactacgtaccttacacctacctaccaaccagtccgaacggtcccgacgtagacgtccgttaggaggttacttcgttcgttacgtttattgttcggtcgttagggactacgactaaccggttcgcccgttaccgtcgttacgttcggaccgaaggggtacccaagtccgtaggactacgtacgaacggtacagttcgggacgctacgacttaccgattctcgtctctaccg

SEQ ID NO: 277136 - DNA, 512 bp, Homo sapiens
  misc_feature: GYAE6OF01BGUJQ.29.35.D02.1.454.CMB.1.raw
tcagatagagtactcacgaccggtgctcgatttagcacacgatagttgggtttgggggaggaactgctcagttaggacccagacggaaccatggaagccccagctcagcttctcttcctcctgctactctggctcccagataccagcggagagattgtgttgacacagtctccagccaccctgtctttgctccgggagaaagagccaccctctcctgcagggccagtcagagtgttaacaactacttggcctggttccaacagaaacctggccaggctcccaggctcctcatctatgatgcatccaacagggccactggcatcccagccaggttcagtgcagtgggtctgggacagacttcactctcaccatcagccgcctagacgcctgaggtattctgtccgtttattattgtcgttggcgtagcactcggcctcccgtctacgtttcggccgtaggggaccagcgtggagagtcgacgacgaatggtggctgcacatctcgtcttctac

SEQ ID NO: 277137 - DNA, 616 bp, Homo sapiens
  misc_feature: GYAE6OF01DWNPY.29.35.D02.1.454.CMB.1.raw
  modified_base (291)..(291): a, c, t, g, unknown or other
  misc_feature (291)..(291): n is a, c, g, or t
tcagatagagtactcacgaccggtgctcgatttagcacacgatagttgggtttggggaggaactgctcagttaggacccagacggaaccatggaagccccagctcagcttctcttcctcctgctactctggctcccagataccagcggagagattgtgttgacacagtctccagccacctgtctttgtctccgggagaaagcgccaccctctcctgcagggccagtcagagtgttaaacaactacttggcctggttaccaacagaaacctggccaggcctccaggctcctnatctatgatgcactccaaacgacgggccacgtggacactccccgagccaggttcaaggtcggactagggttgggtctaggggaacaggtactttcactctacacatcgacgccgacctagacgccgtaggacggtattcgtcgttaccgtttagttattcgttcgttcgggcgtaagacgtaacgtcggtcccgtcccgttaccgtacgttttaccggaccgtaacggggtaaccaaggtccgtaggtacgtacgtacgaacggtaaccgtaacgttggtcggaccgtcggacctacccgtacttcgttcgttccttcgtacccg

SEQ ID NO: 277138 - DNA, 556 bp, Homo sapiens
  misc_feature: GYAE6OF01APP4E.29.35.D02.1.454.CMB.1.raw
  modified_base (310)..(310): a, c, t, g, unknown or other
  misc_feature (310)..(310): n is a, c, g, or t
tcagatagagtactcacgaccggtgctcgatttagcacacgatagttgggtttgggggaggaactgctcagttaggacccagacggaaccatggaagccccagctcagcttctcttcctcctgctactctggctcccagataccagcggagagattgtgttgacacagtctccagccaccctgtctttgtctccgggagaaagagccaccctctcctgcagggccagtcagagtgttaacaactacttggcctggttccaacagaaaccctggccaggctcccaggctcctcatctatgatgcatccaancgggccactggcatcccagccaggttcagtggcaggtggtctgggacagcttcactctcaccatccagccgcctagacgcctgaggtattctcgtccgtttattattgtcttgggtcgtagcaacgtcggcctcccgtctacgttttcggccgtacggggaccgaagcgtggacgtagtccgacgaccggtaacgttggtcgggtccgtgccgtaacccgtattaccttcggttcttcgttaaccg

SEQ ID NO: 277139 - DNA, 586 bp, Homo sapiens
  misc_feature: GYAE6OF01DUK9U.29.35.D02.1.454.CMB.1.raw
  modified_base (313)..(313): a, c, t, g, unknown or other
  misc_feature (313)..(313): n is a, c, g, or t
tcagatagagtactcacgaccggtgctcgatttagcacacgatagttgggtttgggggaggaactgctcagttaggacccagacggaaccatggaagccccagctcagcttctcttcctcctgctactctggctcccagataccagcggagagattgtgttgacacagtctccagccacccttgtctttgtctccggggagaaaagacgccaccctctcctgcagggccagtcagagtgttaaacactacttggcctggttccaaacagaaacctggccaggctcccaggctctcatctatgatgcatccaangggccatggcatcccagccaggttcaggtgcaggtggtctgggacagacttcactctcaccatcacgccgctacgacgctgaggtattctcgtaccgtttatttagtttcgttcgttggtcgtagctaacgtcggtcctcccgtcgtaccgttttcggaccgtacggggtaaccgaacggtcgtagggtacgtagtacgaacggaaccggtaacgttcggtcgggtacctcggaccctaacccgtacttaccgttcgttccgttcgtaacccg

SEQ ID NO: 277140 - DNA, 915 bp, Homo sapiens
  misc_feature: GYAE6OF01EC2TY.29.35.D02.1.454.CMB.1.raw
tcagatagagtactcacgaccggtgctcgatttagcacacgatagttgggtttgggggaggaactgctcagttaggacccagacggaaccatggaagcccagctcagcttctcttcctcctgctactctggctccagataccagcggagagattgtgttgacacagtctccagccacctgtcttgtctccgggagaaacgcgccaccgtctccgtgcgacgggccaggtcaggagttacgtaaaccaacttacgttgggccttagggttacccaaacgtacgtaaaacccgttggaccctaagggtcccttacccgagggtccttccccgtatacgtccttaagtcggaacttcggacctaacgttaccccgaaacggtacggggaccctaaccggttacggggacctaaacccggttccccccgaaaaggttccccgtaaacggggttttacccgaaaggggtttacggggacccgttaaagggggtttcgggggggtttaccctaacgggggggaaaccctaaacggggttacccctttttaaccggaccctttaccccttaaccgaaacccgttacggttaccccgaacgggttacccccggtaccccgttaaacggacccggttaccgtaacgggtaacggttaccgtttaccgttaccgggtttaccgtttttaagtttaaccggttttcgggtttaccgggtttacggggttaccggtttaacggtaccgttaaacccgggtccggttaccccggttaccccgttacggtttacccgtttttacgggacccggtaaacggggtacccgtaacggtccggtaaggggtacgtacgtaccggtacggtaaccgttagttcggtacgtacgtcgtacgtaccgtagttaccgtcggttacgtcgttaacccg

SEQ ID NO: 277141 - DNA, 454 bp, Homo sapiens
  misc_feature: GYAE6OF01CAH43.29.35.D02.1.454.CMB.1.raw
  modified_base (259)..(263): a, c, t, g, unknown or other
  misc_feature (259)..(263): n is a, c, g, or t
  modified_base (265)..(265): a, c, t, g, unknown or other
  misc_feature (265)..(265): n is a, c, g, or t
  modified_base (271)..(271): a, c, t, g, unknown or other
  misc_feature (271)..(271): n is a, c, g, or t
  modified_base (275)..(275): a, c, t, g, unknown or other
  misc_feature (275)..(275): n is a, c, g, or t
  modified_base (278)..(278): a, c, t, g, unknown or other
  misc_feature (278)..(278): n is a, c, g, or t
  modified_base (281)..(281): a, c, t, g, unknown or other
  misc_feature (281)..(281): n is a, c, g, or t
  modified_base (284)..(284): a, c, t, g, unknown or other
  misc_feature (284)..(284): n is a, c, g, or t
  modified_base (290)..(290): a, c, t, g, unknown or other
  misc_feature (290)..(290): n is a, c, g, or t
  modified_base (292)..(292): a, c, t, g, unknown or other
  misc_feature (292)..(292): n is a, c, g, or t
  modified_base (294)..(294): a, c, t, g, unknown or other
  misc_feature (294)..(294): n is a, c, g, or t
  modified_base (296)..(296): a, c, t, g, unknown or other
  misc_feature (296)..(296): n is a, c, g, or t
  modified_base (301)..(301): a, c, t, g, unknown or other
  misc_feature (301)..(301): n is a, c, g, or t
  modified_base (303)..(303): a, c, t, g, unknown or other
  misc_feature (303)..(303): n is a, c, g, or t
  modified_base (306)..(307): a, c, t, g, unknown or other
  misc_feature (306)..(307): n is a, c, g, or t
  modified_base (310)..(310): a, c, t, g, unknown or other
  misc_feature (310)..(310): n is a, c, g, or t
  modified_base (315)..(316): a, c, t, g, unknown or other
  misc_feature (315)..(316): n is a, c, g, or t
  modified_base (320)..(320): a, c, t, g, unknown or other
  misc_feature (320)..(320): n is a, c, g, or t
  modified_base (323)..(323): a, c, t, g, unknown or other
  misc_feature (323)..(323): n is a, c, g, or t
  modified_base (328)..(328): a, c, t, g, unknown or other
  misc_feature (328)..(328): n is a, c, g, or t
  modified_base (331)..(331): a, c, t, g, unknown or other
  misc_feature (331)..(331): n is a, c, g, or t
  modified_base (334)..(335): a, c, t, g, unknown or other
  misc_feature (334)..(335): n is a, c, g, or t
  modified_base (356)..(356): a, c, t, g, unknown or other
  misc_feature (356)..(356): n is a, c, g, or t
  modified_base (377)..(377): a, c, t, g, unknown or other
  misc_feature (377)..(377): n is a, c, g, or t
  modified_base (398)..(398): a, c, t, g, unknown or other
  misc_feature (398)..(398): n is a, c, g, or t
  modified_base (400)..(400): a, c, t, g, unknown or other
  misc_feature (400)..(400): n is a, c, g, or t
  modified_base (416)..(416): a, c, t, g, unknown or other
  misc_feature (416)..(416): n is a, c, g, or t
  modified_base (420)..(420): a, c, t, g, unknown or other
  misc_feature (420)..(420): n is a, c, g, or t
tcagatagagtactcacgaccggtgctcgatttagcacacgatagttgggtttggggacagacttcactctcaccatcagccgcctagacgcctgaggattcgtgccgtttattattgtcttgggcgtagcaactggcctccgtcacttttggccaggggaccaagctggagatcagacgaactgtggctgcaccatctgtcttcatcttccgccatctgaagtactctaatctgagcgggctggctaaggcgcatagnnnnncngtgctnctancancancgntaacgncncncntgctnangtnngtncacgnncacnctnctgcnacncgnntcgtcgtctcgcgagcgcgtntctctctctcgtcgtctcgtntctctgtgtgtgtcgtcgcgngncgtcgtcgtacgtcgncgcncgtcgtacgtacgtacgtacgtacgtcgtcgtcg

SEQ ID NO: 277142 - DNA, 544 bp, Homo sapiens
  misc_feature: GYAE6OF01AXFOY.29.35.D02.1.454.CMB.1.raw
  modified_base (308)..(308): a, c, t, g, unknown or other
  misc_feature (308)..(308): n is a, c, g, or t
tcagatagagtactcacgaccggtgctcgatttagcacacgatagttgggtttggggaggaactgctcagttaggacccagacggaaccatggaagccccagctcagcttctcttcctcctgctactctggctcccagataccagcggagagattgtgttgacacagtctccagccaccctgtctttgtctccgggagaaagagccacctctcctgcagggccagtcagagtgttaacaactacttggcctggttccaacagaaacctggccaggctcccaggctcctcatctatgatgcatccaacngggccactggcactcccagccaggttcagtggcagtggtctgggacagacttcactctcacactcacgccgctacgacgcctgacgtagttcgtcgtccgtttattattgttcgttcgggtcgtagcaacgtcggtcctacccgtctacttttcggccgtacgggtaccaagtcgtacggagtactacgacggacgtaacgtcggtggctacgctaccactctcgtcgttctaccg

SEQ ID NO: 277143 - DNA, 599 bp, Homo sapiens
  misc_feature: GYAE6OF01DWR4H.29.35.D02.1.454.CMB.1.raw
  modified_base (262)..(262): a, c, t, g, unknown or other
  misc_feature (262)..(262): n is a, c, g, or t
tcagatagagtactcacgaccggtgctcgatttagcacacgatagttgggtttgggggaggaactgctcagttaggacccagacggaaccatggaagccccagctcagcttctcttcctcctgctactctggctcccagataccagcggagagattgtgttgacacagtctccagccaccctgtctttgtctccgggagaaagacgccaccctctcctgcagggccagtcagagtgtaacaactacttggcctggttccaanagaaacctggccaggcctcccgaggctcctcatctatgatgcatccaagacgggccagtcgcactccagccaggttcagtgcgtaggtggtcgtgggacagtacttcactctacacctatccgagcccgcgtagacgccgtagaggtattcgtcgttaccgttttattagtttcgttcgttgggtacgtacgctaaccgtcggtcccttcccgtcgttacgttttcggaccgtaacggggtaccgacggtcgtaggagtacgtacgaacggaccggtaaacgttcggtcggaccgtacgaccgtaacccgtacgttccttcgttcttacgttacccg

SEQ ID NO: 277144 - DNA, 605 bp, Homo sapiens
  misc_feature: GYAE6OF01D29XA.29.35.D02.1.454.CMB.1.raw
tcagatagagtactcacgaccggtgctcgatttagcacacgatagttgggtttgggggaggaactgctcagttaggacccagacggaaccatggaagccccagctcagcttctcttcctcctgctactctggctcccagataccagcggagagatttgtgttgacacagtctccagcccaccttgttctttgtcgtccgggaagaaagcgcccaccctctcctgcgacgggccagtcagtagtcttaacactacttggccttggtaccaacacgaaacctggccacggctccaggctacctcactctagtcgatcgcactccgaacgcgggccacgtggcacgtcccgagcccgaggttcaaggtcggacgtagggttcgggcgtaggggactacggtaccttcacctccttaccacactccgacgcccgaccgtacgacgccgtaggtacggtacgttcgttcgttaccgttttagtttgtttcgttcgttggtacgtacgctacgtcgcccttccgtctcgtttcggacgacgggacacgcgtagacgagtacacgtacgtagtcggtcgcgtgacctacgtacttcgtcgtccttcgtaccg

SEQ ID NO: 277145 - DNA, 712 bp, Homo sapiens
  misc_feature: GYAE6OF01D5SVC.29.35.D02.1.454.CMB.1.raw
tcagatagagtactcacgaccggtgctcgatttagcacacgatagttgggtttgggggaggaactgctcagttaggacccagacggaaccatggaagccccagctcagcttctcttcctcctgctactctggctcccagataccagcggagagattgtgttgacacagtctccagcccaccctgtctttgtctccgggaagaaagcgcccaccctctcctgcagggccagtcagagtgttaaacactacttggcctggttaccaacagaaacctggaccaggcctcccgaggcctcctacatctatgatgcactaccaacgacgggcctacgtcggactactcccgagtccgtaaggttccgaaggttcggacgtagggtcggggttcgtaggggaacctacggtacctttcgaacctccgtaccaacctactccgacgcccgtaccgtaacggaccgtccgtacggtacggtactttcgttacggttaccgtttttagtttacgtttacggttcggtttcgggtacgttacgtaccgtaaccgttcggtccccgtttacccggttaccgttacggttttaccgggacccggtaacggggtaaccgtaacgggtcgtagggaacgtacgtaaccgtaacggtaaccggtaacgttcgggttcggaccgttacgacccgtaccgtagttacccgttcgttccttccgttaccg

SEQ ID NO: 277146 - DNA, 819 bp, Homo sapiens
  misc_feature: GYAE6OF01BEPOV.29.35.D02.1.454.CMB.1.raw
tcagatagagtactcacgaccggtgctcgatttagcacacgatagttgggtttgggggaggaactgctcagttaggacccagacggaaccatggaagccccagctcagcttctcttcctcctgctactctggctcccagataccagcggagagattgtgttgacacagtcctccagcccaccctgttcctttgtcctccggggaagaaacgacgcccaccctctcctgcgacgggccagtcagagtcgtaaccactacgttggcctaggtaccaacacgaaaccgtcggaccacggcctcccgacggtcctcctacacttctatcgatcgactacgtaccgaacggacgggccctacgtcggacctaaccgtccccgtaggtacccgtaagggttccgaacggtcggtaccggtaagggttcgggggtacgtacggggaacctaacgtaccgtttccaacccgttcctaacctaacccgtaacgtcccgaaccggtacccccgtaccgtaaacggtacccggtaccgttaacggtaagggtttacctttaccggttacggtttacccgtttttagttttaacggttcggtttaccggtttaccggggtacgttaaacgggtacccgttaaaccgggtttcccgggtaccccgtttaccccgggtttaccgtttacccggggttttaccgggaacccgggtaaccggggaacctaacgggtacgtagggtaaccgtacgtaaccgtaacggtaaccgtaacggttcgggtcgtaccgtacggcctaaccggtcttaccgtccttccgttccttaccccgg

SEQ ID NO: 277147 - DNA, 814 bp, Homo sapiens
  misc_feature: GYAE6OF01B1QD9.29.35.D02.1.454.CMB.1.raw
  modified_base (200)..(200): a, c, t, g, unknown or other
  misc_feature (200)..(200): n is a, c, g, or t
tcagatagagtactcacgaccggtgctcgatttagcacacgatagttgggtttgggggaggaactgctcagttaggacccagacggaaccatggaagccccagctcagcttctcttcctcctgctactctggctcccagataccagcggagagattgtgttgacacagtctccagccaccctgtctttgtctccgggaanaagcgcccacctctcctgcgacggccagtcagtagttagttaacaacttacgttcggcccttagggttacccaaacgaacgaaaacccgtgggacccgaagggccctaccccgagggtccttccctacacttccttaagtgtaatcgaccactacccaaacggacgggcccaacggtcggacctactccccgaacggccgtaaggttccaaggtcggacgtaagggtcggggtcgtaggggaacctacggttaccttacgtacccttccgtaccacctacgttccgaaccggtcccgtacccgtaacggaccgtaccgttacgggtaacggttaacgtttccgttacggtttacccgttttttaagtttacgttttcggtttaccgggttttggggtaccgttaacggtaccgtaaccggttccgggtccccgtttaccccggtttaccgtttacccggtttttccgggacccggtaaccgggggtaacctaacggtacggttacgggaacggtaccgtacgtaacggtaaaccggtaacgttacgggtacggtaccggttacgtacccgtaaccttacgttaccgtttaccggtttcctttaccgttaccccg

SEQ ID NO: 277148 - DNA, 515 bp, Homo sapiens
  misc_feature: GYAE6OF01AO029.29.35.D02.1.454.CMB.1.raw
tcagatagagtactcacgaccggtgctcgatttagcacacgatagttgggtttgggggaggaactgctcagttaggacccagacggaaccatggaagccccagctcagcttctcttcctcctgctactctggctcccagataccagcggagagattgtgttgacacagtctccagccaccctgtctttgtctccgggagaaagagccaccctctcctgcagggccagtcagagtgttaacaactacttggcctggttccaacagaaacctggccaggctcccaggctcctcatctatgatgcatccaacagggccactggcatcccagccaggttcagtggcagtgggtctgggacagacttcactctcaccatcagccgcctagagcctgaggattctgtccgtttattattgtcttgggcgtagcactcggcctcccgtctacgtttcggccgaggggaccagcgtggagtagtcgacgacgtaatggtggctgcaccactctcgtcttctac

SEQ ID NO: 277149 - DNA, 695 bp, Homo sapiens
  misc_feature: GYAE6OF01CCD2O.29.35.D02.1.454.CMB.1.raw
  modified_base (195)..(195): a, c, t, g, unknown or other
  misc_feature (195)..(195): n is a, c, g, or t
  modified_base (263)..(263): a, c, t, g, unknown or other
  misc_feature (263)..(263): n is a, c, g, or t
tcagatagagtactcacgaccggtgctcgatttagcacacgatagttgggtttgggggaggaactgctcagttaggacccagacggaaccatggaagccccagctcagcttctcttcctcctgctactctggctccagataccagcggagagattgtgttgacacagtctccagccacctgtctttgctcggganaaagcgccacctctcctgcagggtccagtcagagtagttaacaacttacttggccttggttaccaaanacgaaacctggccaggctccaggctcctcactctatgatcgcactccaaacgacgggcctaacgtcggacctaactccccgaaggtcccgtaacgggttccaaggttcggaccgtagggttcggggtccgtaggggaaccacggtacctttcgaaccttcctacaccagtccgacgcccgacgtagacgtccgtaggacggtacttcgtacgttaccgtttatttacgtttcgttcgttgggtacgtacgacgtaaccgtcgggtacccttcccggttacgttaccggttttcggacccggtaacggggaacctacggtaccggtagggtaacgtacgttacgaacggtaaccgtaacggttacgggtcgggtaccgtacggaacccgtaacccgttaacgttccgtttacggttccttaccgttaaccccg

SEQ ID NO: 277150 - DNA, 550 bp, Homo sapiens
  misc_feature: GYAE6OF01BEW1S.29.35.D02.1.454.CMB.1.raw
tcagatagagtactcacgaccggtgctcgatttagcacacgatagttgggtttggggaggaactgctcagttaggacccagacggaaccatggaagccccagctcagcttctcttcctcctgctactctggctcccagataccagcggagagattgtgttgacacagtctccagccaccctgtctttgtctccgggagaaagagccaccctctcctgcagggccagtcagagtgtaacaactacttggcctggttccaacagaaacctggccaggctcccaggctcctcatctatgatgcatccaacgagggccacgtggcactcccagccaggttcaggtggcaggtgggtctgggacagacttcactctcaccatcacgccgccgtacgacgccgtgaggtacttcgtcgtaccgtttatttagtttcgttcgttgggtcgttacgcaacgacggtcccgtcccgtctacgttttcggccgtacggggacccagcgtggacgtagtcgagacgtacgtggtcggcgtcgctacatctcgtcttcgtac

SEQ ID NO: 277151 - DNA, 545 bp, Homo sapiens
  misc_feature: GYAE6OF01EVAO6.29.35.D02.1.454.CMB.1.raw
tcagatagagtactcacgaccggtgctcgatttagcacacgatagttgggtttggggaggaactgctcagttaggacccagacggaaccatggaagccccagctcagcttctcttcctcctgctactctggctcccagataccagcggagagattgtgttgacacagtctccagccaccctgtctttgtctccgggagaaagagccaccctctcctgcagggccagtcagagtgttaacaactacttggcctggttccaacagaaacctggccaggctccaggctcctcatctatgatgcatccaacacgggccacgtggcatcccagcccaggttcagtggcagtgggtctgggacagacttcactctcaccatcacgccgcctagacgcctggaggattctgtaccgtttatttagttcgttcgttgggtcgtacgacaacgtcggtcccttcccgtctacgttttcggccgtacggggaccaaggcgtaggagacgtacgacgacgtaacgtggtcggctcgactaccatctcgtctctacg

SEQ ID NO: 277152 - DNA, 576 bp, Homo sapiens
  misc_feature: GYAE6OF01EXUL3.29.35.D02.1.454.CMB.1.raw
tcagatagagtactcacgaccggtgctcgatttagcacacgatagttgggtttggggaggaactgctcagttaggacccagacggaaccatggaagccccagctcagcttctcttcctcctgctactctggctcccagataccagcggagagattgtgttgacacagtctccagccaccctgtctttgtctccgggagaaagagccaccctctcctgcagggccagtcagagtgttaacaactacttggcctggttaccaacagaaacctggccaggcctcccaggctcctcatctatgatgcatccaacgacgggccactggcatccccagccaggttcagtcggcgaggtgggtctgggacagtacttcactctacaccatccacgccgacctagacgccgtgaggtacttcgtcgttccgttttatttagtttgttcgttcgggtcgtacgtctaacgtcggtcccttcccgtcgtacgttttcggccgtacggggtaccacggcgtgggagtacgtacgacggacgtaagtcggtggctggacctaccgtactcgttcgttccttcgtaccg

SEQ ID NO: 277153 - DNA, 575 bp, Homo sapiens
  misc_feature: GYAE6OF01A9WNZ.29.35.D02.1.454.CMB.1.raw
tcagatagagtactcacgaccggtgctcgatttagcacacgatagttgggtttggggaggaactgctcagttaggacccagacggaaccatggaagccccagctcagcttctcttcctcctgctactctggctcccagataccagcggagagattgtgttgacacagtctccagccaccctgtctttgtctccgggagaaagagccaccctctcctgcagggccagtcagagtgttaacaactacttggcctggttccaacagaaacctggccaggctcccaggcctcctcatctatgatgcatccaacgacgggccactcggcactcccagccaggttcaggtggcagtgggtctgggacagtacttcactctcaccatcacgccgtcctagacgcctgaggtacttcgtcgtccgtttattagttgtcgttgggtcgtagctaaccgtgtcccttccgtctacgtttcggaccgtacggggacctacggcgtaggtacgtacgtaccgaggaaccgtaacgtcggtcgggaccgtcgacccgtaccgtattaccgttcgttccttcgtacccg

SEQ ID NO: 277154 - DNA, 592 bp, Homo sapiens
  misc_feature: GYAE6OF01AXLVD.29.35.D02.1.454.CMB.1.raw
  modified_base (204)..(204): a, c, t, g, unknown or other
  misc_feature (204)..(204): n is a, c, g, or t
tcagatagagtactcacgaccggtgctcgatttagcacacgatagttgggtttgggggaggaactgctcagttaggacccagacggaaccatggaagccccagctcagcttctcttcctcctgctactctggctcccagataccagcggagagattgtgttgacacagtctccagccaccctgtctttgtctccgggagaaagngccaccctctcctgcagggccagtcagagtgttaacaactacttggcctggttccaacagaaacctggccaggctcccaggctcctcatctatgatgcatccaacgagggccactggcactcccagccaggttcagtggcaggtgggtctgggacaggtacttcgactctacaccatcacgccgcctacgacgccgtagaggtattccgtgttacccgttttatttactttggttcgtttcggggtcgtagtccaacgttcggtcccttcccgttcgttaccgttttcggaccgtaacggggaccctaacggccgtgggacgtagtacgaaggtaccgtaacgtgggtcggcgtaggacctaccctatccttcgttccttcgttaccc

SEQ ID NO: 277155 - DNA, 659 bp, Homo sapiens
  misc_feature: GYAE6OF01C59DH.29.35.D02.1.454.CMB.1.raw
  modified_base (196)..(196): a, c, t, g, unknown or other
  misc_feature (196)..(196): n is a, c, g, or t
tcagatagagtactcacgaccggtgctcgatttagcacacgatagttgggtttggggaggaactgctcagttaggacccagacggaaccatggaagccccagctcagcttctcttcctcctgctactctggctcccagataccagcggagagattgtgttgacacagtctccagccaccctgtctttgctcggganaagacgccacctctcctgcagggccagtcagagtagttaacaactacgttggccttggttaccaacagaaacctggccaggctcccgaggctcctcatctatgaatgcactaccgaacacgggccaacgtggcactcccacgcctacggttcaggtcggcgagggttcgggtcgtagggacaggtaccttacgacctctaccgacctatccacgccgtacctacggacgtcgtagacggtacttacgtcgttaccgttttagtttacgtttacggttccgttaggggtaccgttaggtaccgtaacggttccggtcccttcccggttaccgttacccgtttttcgggacccggtaacggggtacccgtaacggtcggtacgggacgtacgtaacgacggtaacggaacgttacggtcggtcctacgacccgtaccgtactccgttcgttccgttcgttacccg

SEQ ID NO: 277156 - DNA, 623 bp, Homo sapiens
  misc_feature: GYAE6OF01CN7CN.29.35.D02.1.454.CMB.1.raw
  modified_base (198)..(198): a, c, t, g, unknown or other
  misc_feature (198)..(198): n is a, c, g, or t
  modified_base (261)..(261): a, c, t, g, unknown or other
  misc_feature (261)..(261): n is a, c, g, or t
  modified_base (311)..(311): a, c, t, g, unknown or other
  misc_feature (311)..(311): n is a, c, g, or t
tcagatagagtactcacgaccggtgctcgatttagcacacgatagttggggtttgggggaggaactgctcagttaggacccagacggaaccatggaagccccagctcagcttctcttcctcctgctactctggctcccagataccagcggagagattgtgttgacacagtctccagccacctgtctttgtctcggganaagagccacctctcctgcagggccagtcagagtgttaacaactacttggccttggttaccaanagaaacctggccaggctcccaggcctcctcatctatgatgcatccaacgngggccacgtggccactccccgagccgtaggttcaggtggcgtaggtgggtctgggactaggactttcactcacaccatcacgccgacctagacgtcgtgtaggtattctcgtaccgtttattacgtttgttacgttgggtcgtacggtactaaccgttcggtcccttcccggttccgttaccgttttcgggacccggtacggggtaacccgtacggtaccggtgggaacgtacgtacgtaacggtaaccggtaacgttcgggtcggacgttcgaccgtaccctacgttaccttcgttccgttcgttaacccg

SEQ ID NO: 277157 - DNA, 559 bp, Homo sapiens
  misc_feature: GYAE6OF01BF0TA.29.35.D02.1.454.CMB.1.raw
tcagatagagtactcacgaccggtgctcgatttagcacacgatagttgggtttgggggaggaactgctcagttaggacccagacggaaccatggaagccccagctcagcttctcttcctcctgctactctggctcccagataccagcggagagattgtgttgacacagtctccagccaccctgtctttgtctccgggagaaagcgccaccctctcctgcagggccagtcagagtgttaacactacttggcctggtccaacagaaacctggccaggctcccaggcctcctcatctatgatgcatccaacgacgggccacgtggcactcccagcctaggttcaggtggcaggtgggtctgggacagacttcactctcaccatcacgccgctacgacgccgtaggaggtacttcgtcgttaccgtttattagtttgttcgttgggtcgtagtcaacgtcggtccctccgtctacgtttcggaccgtacggggaccacggtcgtaggagacgtacgaggacgtaacgtggtcggcgtgacctaccattctcgttctctacccg

SEQ ID NO: 277158 - DNA, 619 bp, Homo sapiens
  misc_feature: GYAE6OF01ACZK3.29.35.D02.1.454.CMB.1.raw
  modified_base (204)..(204): a, c, t, g, unknown or other
  misc_feature (204)..(204): n is a, c, g, or t
  modified_base (287)..(287): a, c, t, g, unknown or other
  misc_feature (287)..(287): n is a, c, g, or t
  modified_base (307)..(307): a, c, t, g, unknown or other
  misc_feature (307)..(307): n is a, c, g, or t
tcagatagagtactcacgaccggtgctcgatttagcacacgatagttgggtttgggggaggaactgctcagttaggacccagacggaaccatggaagccccagctcagcttctcttcctcctgctactctggctcccagataccagcggagagattgtgttgacacagtctccagccaccctgtctttgtctccgggagaaagngccaccctctcctgcagggccagtcagagtgtaacactactggcctggtccaacagaaacctggccaggcctccaggctcctnatctatgatgcatccaacgnggccagtggcactcccagccaggttcaggtgcaggtggtcgtgggacagtacttcactctacacatcgacgccgacctagacgtcctgaggtacttcgtgttacccgttttatttacgttcgttacgttcgggtacgtacgctaaccgtcggtcccttcccggtccttaccggttttcgggaccgtaacgggggtaaccctaacggtaccgtagggtaacgtacgtaccgaacggtaaccgtaaggttcggtacgggtccgttacggacccgtaaccgtacgttaccgttcgttccgtttcgttaaccccgg

SEQ ID NO: 277159 - DNA, 721 bp, Homo sapiens
  misc_feature: GYAE6OF01DGDLQ.29.35.D02.1.454.CMB.1.raw
tcagatagagtactcacgaccggtgctcgatttagcacacgataggtttggggttgggggaagaactgctctagttacgaccagacggaccatggaagccccagctcagcttctcttcctcctgctactctggctcccagactacccagcggagtaggtatttgtagttggacacagttctccagcccaccctgtcttgtcgtccgggacgaaagggagcccaccctcctcctgcacgggccagtccaagtcgtagttaacaacttacgtggcctggtttaccaaacacgtaaccgtcgaccgaggactacccaggtctcctacgactcctatcgtactcgactacgtccaacacggccaacgtggacctacgtcccgtacgaccccgtaggttcaaggttcggacgtacgggtcgggtcgtaggggtacaggtactttcgtaccgttcaccgaaccttcgtaccaccgacccgtacctaagaacggtccgtaggtaacggttattcggttacgttccgttttatttacgtttcgttcgtacgggtacgtaacgtacgttaattccggtacccttaccggttaccgttaccggtttcggaccggtaaccggggttaaccacggtaccggttacggaaggtacgttacgaacggtaaacgtaaccgttggtccgacgttacggaccctaaccttacttcgttaacgttcctttcgtaacccg

SEQ ID NO: 277160 - DNA, 576 bp, Homo sapiens
  misc_feature: GYAE6OF01B0H76.29.35.D02.1.454.CMB.1.raw
  modified_base (204)..(204): a, c, t, g, unknown or other
  misc_feature (204)..(204): n is a, c, g, or t
tcagatagagtactcacgaccggtgctcgatttagcacacgatagttgggtttgggggaggaactgctcagttaggacccagacggaaccatggaagccccagctcagcttctcttcctcctgctactctggctcccagataccagcggagagattgtgttgacacagtctccagccaccctgtctttgtctccgggagaaagngccaccctctcctgcagggccagtcagagtgttaacactacttggcctggttccaacagaaacctggccaggcctcccaggctcctcatctatgatgcatccaacgagggccactcggcactcccagcctaggttcaggtggctaggtgggtcgtgggacagtacttcactctcaccatacacgccgcctagcgtcgtagaggtacttcgtcgtaccgttttatttattcgttcgtttgggtcgtacgcgtaaccgtcggtcccttcccgtctaccgtttcggccgacggggtaccagtcgtaggagatacgaacggacgtaagttcggtcggacttggacctaccgtacttcgtcgttccgttcttacccg

SEQ ID NO: 277161 - DNA, 656 bp, Homo sapiens
  misc_feature: GYAE6OF01D4KVU.29.35.D02.1.454.CMB.1.raw
  modified_base (203)..(203): a, c, t, g, unknown or other
  misc_feature (203)..(203): n is a, c, g, or t
  modified_base (385)..(385): a, c, t, g, unknown or other
  misc_feature (385)..(385): n is a, c, g, or t
tcagatagagtactcacgaccggtgctcgatttagcacacgatagttgggtttggggaggaactgctcagttaggacccagacggaaccatggaagccccagctcagcttctcttcctcctgctactctggctcccagataccagcggagagattgtgttgacacagtctccagccaccctgtctttgtctccgggagaaagngccaccctctcctgcagggccagtcagagtgttaaacaactacttggcctggttccaacagaaacctggccaggcctcccaggctcctcatctaatgatgcatccaacgagggccacgtcggcactcccagccaggttcaggtggcgaggtgggtcgtgggacagtacttcactctcgaccntcgacgccgactacgacgccgtagacggtacttcgtcgttaccgttttatttagtttcgttcgtttcgggtacgttagacctaacgtacggtcccgttaccccgttcgttaccgttttcgggacccggtacggggtaacccgtaacggtccgtacgggtaacgtacgtaaccggtaacggaaccggttaaacgttacgggttccgggaccgttacggtacccgtaacccgtacgttaccgtttaccggttttcccgttaccgttaaccccg

SEQ ID NO: 277162 - DNA, 560 bp, Homo sapiens
  misc_feature: GYAE6OF01DWWI6.29.35.D02.1.454.CMB.1.raw
  modified_base (393)..(393): a, c, t, g, unknown or other
  misc_feature (393)..(393): n is a, c, g, or t
tcagatagagtactcacgaccggtgctcgatttagcacacgatagttgggtttgggggaggaactgctcagttaggacccagacggaaccatggaagccccagctcagcttctcttcctcctgctactctggctcccagataccagcggagagattgtgttgacacagtctccagccacctgtctttgtctccgggagaaagagccaccctctcctgcagggccagtcagagtgttaacaactacttggcctggttccaacagaaacctggccaggcctcccaggctcctcatctatgatcgcactccaacgagggcccacgtcggacactccccagcccgtagggttccaggtcggcgtaggtcgggtcgtggggaacaggtacttcactcncaccatcgacgccgcctagacgcctggagtattctgtccgttttattagttcgttcgttgggcgtagctaacgtcggtccctccgtctacgtttcggccgtacgggaccacgcgtggagactacgagacgagtcggtcgcgtgaccacctactctgttcttctaccg

SEQ ID NO: 277163 - DNA, 591 bp, Homo sapiens
  misc_feature: GYAE6OF01CJLN8.29.35.D02.1.454.CMB.1.raw
  modified_base (261)..(261): a, c, t, g, unknown or other
  misc_feature (261)..(261): n is a, c, g, or t
  modified_base (289)..(289): a, c, t, g, unknown or other
  misc_feature (289)..(289): n is a, c, g, or t
  modified_base (360)..(360): a, c, t, g, unknown or other
  misc_feature (360)..(360): n is a, c, g, or t
tcagatagagtactcacgaccggtgctcgatttagcacacgatagttgggtttgggggaggaactgctcagttaggacccagacggaaccatggaagccccagctcagcttctcttcctcctgctactctggctcccagataccagcggagagattgtgttgacacagtctccagccaccctgtctttgtctccgggagaaagagccacctctcctgcaggggccagtcagagtgttaacactacttggcctggttccaanagaaacctggccaggctcccaggctccncatctatgatgcatccaaacagggccaactggcactcccagccaggttcagtggctaggtgggctgggacngacttcgactcacacatcacgccgacctagacgcctgagattcgtcgtcgtttattagttgttcgtggtcgtacgctaacgtcggtaccgtcccgttcgtaccgttttcggaccgtaacggggtaccgtaacgtcgtagggtaacgtacgttacgaacggaaccggtaacgtacgggttacggtcgtacggaccgtaacccgtacgttaccgttcgttacgttccttaccg

SEQ ID NO: 277164 - DNA, 581 bp, Homo sapiens
  misc_feature: GYAE6OF01AIXTO.29.35.D02.1.454.CMB.1.raw
tcagatagagtactcacgaccggtgctcgatttagcacacgatagttgggtttggggaggaactgctcagttaggacccagacggaaccatggaagccccagctcagcttctcttcctcctgctactctggctcccagataccagcggagagattgtgttgacacagtctccagccaccctgtctttgtctccgggagaaagagccaccctctcctgcagggccagtcagagtgttaacaactactggcctggttccaacagaaacctggccaggctccaggcctcctcatctatgatgcatccaacacgggccacgtggccatccccagccaggttccaggtggcgaggtgggtctgggcagacttcactctcaccatcacgcccgctagacgcctggacgtattctggtccgttttatttagttcgttcgtttgggaccgttagtccgtaaccgtcggtccctcccggttcgttaccgttttcgggaccgtacggggaaccctaggtcgtcggacgacgtacgacggtacgtaacgtggtcggtccgtagcctacctacttccttcgtccttctacccg

SEQ ID NO: 277165 - DNA, 634 bp, Homo sapiens
  misc_feature: GYAE6OF01AKC9D.29.35.D02.1.454.CMB.1.raw
  modified_base (205)..(205): a, c, t, g, unknown or other
  misc_feature (205)..(205): n is a, c, g, or t
  modified_base (310)..(310): a, c, t, g, unknown or other
  misc_feature (310)..(310): n is a, c, g, or t
tcagatagagtactcacgaccggtgctcgatttagcacacgatagttgggtttgggggaggaactgctcagttaggacccagacggaaccatggaagccccagctcagcttctcttcctcctgctactctggctcccagataccagcggagagattgtgttgacacagtctccagccaccctgtctttgtctccggggagaaagngccaccctctcctgcagggccagtcagagtgtaacaactacttggcctggttccaacagaaacctggccaggctcccaggctcctcatctatgatgcatccaacngggccactggcatcccagccaggttcagtggcaggtgggtctgggacagtacttcactctcaccatcacgccgcctacgacgccgtggacggtacttcgtcggttccgttttagtttacgtttcgttcgtttcgggtcggttacgtcgtaaccgttcgggtcccgttccccggttccgtaccgtttttcgggacccggtacgggggtaacccgtaacggtcggttacggacggtaacgtaccgaacggtaaccggtaaaccgttgggtcgggtccgtacggtacccgtaaccctacgttccgttcggttcctttccgttacccg

SEQ ID NO: 277166 - DNA, 705 bp, Homo sapiens
  misc_feature: GYAE6OF01CMT2H.29.35.D02.1.454.CMB.1.raw
tcagatagagtactcacgaccggtgctcgatttagcacacgatagttgggtttgggggaggaactgctcagttaggacccagacggaaccatggaagccccagctcagcttctcttcctcctgctactctggctcccagataccagcggagagattgtgttgacacagtctccagccaccctgtctttgtctccgggaagaaagcgccaccctctcctgcgagggccagtcagagtagttaacactacgttggcctggttaccaacagaaacctggccaggcctccgaggcctcctcactcgtatgatgcactccaacgcgggccacgtggcctactcccgagccgtaggttacaggtcggctagggtgggtctagggactacggtacttcgacttcctacaccacgtaccgacggacccgaccgttaaggaccggtccgtagggtaacggtactttacccggttacggttacccgtttttaatttacggtttcggtttaccggtttacggggtaccggtttacgtaccgtaaaccgttccggggttccccctttacccgggtttaccgttacccgggtttttaccgggacccgggtaacggggtaaccctaagggtccgttaggaacgacgttacgaacggtacggtaagttcggtacggtccgtacggacctaccgtacgttcgttcggttccttcttacccg

SEQ ID NO: 277167 - DNA, 849 bp, Homo sapiens
  misc_feature: GYAE6OF01BCTGQ.29.35.D02.1.454.CMB.1.raw
  modified_base (213)..(213): a, c, t, g, unknown or other
  misc_feature (213)..(213): n is a, c, g, or t
tcagatagagtactcacgaccggtgctcgatttagcacacgatagttgggtttgggggaggaactgctcagttaggacccagaccggaaccatggaagcccctagcttcagcttctcttcctcctgctactctggctcccagactaccagcggaggagattgtggtttgacacagtcttccagccaccctgtctttgtctccgggagtaaagngcccgacccgtctcctggcagggccaggtcagagtgttaacactattggcctggttcccaacagtaaaccctggaccaggctcccgaggcctccttcgacttcctaatcgtacgtggcgacttacccgaaacgtacggggcccaaccttagggaccaacgttccccaaaggtccccgtaagggtttaccaggttaccgggtaccgttaagggttcggggttaccttcggggggacctaacgggtaaccggttttccctaaaccgttcccttaaccgtaacccgtaacttaccggaacggaccccgtaacccggtaaccgtaacggtaccccgttacgggtaacggttacgttttaccgtacgtttaacccggtttttaatttacgttttacggttaccggttttacggggtacggttaacggtccgttaaaccggttccgggtaccccgtttacccccggttaccgttacccgttttttacgggaccccggttaaacgggggtaccctaaacgggtcccgtaagggtacggtaacgttaccggaaaaggttaaccggtaaacggttcggttcgggtaccggttagggtacccgtaaccgtacggttacccgttcgttccgtttaccgttaccccgg

SEQ ID NO: 277168 - DNA, 653 bp, Homo sapiens
  misc_feature: GYAE6OF01C70TK.29.35.D02.1.454.CMB.1.raw
  modified_base (194)..(194): a, c, t, g, unknown or other
  misc_feature (194)..(194): n is a, c, g, or t
  modified_base (199)..(199): a, c, t, g, unknown or other
  misc_feature (199)..(199): n is a, c, g, or t
  modified_base (267)..(267): a, c, t, g, unknown or other
  misc_feature (267)..(267): n is a, c, g, or t
tcagatagagtactcacgaccggtgctcgatttagcacacgatagttgggtttggggagaactgctcagttaggacccagacggaaccatggaagccccagctcagcttctcttcctcctgctactctggctcccagataccagcggagagattgtgttgacacagtcctcagccacctgtctttgctcggganaaagncccacctcgtcctgcagggccaagtcaagtagtcgttaacaacttacttgggccttggttacccaaanagaaacctggccaggctcccaggctctcatcatgaatgacactaccaacgacgggccaactcgggacaatccccgagtcccaagggtttccaaggtcggcctaggtggggtcttaggggaacacggactttcaactctacactatcgaacgcccgacgtagagtcctagaggtacttctagtaccgttttattagttgttacgttggtcgtacgctaacgtcggtaccgtcccgttacgtaacgttttcgggaccgtaacgggggtaactaacggtcgttacgggaacgtacgtaccgtaaggtaaaccgggtaactttagggtacggtaccgtacgggtaccctaacccggttaactcgtttaccggtactttccggttaacccg

SEQ ID NO: 277169 - DNA, 740 bp, Homo sapiens
  misc_feature: GYAE6OF01D1CGO.29.35.D02.1.454.CMB.1.raw
tcagatagagtactcacgaccggtgctcgatttagcacacgatagttgggtttgggggaggaactgctcagttaggacccagacggaaccatggaagccccagctcagcttctcttcctcctgctactctggctcccagataccagcggagagattgtgttgacacagtctccagccaccctgtctttgtctccgggagaaagcgccaccctctcctgcagggccagtcagagtagttaacaactacgttggcctggttaccaaacagaaacctggccaggcctcccgaggctcctcatctatgatgcataccaacgacgggccacgtcggacactccccgacgccgtacggttcaacgggttggaccgtagggttcggggtaccgtagggggaacctaacggtacctttaccgtaccttacctacccaacccgtacgtacccgaaccggtccccgtacccgtaacggaccgtccgtacgggtaacggtactttccgttcggttacccgtttttaagttttacgttttcggttcggtttcggggtaccgttaacggtaccgttaaccggttcccggttaccccttccccggtttaccgttaaccggtttttccgggaacccgggtaaccggggtaacccgtaacggtccggtacgggaacgtacgtaccgaacggtaaccgtaacgttggtaccggtcgtacgaccgtaaccgtacttaccgtcgttccgttcttacccg

SEQ ID NO: 277170 - DNA, 256 bp, Homo sapiens; identical to SEQ ID NO: 276990
  misc_feature: GYAE6OF01A4AR5.29.35.D02.1.454.CMB.1.raw
  modified_base (256)..(256): a, c, t, g, unknown or other
  misc_feature (256)..(256): n is a, c, g, or t

SEQ ID NO: 277171 - DNA, 572 bp, Homo sapiens
  misc_feature: GYAE6OF01BWO4R.29.35.D02.1.454.CMB.1.raw
  modified_base (234)..(234): a, c, t, g, unknown or other
  misc_feature (234)..(234): n is a, c, g, or t
  modified_base (288)..(288): a, c, t, g, unknown or other
  misc_feature (288)..(288): n is a, c, g, or t
tcagatagagtactcacgaccggtgctcgatttagcacacgatagttgggtttgggggaggaactgctcagttaggacccagacggaaccatggaagccccagctcagcttctcttcctcctgctactctggcctccagataccagcggagagattgtgttgacacagtctccagccacctgtctttgtctccgggagaaagagccaccctctcctgcagggccagtcagagtntaacactactggcctgtaccaacagaactgccaggctcccaggctctcatctancgatgacactaccaacacggggaccagtcggcactcccagcctaggtcaggtcggctaggtcgggtctgggacaggtaccttcgacctctcaccatccacgccgacctacgacgtccgtagacgtacgttcgtacgttaccgttttattagtttgtcggtttgggtcgtagtacctacgtggcccttccgtccgtacgtttcggccgtacgggacctaggcgtggagtctacgacggacgtacgtgtacggctcggacctactacttagtcgttctcgtacccg

SEQ ID NO: 277172 - DNA, 628 bp, Homo sapiens
  misc_feature: GYAE6OF01DB5DW.29.35.D02.1.454.CMB.1.raw
  modified_base (199)..(199): a, c, t, g, unknown or other
  misc_feature (199)..(199): n is a, c, g, or t
  modified_base (258)..(258): a, c, t, g, unknown or other
  misc_feature (258)..(258): n is a, c, g, or t
  modified_base (283)..(283): a, c, t, g, unknown or other
  misc_feature (283)..(283): n is a, c, g, or t
tcagatagagtactcacgaccggtgctcgatttagcacacgatagttgggtttgggggaggaactgctcagttaggacccagacggaaccatggaagccccagctcagcttctcttcctcctgctactctggctcccagataccagcggagagattgtgttgacacagtctccagccaccctgtctttgtctccggganaaagcgccacctctcctgcagggccagtcagagtgtaacactactggcctggttccaanagaacctggccaggctccagctccncatctatgatgcataccaacgcggccacgtggcactcccagcctaggttcaggtcggctaggtcgggtctaggggactacgtacttacacgtcctacaacctatccgacgccgtccgtagacgtcctaggacggtacttacgttcggttaccgttttaagtttagtttcggttacggtttcgggtacgttacgtaccgtaaccgttcgggtccccgttcccgttaccgttaccggtttttccgggaccggtaacggggtaacccgaggtcgtacggagtacgtaccgaacggtaccgtaacgttggtcggactcgacctacctacgtcgttcgtcgttctacccg

SEQ ID NO: 277173 - DNA, 540 bp, Homo sapiens
  misc_feature: GYAE6OF01BK2BF.29.35.D02.1.454.CMB.1.raw
tcagatagagtactcacgaccggtgctcgatttagcacacgatagttgggtttggggaggaactgctcagttaggacccagacggaaccatggaagccccagctcagcttctcttcctcctgctactctggctcccagataccagcggagagattgtgttgacacagtctccagccaccctgtctttgtctccgggagaaagagccaccctctcctgcagggccagtcagttagtgttaacaactacttggcctggttccaacagaaacctggccaggctcccaggctcctcatctatgatgcatccaacagggccactggcatcccagccaggttcagtggcaggtgggtctgggacagacttcactctcaccatcacgccgcctagacgcctgacggtattctgtccgtttattatttgtcgtttgggcgtagctaacgtggtccctcccgtctacgttttcggccgtacggggaccgagcgtggagagtcgagacgtaacgtggtcggcgtgacctaccactctcgttcttctaccg

SEQ ID NO: 277174 - DNA, 551 bp, Homo sapiens
  misc_feature: GYAE6OF01ECIEZ.29.35.D02.1.454.CMB.1.raw
tcagatagagtactcacgaccggtgctcgatttagcacacgatagttgggtttgggggaggaactgctcagttaggacccagacggaaccatggaagccccagctcagcttctcttcctcctgctactctggctcccagataccagcggagagattgtgttgacacagtctccagccaccctgtctttgtctccgggagaaagagcccaccctctcctgcagggccagtcagagtgttaaacaactacttggcctggttccaaacagaaacctggccaggctcccaggctcctcatctatgatgcatccaacagggcccacgtggcatccccagccgaggttcaggtggcaggtgggtctgggacagtctcactctcaccatcagccgcctagacgctaggagtattctgtaccgtttattattgtcgttgggcgtagcacgtcgcctcccgtctacgtttcggccggtaacggggaccaaggtcgtggaagacgtacgaaggaaccgtaagtggtcggacgtcgacctactacttctcgttcttctaccg

SEQ ID NO: 277175 - DNA, 556 bp, Homo sapiens
  misc_feature: GYAE6OF01CQ9QL.29.35.D02.1.454.CMB.1.raw
  modified_base (261)..(261): a, c, t, g, unknown or other
  misc_feature (261)..(261): n is a, c, g, or t
tcagatagagtactcacgaccggtgctcgatttagcacacgatagttgggtttggggaggaactgctcagttaggacccagacggaaccatggaagccccagctcagcttctcttcctcctgctactctggctcccagataccagcggagagattgtgttgacacagtctccagccaccctgtctttgtctccgggagaaagagccaccctctcctgcagggccagtcagagtgttaacaactacttggcctggttccaanagaaacctggccaggcctccaggcctcctcatctatgatgcatccaaacgacgggccacgtggcactcccagccaggttcagtggcaggtgggtctgggacagacttcactctcaccatcacgccgccgtacgacgcctaggacggtattcgtcgtccgttttattactttggttcgttgggtcgtagactaacgtcgtccctcccgtcgtacgtttcggaccgtacgggtaccgagcgtaggagacgtcgaggtacgaagtggtcggctcgactacctattctcttcttcgtac

SEQ ID NO: 277176 - DNA, 517 bp, Homo sapiens
  misc_feature: GYAE6OF01A9AWG.29.35.D02.1.454.CMB.1.raw
  modified_base (203)..(203): a, c, t, g, unknown or other
  misc_feature (203)..(203): n is a, c, g, or t
  modified_base (259)..(259): a, c, t, g, unknown or other
  misc_feature (259)..(259): n is a, c, g, or t
tcagatagagtactcacgaccggtgctcgatttagcacacgatagttgggtttggggaggaactgctcagttaggacccagacggaaccatggaagccccagctcagcttctcttcctcctgctactctggctcccagataccagcggagagattgtgttgacacagtctccagccaccctgtctttgtctccgggagaaagngccaccctctcctgcagggccagtcagagtgttaacactacttggcctggtccaanagaacctggccaggctcccaggctcctcatctatgatgcatccaacgagggccactggcactcccagccaggttcagtggcaggtgggtctgggacagacttcactctcaccatcacgccgctagacgcctgacggtattcgtgtccgtttattagttgtcgttgggcgtagctacgtcggccttccgtctacgtttcggccgtagggaccagtcgtaggatagtcgagcgactggtgctgctacatctgtctcgtac

SEQ ID NO: 277177 - DNA, 649 bp, Homo sapiens
  misc_feature: GYAE6OF01D9D0M.29.35.D02.1.454.CMB.1.raw
  modified_base (196)..(196): a, c, t, g, unknown or other
  misc_feature (196)..(196): n is a, c, g, or t
tcagatagagtactcacgaccggtgctcgatttagcacacgatagttgggtttggggaggaactgctcagttaggacccagacggaaccatggaagccccagctcagcttctcttcctcctgctactctggctcccagataccagcggagagattgtgttgacacagtctccagccaccctgtctttgctcggganaaagcgccacctctcctgcagggccagtcagagtgtaacactacttggcctggttaccaacagaaacctggaccaggcctcccgaggcctcctcatctatgatgcatccaagacggccacgtggacactcccagcctaggttcaggtcggacgtaggtcgggtcgtagggacaggtacttcgactctacaccatcgacgccgactagacgtccgtaggacggtacttcgtcgttaccgttttagttacgtttcggttcgtttacgggtcgtaacggtacctaacggtccggtcccgttaccccggttacgttaccggttttaccgggacccggtaacggggaaccctaacgggtccgtagggaacgtacgtacgtaacggtaccggtaacgttacgggtcggccgtacgacccgtaaccgttacgttcccgttcggttaccttcgttaacccg

SEQ ID NO: 277178 - DNA, 544 bp, Homo sapiens
  misc_feature: GYAE6OF01D6ABC.29.35.D02.1.454.CMB.1.raw
  modified_base (261)..(261): a, c, t, g, unknown or other
  misc_feature (261)..(261): n is a, c, g, or t
  modified_base (306)..(306): a, c, t, g, unknown or other
  misc_feature (306)..(306): n is a, c, g, or t
  modified_base (395)..(395): a, c, t, g, unknown or other
  misc_feature (395)..(395): n is a, c, g, or t
tcagatagagtactcacgaccggtgctcgatttagcacacgatagttgggtttgggggaggaactgctcagttaggacccagacggaaccatggaagccccagctcagcttctcttcctcctgctactctggctcccagataccagcggagagattgtgttgacacagtctccagccaccctgtctttgtctccgggagaaagacgccaccctctcctgcagggccagtcagagtgttaacactacttggcctggtccaanagaaacctggccagctccaggctcctcatctatgatgcatccaanagggccacgtggaccatcccagccaggttcaggtggcagtgggtctgggacagctcactctcaccatcacgccgactagacgctgagtnttctgtccgtttattagttcgtcgttgggcgtacgtctaacgtcggtcctcccgtcgttacgtttcggaccgtacggggaccacgcgtggacgtacgtacgacggtaacgtaagtggtcggctgacctactattctcgttcttctaccg

SEQ ID NO: 277179 - DNA, 971 bp, Homo sapiens
  misc_feature: GYAE6OF01BUKCX.29.35.D02.1.454.CMB.1.raw
  modified_base (199)..(199): a, c, t, g, unknown or other
  misc_feature (199)..(199): n is a, c, g, or t
tcagatagagtactcacgaccggtgctcgatttagcacacgatagttgggtttggggaggaactgctcagttaggacccagacggaaccatggaagccccagctcagcttctcttcctcctgctactctggctcccagataccagcggagagattggtgttgacacagtctccagcccacctgtctttgctccgggaanaaacgcgccacctctcctgcgacgggccagtcagtagttacgttaaacaacttacgttgggacctttggggttacccaaaacgacgtaaaacccgtggacccgaacgggtcctaccccgaagggtacccttccctacctaacttcctaagttcggaacttcggacctaaacgttaccccgaaaaccggtaccgggggtaccccaaaccggttcgggaccctaaaaccgttccccccggaaacggccccggttaaacggggttttccgaaacggggttcggggacgtaaccgggggtttggggggttaccctaggggggtaaaccacgggttaaccctttaccctaaccggtttccctaacccggtaaaccctaaacgttcccggaaccgggccccggtaacccgttaacgggaacccggtcccggtttacgggtaaacgggttaaccgttttacccggttacgggtttaacccgttttttaagtttttaccgttttcgggtttaccggttttacgggggtaccggttaacccggtacgttaaacccgggttccgggtaacccccgtttccccggttaccgttttaaccgggtttttacccggggacccgggtaaaccggggggtaaacccgtaacggtacccgggtaaacggggtaacgtaccgttaaccggaaccgggtaacccgggttaaacgttcggggtcgggttacccgtaacgtacccggtacccttaaccgttacgtttccggttacccgtttcttaacccccgg

SEQ ID NO: 277180 - DNA, 744 bp, Homo sapiens
  misc_feature: GYAE6OF01CT07Q.29.35.D02.1.454.CMB.1.raw
  modified_base (200)..(200): a, c, t, g, unknown or other
  misc_feature (200)..(200): n is a, c, g, or t
tcagatagagtactcacgaccggtgctcgatttagcacacgatagttgggtttggggaggaactgctcagttaggacccagacggaaccatggaagccccagctcagcttctcttcctcctgctactctggctcccagataccagcggagagattgtgttgacacagtctccagccacctgtctttgctcgggagaaagngccacctctctgcagggccagtcagagtgtaacaactacttggcctggttaccaacagaaacctggccaggctccgaggctcctcatctatgatgcactccaacgcgggaccacgtcggacaacgtcccgagcccgtaaggttcaaggttcggacgtagggtcggggtacgtcggggaactacggtaccgtttacaccgttcctacgaaccctagtccgaacggcccgtaccgtaacggaccgtacccgttaagggacggtacgtttaccgttacggttacccgttttaactttaacggttttcggttacgtttcggggtaccgtacggtacgtaaccgttcgggtccccgttaccccggttccgttaacccgggtttttcgggaccccgggtaacgggggtaaccccgtaacgggtaccggttagggtaacgtaccggtaaccgaacgggtaaacccgggtaacgttcgggttaacgggtcccgttacggaccgtaaacccgtacgttacccgtttccggtttacccgttacctttaacccgg

SEQ ID NO: 277181 - DNA, 257 bp, Homo sapiens; identical to SEQ ID NO: 276983
  misc_feature: GYAE6OF01B7PWM.29.35.D02.1.454.CMB.1.raw
  modified_base (256)..(257): a, c, t, g, unknown or other
  misc_feature (256)..(257): n is a, c, g, or t

SEQ ID NO: 277182 - DNA, 578 bp, Homo sapiens
  misc_feature: GYAE6OF01DI4DU.29.35.D02.1.454.CMB.1.raw
  modified_base (199)..(199): a, c, t, g, unknown or other
  misc_feature (199)..(199): n is a, c, g, or t
  modified_base (261)..(261): a, c, t, g, unknown or other
  misc_feature (261)..(261): n is a, c, g, or t
tcagatagagtactcacgaccggtgctcgatttagcacacgatagttgggtttgggggaggaactgctcagttaggacccagacggaaccatggaagccccagctcagcttctcttcctcctgctactctggctcccagataccagcggagagattgtgttgacacagtctccagccaccctgtctttgtctccggganaaagagccaccctctcctgcagggccagtcagagtgtaacaactacttggcctggttccaanagaaacctggccaggcctcccaggctcctcatctatgatcgcactccaacgacgggccacgttggccactcccagccctaggttcagtggacaggttgggctgggacagcttacacttcctcacctatccgacgcccgacctagacgccgtaggtaggtacttcgttcgtaccgttttatttacgtttcgttcgttgggcgttacgctaacgtcggtcccttcccgttctcgtttcggccgtacgggaccagcgtggagtacgtacgagaacgtacgtggtcggcgtcgacctactacttcgttcgttcttcgtacc

SEQ ID NO: 277183 - DNA, 686 bp, Homo sapiens
  misc_feature: GYAE6OF01B4SXK.29.35.D02.1.454.CMB.1.raw
tcagatagagtactcacgaccggtgctcgatttagcacacgatagttgggtttgggggaggaactgctcagttaggacccagacggaaccatggaagccccagctcagcttctcttcctcctgctactctggctcccagataccagcggagagattgtgttgacacagtctccagccaccctgtctttgtctccgggagaaagagccaccctctcctgcagggccagtcagagtgttaacaactacttggcctggttaccaacagaaacctggccaggcctcccaggctcctcatctatgatgacactccaacgacgggccacgtcggcctactccccgacgtcctaggttcaggtcggaccgtagggtgggtcgtagggacaaggtaccttcaccgttcaccgaacactccgacgccgccgtaagcgtccgtagacggtacgttctcgttaccgttttaatttacgtttcgttcggtttacgggtacggttacgtaccgtaaccggttccggtaccctttaccccggtaccgttaccggttttccgggaacccggtaaccgggggtaaccctaagggtaccggtagggtaacgttaaccgtacggaaacggtaaccgtaacggttaggtccgggtcgtaccgtaccgtacccgtaacttccgttaccgtttccgttcttaacccg

SEQ ID NO: 277184 - DNA, 606 bp, Homo sapiens
  misc_feature: GYAE6OF01D8IEC.29.35.D02.1.454.CMB.1.raw
  modified_base (199)..(199): a, c, t, g, unknown or other
  misc_feature (199)..(199): n is a, c, g, or t
  modified_base (259)..(259): a, c, t, g, unknown or other
  misc_feature (259)..(259): n is a, c, g, or t
tcagatagagtactcacgaccggtgctcgatttagcacacgatagttgggtttgggggaggaactgctcagttaggacccagacggaaccatggaagccccagctcagcttctcttcctcctgctactctggctcccagataccagcggagagattgtgttgacacagtctccagccaccctgtctttgtctccggganaaagcgccacctctcctgcagggccagtcagagtgtaacactacttggcctggttccaanagaaacctggccaggcctccaggcctcctcatctatcgatcgcatccaacgacgggccactcggacactcccagcctaggttcagttcggcgtaggtcgggtctaggggactacgtacttcgacctctacgaccatccgaacgccgaccgtacgacgccgtaggacggtacttcgtcgtaccgtttattacgttgtcgttggcgtagacgtacgtcggtccgtccgtcgtacgtttcggaccgtacgggtaccgacggtcgtacggtacgacgtacgaacggtacgtaagtggtaccggtcgttacggaccgtaccgtacgttaccgttcgttccgttccttacccg

SEQ ID NO: 277185 - DNA, 532 bp, Homo sapiens
  misc_feature: GYAE6OF01ANH7W.29.35.D02.1.454.CMB.1.raw
  modified_base (199)..(199): a, c, t, g, unknown or other
  misc_feature (199)..(199): n is a, c, g, or t
  modified_base (204)..(204): a, c, t, g, unknown or other
  misc_feature (204)..(204): n is a, c, g, or t
  modified_base (351)..(351): a, c, t, g, unknown or other
  misc_feature (351)..(351): n is a, c, g, or t
tcagatagagtactcacgaccggtgctcgatttagcacacgatagttgggtttgggggaggaactgctcagttaggacccagacggaaccatggaagccccagctcagcttctcttcctcctgctactctggctcccagataccagcggagagattgtgttgacacagtctccagccaccctgtctttgtctccggganaaagngccaccctctcctgcagggccagtcagagtgttaaacaactacttggcctggttccaacagaaacctggccaggctcccaggcctcctcatctatgatgcatccaacaggccactggcatccagcagtcagtgcagtggctgggacngacttcactctcaccatcacgccgctagcgcctgagacttctcgtcgtttattagttgtcgttgggcgtacgcacgtcggccctccgtctacgtttcggccgtacgggtaccaagcgtagggacgtagtacgagaccgtagtggtcggcgtcgacctacctactcgtcgttcgttctaccg

SEQ ID NO: 277186 - DNA, 759 bp, Homo sapiens
  misc_feature: GYAE6OF01CRFW1.29.35.D02.1.454.CMB.1.raw
  modified_base (262)..(262): a, c, t, g, unknown or other
  misc_feature (262)..(262): n is a, c, g, or t
tcagatagagtactcacgaccggtgctcgatttagcacacgatagttgggtttgggggaggaactgctcagttaggacccagacggaaccatggaagccccagctcagcttctcttcctcctgctactctggctcccagataccagcggagagattgtgttgacacagtctccagccaccctgtctttgtctccgggagaaagagccaccctctcctgcagggccagtcagagtgttaacaactacttggcctggttccaanagaaacctggccaggcctcccaggcctcctcatctatgatcgacactacccaaacgacggggcccaacgtcggacctacgtccccgagaccccgtaagggtttccaaggttcgggacctaaggggttcggggggttaccgtaggggggtaacctagggtaaccctttccgaaccgtttccttacccgaacccgtacttacccgaccggtaccccgtacccgtaacggtaaccggtacccgttacgggtaacggttacgtttccgttacggtttacccgtttttattttacgtttcggtttccggtttgggtacggttacgtaccgtaaccgttccgggtccccgttccccgttccgttaccggttttcgggacccggtacggggtaaccgtacggtaccggtacgggtacggtacgtacgacggtaaccggtaacgtacgggttcgggtccgtacgacccgtaaccgtacttaccgttcgttcctttcgttaccccg

SEQ ID NO: 277187 - DNA, 545 bp, Homo sapiens
  misc_feature: GYAE6OF01DVLUU.29.35.D02.1.454.CMB.1.raw
  modified_base (203)..(203): a, c, t, g, unknown or other
  misc_feature (203)..(203): n is a, c, g, or t
  modified_base (262)..(262): a, c, t, g, unknown or other
  misc_feature (262)..(262): n is a, c, g, or t
tcagatagagtactcacgaccggtgctcgatttagcacacgatagttgggtttggggaggaactgctcagttaggacccagacggaaccatggaagccccagctcagcttctcttcctcctgctactctggctcccagataccagcggagagattgtgttgacacagtctccagccaccctgtctttgtctccgggagaaagngcccaccctctcctgcagggccagtcagagtgttaacaactacttggcctggttccaanagaaacctggccaggctcccgaggctcctcatctatgatgcagtccaacgacgggccacgtggcactcccagccaggttcagtggcaggtcgggtctaggggacaggtacttcgactctacaccatcgacgccgctagacgccgtgagtattctgtccgtttattagttgtcgttggcgtagcacgtcgccttcccgtctacgtttcgccgtacgggaccaggcgtggagtagtacgaacggacgaagtggtcggcgtcgacactactctcgttcttctaccg

SEQ ID NO: 277188 - DNA, 693 bp, Homo sapiens
  misc_feature: GYAE6OF01DPZ1D.29.35.D02.1.454.CMB.1.raw
tcagatagagtactcacgaccggtgctcgatttagcacacgatagttgggtttgggggaggaactgctcagttaggacccagacggaaccatggaagccccagctcagcttctcttcctcctgctactctggctccagataccagcggagagattgtgttgacacagtctccagccaccctgtctttgtctcgggagaaagacgccacctctcctgcagggccagtcagagtgttaacaacttactggccttggttccaaacacgaaacctggaccaggcctccgaggtcctcctcatcctatgatcgacactccaacgcgggaccacgtggcactcccgagccgaggtttcaggtcggacgtaggttcgggtacgtgggaacacggtacttacgtaccttctacctaccgtattccgaacgcccgtaccgtaaggacggtcccgttaggtaacgggttactttcgtacggtttacccgtttttaagtttacgtttcggtttacggtttcgggtaccggttaacggtaccgtaaccgttccgggtccccgtttaccccggttacgttacccgggtttttcggggaccccgtacgggggtaccctaacgggtcggtacggacgtacgtacgaacggtacggtacgttggcggtacgtacggcctaaccgtacgttacttcgttcctcttacccg

SEQ ID NO: 277189 - DNA, 532 bp, Homo sapiens
  misc_feature: GYAE6OF01CUOXU.29.35.D02.1.454.CMB.1.raw
  modified_base (264)..(264): a, c, t, g, unknown or other
  misc_feature (264)..(264): n is a, c, g, or t
  modified_base (375)..(375): a, c, t, g, unknown or other
  misc_feature (375)..(375): n is a, c, g, or t
tcagatagagtactcacgaccggtgctcgatttagcacacgatagttgggtttgggggaggaactgctcagttaggacccagacggaaccatggaagccccagctcagcttctcttcctcctgctactctggctcccagataccagcggagagattgtgttgacacagtctccagccaccctgtctttgtctccgggagaaagagccaccctctcctgcagggccagtcagagtgttaaacaactacttggcctggttccaaanagaaacctggccaggctcccaggctcctcatctatgatgcactccaacgacgggccactggacactcccagccaggttcagtggcagtgggtctgggacagacttcactcncaccatcacgccgcctagacgcgtgaggtattctgtccgtttattattgttcgttggtcgtagcaacgtcggtccctccgtcgtacgtttcggccgacgggaccgagcgtaggagactcgaggacgagtggtggcgtgctacatctcgtcttcgtac

SEQ ID NO: 277190 - DNA, 671 bp, Homo sapiens
  misc_feature: GYAE6OF01D7GV5.29.35.D02.1.454.CMB.1.raw
tcagatagagtactcacgaccggtgctcgatttagcacacgatagttgggtttgggggaggaactgctcagttaggacccagacggaaccatggaagccccagctcagcttctcttcctcctgctactctggctccagataccagcggagagattgtgttgacacagtctccagccacctgtctttgtctcgggagaaagcgccacctctcctgcgagggccagtcagagtagttaaacaactactggccttggttaccaaacgaacgaaaccgtggaccaggcctcccgaggcctcctcatctatgatcgactactaccaacgacgggccacgtggccactcccgagtccgtaggttccgaggttcggccgtagggttcggggtacgtggggaactaacggtactttccgaccttctaccactactccgacgcccgactacgacgtccgtggtaacggtactttcgttacggttacgttttaatttacgtttaggtttcgttcgggtacgtaacggtacgtaaccgttcggtccccgttacccgttccgtaccggttttacgggacccggtacggggaaccgtacggtcggtagggtacgtacgtacgaacggtaacgtaacgttgggcggtcgtacgaccgtactactacgttacggttcttctacccg

SEQ ID NO: 277191 - DNA, 598 bp, Homo sapiens
  misc_feature: GYAE6OF01DGYTH.29.35.D02.1.454.CMB.1.raw
  modified_base (270)..(270): a, c, t, g, unknown or other
  misc_feature (270)..(270): n is a, c, g, or t
  modified_base (324)..(324): a, c, t, g, unknown or other
  misc_feature (324)..(324): n is a, c, g, or t
  modified_base (400)..(400): a, c, t, g, unknown or other
  misc_feature (400)..(400): n is a, c, g, or t
tcagatagagtactcacgaccggtgctcgatttagcacacgatagttgggtttgggggaggaactgctcagttaggacccagacggaaccatggaagccccagctcagcttctcttcctcctgctactctggctccagataccagcggagagattgtgttgacacagtctccagcccaccctgtctttgtctccgggagaaagcgccaccctctcctgcagggccagtcagagtagttaacaacttacgttggcccttggttacccaaanacgaaaacctggaccaggcctcccaggcctcctcatctatgatgcatccaacgngggccacgtggccactcccagcctaggttcaggtcggcaggttcgggtctaggggacagacttcacttcctacacntacgacgccgctagacgcctgagtattctgtacgtttattagttgtcgttggtcgtacgctacgtcggtccttcccggtactccgtttggacccgtaggggtaccctaggccgtagggacgtagtacgaacgtaaccggtaacgttaggtcggacgttcgaccgtaccctattacccgttcgttcccgttcgttaccg

SEQ ID NO: 277192 - DNA, 564 bp, Homo sapiens
  misc_feature: GYAE6OF01DGC8A.29.35.D02.1.454.CMB.1.raw
  modified_base (263)..(263): a, c, t, g, unknown or other
  misc_feature (263)..(263): n is a, c, g, or t
tcagatagagtactcacgaccggtgctcgatttagcacacgatagttgggtttgggggaggaactgctcagttaggacccagacggaaccatggaagccccagctcagcttctcttcctcctgctactctggctcccagataccagcggagagattgtgttgacacagtctccagccacctgtctttgtctccgggagaaagagcccaccctctcctgcagggccagtcagagtgttaacaactacttggcctggttccaaanacgaaacctggccaggcctcccaggcctcctcatctatgatgcatccaacacgggccactggcactcccagccaggttcaggtggcgtaggtcgggtctggggaactaggacttcacttctacaccatcacgccgcctagacgcgtagaggtacttctcgtcgtttattagtttcgttcgttggtcgtagtactacgtcggtcccgtcccgtcttacgtttcggccggtacgggtaccgacgtcgtggacgtagtcgacgtaacgacgtcggtcgcgtcgctacactctcgtcttcgtacc

SEQ ID NO: 277193 - DNA, 573 bp, Homo sapiens
  misc_feature: GYAE6OF01DWF71.29.35.D02.1.454.CMB.1.raw
  modified_base (405)..(405): a, c, t, g, unknown or other
  misc_feature (405)..(405): n is a, c, g, or t
  modified_base (415)..(415): a, c, t, g, unknown or other
  misc_feature (415)..(415): n is a, c, g, or t
tcagatagagtactcacgaccggtgctcgatttagcacacgatagttgggtttgggggaggaactgctcagttaggacccagacggaaccatggaagccccagctcagcttctcttcctcctgctactctggctcccagataccagcggagagattgtgttgacacagtctccagccaccctgtctttgtctccgggagaaagagccaccctctcctgcagggccagtcagagtgttaacaacttacttggcctggttccaaacaacgaaacctggccaggcctcccgaggcctcctcatctatgatgcactccaaacgacgggccacgtggaccactcccagcccaggttcaggtggcgaggtgggtctgggacagtacttcactctcacatcacgccgcgtanagcgtgagtnttctcgtcgtttattatttcgttcgttggtcgtacgactaacgtcggtcccgttcccgtaccgttacgttttcggacccggtacgggaccgtaagcgtaggagtacgtacgaacgacgtaacgtggtcgacgtgacctactactcttcgtcttctacc

SEQ ID NO: 277194 - DNA, 780 bp, Homo sapiens
  misc_feature: GYAE6OF01A21RY.29.35.D02.1.454.CMB.1.raw
  modified_base (202)..(202): a, c, t, g, unknown or other
  misc_feature (202)..(202): n is a, c, g, or t
tcagatagagtactcacgaccggtgctcgatttagcacacgatagttgggtttgggggaggaactgctcagttaggacccagacggaaccatggaagccccagctcagcttctcttcctcctgctactctggctcccagataccagcggagagattgtgttgacacagtctccagccacctgtctttgctccgggagaaagngccaccctctcctgcagggccagtccagagtgttaacaactacttggcctggttaccaacagaaacctggccaggctcccaggctcctcatctatgatcgacactccgaacgagggcccagtcggactactccccagcccgtaaggtttccaaggttcgggcctagggttcgggggtccttagggggaacctacggtaaccctttcgaacccgtttcccttacccgaaccctacgttccgaaccggccccggtacccgttaacggaccgtaccccgtagggtaacgggtaactttaccggttacggttacccgtttttagttttacgtttcggtttcggtttcggggtaccgttacggtaccgttaaccggttcggtccccgtttaccccggttaccgttaccggtttttaccggggacccggtaaacgggggtaacccgtaaacgggtccggttacggggtaaaccgtacggttaaccgtaacggtaacccggtaaaccggttacgggttaccgggtaccgttacggtacccgtaccgttaacgtttaccgtacggtttccctttccggttaacccg

SEQ ID NO: 277195 - DNA, 589 bp, Homo sapiens
  misc_feature: GYAE6OF01EWORJ.29.35.D02.1.454.CMB.1.raw
tcagatagagtactcacgaccggtgctcgatttagcacacgatagttgggtttgggggaggaactgctcagttaggacccagacggaaccatggaagccccagctcagcttctcttcctcctgctactctggctcccagataccagcggagagattgtgttgacacagtctccagccaccctgtctttgtctccgggagaaagagccaccctctcctgcagggccagtcagagtgttaacaactacttggcctggttccaacagaaacctggccaggctcccaggctcctcatctatgatgcatccaacagggccactggcactcccagccaggttcagtggcagtgggtctgggacagacttcactctcaccatcacgccgcctagacgccgtgagtacttcgtgtcccgtttatttacgttcgttcgttgggtcgtacgactaacgtcggtcccttcccggtctaccgttttcggacccgtaacggggaccctaaggccgtagggacgtacgtacgaacggtaaccggtaacgttggtcggcgtcggaccgtaacccgtacttccgttcggttcctttccgtacccg

SEQ ID NO: 277196 - DNA, 523 bp, Homo sapiens
  misc_feature: GYAE6OF01DQN74.29.35.D02.1.454.CMB.1.raw
  modified_base (262)..(262): a, c, t, g, unknown or other
  misc_feature (262)..(262): n is a, c, g, or t
tcagatagagtactcacgaccggtgctcgatttagcacacgatagttgggtttgggggaggaactgctcagttaggacccagacggaaccatggaagccccagctcagcttctcttcctcctgctactctggctcccagataccagcggagagattgtgttgacacagtctccagccaccctgtctttgtctccgggagaaagagccaccctctcctgcagggccagtcagagtgttaacaactacttggcctggttccaanagaaacctggccaggctcccaggctcctcatctatgatgcatccaacagggccacgtggcatcccagccaggttcagtggcagtgggtctgggacagcttcactctcaccatcacgccgcctagacgccgtgaggtattctgtccgttttattagttgttcgttgggcgtagctaacgtcggcctcccgtctacgtttcggccgagggaccgagcgtaggagacgtcgagacgaagtggtggctgctacatctgtctctac

SEQ ID NO: 277197 - DNA, 637 bp, Homo sapiens
  misc_feature: GYAE6OF01BBTJK.29.35.D02.1.454.CMB.1.raw
  modified_base (203)..(203): a, c, t, g, unknown or other
  misc_feature (203)..(203): n is a, c, g, or t
tcagatagagtactcacgaccggtgctcgatttagcacacgatagttgggtttggggaggaactgctcagttaggacccagacggaaccatggaagccccagctcagcttctcttcctcctgctactctggctcccagataccagcggagagattgtgttgacacagtctccagccaccctgtctttgtctccgggagaaagngccaccctctcctgcagggccagtcagagtgttaaccaactacttggcctggttccaacagaaacctggccaggcctcccaggcctcctcatctatgatgcataccaacgacgggccacgtcggcactccccagcctaggttccaggtcggcgaggtgggtcgtgggacagtacttcactctcaccatcacgccgcctacgacgccgtagaggtacttcgtcgttaccgttttatttagtttcggttcgtttcggggtcgttacgaccgtaacgttcggtccccgttccccggttacgttaccgtttttcgggacccggtaacggggtaacccgtaacggtccgtacgggacgtacgtacggaacggtaaccgtaacgttcggtcggaccgtacgaccctaacccgtagttaccgttcgttcccttcgtacccg

SEQ ID NO: 277198 - DNA, 577 bp, Homo sapiens
  misc_feature: GYAE6OF01AQDRW.29.35.D02.1.454.CMB.1.raw
  modified_base (198)..(198): a, c, t, g, unknown or other
  misc_feature (198)..(198): n is a, c, g, or t
  modified_base (312)..(312): a, c, t, g, unknown or other
  misc_feature (312)..(312): n is a, c, g, or t
  modified_base (553)..(553): a, c, t, g, unknown or other
  misc_feature (553)..(553): n is a, c, g, or t
tcagatagagtactcacgaccggtgctcgatttagcacacgatagttgggtttgggggaggaactgctcagttaggacccagacggaaccatggaagccccagctcagcttctcttcctcctgctactctggctcccagataccagcggagagattgtgttgacacagtctccagccacctgtctttgtctccggganaaagcgcccaccctctcctgcagggccagtcagagtgttaaccaactacgttggcctggttccaacagaaacctggccaggctcccaggctcctcatctatgatgcatccaacngggccactggcactcccagccaggttcaggtggcagggtgggtctgggacacgacttcgacctctaccaccatccacgcccgtctacgacgcctaggtagtacttcgtgttccgtttattagttcggtcgtttcgggcttagctaacgttcggcccttccgtctaccgtttcggaccgtacggggacccaagcgtaggagacgtcgaacggacgtaacgtggtcggtcctacgactaaccnttaccgttcttccgttcctacccg

SEQ ID NO: 277199 - DNA, 742 bp, Homo sapiens
  misc_feature: GYAE6OF01CBNA0.29.35.D02.1.454.CMB.1.raw
  modified_base (204)..(204): a, c, t, g, unknown or other
  misc_feature (204)..(204): n is a, c, g, or t
  modified_base (261)..(261): a, c, t, g, unknown or other
  misc_feature (261)..(261): n is a, c, g, or t
tcagatagagtactcacgaccggtgctcgatttagcacacgatagttgggtttggggaggaactgctcagttaggacccagacggaaccatggaagccccagctcagcttctcttcctcctgctactctggctcccagataccagcggagagattgtgttgacacagtctccagcccaccctgtctttgtctccgggagaaagngcccaccctctcctgcagggccagtcagagtgttaacactacttggcctggtccaanagaaacctggccaggcctcccgaggctcctcatctatgatgcactccaacgagggcccacgtcggcactccccaggtccagggtttccaaggtcggcgtagggttcggggtcgttacgggggaactaggtacctttccgaccttcccgttacacccattaccgacggccccgtacccgtacggacgtaccccgtgggtaacggtaacgtttccgttacggtttacccgtttttaagtttacgttttcggtttccggtttcgggggtaccggtttacggtaccgttaaaccggttcggggtacccccgtttcccccggtttaccgttaccggtttttccggggacccgtaacggggggtaacccgtaaggtaccggtacgggtacggtaacgtaccggaacggtaacccggtaacgtcgggttcgggtaccgtacggtaccctacccgtacgttcccgttcgtttccctttccgttaacccg

SEQ ID NO: 277200 - DNA, 529 bp, Homo sapiens
  misc_feature: GYAE6OF01DFEN2.29.35.D02.1.454.CMB.1.raw
  modified_base (371)..(371): a, c, t, g, unknown or other
  misc_feature (371)..(371): n is a, c, g, or t
  modified_base (521)..(521): a, c, t, g, unknown or other
  misc_feature (521)..(521): n is a, c, g, or t
tcagatagagtactcacgaccggtgctcgatttagcacacgatagttgggtttggggaggaactgctcagttaggacccagacggaaccatggaagccccagctcagcttctcttcctcctgctactctggctcccagataccagcggagagattgtgttgacacagtctccagccaccctgtctttgtctccgggagaaagagccaccctctcctgcagggccagtcagagtgttaacaactacttggcctggttccaacagaaacctggccaggctcccaggctcctcatctatgatgcatccaacgagggccacgtggcactccccagccaggttcagtggcaggtggtctgggacagacttcactcncacatcagccgcctagacgcctgagtattctgtcgtttattatttgttcgttggtcgtagactaacgtcggtcctcccgtctacgttttcggaccgtagggaccaacgcgtacggagactacgagacgaagtggtggctgcaccatcttntcttctac

SEQ ID NO: 277201 - DNA, 514 bp, Homo sapiens
  misc_feature: GYAE6OF01AGVE1.29.35.D02.1.454.CMB.1.raw
tcagatagagtactcacgaccggtgctcgatttagcacacgatagttgggtttggggaggaactgctcagttaggacccagacggaaccatggaagccccagctcagcttctcttcctcctgctactctggctcccagataccagcggagagattgtgttgacacagtctccagccaccctgtctttgtctccgggagaaagagccaccctctcctgcagggccagtcagagtgttaacaactacttggcctggttccaacagaaacctggccaggctcccaggctcctcatctatgatgcatccaacagggccactggcatcccagccaggttcagtggcagtgggtctgggacagacttcactctcaccatcacgccgcctagacgcctgagtattctgtccgtttattattgtcttggtcgtagcacgtggcctccgtctcgtttcggccgtagggaccagtcgtggagactacgagacgacgtgtcggctgctaccatctcgtctctacg

SEQ ID NO: 277202 - DNA, 558 bp, Homo sapiens
  misc_feature: GYAE6OF01C7UV9.29.35.D02.1.454.CMB.1.raw
  modified_base (262)..(262): a, c, t, g, unknown or other
  misc_feature (262)..(262): n is a, c, g, or t
tcagatagagtactcacgaccggtgctcgatttagcacacgatagttgggtttgggggaggaactgctcagttaggacccagacggaaccatggaagccccagctcagcttctcttcctcctgctactctggctcccagataccagcggagagattgtgttgacacagtctccagccaccctgtctttgtctccgggagaaagagccaccctctcctgcagggccagtcagagtgttaacaactacttggcctggttccaanagaaacctggccaggcctcccaggctcctcatctatgatgcatccaacagggccactggcatcccagccaggttcagtggcagtgggtctgggacagacttcactctcacctatcacgccgcctagacgcctaggaggtattcgttcgtccgttttattacgtttaggttcgttgggtcgttagcgtaaccgttcggtcccgttcccgttcgtaccgttttcggccgtacggggaccaggcgtaggtagagtcgaaggacgaacgtggtcggctgcacctactctcgtcgttctac

SEQ ID NO: 277203 - DNA, 590 bp, Homo sapiens
  misc_feature: GYAE6OF01B6KPS.29.35.D02.1.454.CMB.1.raw
  modified_base (204)..(204): a, c, t, g, unknown or other
  misc_feature (204)..(204): n is a, c, g, or t
  modified_base (261)..(261): a, c, t, g, unknown or other
  misc_feature (261)..(261): n is a, c, g, or t
  modified_base (309)..(309): a, c, t, g, unknown or other
  misc_feature (309)..(309): n is a, c, g, or t
tcagatagagtactcacgaccggtgctcgatttagcacacgatagttgggtttggggaggaactgctcagttaggacccagacggaaccatggaagccccagctcagcttctcttcctcctgctactctggctcccagataccagcggagagattgtgttgacacagtctccagcccaccctgtctttgtctccgggagaaagngccaccctctcctgcagggccagtcagagtgttaacaactacttggcctggtccaanagaaacctggccaggctcccaggctcctcatctatgatgcatccaacngggccactggcactcccagccaggttcaggtcgcgaggtgggtcgtgggacagtaccttcactctcaccatcgacgccgcctacgacgccgtagaggtattcgtcgtaccgttttattagtttgttcgttgggtcgttacgacctaacgtcggtcccgtcccgttcgtaccgttttcggacccggtacggggtaccgtaacggtcgtaggagtacgtacgaacggacgtaacgtcggtcggccgtgacccgtacctacttcgttcgttccttcgttacccg

SEQ ID NO: 277204 - DNA, 698 bp, Homo sapiens
  misc_feature: GYAE6OF01DQ0AW.29.35.D02.1.454.CMB.1.raw
  modified_base (261)..(261): a, c, t, g, unknown or other
  misc_feature (261)..(261): n is a, c, g, or t
tcagatagagtactcacgaccggtgctcgatttagcacacgatagttgggtttgggggaggaactgctcagttaggacccagacggaaccatggaagccccagctcagcttctcttcctcctgctactctggctcccagataccagcggagagattgtgttgacacagtctccagccaccctgtctttgtctccgggagaaagagccaccctctcctgcagggccagtcagagtgtaacaactacttggcctggttccaanagaaacctggccaggcctcccaggctcctcatctatgatgcactccaacgacgggccactgggccatcccagccgaggttcaggtggcgaggtgggtcgtgggacaggacttcacttcctacacctatccgacgcccgtcctaacggacgtcccgtagggacggtactttacgttcggttcccggtttttaagtttacgttttcggttccggttttacggggtcggttaacggaccgtaacgttcgggtccccgttccccgttaccgttaccgtttttacgggcccggtaacggggggtaaccctaacgggtccgtacgggtaacggacgttaccgaacgggtaaacccggttaaaccggttcgggttcggggccgtttacggaccccgtaaccgttaaacgttcccgtttccggttaccgtttcccgttaaccccg

SEQ ID NO: 277205 - DNA, 845 bp, Homo sapiens
  misc_feature: GYAE6OF01A3GJK.29.35.D02.1.454.CMB.1.raw
  modified_base (197)..(197): a, c, t, g, unknown or other
  misc_feature (197)..(197): n is a, c, g, or t
tcagatagagtactcacgaccggtgctcgatttagcacacgatagttgggtttgggggaggaactgctcagttaggacccagacggaaccatggaagccccagctcagcttctcttcctcctgctactctggctcccagataccagcggagagattgtgttgacacagtctccagccacctgtctttgtctcggganaaagcgcccacctctcctgcacgggccagtcagtagttgttaaaccacttacgttggccttaggttaccaaacgaggtaaaaccctgggacccaagggccttcccgaacgggtccttcccgtactacgtttcctaaagttcggtaacttcggacctaacgttaccccgaaaaccggtacgggggacccctaacgggttacgggacctaacgttacccccgaacggtaccccgttaaggggtttccctaaaggggttccgggtaccggtaacggggtttcgggggtaccgttacgggggggaaccctaagggttaacccttttccgaacctttcccgaacctaacccgtacttaccgaccggtaccccgtacccggttaacggaccgtacccggtaggtaacggtacgttttcgttacggttaccgttttaagtttacgtttcggttcgtttacggggcgtttacggaccgtaacgttcgggtccccttacccggttcgttaccggtttttacggacccgggttaacggggaacctaacggtccggttagggtaacgtacgtaccggaaaggtaccggttaaacggttcggtacgggtccgtacggacccgtaccgttacgttaccgttctttccgttccttaacccgg

SEQ ID NO: 277206 - DNA, 570 bp, Homo sapiens
  misc_feature: GYAE6OF01D32WT.29.35.D02.1.454.CMB.1.raw
tcagatagagtactcacgaccggtgctcgatttagcacacgatagttgggtttggggaggaactgctcagttaggacccagacggaaccatggaagcccagctcagcttctcttcctcctgctactctggctcccagataccagcggagagattgtgttgacacagtctccagcccaccctgtctttgtctccgggagaaagcgcccaccctctcctgcagggccagtcagagtgttaacaactacttggcctggttaccaacagaaacctggccaggcctccaggctcctcatctatgatcgcataccaacagggccactggcactcccagccaggttcagtcggcagtgggtctgggacagacttcactctacaccatccgagcccgcctacgacgccgtggacggtacttcgtcgtaccgttttatttatttggttcgtttgggtcgtagtcctaacgtcggtcccgttcccgttccgtacgttttcggcccgtacggggaaccgaggcgtaggagagtacgaggacgtacgtcgtcggcgtgaccactactctcgttcttcgtacc

SEQ ID NO: 277207 - DNA, 574 bp, Homo sapiens
  misc_feature: GYAE6OF01D8YXK.29.35.D02.1.454.CMB.1.raw
  modified_base (203)..(203): a, c, t, g, unknown or other
  misc_feature (203)..(203): n is a, c, g, or t
  modified_base (343)..(343): a, c, t, g, unknown or other
  misc_feature (343)..(343): n is a, c, g, or t
  modified_base (567)..(567): a, c, t, g, unknown or other
  misc_feature (567)..(567): n is a, c, g, or t
tcagatagagtactcacgaccggtgctcgatttagcacacgatagttgggtttggggaggaactgctcagttaggacccagacggaaccatggaagccccagctcagcttctcttcctcctgctactctggctcccagataccaggcggagagattgtgttgacacagtctccagccaccctgtcttgtctccgggagaaagngccaccctctcctgcagggccagtcagagtgttaaccaactacttggccttggttaccaacagaaacctggccaggctcccaggctcctcatctactgatgcatccaacgagggccacgtggcactcccagccaggttcngtggcaggtcgggtctagggacagacttcactctcacatcacgccgctacgacgccgtgacgtatcgtgtccgttttattattcggttacgttgggtcgtagaccgtaacgtcggtcccttcccgtcgtacgtttcggaccgtacggggtaccgaaggtcgtaggacgtagtacgacggacgtaacgtcggtcggacgtgacctacctactcgttcgttacctnttacccg

SEQ ID NO: 277208 - DNA, 674 bp, Homo sapiens
  misc_feature: GYAE6OF01CNYMR.29.35.D02.1.454.CMB.1.raw
  modified_base (204)..(204): a, c, t, g, unknown or other
  misc_feature (204)..(204): n is a, c, g, or t
  modified_base (263)..(263): a, c, t, g, unknown or other
  misc_feature (263)..(263): n is a, c, g, or t
tcagatagagtactcacgaccggtgctcgatttagcacacgatagtttgggtttggggaggaactgctcagttaggacccagacggaaccatggaagccccagctcagcttctcttcctcctgctactctggctcccagataccagcggagagattgtgttgacacagtctccagccaccctgtctttgtctccgggagaaagngccaccctctcctgcagggccagtcagagtagttaacaactacttggcctggttccaanagaaacctggaccaggcctcccgaggcctcctcatctatgatgcatccaacgacgggccacgtggccatccccagccgtaggttcaggtcggctagggtgggtcgtaggggacacggtacctttcaccttcctacaccctatccgacgacccgccgtaacgacgtaccgtggaacggtacgtttcgttcggttaccgttttatttacgtttgttcgtttacgggtcgtacgtacgtaaccgttcggtccccgttccccggttccgttaccgttttacgggacccggtaacgggggtaacccgtacggtccgtagggacgtaacgttaccgaaggtaaccggtaaccggttcggtacgggtccgttcggacccgtaaccgtacgttccgttccgttccgtttccgttacccg

SEQ ID NO: 277209 - DNA, 701 bp, Homo sapiens
  misc_feature: GYAE6OF01CV28J.29.35.D02.1.454.CMB.1.raw
tcagatagagtactcacgaccggtgctcgatttagcacacgatagttgggtttggggaggaactgctcagttaggacccagacggaaccatggaagccccagctcagcttctcttcctcctgctactctggctcccagataccagcggagagattgtgttgacacagtctccagcccaccctgtctttgtctccgggagaaagagccaccctctcctgcagggccagtcagtagtagttaaccaacttacgttcgggccttggttaccaaacagaaacccgtggacccaagggcccttcccggacggtcctcctacacttctagtgtaagtcactactaccgaacggaccgggaccaggtcggacctacctaccccgagtaccgtagggttcgacggttcggacgtacggggttcgggtacggtacgggaactacgtaccttcaccgttccaacacctacgtcgacgaccgtaccgtacgacgtcgacggtacgtcttcgttacgtttacgttttagttagtttcggttcgttcgggtacgtaacgtacgttaccggtccggttcccgtcccgtttacgttacggtttacgggaccggtacgggtaacgtacggtacggtaacggtacgtaccgtacgaacggtaacgtacgtggtacgcgtaccgacctaccgtacttctaccgttccgttcgttacccg

SEQ ID NO: 277210 - DNA, 553 bp, Homo sapiens
  misc_feature: GYAE6OF01A1QLL.29.35.D02.1.454.CMB.1.raw
  modified_base (262)..(262): a, c, t, g, unknown or other
  misc_feature (262)..(262): n is a, c, g, or t
tcagatagagtactcacgaccggtgctcgatttagcacacgatagttgggtttgggggaggaactgctcagttaggacccagacggaaccatggaagccccagctcagcttctcttcctcctgctactctggctcccagataccagcggagagattgtgttgacacagtctccagccaccctgtctttgtctccgggagaaagagccaccctctcctgcagggccagtcagagtgttaacaactacttggcctggttccaanagaaacctggccaggctcccaggctcctcatctatgatgcatccaacaggccactggcactcccagccaggtcagtggcagtgggtctgggacagacttcactctcaccatcagccgcctagagcctgagacttctgtccgtttatttagttgtcgttgggcgttaggctaacgtcggtcccttcccgttcgtaccgttttcggacccgtacggggtaacccaagtccgtagggacgtagtacgaacggtaccaagtgttcggctcgcctaccattctcgtcttcgtaccg

SEQ ID NO: 277211 - DNA, 764 bp, Homo sapiens
  misc_feature: GYAE6OF01DDT4L.29.35.D02.1.454.CMB.1.raw
  modified_base (751)..(751): a, c, t, g, unknown or other
  misc_feature (751)..(751): n is a, c, g, or t
tcagatagagtactcacgaccggtgctcgatttagcacacgatagttgggtttcgggaggaacctgctcagttaggaccagacggaaccatggaacgccccagctcaggccttcgtcttcctccgtgcctactctcggctcccagagtaccagaccggacgagattcgggtgttagacacagtcctccagtcccacctgtctttcgtccgtaccggggagaaaacgaccgaccctaccctctccttgccgagggcccaagtccgacggacgttacgtaaaccgaaccttacgttcggaccttcggttacccaaagtaccgtaaaacccgtgggtacccaagggtcccctacccccgaggtcccttccccttaccaagttcccttaagtcggaaacgttcggaaccctacgttaacccgaaacggtacggggaccctaacgtcgggacctacctaccccgacgtacccgttaggggttccaacgggtttcggacctagggtcggggtcgtaggggactaacggtctttaccgacgtttcaaccgtacctagtccgtacggcccgtaccgtacggaaccgtccgtaggaacggttcttacgtcggtacccgtttaagttacgttccgttaccgttggtaccgttacgtacctaccgtccggtacccctcccgttaccttacgtttcggaccgtaacgggtaccgacggtcgtcggacgacgtacgaacgtacgacgttggcgctgacactatntcgtcttcgtacg

SEQ ID NO: 277212 - DNA, 565 bp, Homo sapiens
  misc_feature: GYAE6OF01EGMQR.29.35.D02.1.454.CMB.1.raw
  modified_base (204)..(204): a, c, t, g, unknown or other
  misc_feature (204)..(204): n is a, c, g, or t
tcagatagagtactcacgaccggtgctcgatttagcacacgatagttgggtttgggggaggaactgctcagttaggacccagacggaaccatggaagccccagctcagcttctcttcctcctgctactctggctcccagataccagcggagagattgtgttgacacagtctccagccaccctgtctttgtctccgggagaaagngccaccctctcctgcagggccagtcagagtgttaacaactacttggcctggttccaacagaaacctggccaggcctcccaggctcctcatctatgatgcatccaacagggccacgtggcactcccagccaggttcagtggcaggtgggtctgggacagactcactctcaccatcacgccgcctagcgccgtgaggtattcgtgtccgtttattagtttgttcgttgggtcgtacgtctaacgtcggtcccgtcccgttctaccgttttcggaccgtacggggaccgaacggcgtaggacgtacgtacgacggacgtaacgtggtggccgtgacctacctactccgttcgttccttctaccg

SEQ ID NO: 277213 - DNA, 750 bp, Homo sapiens
  misc_feature: GYAE6OF01DF0Z7.29.35.D02.1.454.CMB.1.raw
  modified_base (261)..(261): a, c, t, g, unknown or other
  misc_feature (261)..(261): n is a, c, g, or t
tcagatagagtactcacgaccggtgctcgatttagcacacgatagttgggtttgggggaggaactgctcagttaggacccagacggaaccatggaagccccagctcagcttctcttcctcctgctactctggctcccagataccagcggagagattgtgttgacacagtctccagccacctgtcttgtctccgggagaaagagccaccctctcctgcacgggccagtcagagtagtaacaactacgttggcctggtccaanacgaactggccagctccgagctcctcatctatgatcgcactccaacgacggggaccacgtcggacacgtaccccgagacccgtaagggtttcaaggttcggcgtaacgggttggggtaccgttagggggaacctacgggtaacctttccaacgttccctaccaaccgacttccgaacgcccgacccgtaggaaccgtccgtaggtaacggtactttacgtacggttacccgttttagtttaacgttttcggttacgtttcgggtacggttaacggtacctaaacggttcgggtacccctttaccccggttacccgtttaccgtttttacggggacccggtaacggggtaacccggtaacggtaccggttaacgggtaacgtacggttaccgaacgggtaaaccggttaaacggttacgggtccgggtacgttaccgaaccccgtacccgttaactttcccgttaccggtttccctttaccgttaacccg

SEQ ID NO: 277214 - DNA, 540 bp, Homo sapiens
  misc_feature: GYAE6OF01BJMNO.29.35.D02.1.454.CMB.1.raw
tcagatagagtactcacgaccggtgctcgatttagcacacgatagttgggtttggggaggaactgctcagttaggacccagacggaaccatggaagccccagctcagcttctcttcctcctgctactctggctcccagataccagcggagagattgtgttgacacagtctccagccaccctgtctttgtctccgggagaaagagccaccctctcctgcagggccagtcagagtgttaacaactacttggcctggttccaacagaaacctggccaggcctcccaggctcctcatctatgatgcatccaacgagggccacgtggcactcccagccaggttcaggtggcagtgggtctgggacagtactcactctcaccatcacgccgcctagacgccgtgagtacttctgtaccgtttattagtttgtcgttgggcgttagctaacgtcgccctccgtctacgtttcggccgtacgggaccagtcgtggagtacgtacgagacgaagtggtcggctgacctactatcttcgttcttctaccg

SEQ ID NO: 277215 - DNA, 516 bp, Homo sapiens
  misc_feature: GYAE6OF01CQSDA.29.35.D02.1.454.CMB.1.raw
  modified_base (197)..(197): a, c, t, g, unknown or other
  misc_feature (197)..(197): n is a, c, g, or t
  modified_base (202)..(202): a, c, t, g, unknown or other
  misc_feature (202)..(202): n is a, c, g, or t
  modified_base (211)..(211): a, c, t, g, unknown or other
  misc_feature (211)..(211): n is a, c, g, or t
  modified_base (259)..(259): a, c, t, g, unknown or other
  misc_feature (259)..(259): n is a, c, g, or t
  modified_base (307)..(307): a, c, t, g, unknown or other
  misc_feature (307)..(307): n is a, c, g, or t
  modified_base (366)..(366): a, c, t, g, unknown or other
  misc_feature (366)..(366): n is a, c, g, or t
  modified_base (418)..(418): a, c, t, g, unknown or other
  misc_feature (418)..(418): n is a, c, g, or t
tcagatagagtactcacgaccggtgctcgatttagcacacgatagttggggtttggggggaactgctcagttaggacccagacggaaccatggaagccccagctcagcttctcttcctcctgctactctggctcccagataccagcggagagattgtgttgacacagtctccagccaccctgtctttgctccggganaaagngccaccctntcctgcagggccagtcagagtgttaaacactacttggcctggtccaanagaaacctggccaggctccaggctcctcatctatgatgacatccaaanagggccaactggcatcccagccaggttcagtgcagtgggtctgggacagacttcactcncaccatcagccgcctagagctagagattctgtcgtttattattgtcttgggngttagcaactggccttccgtctacttttggaccgaggggaccaagcgtagagatcgagacgaactagtcggctgacacctaatctgtcttcattcccg

SEQ ID NO: 277216 - DNA, 728 bp, Homo sapiens
  misc_feature: GYAE6OF01BR2MV.29.35.D02.1.454.CMB.1.raw
  modified_base (199)..(199): a, c, t, g, unknown or other
  misc_feature (199)..(199): n is a, c, g, or t
tcagatagagtactcacgaccggtgctcgatttagcacacgatagttgggtttgggggaggaactgctcagttaggacccagacggaaccatggaagccccagctcagcttctcttcctcctgctactctggctcccagataccagcggagagattgtgttgacacagtctccagccaccctgtctttgtctccggganaaagcgccaccctctcctgacgacggggccaggtcaagtagttacgttaaacaacttacgttgggccctggttaacccaacgtaacgaaaccgttttcggaccgacggcctcccgacggcctccgtactactctatgatgaccactaccaacgacgggaccacgtcggtacacgtacccgacgaccgtacggttacgaggtcggacgaggtcgggtcgtagggacgacggtacttcactctaccaccactcgacgacccgtccgtacgacgcgtacggacggtacgtttcgtcggttaccgttttagtttacgtttcggttcgtttacggggtaccggttacgtaccgtaaccgttccggtcccgtttaccccggttaccgttaccgggttttaccgggacccgggtaaccggggtaacccgtaacggccggttacggaacgtacgtacgtaacggtaccgtaacggttcggtaccggaccgttacggacctaaccgtacgttaccgttcgtttaccgttcgttacccg

SEQ ID NO: 277217 - DNA, 595 bp, Homo sapiens
  misc_feature: GYAE6OF01ASLLG.29.35.D02.1.454.CMB.1.raw
  modified_base (201)..(201): a, c, t, g, unknown or other
  misc_feature (201)..(201): n is a, c, g, or t
tcagatagagtactcacgaccggtgctcgatttagcacacgatagttgggtttggggaggaactgctcagttaggacccagacggaaccatggaagccccagctcagcttctcttcctcctgctactctggctcccagataccagcggagagattgtgttgacacagtctccagccacctgtctttgtctcgggagaaagngccacctctcctgcagggccagtcagagtgttaacaactacttggccttggttaccaacacgaaacctggaccaggcctcccgaggcctcctcatctatgatcgcactccaacgcgggccacgtcggcactcccagccgtaggttcaggtcggacgtagggtgggtcgtagggactacgtaccttcaccttctaccacctataccgacgcccgaccgtacggacgccgtaggtaacggtacttcgtcgttaccgtttagttacgtttcggttcgttcgggtcgtacgctaccgtcggtcccttccgtcttacgtttcggccgtagggaccagtcgtggacgtacgtacgagacgtagtggtcgcgtgacctactagtctcgttccttcgtaccg

SEQ ID NO: 277218 - DNA, 556 bp, Homo sapiens
  misc_feature: GYAE6OF01DHSEK.29.35.D02.1.454.CMB.1.raw
  modified_base (260)..(260): a, c, t, g, unknown or other
  misc_feature (260)..(260): n is a, c, g, or t
  modified_base (286)..(286): a, c, t, g, unknown or other
  misc_feature (286)..(286): n is a, c, g, or t
  modified_base (364)..(364): a, c, t, g, unknown or other
  misc_feature (364)..(364): n is a, c, g, or t
tcagatagagtactcacgaccggtgctcgatttagcacacgatagttgggtttggggaggaactgctcagttaggacccagacggaaccatggaagccccagctcagcttctcttcctcctgctactctggctcccagataccagcggagagattgtgttgacacagtctccagccaccctgtctttgtctccgggagaaagagccaccctctcctgcagggccagtcagagtgtaacaactacttggcctggttccaanagaacctggccaggctccaggctccncatctatgatgcatccaacgacgggccactggcactcccagccaggttcagtggcaggtgggtctgggacagacttcnctctcacatcagccgcctagacgcctgaggtattcgtcgtaccgtttattatttgttcgttgggtcgtagtctaacgtcggcccttcccgtctacgtttcggaccgtacgggaccgagcgtaggagacgtacgacggaccggtaacgttggtcggcgtcggcctacctacgttcttcgttccttcgtacccg

SEQ ID NO: 277219 - DNA, 878 bp, Homo sapiens
  misc_feature: GYAE6OF01CNB01.29.35.D02.1.454.CMB.1.raw
  modified_base (203)..(203): a, c, t, g, unknown or other
  misc_feature (203)..(203): n is a, c, g, or t
  modified_base (263)..(263): a, c, t, g, unknown or other
  misc_feature (263)..(263): n is a, c, g, or t
tcagatagagtactcacgaccggtgctcgatttagcacacgatagttgggtttggggaggaacgtgctcagttaggacccagacggaaccatggaagccccagctcagcttctcttcctcctgctactctggcctcccagataccagcggagagattgtgttgacacagtctccagccacctgtctttgctccgggagaaagngcccaccctctcctgcgagggccagtcagagtgttaacactacttggcctggttaccaanagaaacctggccaggctccaggctcctcatctatgatgacatccaacgacgggacccacgtcgggacctacgtccccgacggtaccctagggtttaccgaacggttcgggacgtaacggggtttcgggggttaccgttaaggggggaaccctaacgggtacccttttaccgaacccgtttacccgtaccctaaaccctaacgttacccgaaaccggcccccggtaaccccgttaacgggtaaccggtaccccggttaacggggtaacggtttaaccgttttaccgtttaaccggttttaaccccggttttttaaagttttaaccggtttttcgggttttcccgggttttaccggggggttaaccggtttaaaccggtaccccgtttaaaccgggttacccgggttccccccgtttacccccggtttacccggtttaaccccgggttttttccggggaaccccgggtaaccgggggtaacccgtaacggtaccggttacgggtacgtaaccgttacggtaaacggtaaccggttaacggttacgggttacgggtaccgttaccggacccgtaaccgttaacgttccgtttcggttcccttttaaccgttaaccccg

SEQ ID NO: 277220 - DNA, 521 bp, Homo sapiens
  misc_feature: GYAE6OF01AG3J2.29.35.D02.1.454.CMB.1.raw
tcagatagagtactcacgaccggtgctcgatttagcacacgatagttgggtttggggaggaactgctcagttaggacccagacggaaccatggaagccccagctcagcttctcttcctcctgctactctggctcccagataccagcggagagattgtgttgacacagtctccagccaccctgtctttgtctccgggagaaagagccaccctctcctgcagggccagtcagagtgttaacaactacttggcctggttccaacagaaacctggccaggctcccaggctcctcatctatgatgcatccaacagggccactggcatcccagccaggttcagtggcaggtgggtctgggacagacttcactctcaccatcacgccgcctagacgcctgagtattctgtccgtttattatttgtcgttggtcgtagctaacgtcggtccctcccgtctacgtttcggccgtaggggaccagcgtggagagtcgagacgagtggtgctgcaccatctcgttctcgtac

SEQ ID NO: 277221 - DNA, 710 bp, Homo sapiens
  misc_feature: GYAE6OF01DTDOW.29.35.D02.1.454.CMB.1.raw
  modified_base (199)..(199): a, c, t, g, unknown or other
  misc_feature (199)..(199): n is a, c, g, or t
  modified_base (203)..(203): a, c, t, g, unknown or other
  misc_feature (203)..(203): n is a, c, g, or t
  modified_base (263)..(263): a, c, t, g, unknown or other
  misc_feature (263)..(263): n is a, c, g, or t
tcagatagagtactcacgaccggtgctcgatttagcacacgatagttgggtttgggggaggaactgctcagttaggacccagacggaaccatggaagccccagctcagcttctcttcctcctgctactctggctcccagataccagcggagagattgtgttgacacagtctccagccaccctgtctttgtctccggganaagngccaccctctcctgcagggccagtcagagtgtaaaccaactacgttggcctggtccaaanagaacctgccaggcctccaggctctcatctatgatgcactccaacgacgggccacgtcggactactccccagaccgagggttccaaggttcggacgtagggtcgggtcgtggggaactaggtacttccgactcctaccacctacgtccaacggcccgtaccgtaacggacggtcccgtagggtaacgtcgtttaccgttaggtttacccggtttttaatttacgtttcggtttcggtttacggggtacggttaacgtaccgtaaccggttcgggttcccccttcccggttacctttaccggttttcggggaccccggtaacgggggaaccctacgggtcggtaagggtaacggtacgtacggtaacggtaaacccggtaagtttcggggtacggtaccgttaggacccttaacccgtacttccgttaccgttctttacccgtacccg

SEQ ID NO: 277222 - DNA, 551 bp, Homo sapiens
  misc_feature: GYAE6OF01CCFBR.29.35.D02.1.454.CMB.1.raw
  modified_base (200)..(200): a, c, t, g, unknown or other
  misc_feature (200)..(200): n is a, c, g, or t
  modified_base (205)..(205): a, c, t, g, unknown or other
  misc_feature (205)..(205): n is a, c, g, or t
  modified_base (263)..(263): a, c, t, g, unknown or other
  misc_feature (263)..(263): n is a, c, g, or t
tcagatagagtactcacgaccggtgctcgatttagcacacgatagttggggtttgggggaggaactgctcagttaggacccagacggaaccatggaagccccagctcagcttctcttcctcctgctactctggctcccagataccagcggagagattgtgttgacacagtctccagccaccctgtctttgtctccggganaaagngccaccctctcctgcagggccagtcagagtgttaacaactacttggcctggttccaanagaaacctggccaggctccaggctcctcatctatgatgcatccaacgagggccacgtggcatcccagccaggttcagtggcaggtgggtctgggacagtacttcactctcaccatcacgccgctagacgcctgaggtattctgtccgtttattagttgttcgttgggtcgtagctaacgtcggtccctcccgttctacgtttcggccgtacggggaccagcgtaggacgtactacgaaggtacgaagtggtcggacgtcgaccacctacttctcgttccttcgtaccg

SEQ ID NO: 277223 - DNA, 578 bp, Homo sapiens
  misc_feature: GYAE6OF01EI0GG.29.35.D02.1.454.CMB.1.raw
  modified_base (259)..(259): a, c, t, g, unknown or other
  misc_feature (259)..(259): n is a, c, g, or t
tcagatagagtactcacgaccggtgctcgatttagcacacgatagttgggtttggggaggaactgctcagttaggacccagacggaaccatggaagccccagctcagcttctcttcctcctgctactctggctcccagataccagcggagagattgtgttgacacagtctccagccaccctgtctttgtctccgggagaaagagcccaccctctcctgcagggccagtcagagtgttaacactatggcctggttccaanacgaaacctggccaggctcccgaggcctcctcatctatgatgcatccaacgacgggccacgtggcactccccagccaggttcagtggcaggtgggtctgggacaggtacttcacctctcaccatcacgccgcctagcgcctgaggacttctgtcctttattagtttgttcgttgggtcgtagtactaaccgtcgacccgttcccgtccgtaccgttttcggacccggtacggggacccaaggtccgtagggtatacgtacgacggaacggtacgtggtcggccgtcgaccgtacctattccgttcgttcgttcttaccc

SEQ ID NO: 277224 - DNA, 566 bp, Homo sapiens
  misc_feature: GYAE6OF01CTHV0.29.35.D02.1.454.CMB.1.raw
  modified_base (527)..(527): a, c, t, g, unknown or other
  misc_feature (527)..(527): n is a, c, g, or t
  modified_base (546)..(546): a, c, t, g, unknown or other
  misc_feature (546)..(546): n is a, c, g, or t
  modified_base (554)..(554): a, c, t, g, unknown or other
  misc_feature (554)..(554): n is a, c, g, or t
tcagatagagtactcacgaccggtgctcgatttagcacacgatagttgggtttgggggaggaactgctcagttaggacccagacggaaccatggaagccccagctcagcttctcttcctcctgctactctggctcccagataccagcggagagattgtgttgacacagtctccagccaccctgtctttgtctccgggagaaagagccaccctctcctgcagggccagtcagagtgttaacaactacttggcctggttccaacagaaacctggccaggctcccaggctcctcatctatgatgcatccaacagggccacgtggcactcccagccgtaggttcaggttggacgtagggttcggggtcttggggacaggtacctttcacttctaccaccatccacgcccgccgtaaggacgtaccgtggaggtacgtttcgtagtaccgttttattagtttgttcgttgggtcgttagccgtaactcggtccctccgtcgttcgtttcggaccgagggaccgagcgtgganagtacgagcgagtgtggcngctacatntcgtcttcgtac

SEQ ID NO: 277225 - DNA, 593 bp, Homo sapiens
  misc_feature: GYAE6OF01BV2Q4.29.35.D02.1.454.CMB.1.raw
  modified_base (195)..(195): a, c, t, g, unknown or other
  misc_feature (195)..(195): n is a, c, g, or t
  modified_base (208)..(208): a, c, t, g, unknown or other
  misc_feature (208)..(208): n is a, c, g, or t
  modified_base (312)..(312): a, c, t, g, unknown or other
  misc_feature (312)..(312): n is a, c, g, or t
  modified_base (347)..(347): a, c, t, g, unknown or other
  misc_feature (347)..(347): n is a, c, g, or t
tcagatagagtactcacgaccggtgctcgatttagcacacgatagttgggtttgggggaggaactgctcagttaggacccagacggaaccatggaagccccagctcagcttctcttcctcctgctactctggctccagataccagcggagagattgtgttgacacagtctccagccacctgtcttgtctcggganaaagcgccacctntcctgcgaggccagtcagagtgttaaacactcttggcctggttaccaagagtaaacctggccaggcctcccgaggcctctcatctatgatcgacataccgaagnggccacgtgcaactccagtcctaggttcaggtcgntagggtcggtcgtgggactagtacttcactctacgacatccgacgccgaccgtagacgcgtagagtacttcgtacgtacgtttagttagttcgttcgttacggtacgtacgacgtaccgtcgtcccgtaccgttcgtacgtttacgggaccgtaacgggtaccgtaagtccggtaggtacgtagtaccgaaggtacgtaacgtggtcgacgtacgacgtacctacgttcttcgttccgtgtacccg

SEQ ID NO: 277226 - DNA, 597 bp, Homo sapiens
  misc_feature: GYAE6OF01ANMAV.29.35.D02.1.454.CMB.1.raw
tcagatagagtactcacgaccggtgctcgatttagcacacgatagttgggtttggggaggaactgctcagttaggacccagacggaaccatggaagccccagctcagcttctcttcctcctgctactctggctcccagataccagcggagagattgtgttgacacagtctccagccaccctgtctttgtctccgggagaaagagccaccctctcctgcagggccagtcagagtgttaacactacttggcctggttccaacagaaacctggccaggctcccaggctcctcatctatgatgcatccaacgcgggccactggcactccccagccaggttcaggtcggcaggtggggtctggggacaggtacttcactctacaccatccgacgccgcctacgacgcctggacggtattcgtcgttaccgttttatttagtttgttcgttgggtacgttacgcgtaaccgtcggtcccttcccgtcttaccgttttcggacccgtacggggtacccgaacggtcgtagggacgtacgtacgaacggtacgtaacgtggtcggtccgtcgacctacctacttccgttcgttccttcgtacccg

SEQ ID NO: 277227 - DNA, 790 bp, Homo sapiens
  misc_feature: GYAE6OF01CNWJ9.29.35.D02.1.454.CMB.1.raw
  modified_base (297)..(297): a, c, t, g, unknown or other
  misc_feature (297)..(297): n is a, c, g, or t
tcagatagagtactcacgaccggtgctcgatttagcacacgatagttgggtttggggaggaactgctcagttaggacccagacggaaccatggaagccccagctcagcttctcttcctcctgctactctggctcccagataccagcggagagattgtgttgacacagtctccagcccaccctgttctttgtctccggggagaaagacgcccaccctctcctgcagggccagtcagagtgtaacactacttggcctggttaccaactagaaacctggccaggcctccgaggcctcctnactctatcgatcgcactaccaacgacgggcctaacgtcggacaacgtccccaacggtacccggtttcaggttcgggaccgtaggggttcgggggtcctagggggaacctaagggtaccctttacgaacctttccgttaccaaacccgtaattccccgaaaggtcccgaacggtaaccggtacggggggtacccgttaaggaaaacgggtacgttacgggacctaaacgttccggtaacggtttaggtttaactttaaccgttacggtttaaccctaagttaacctaaagttttacgtttacgggttttaccttttaccggttaacgtttttccgggtacctttacccgttaacccggtttacccgggtaacccgtaaacggggtaacctaaccgggttaaccggtacgggtaaacggtaaagttaaaaccggtaacgttacgggttacggtaccgttacgggaacctaccgttaacttccggttcgtttaccc

SEQ ID NO: 277228 - DNA, 709 bp, Homo sapiens
  misc_feature: GYAE6OF01DBYYB.29.35.D02.1.454.CMB.1.raw
tcagatagagtactcacgaccggtgctcgatttagcacacgatagttgggtttggggaggaactgctcagttaggacccagacggaaccatggaagccccagctcagcttctcttcctcctgctactctggctccagataccagcggagagattgtgttgacacagtctccagccaccctgtctttgtctccgggagaaagcgccaccctctcctgcagggccagtcagagtgttaacaacttacttggccttggttccaaacagaaacctggccaggcctcccgaggctcctcatctatgatgacactaccaacgacgggccacgtcggaccactccccgagaccgtaggttcgaggttcggaccgtagggttcggggtccgtaggggaacacggtacctttcgaccttccgtaccaaccctactaccgaccgacccgtaccgtaacggacgtccgtagggtacggtacgtttacgttacggttaccgtttttaactttacgtttcggtttacggtttcggggtacggttacggtaccgttaaccgttccgggtaccccgtttcccggttaccgtttaccggtttttccgggacccggtaacggggtaacctaacgggtcgtagggacgtacgtacgaacggtaaccgtaacgttcggtcggtaccgtacgacctaccgtacgttccttcgttccgttccgttacccg

SEQ ID NO: 277229 - DNA, 678 bp, Homo sapiens
  misc_feature: GYAE6OF01BVU0A.29.35.D02.1.454.CMB.1.raw
  modified_base (198)..(198): a, c, t, g, unknown or other
  misc_feature (198)..(198): n is a, c, g, or t
  modified_base (203)..(203): a, c, t, g, unknown or other
  misc_feature (203)..(203): n is a, c, g, or t
tcagatagagtactcacgaccggtgctcgatttagcacacgatagttgggtttgggggaggaactgctcagttaggacccagacggaaccatggaagccccagctcagcttctcttcctcctgctactctggctcccagataccagcggagagattgtgttgacacagtctccagccaccctgtctttgctccggganaaagngccaccctctcctgcagggccagtcagagtgtaacactacttggcctggttccaacagaaacctggccaggctcccaggcctctcatctatgatgcactccaagacgggccacgtggccatcccagccaggttcaggtcggcgtaggtcgggtacgtcggggaactacggtacctttacaccgttacctaccaacccgtactaccgacggtccccggtaccgttaacggacggtacccgtacggtacggtaacgtttccgtacggttacccgttttaagtttaacgtttcggtttacggtttcggggtccgtaacggtaccctaacgttcggtccccgttcccgttaccgttaccgttttccgggaccggtaacggggaccgacggtccggtaggtaaggtaccgtacggtaacgaccggtaagtcggtcggtacctcggacctaccgtacgttccgttacgtccgtttcgtacc

SEQ ID NO: 277230 - DNA, 588 bp, Homo sapiens
  misc_feature: GYAE6OF01A6DRV.29.35.D02.1.454.CMB.1.raw
tcagatagagtactcacgaccggtgctcgatttagcacacgatagttgggtttgggggaggaactgctcagttaggacccagacggaaccatggaagccccagctcagcttctcttcctcctgctactctggctcccagataccagcggagagattgtgttgacacagtctccagccaccctgtctttgtctccgggagaaagagccaccctctcctgcagggccagtcagagtgttaacaactacttgggcctggttccaacagaaacctggccaggctcccaggctcctcatctatgatgcatccaagacgggccactggcactcccagccaggtcagtggcaggtgggtctgggacagtactcactctcaccatcacgccgccgtagacgcctaggtagtacttctgtacccgtttatttacttgttcgttgggcgttagactaacgtcggtccctcccgttcgtaccgtttcggacccgtacggggaaccacggtcgtagggacgtacgtacgacggtaaccggtaacgttggtcggtacgtacggacctaacccgtacgttcctacggttccttacgtacccg

SEQ ID NO: 277231 - DNA, 601 bp, Homo sapiens
  misc_feature: GYAE6OF01CB9LK.29.35.D02.1.454.CMB.1.raw
tcagatagagtactcacgaccggtgctcgatttagcacacgatagttgggtttgggggaggaactgctcagttaggacccagacggaaccatggaagccccagctcagcttctcttcctcctgctactctggctcccagataccagcggagagattgtgttgacacagtctccagccaccctgtctttgtctccgggagaaagagcccaccctctcctgcagggccagtcagagtgttaaacaacttacttcgggcctggttccaaacacgaaacctggccaggctcccaggctcctcatctatgatgcatccaacgacgggccacgtggcactcccagcctaggttcaggtggcaggtgggtcgtgggacagacttcactctcacctatcacgccgccgtacgacgtcgtacgtaggtacttcgtcgtaccgttttatttagtttcgttcgtttcgggtacgttacgacgtaacgtcggtcccgttcccgtccgttacgttttcggacccggtacggggtaaccgtacgccgtaggacgacgtacgacggacgtaacgtcggtcggtcgtcgaccgtactactcttcgttcttcgtaccg

SEQ ID NO: 277232 - DNA, 741 bp, Homo sapiens
  misc_feature: GYAE6OF01EFKT9.29.35.D02.1.454.CMB.1.raw
  modified_base (200)..(200): a, c, t, g, unknown or other
  misc_feature (200)..(200): n is a, c, g, or t
  modified_base (205)..(205): a, c, t, g, unknown or other
  misc_feature (205)..(205): n is a, c, g, or t
  modified_base (260)..(260): a, c, t, g, unknown or other
  misc_feature (260)..(260): n is a, c, g, or t
tcagatagagtactcacgaccggtgctcgatttagcacacgatagttgggtttgggggaggaactgctcagttaggacccagacggaaccatggaagccccagctcagcttctcttcctcctgctactctggctcccagataccagcggagagattgtgttgacacagtctccagcccaccctgtctttgtctccggganaaagngccaccctctcctgcagggccagtcagagtgttaacactcttggcctggtccaanagaacctggccaggctccaggctcctcatctatgatgcataccaacgacgggccacgtcggcactcccagccgtaggttccaggtggaaaacgtggtcgggtcgtggggactacggtacttcactcctacaacctatcgacgcccgtaccgtacgacgtccgtaggtacggtaactttcgttacggttacccgttttaagttttaacgtttcggtttaccggtttacggggtaccgttaacggtacccgttaaaccgttccgggttacccccgtttccccggtttaccgttacccgggttttttaccggggacccggttaaacggggggtaaccccgtaacgggtccggttacggggaacgtaaccgtaccggtaaacgggtaacccgggttaaaccggttcgggttaccgggtacccgttaccggaacccgtaacccgttaacgtttcccgtttacggtttcccgtttaccgttaacccg

SEQ ID NO: 277233 - DNA, 766 bp, Homo sapiens
  misc_feature: GYAE6OF01DF0JO.29.35.D02.1.454.CMB.1.raw
tcagatagagtactcacgaccggtgctcgatttagcacacgatagttgggtttgggggaggaactgctcagttaggacccagacggaaccatggaagccccagctcagcttctcttcctcctgctactctggctccagataccagcggagagattgtgttgacactagtctccagccctaccctgttctttgtccgtccgggagaaagacgcccaccctctcctgccgacgggcccaaggtcagtagttacgttaaaccaacttacgttcggcccttggttacccaaacgaacgtaaacccgtgggacccaagggtccctacccgaggtccttccgtacctattctagtcgatcgaccaacttacccgaaacgacgggaccctaacgtcggacctacgtaccccgaacgtacccgtaggttccgaggtcggtaccgtagggttacggggtcgttacgggggaactaacgggttaccctttacgaaacccgttttcccgaaccgtaaaccctacgttacccgaaccggtaccccgtaacccgtacggtaaccgtacccgtagggtaacgttacgtttaccgtttacggttacgtttttagttacgtttggttcgttacgggtacgtacgtcgtaacgttcgtcccgttaccgtcgttacgtttcggaccggtacggaccgtagccgtaggacgtacgtacgaacggtacgtagttggtcggtacgtccgacttaccgacgttccgttacgttccgttccgttacccg

SEQ ID NO: 277234 - DNA, 786 bp, Homo sapiens
  misc_feature: GYAE6OF01BMQ4K.29.35.D02.1.454.CMB.1.raw
tcagatagagtactcacgaccggtgctcgatttagcacacgatagttgggtttgggggaggaactgctcagttaggacccagacggaaccatggaagccccagctcagcttctcttcctcctgctactctggcctccagataccagcggagagattgtgttgacacagtctccagccaccctgtctttgctcgggagaaagcgccacctctcctgcacgggccagtcagtagtagttaaacaacttacgttgggcccttaggttacccaaacgacggtaaaccctggacccgtaacggcctccccgaggccttccctcaacttcctaagttcggattcgacctaacgtacccaaacgacggggacccaacggtcggacctaaccgtccccaaggtaccccgtagggtttccacgggttcggaccgtaacggggttcggggtaccgtacgggggaaccctaacgggttacccgtttaccgaaccttccctaacccgaacccgtacgttcccgaaccggtacccgtaccgtaacggaccggtaccgttacggtaacggttactttccggttacgttaccggttttaatttacgtttaacgttcggtttacgggacgtttacgtacgtaaccgttccggtcccgttacccggttaccgttaccggttttccgggaccggtaacggggtaacctacggtcggtacggacgtacgtacgaacggtaccggtaacgttcggtacggaccgtcgaccgtaccgtacgttaccgttcgttcctttccgtacccg

SEQ ID NO: 277235 - DNA, 705 bp, Homo sapiens
  misc_feature: GYAE6OF01C8BJ7.29.35.D02.1.454.CMB.1.raw
tcagatagagtactcacgaccggtgctcgatttagcacacgatagttgggtttgggggaggaactgctcagttaggacccagacggaaccatggaagccccagctcagcttctcttcctcctgctactctggctcccagataccagcggagagattgtgttgacacagtctccagccacctgtctttgtctccgggagaaagagccaccctctcctgcagggccagtcagagtgttaacaactacttggcctggttccaacacgaaacctggccaggcctcccaggctcctcatctatgatgcactccgaacgacgggcccacgtggaccactccccagacctaggttcagtcggcgtagggtcgggtacgtggggactaggtacttccactcgtaccaccatcgacgccgtcctacgacgtccgtgaacggtacttcgtcggttacccgtttttattcgttttcggttacgtttcggggtacgttaacgccgtaaccggttccgggtccccttaccccggtttccgttaacccggtttttcgggaccccggtaaacgggggtaaccccgtaaggtccggttaacgggtaacggtaacgtaccgaaaccgggtaaccggtaaaccgttagggttaccgggaccgtttacggtaccccgtaaaccgttacttcccggtttacggttccctttacggtttaaccccc

SEQ ID NO: 277236 - DNA, 546 bp, Homo sapiens
  misc_feature: GYAE6OF01BRUCX.29.35.D02.1.454.CMB.1.raw
  modified_base (202)..(202): a, c, t, g, unknown or other
  misc_feature (202)..(202): n is a, c, g, or t
  modified_base (313)..(313): a, c, t, g, unknown or other
  misc_feature (313)..(313): n is a, c, g, or t
tcagatagagtactcacgaccggtgctcgatttagcacacgatagttgggtttggggaggaactgctcagttaggacccagacggaaccatggaagccccagctcagcttctcttcctcctgctactctggcctcccagatacccagcggagagattgtgttgacacagtctccagcccaccctgtctttgctccggggaanaaagcgcccacctctcctgcagggccagtcagagtgttaaacaactcttggcctggtccaacagaaacctggccaggtctcccaggcctcctcatctatgatgcatccaanggccactggcatccagccaggttcagtgcagtgggtctgggactgacttcactcgtcacatcgacgccgctagacgccgtgagtacttctcgtcgtttacttattgttcgttggtcgtagctaacgtcggtaccgtccgtcgtacgttttcggaccgtaggggtaccaggccgtggagactacgacggtacgaactcggtggccgttgacctaccactctcggttcttcgtac

SEQ ID NO: 277237 - DNA, 636 bp, Homo sapiens
  misc_feature: GYAE6OF01BUNZI.29.35.D02.1.454.CMB.1.raw
  modified_base (590)..(590): a, c, t, g, unknown or other
  misc_feature (590)..(590): n is a, c, g, or t
tcagatagagtactcacgaccggtgctcgatttagcacacgatagttgggtttgggggaggaactgctcagttaggacccagacggaaccatggaagccccagctcagcttctcttcctcctgctactctggctcccagataccagcggagagattgtgttgacacagtctccagcccacccttgtctttgcgtccgggagaaacgagccaccctctcctgcgagggccagtcagtagtagttaacactacgttggcctggtaccaacaagtaaaccgtggcccaagggcctccaggtcctcctacatctatgactgacataccaacgacgggccagtcggcactcccagccaggttcaggtggcgacggtggggtctaggggacacggtacttcgactaccctcgaacctagtcacgcccgaccgtaggacgccgtaggaggtacttccgtgttaccgtttatttacggttcgttggttcgggacgttacgacgtaaccgtcgggtcccttacccgggttcttaaccggtttcgggaacccgtacggggaaccctaggtcggtagggactacgacgaacggacgtaagnggtcggctacgaccgtacctacgttcgttacgtccgttcgtacccg

SEQ ID NO: 277238 - DNA, 574 bp, Homo sapiens
  misc_feature: GYAE6OF01ELDPC.29.35.D02.1.454.CMB.1.raw
tcagatagagtactcacgaccggtgctcgatttagcacacgatagttgggtttggggaggaactgctcagttaggacccagacggaaccatggaagccccagctcagcttctcttcctcctgctactctggctcccagataccagcggagagattgtgttgacacagtctccagccaccctgtctttgtctccgggagaaagagccaccctctcctgcagggccagtcagagtgttaacaactacttggcctggttccaacagaaacctggccaggctcccaggctcctcatctatgatgcatccaacgagggccacgtggcactcccagccaggttcagtggcaggtgggtctgggacagtaccttcactctcacccatccacgccgccgtagacgccgtaggacggtacttcgttcgtaccgttttatttacgtttcggttcgttgggtccgtagtcctaacgtcggtcccttcccggttcctacgttttcggccgtacggggaaccagcgtaggagacgtacagtaacgtaacgtcggtcggctgacctacctactcgtgttccttctacg

SEQ ID NO: 277239 - DNA, 640 bp, Homo sapiens
  misc_feature: GYAE6OF01CR5N8.29.35.D02.1.454.CMB.1.raw
  modified_base (200)..(200): a, c, t, g, unknown or other
  misc_feature (200)..(200): n is a, c, g, or t
  modified_base (267)..(267): a, c, t, g, unknown or other
  misc_feature (267)..(267): n is a, c, g, or t
tcagatagagtactcacgaccggtgctcgatttagcacacgatagttgggtttgggggaggaactgctcagttaggacccagacggaaccatggaagccccagctcagcttctcttcctcctgctactctggctcccagataccagcggagagattgtgttgacacagtctccagccaccctgtctttgtctccgggaanaaagcgccaccctctcctgcagggccaggtcagagtgttaaacaacttacttggcctggttccaaanacgaaacctggaccaggctcccgaggcctcctcatcctatgatcgacactaccgaaacgtacgggccacgtcggcactccccgagccgtaggttcaggtcggacgagggtcgggtcgtgggaactaggtaccttcgacttcctacaacctataccacgcccgacctacggacgtccctaggacgtactttcgtcgtccgttttaatacgtttcgttcgttgggtccgttagaccgtaacgtcggtcccttcccggttacttaccggtttcggaccgtaggggaccctagtcgttagggactacgtacgaacggtaccgtaaggttgtacgggcctacggtaccaaccgtattcgttcggtcctttcgtacccg

SEQ ID NO: 277240 - DNA, 643 bp, Homo sapiens
  misc_feature: GYAE6OF01C6CRT.29.35.D02.1.454.CMB.1.raw
  modified_base (255)..(255): a, c, t, g, unknown or other
  misc_feature (255)..(255): n is a, c, g, or t
  modified_base (278)..(278): a, c, t, g, unknown or other
  misc_feature (278)..(278): n is a, c, g, or t
tcagatagagtactcacgaccggtgctcgatttagcacacgatagttgggtttgggggaggaactgctcagttaggacccagacggaaccatggaagccccagctcagcttctcttcctcctgctactctggctcccagactaccagcggagagattgtgttgacacagtctcagccacctgttctttgtctcgggaagaaagcgccacctctcctgcagggccagtcagagtataacactcgtgcctgtccaanagaactgcaggcctccagcctcncatctatgatcgacactaccgaaacgcgggccctaagtcggactactccccgagcccgtaggttcaggtcggactaggttcgggacgtacggggaactacggtacctttcgaccttctccaactactcgaaccgtcccgtaccgtacgaccgtccgtaggacggttacttcgtacgttaccgttttattagtttcggttcgtcgggtacgttacgaccgtacgtacgtcccgttaccgtcgttaacgtttccgggacggtacggggtaaccgaagtcggtacggtaacgacgtacgaacggtaaccgtaagtcggtcggtaccgtacgaccgtacgtacttacgttacgttcctacgttaacccg

SEQ ID NO: 277241 - DNA, 579 bp, Homo sapiens
  misc_feature: GYAE6OF01E2LTE.29.35.D02.1.454.CMB.1.raw
  modified_base (366)..(366): a, c, t, g, unknown or other
  misc_feature (366)..(366): n is a, c, g, or t
tcagatagagtactcacgaccggtgctcgatttagcacacgatagttgggtttgggggaggaactgctcagttaggacccagacggaaccatggaagccccagctcagcttctcttcctcctgctactctggctcccagataccagcggagagattgtgttgacacagtctccagccaccctgtctttgtctccgggagaaagagccaccctctcctgcagggccagtcagagtgttaacaacttacttggccttggttaccaaacagaaaacctggccaggctcccaggctcctcatctatgatgcatccaacagggccacgtggcactcccagccaggttcaggtggcaggtgggtctgggacngacttcactcacacatcacgccgcgtagacgtcctaggtagtacttcgtcgtaccgttttattacgttgttcgttgggacgtacgctaaccgtcggtcccgttcccgttctaccgtttcggaccgtacgggaccaacggcgtaggagacgtacgaacggacgtaacgtggtcgtccgtacgacctaccctagttccttcgttccttcgtaccg

SEQ ID NO: 277242 - DNA, 691 bp, Homo sapiens
  misc_feature: GYAE6OF01CGXH2.29.35.D02.1.454.CMB.1.raw
  modified_base (217)..(217): a, c, t, g, unknown or other
  misc_feature (217)..(217): n is a, c, g, or t
  modified_base (264)..(264): a, c, t, g, unknown or other
  misc_feature (264)..(264): n is a, c, g, or t
  modified_base (294)..(294): a, c, t, g, unknown or other
  misc_feature (294)..(294): n is a, c, g, or t
tcagatagagtactcacgaccggtgctcgatttagcacacgatagttgggtttgggggaggaactgctcagttaggacccagacggaaccatggaagccccagctcagcttctcttcctcctgctactctggctcccagataccagcggagagattgtgttgacacagtctccagccaccctgtctttgtctccgggagaaagcgccaccctctccngcagggccagtcagagtagtaacaactacttggacctggttaccaanagaaacctggaccaggctcccaggcctccnctatctatgatgcatccaacgcggccactggcactcccgagcctaggttcaggttcggacgtagggttcgggtacgtagggactacggtacctttaccgaccttcctaccaaccctagtaccgaccgccccgtaccgtaacggacggtaccctgggaacggttacgtttaccgtcggttacccgttttatttacggtttcggttacggtttcgggtacgtacgtacgtaaccgtcggtccccgttacccggttcttaccggttttcgggacccggtaacggggacccgtaacggtcgtagggtaacgtacgttacgaacggtaaccggtaacgttcgggtcggtaccgtacgtacccgtaaccttacgttccgtttcttcccgtttcgttaaccccg

SEQ ID NO: 277243 - DNA, 561 bp, Homo sapiens
  misc_feature: GYAE6OF01D8DUS.29.35.D02.1.454.CMB.1.raw
  modified_base (310)..(310): a, c, t, g, unknown or other
  misc_feature (310)..(310): n is a, c, g, or t
tcagatagagtactcacgaccggtgctcgatttagcacacgatagttgggtttggggaggaactgctcagttaggacccagacggaaccatggaagccccagctcagcttctcttcctcctgctactctggctcccagataccagcggagagattgtgttgacacagtctccagccaccctgtctttgtctccgggagaaagacgccaccctctcctgcagggccagtcagagtgttaaacactacttggcctggtccaacagaaacctggccaggctacccaggctcctcatctatgatgcatccaacncggaccactggcactcccagccagtcagtggcaggtggtcgtgggacacgcttcactctacacctatcgacgccgctacgacgcgtgaggtacttcgttgtaccgtttatttagttcgtcgttacgggtcgtacgctaacgtcggtcccgtcccgtcgtacgtttcggaccgtacgggacacgtcgtaggacgtagtacgacgacgtacgtcggtggcgtacgaccgtactacttctcgttcttcgtaccc

SEQ ID NO: 277244 - DNA, 733 bp, Homo sapiens
  misc_feature: GYAE6OF01BRYTD.29.35.D02.1.454.CMB.1.raw
  modified_base (205)..(205): a, c, t, g, unknown or other
  misc_feature (205)..(205): n is a, c, g, or t
  modified_base (215)..(215): a, c, t, g, unknown or other
  misc_feature (215)..(215): n is a, c, g, or t
  modified_base (262)..(262): a, c, t, g, unknown or other
  misc_feature (262)..(262): n is a, c, g, or t
tcagatagagtactcacgaccggtgctcgatttagcacacgatagttgggtttgggggaggaactgctcagttaggacccagacggaaccagtggaagccccagctcagcttctcttcctcctgctactctggctcccagataccagcggagagatttgtgttgacacagtctccagccaccctgtctttgctccgggagaaagngcccaccctntcctgcaggccagtcagagtgttaacactacttggcctggttccaanagaaacctggccaggcctcccgaggctcctcatctatgatcgcactccaacgacgggtaccacgtggaccacgtccccagtccctaggttccaggtcggactaggtcgggtctgggacagtacttcacgtctcacctatccacgccgaccgtacggacgcccgtagacggtactttcgtacggttacccgttttagtttaacgtttccggttacgtttcggggtaccggttaacgtaccgtaaaccgttccgggtaaccccctttccccgggttaccttacccggtttttaccgggacccggttaaacggggggtaaccccgtaaggtccggttaacggggtaacggtaaccgtttaacggtaaaccggggtaaccggtaaaccgtttgggtttaccgggtaccgtacccggaacccgttacccgttaacgtttcccgtttaccggttttaccgtttccctttaaccccgg

SEQ ID NO: 277245 - DNA, 614 bp, Homo sapiens
  misc_feature: GYAE6OF01DL53R.29.35.D02.1.454.CMB.1.raw
  modified_base (269)..(269): a, c, t, g, unknown or other
  misc_feature (269)..(269): n is a, c, g, or t
tcagatagagtactcacgaccggtgctcgatttagcacacgatagttgggtttggggaggaactgctcagttaggacccagacggaaccatggaagccccagctcagcttctcttcctcctgctactctggctcccagataccagcggagagattgtgttgacacagtctccagccaccctgtctttgtctccgggagaaagcgccaccctctcctgcaggggccagtcagagtacgttaacaacttacttggcccttggttaccaaanacgaaacctggccaggcctcccaggcctcctcatctatgatgcactccaacgagggccacgtgcactcccagcctaggttcagtcggcgaggtcgggtcgtggggacacggacttcactccacaccatcacgaccgaccgtacgacgcgtacggagtacttctacgtccgttttattacgttcgttcgttcgggtcgtacgtctaacgtcggtcccttcccggttaccttacgtttcggaccggtaacgggtacccgacggtcgtaggacggtacgtaccggaacggtaacgtggtacggtcgtcgcctaccgtacgttccttcgttaccttcgtcctttccccg

SEQ ID NO: 277246 - DNA, 538 bp, Homo sapiens
  misc_feature: GYAE6OF01DW8DM.29.35.D02.1.454.CMB.1.raw
  modified_base (204)..(204): a, c, t, g, unknown or other
  misc_feature (204)..(204): n is a, c, g, or t
  modified_base (499)..(499): a, c, t, g, unknown or other
  misc_feature (499)..(499): n is a, c, g, or t
tcagatagagtactcacgaccggtgctcgatttagcacacgatagttgggtttgggggaggaactgctcagttaggacccagacggaaccatggaagccccagctcagcttctcttcctcctgctactctggctcccagataccagcggagagattgtgttgacacagtctccagccaccctgtctttgtctccgggagaaagngccaccctctcctgcagggccagtcagagtgttaacaactacttggcctggttccaacagaaacctggccaggctccaggctcctcatctatgatgcatccaacgacgggcccactggccactccccagcccaggttcagtggcaggttgggtctggggacagacttcactctcaccatccagccgcctagacgcctggacgtattcgtgtccgtttattacgttgtcgttgggcgttagctaacgtcggtcccttccgtcgtacgtttcggaccgtagggaccagcgtggacgntacacgacgaatggtcgctgactacatctcgtctctacg

SEQ ID NO: 277247 - DNA, 798 bp, Homo sapiens
  misc_feature: GYAE6OF01AQZ25.29.35.D02.1.454.CMB.1.raw
tcagatagagtactcacgaccggtgctcgatttagcacacgatagttgggtttgggggaggaactgctcagttaggacccagacggaaccatggaagccccagctcagcttctcttcctcctgctactctggctcccagataccagcggagagattgtgttgacacagtctccagcccaccctgtctttgtcgtccgggagaaagcgccaccctctcctgcagggccagtcagagtagttaaacaacttcgttgggccttgggttacccaaacacgtaaaaccctggccaaggcctccccgaggcctccgtcactctatgatgcatccaacgacgggccctagtcggacactccccaggtcctagggtccaaggttcggaccgtagggtcggggtccgtagggaccagtaccttcaccttaccgttccaaccctataccgaccggtcccgtccgttaacggacggtaccgtacgggtaacggtacttttccggtaccgtttacccggttttaagtttacgttttcgggttaccggttttcggggtacccggtttaacggtaccgttaaacccgggttccgggttacccccggttttacccccggtttaccggtttaacccgggtttttttaccggggaccccgggtaacgggggtaaccccgtaaccgggttaccgggttacgggtaacggttacgtaaccggtaacgggtaaacccggtaacggttcgggtcggttaccgtacgggtacccgtaacccgttacgttacgtttcgtttacccgtttcgttaacccccg

SEQ ID NO: 277248 - DNA, 531 bp, Homo sapiens
  misc_feature: GYAE6OF01EUSPH.29.35.D02.1.454.CMB.1.raw
  modified_base (298)..(298): a, c, t, g, unknown or other
  misc_feature (298)..(298): n is a, c, g, or t
  modified_base (408)..(408): a, c, t, g, unknown or other
  misc_feature (408)..(408): n is a, c, g, or t
tcagatagagtactcacgaccggtgctcgatttagcacacgatagttgggtttggggaggaactgctcagttaggacccagacggaaccatggagccccagctcagcttctcttcctcctgctactctggctcccagataccagcggagagattgtgttgacacagtctccagccaccctgtctttgtctccggggagaaaagagccaccctctcctgcagggccagtcagagtgttaacaactacttggcctggttccaacagaaacctggccaggctcccaggctcctcatctatnatgcatcaaacaggggcccaactggcatccccagccaggttcagtggcagtgggtctggggacaggacttcactctcaccatcagccgcctagacgccctgaggatttcngccgttttattattgttcttgggcgttagcaacgtggcctcccgtcaccgttttcggcctaggggtacccaaggccgtggacgatcgagacgaactggtggctggcaccatctcgtcttcgac

SEQ ID NO: 277249 - DNA, 726 bp, Homo sapiens
  misc_feature: GYAE6OF01B06YM.29.35.D02.1.454.CMB.1.raw
  modified_base (203)..(203): a, c, t, g, unknown or other
  misc_feature (203)..(203): n is a, c, g, or t
tcagatagagtactcacgaccggtgctcgatttagcacacgatagttgggtttggggaggaactgctcagttaggacccagacggaaccatggaagccccagctcagcttctcttcctcctgctactctggctcccagataccagcggagagattgtgttgacacagtctccagccaccctgtctttgtctccgggagaaagngccaccctctcctgcagggccagtcagagtgttaacaactacttggcctggttccaacagaaacctggccaggcctcccgaggcctcctcatctatgatgcactccaacgacgggcccacgtcggaccactccccgagcccgtaagggttccaaggttggaccgtaggggttcgggggtccgtggggaacctacggtacctttccaaccgttcctaccaaccctacgttccgaaccggcccgtacccgtaacggaccggtccgttacgggtacggttacgtttcgttaccggtttaccggtttttacgttttaacgttttcggtttccggtttacggggtaccggttaacggtaccgtaaccgttcgggtccccgttccccggttaccgttaccggttttccgggacccgggtaacggggacccgtaacggcgtacgggaagtacgtacgaacggtaaccggtaacgtacggtcggaccgtcgacccgtaacccgtacgttccgtcgttccttccgttacccg

SEQ ID NO: 277250 - DNA, 577 bp, Homo sapiens
  misc_feature: GYAE6OF01BIA8F.29.35.D02.1.454.CMB.1.raw
tcagatagagtactcacgaccggtgctcgatttagcacacgatagttgggtttgggggaggaactgctcagttaggacccagacggaaccatggaagccccagctcagcttctcttcctcctgctactctggctcccagataccagcggagagattgtgttgacacagtctccagccaccctgtctttgtctccgggagaaagagccaccctctcctgcagggccagtcagagtgttaacaactacttggcctggttccaacagaaacctggccaggctcccaggctcctcatctatgatgcatccaacagggccacgtggcatcccagccaggttcagtggcagtgggtctgggacagtacttcactctcaccatcgacgccgccgtacgacgccgtgacggtacttcgtcgtaccgttttattagtttcgttcgtttcgggtacgttagacctaacgtcggtcccgttcccgttcgtacgttttcggaccgtacggggaccaacggtcgtaggagtacgtacgacggaacgtacgtggtcggctacgcctacacttcttcgttccgttctacccg

SEQ ID NO: 277251 - DNA, 632 bp, Homo sapiens
  misc_feature: GYAE6OF01C6GOO.29.35.D02.1.454.CMB.1.raw
  modified_base (262)..(262): a, c, t, g, unknown or other
  misc_feature (262)..(262): n is a, c, g, or t
tcagatagagtactcacgaccggtgctcgatttagcacacgatagttgggtttggggaggaactgctcagttaggacccagacggaaccatggaagcccagctcagcttctcttcctcctgctactctggctccagataccagcggagagattgtgttgacacagtctcagccacctgtctttgtctccgggagaaagagccaccctctcctgcacgggccagtcagagtagttaacaacttacttgggcctggttaccaanaagaaacctggaccacggcctcccaggctcctcatctatgatgacactaccaacgacgggccagtcgacactccagccgtaggttcagtggacgaggttggtcgtgggacacggtacttcacgtactacaccctataccgacgaccgtaccgtacgaccgtccgtacggtacggttacttcgttacggttaccgttttatttacgtttcggttggtttcgggtaccggttagaccgtacgttcgggtcccttacccggttacgtaccgttttcgggaccggtaacgggtaccgagtcgttagggaacgtacgtacgacggtaccgaacgtggtcggcgtacgactaccgtactcgttactcgttctaccg

SEQ ID NO: 277252 - DNA, 554 bp, Homo sapiens
  misc_feature: GYAE6OF01EZ79U.29.35.D02.1.454.CMB.1.raw
  modified_base (199)..(199): a, c, t, g, unknown or other
  misc_feature (199)..(199): n is a, c, g, or t
  modified_base (204)..(204): a, c, t, g, unknown or other
  misc_feature (204)..(204): n is a, c, g, or t
  modified_base (262)..(262): a, c, t, g, unknown or other
  misc_feature (262)..(262): n is a, c, g, or t
tcagatagagtactcacgaccggtgctcgatttagcacacgatagttgggtttggggaggaactgctcagttaggacccagacggaaccatggaagccccagctcagcttctcttcctcctgctactctggctcccagataccagcggagagatttgtgttgacacagtctccagccaccctgtctttgtctccggganaaagngccaccctctcctgcagggccagtcagagtgttaaacactacttggcctggttccaanagaaacctggccaggctcccaggctcctcatctatgatgcatccaacagggccactcggcactcccagccaggttcagtggctaggtgggtctgggacagacttcactctcaccatcacgccgcctagacgccgtgaggtattcgtgtaccgttttattatttgttcgttgggtcgtagctaactcggcccttccgtctacgtttcggccgtagggaccaagcgtaggacgtatcgaacgtacgtaagtcggtcggcgtgacctaccgtactccgttcgttcttccgtaccg

SEQ ID NO: 277253 - DNA, 729 bp, Homo sapiens
  misc_feature: GYAE6OF01B3FB3.29.35.D02.1.454.CMB.1.raw
  modified_base (199)..(199): a, c, t, g, unknown or other
  misc_feature (199)..(199): n is a, c, g, or t
  modified_base (204)..(204): a, c, t, g, unknown or other
  misc_feature (204)..(204): n is a, c, g, or t
tcagatagagtactcacgaccggtgctcgatttagcacacgatagttgggtttgggggaggaactgctcagttaggacccagacggaaccatggaagccccagctcagcttctcttcctcctgctactctggctcccagataccagcggagagattgtgttgacacagtctccagccaccctgtctttgtctccggganaaagngccaccctctcctgcagggccagtcagagtgttaacactacttggcctggttccaacacgaaacctggccaggcctcccgaggcctcctcatctatgatgcatccaacgacgggcccacgtcggaccaacgtccccacggtcccgtaaggtttccgaaggtcgggacctaaggggttcgggggttcggttagggggaccgtaaggtaaccctttaccaccgtttccttaccgaaacccctattacccgaaccggtcccgtacccgtaacggaccgtacccgttaggacgggttactttccgttcgttacccggtttttaatttacggtttagtttccggtttacggggaccttacggtacttaaacccggtcgggtaccccctttacccggttacgttaccgttttacgggccccgtaacgggggtacccaagggtccgtaggggtactaacgtccgaacgggaccgtaagtcgggttcgaccgttcggaccctaccacgtttccgtacgttccttcgtaacccg

SEQ ID NO: 277254 - DNA, 757 bp, Homo sapiens
  misc_feature: GYAE6OF01DAKEF.29.35.D02.1.454.CMB.1.raw
tcagatagagtactcacgaccggtgctcgatttagcacacgatagttgggtttgggggaggaactgctcagttaggacccagacggaaccatggaagccccagctcagcttctcttcctcctgctactctggctccagataccagcggagagattgtgttgacacagtctccagcccaccctgttctttgtcgtccgggagaaagcgccaccctctcctgcgacgggccagtcagtagtagttaaacaacttacgttggcccttaggttacccaaacgacgaaaccgtcggaccgaggcctccgaggcctcctactatctatgtatcgactactaccgaacgacgggacctacgtcggacctacgtaccccacggtacccgtagggttcacggttcgggaccgtaggggttcggggtacgtacggggaactacggtacctttaccacttcctaccaccgtactaccgtacgacccgtaccgtaacggtaccgtaccggtacggtacggttacttaccgtttacggtttacccgttttaagtttacggtttcggttcggttcgggttacggttacggtaccgttaaccggttccggtcccgtttacccggtttaccggttaccggtttttaccgggacccgggtaacggggtaaccgtaacggtacggttacgggacgtaccgtacgtaacggtaaccgtacggttacggtcggtaccgtacgacctacgtacgttcgttacttcgttacgttacccg

SEQ ID NO: 277255 - DNA, 576 bp, Homo sapiens
  misc_feature: GYAE6OF01CGAJQ.29.35.D02.1.454.CMB.1.raw
tcagatagagtactcacgaccggtgctcgatttagcacacgatagttgggtttgggggaggaactgctcagttaggacccagacggaaccatggaagccccagctcagcttctcttcctcctgctactctggctcccagataccagcggagagattgtgttgacacagtctccagccaccctgtctttgtctccgggagaaagagccaccctctcctgcagggccagtcagagtgttaacactacttggcctggttccaacagaaacctggccaggcctcccaggctcctcatctatgatgcatccaacgacgggccctacgtggccactccccgagcctagggttcaggtcggcgagggttcggggtctaggggacaggtaccttcacctctaccaccatccacgccgcctagcgcctaggaggtacttcgtcgtaccgtttattagtttgttcgttgggtcgtagactaacgtcggtccctccgttcgtacgttttcggccgtacgggaccgaggtcgtggagtagtacgacgacgtacgtggtggcgtgacctactactctcgttctctaccg

SEQ ID NO: 277256 - DNA, 616 bp, Homo sapiens
  misc_feature: GYAE6OF01DX7W0.29.35.D02.1.454.CMB.1.raw
tcagatagagtactcacgaccggtgctcgatttagcacacgatagttgggtttggggaggaactgctcagttaggacccagacggaaccatggaagccccagctcagcttctcttcctcctgctactctggctcccagataccagcggagagattgtgttgacacagtctccagccaccctgtctttgtctccgggagaaagacgccaccctctcctgcagggccagtcagagtgttaacaactcttggcctggttccaacagaacctggccaggctcccaggctctcatctatgatgcatccaacgacgggccaacgtggacactcccagcctaggttcaggtgcaggtgggctagggactagcttcactctacaccatcacgccgacctaggaacgcctaggtacgggtactttcgtacggttcccgtttttaagtttacgttttcggttcgtttcggggtccggttaacgccgtaaccgtcggtaccccgttccccggttacttaccgtttttcgggacccggtacggggaccctaacggccgttagggagtacgtcgaaggaacgtaacgttgggtcgcgtcgaccgacctacttctcgttcctcgtacccg

SEQ ID NO: 277257 - DNA, 528 bp, Homo sapiens
  misc_feature: GYAE6OF01B42PJ.29.35.D02.1.454.CMB.1.raw
  modified_base (205)..(205): a, c, t, g, unknown or other
  misc_feature (205)..(205): n is a, c, g, or t
  modified_base (238)..(238): a, c, t, g, unknown or other
  misc_feature (238)..(238): n is a, c, g, or t
  modified_base (317)..(317): a, c, t, g, unknown or other
  misc_feature (317)..(317): n is a, c, g, or t
  modified_base (362)..(362): a, c, t, g, unknown or other
  misc_feature (362)..(362): n is a, c, g, or t
  modified_base (486)..(486): a, c, t, g, unknown or other
  misc_feature (486)..(486): n is a, c, g, or t
tcagatagagtactcacgaccggtgctcgatttagcacacgataggttgggtttgggggaggaactgctcagttaggacccagacggaaccatggaagccccagctcagcttctcttcctcctgctactctggctcccagataccagcggagagattgtgttgacacagtctccagccaccctgtctttgtctccgggagaaagngcccaccctctcctgcagggcccagtcagagtnttaacaactacttggccctggttaccaacagaaacctggccaggcctcccaggcctcctcatctatgatgcatccaacngggccactggcatcccagccaggttcagtgcagtggtctgggacngactcgactctcacatcgagccgctacgcgcctagaggtacttctcgtcgtttattagttgttcgttgggtcgtagcaacgtcggcctcccgtctacgtttcggcgtacgggaccagcgtgagntacgagacgagtcgtgtcgtgcctactatcctctctctaccg

SEQ ID NO: 277258 - DNA, 567 bp, Homo sapiens
  misc_feature: GYAE6OF01BUCV9.29.35.D02.1.454.CMB.1.raw
  modified_base (199)..(199): a, c, t, g, unknown or other
  misc_feature (199)..(199): n is a, c, g, or t
  modified_base (308)..(308): a, c, t, g, unknown or other
  misc_feature (308)..(308): n is a, c, g, or t
tcagatagagtactcacgaccggtgctcgatttagcacacgatagttgggtttgggggaggaactgctcagttaggacccagacggaaccatggaagccccagctcagcttctcttcctcctgctactctggctcccagataccagcggagagattgtgttgacacagtctccagccaccctgtctttgtctccggganaaagagccaccctctcctgcagggccagtcagagtgttaacaactacttggccttggttccaacagaaacctggccaggctcccgaggcctcctcatctatgatgctancccaacgacggggccacgtggccatccccagccgaggttcaggtcggcgaggtcggggtctagggacagtaccttcactctccacatcacgccgcctaggcgtctagaggtacttcgtcgttccgttttatttattggttcgttggcgttagactacgtcggtccctccgttcgtacgtttcggaccggacgggaccaagcgtggagctacgagaccgtagtggtcgcgtacgacctactactcgttgttcctcgtacc

SEQ ID NO: 277259 - DNA, 778 bp, Homo sapiens
  misc_feature: GYAE6OF01DOR92.29.35.D02.1.454.CMB.1.raw
tcagatagagtactcacgaccggtgctcgatttagcacacgatagttgggtttggggaggaactgctcagttaggacccagacggaaccatggaacgccccagctcagcttctcttcctcctgctactctggctcccagataccagcggagagtatttgtgttgacacagtctccagcccaccctgttctttgtcgtaccgggaagaaagcgcccaccctctcctgcagggccagtcaagagttacgttaaacaacttacgttggccttggttaccaaacgacgaaaaccgttcggaccaaggcctacccgaggccttacctcactctactgatcgacactaccaacgacgggaccacgtacggacaaccgtcccgacgtaccgtaggtttaccgaggtacggacgtagggtacggggtcgtacggggaactaacggtacctttaccaaccttccgtaacctaacccacgttaccgaccggtaccccgtaccgtaacggaaccggtccgtagggtacggttacttacgttaccggtttaccgtttttaagtttacgttttacgttcgggtttacgggtaccggttaacgtacgtaaccggttccggtcccgtttacccgttacgtttaccggttttacgggaacccggtacggggtaacccgaacggtacggtaggtaacggtacgtaacgtaacggtaaccgtaagttacggttacggtaccgttacggacctacccgttaacgttaccgtttacgtttcccgtttcgttaacccgg

SEQ ID NO: 277260 - DNA, 682 bp, Homo sapiens
  misc_feature: GYAE6OF01CD2R8.29.35.D02.1.454.CMB.1.raw
  modified_base (198)..(198): a, c, t, g, unknown or other
  misc_feature (198)..(198): n is a, c, g, or t
  modified_base (260)..(260): a, c, t, g, unknown or other
  misc_feature (260)..(260): n is a, c, g, or t
tcagatagagtactcacgaccggtgctcgatttagcacacgatagttgggtttggggaggaactgctcagttaggacccagacggaaccatggaagccccagctcagcttctcttcctcctgctactctggctcccagataccagcggagagattgtgttgacacagtctccagccaccctgtctttgtctccggganaaagacgccaccctctcctgcagggccagtcagagtgtaacaactacttggcctggtccaanagaacctggcagctccagctcctcatctatgatgcataccaacgcgggccacgtggcactcccagccaggttcaggtggcgtaggtcgggtcgtggggactaggtacctttcgaactttctacctaaccgacttccgaacgtccctacccgtaaggaccgaccgttagggacggttaatttcgttacgttaccgtttttactttaagtttcggtttcgtttacggggtaccgttaacggtccgtaaacgttcgggtccccgtttccccggttccgttaacccggttttcgggaccccgttaaccgggggaacccgtaacggacccgttaggggaacgtaccgttacgaacggaaccggtaacgtcgggttacgggtcctacggaccctaccgacttccgttcggttcctttccgttaacccg

SEQ ID NO: 277261 - DNA, 538 bp, Homo sapiens
  misc_feature: GYAE6OF01A2MN1.29.35.D02.1.454.CMB.1.raw
  modified_base (204)..(204): a, c, t, g, unknown or other
  misc_feature (204)..(204): n is a, c, g, or t
  modified_base (312)..(312): a, c, t, g, unknown or other
  misc_feature (312)..(312): n is a, c, g, or t
tcagatagagtactcacgaccggtgctcgatttagcacacgatagttgggtttggggaggaactgctcagttaggacccagacggaaccatggaagccccagctcagcttctcttcctcctgctactctggctcccagataccagcggagagattgtgttgacacagtctccagccaccctgtctttgtctccgggagaaaagngccaccctctcctgcagggccagtcagagtgttaacaactacttggcctggttccaacagaaacctggccaggctcccaggctcctcatctatgatgcatccaaacgngggccagtggcatcccagccaggttcagtggcagtgggtctgggacagtacttcactctcaccatcacgccgcctagacgcctgacggtattctgtccgtttattacgtttgtcgttgggtcgtagcaacgtcggcccttcccgtctacgttttcggaccgtacggggaccgagcgtggagtagtacacgtacgaacgtggtcggctgcactatctcttcttctac

SEQ ID NO: 277262 - DNA, 631 bp, Homo sapiens
  misc_feature: GYAE6OF01CK48I.29.35.D02.1.454.CMB.1.raw
  modified_base (263)..(263): a, c, t, g, unknown or other
  misc_feature (263)..(263): n is a, c, g, or t
tcagatagagtactcacgaccggtgctcgatttagcacacgatagttgggtttgggggaggaactgctcagttaggacccagacggaaccatggaagccccagctcagcttctcttcctcctgctactctggctcccagataccagcggagagattgtgttgacacagtctccagccaccctgtctttgtctccgggagaaagagccaccctctcctgcagggccagtcagagtgttaacaactacttggcctggttaccaanacgaaacctggaccaggcctcccgaggcctcctcatctatgatgactataccaacgacggccctaactcgggcactccccgacgccgtacggttcaggtcggacgagggttcggggtctagggggactacggtacctttcacttcctaccgacccatccacgcccgtacctacgacgcctggtaggtacttacgtcgtccgttttattacgtttgttccgttgggtccgttacggctaaccgtcggtaccccgttcccgttcgttaccgttttcggaccggtacgggtaaccacggcgtaggagtacgtcgaacggtacgtaagttcggtcggtctcgtaccaccctactcttcgttccgttctaccg

SEQ ID NO: 277263 - DNA, 638 bp, Homo sapiens
  misc_feature: GYAE6OF01B6RWV.29.35.D02.1.454.CMB.1.raw
  modified_base (199)..(199): a, c, t, g, unknown or other
  misc_feature (199)..(199): n is a, c, g, or t
  modified_base (292)..(292): a, c, t, g, unknown or other
  misc_feature (292)..(292): n is a, c, g, or t
tcagatagagtactcacgaccggtgctcgatttagcacacgatagttgggtttgggggaggaactgctcagttaggacccagacggaaccatggaagccccagctcagcttctcttcctcctgctactctggctcccagataccagcggagagattgtgttgacacagtctccagccaccctgtctttgtctccggganaaagcgccaccctctcctgcagggccagtcagagtgtaacaactacttggcctggttccaacagaacctggccaggctcccgaggtcctcctnactctatcgatgacactcccaaacgcggtccactggccactcccagcctaggttcaggtcgcgtaggtcgggtcgtaggggactaacggtacttccgactccgtacaccagtccacgtacccgtctaggaccgcgtacgacggtacttcgtaggttccgtttatttagtttcgttcgtttcgggtacgttacgacgtaacgttccggtcccgttacccgttacctacgggttttccggaccgtacggggtaaccctacggtcgtacggtacgacgtcgaacggtacgtaacgttggtcggtaccgtcgtaaccctacgtacttcgttcgtttcctaccgttacccg

SEQ ID NO: 277264 - DNA, 671 bp, Homo sapiens
  misc_feature: GYAE6OF01EJB9R.29.35.D02.1.454.CMB.1.raw
tcagatagagtactcacgaccggtgctcgatttagcacacgatagttgggtttgggggaggaactgctcagttaggacccagacggaaccatggaagccccagctcagcttctcttcctcctgctactctggctcccagataccagcggagagattgtgttgacacagtctccagcccacccttgtcttttgtcgtccgggaagaaacgcgcccaccctctcctgcgagggccagtcagtagtgttaaacactacgttggccttggtaccaacagaaacctggccaggcctcccgaggcctcctcatctatgatgcactaccaacgacgggccacgtcggacactcccgacgtccgtaggttcgaggtcggcgtagggtggggtactcggggactacggtaccttccgacctccgtaccaacctactccgacgcccgtaccgtacgacgccgtaggtagtacgttcgttcgttaccgttttatttcgtttcgttcggtttgggtacgtagtactacgtcggtcccgttcccgttcgttaccgtttcggaccggtacgggaccgtacggtcgtacggacgtacgtaccgaacggtaaccggttaacgttcggttcgggtaccgtaccggacccgttaccctacgttaccgtttcgttcccgttcgttacccg

SEQ ID NO: 277265 - DNA, 814 bp, Homo sapiens
  misc_feature: GYAE6OF01D278Y.29.35.D02.1.454.CMB.1.raw
tcagatagagtactcacgaccggtgctcgatttagcacacgatagttgggtttgggggaggaactgctcagttaggacccagacggaaccatggaagccccagctcagcttctcttcctcctgctactctggctcccagataccagcggagagattgtgttgacacagtctccagcccacccttgtctttgtctaccgggagaaagcgccaccctctcctgcagggccagtcagtagtagttaaaccaacgttacgttcggccttacgggttacccaaaacgaacggaaacccgtcggacccgtaacggccctccccgaaggtcctccctacctaattccgtaatcggaatcgacctactaccgaacggacgggcccacgtcggaccacgtacccgacggtaccgtaggttccgaaggttggaccgtagggttcgggtacgtacggggaacctaacggtaccttacgtaccttaccgtacccaaccgtacttaccgaccggtaccccgtaccgtacggaccgtccgtaggacggttacttacgttcgtttacccgttttagtttacgtttcggttcggttacggggtaccttacggtaccgttaaccggttccggtacccctttacccggttaccgtttaccgggttttcccgggacccgggtaaaccggggtaacccgtaagggtaccgtaggggtaaaccgtacgtaaccgtaaaccgggtaaccggttaacggttcggtacgggtaccttaccgggtaccctaacccgttacgtttacccgtttacggtttaccctttccgttaacccccg

SEQ ID NO: 277266 - DNA, 703 bp, Homo sapiens
  misc_feature: GYAE6OF01B131R.29.35.D02.1.454.CMB.1.raw
  modified_base (198)..(198): a, c, t, g, unknown or other
  misc_feature (198)..(198): n is a, c, g, or t
  modified_base (263)..(263): a, c, t, g, unknown or other
  misc_feature (263)..(263): n is a, c, g, or t
tcagatagagtactcacgaccggtgctcgatttagcacacgatagttgggtttggggaggaactgctcagttaggacccagacggaaccatggaagccccagctcagcttctcttcctcctgctactctggcctcccagataccagcggagagattgtgttgacacagtctccagccaccctgtctttgctccggganaaagcgccaccctctcctgcagggccagtcagagtgttaacaacttcttggccttggttaccaanacgaaacctggccaggcctcccgaggtcctcctcatctaagtgatgctacaccaacgcgggccacgtggaccaactccccaaggccgtaggttcaggtcggctagggtgggtcctaggggacacgtactttacgacttaccacaacctacgtaccgaccgcccgaccgttaaggcggtaccctagggaacggttactttccgttacgggtttaccgttttaatttacgtttcggtttccgggtttagggtaccgttaacggtaccttaaccgggttcccggttccccgttacccggttttacgttaaccgggtttttccggggaacccggaacgggggtaaccctaaggtccgtagggtaacgactaccggaaaggtaccgtaacgttcggtcgggtcctacgtacccgtactacgttccgttcgttccttaccgttccc

SEQ ID NO: 277267 - DNA, 644 bp, Homo sapiens
  misc_feature: GYAE6OF01EWOCY.29.35.D02.1.454.CMB.1.raw
tcagatagagtactcacgaccggtgctcgatttagcacacgatagttgggtttggggaggaactgctcagttaggacccagacggaaccatggaagccccagctcagcttctcttcctcctgctactctggctcccagataccagcggagagattgtgttgacacagtctccagccaccctgtctttgtctcgggagaaagcgccaccctctcctgcagggccagtcagagtgttaaacactacttggccttggtccaaacagaaacctggccaggcctcccgaggcctcctcatctatgatgcactccaacgacgggccacgtcggacactcccgagccgtaggttcaggtcggactagggtcgggtacgtaggggaactaggtaccttacgacctcctaccacctatccgacgcccgtaccgtacgacgtccgtaggacgtacttcgtcgttaccgttttatttacgtttcgttcggttcgggtacgtacgaccgtaacgtccggtcccttcccgttacgttaccggtttcggaccggtacgggaacctaggtcgtaggacgtacgtaccgaaggtaccgtaacgtcggtcggacctcggtacccgtaaccgtacttaccgttcgtttccttccgttacccg

SEQ ID NO: 277268 - DNA, 668 bp, Homo sapiens
  misc_feature: GYAE6OF01CFBJY.29.35.D02.1.454.CMB.1.raw
  modified_base (199)..(199): a, c, t, g, unknown or other
  misc_feature (199)..(199): n is a, c, g, or t
tcagatagagtactcacgaccggtgctcgatttagcacacgatagttgggtttggggaggaactgctcagttaggacccagacggaaccatggaagccccagctcagcttctcttcctcctgctactctggctcccagatacccagcggagagattgtgttgacacagtctccagccaccctgtctttgtctccggganaaagagccaccctctcctgcagggccagtcagtagtagttaaccaactacgttggccttggttccaaacacgaaacctggaccaggcctccaggctcctacatctatgatgacataccgaaacgacgggcccaacgtggaccaacgttacccccgaggtaccccgtaagggttccaaggggttcggaccgtaaggttcgggggttccgtaggggaactacggtactttcccgacttcccgtacaaccctataccgacgccgacctacgacgcgtggagtacttctacgttccgtttaagttagtttcgtcgttgggtcgtacgactaaccggttcgtacccgttcccgttacgttaccgttttacggacccgtaggggaacccagtccgtagggtaacgagttaccgaaggtaccgtaagtcgggtcgtcgacgtacctacctacgttcttcgttccgttgttaccccg

SEQ ID NO: 277269 - DNA, 743 bp, Homo sapiens
  misc_feature: GYAE6OF01CD7W3.29.35.D02.1.454.CMB.1.raw
  modified_base (258)..(258): a, c, t, g, unknown or other
  misc_feature (258)..(258): n is a, c, g, or t
tcagatagagtactcacgaccggtgctcgatttagcacacgatagttgggtttggggaggaactgctcagttaggacccagacggaaccatggaagccccagctcagcttctcttcctcctgctactctggctcccagataccagcggagagattgtgttgacacagtctccagccaccctgtctttgtctccgggagaaagagccaccctctcctgcagggccagtcagagtgtaacactacttggcctggtccaanagaacctggccaggcctcccaggcctcctcatctatgatgcataccaacgagggccacgtcggccactccccgagcctagggttcaggttcggacgtagggttcggggtcgtaggggaacctaacggtacctttccgaacctttccgtacctaacccgtacttcccgacggcccgtacccgtaacggtacggtacccgttagggtacggtaacgtttccgttacggttacccgtttttagtttacgtttcggtttaccggtttcggggtaccggtttaacggtaccgttaaccggttccgggtccccgtttccccggttaccgttaccggtttttccgggacccgggtaacgggggtaaccgtaacgggtccggtacgggtaacggtacgtaccggtaacggtaaccggtaacggttacgggtcgggtccgttacggacccgtaaccgtacgttaccgtttacggtttcccgttaccgttacccg

SEQ ID NO: 277270 - DNA, 638 bp, Homo sapiens
  misc_feature: GYAE6OF01E05K8.29.35.D02.1.454.CMB.1.raw
tcagatagagtactcacgaccggtgctcgatttagcacacgatagttgggtttggggaggaactgctcagttaggacccagacggaaccatggaagccccagctcagcttctcttcctcctgctactctggctcccagataccagcggagagattgtgttgacacagtctccagccacctgtctttgtctccgggagaaagcgccaccctctcctgcagggccagtcagagtgttaacactacgttggcctggttccaacagaaacctggccaggcctcccgaggcctcctcatctatgatcgcactaccaacgcgggccacgtggacactcccgagtccgtaagggttcaaggtggccgtaagggtcgggtcgtaggggactaggtaccttcgaacctcctaccaacctactaccgacgtcccgaccgtacggcgtccgtaggtaggtacttcgtcgttacgttttattagtttcggttcgttgggcgttacgacctacgtcggtccttcccgtcgttacgtttcggaccggtacggggaacccgtacggtcgtagggtaacgtacgtacgtaacggaaccgtaacgttggtcggcgtcggacctaaccctacttaccgttacgttccttctacccg

SEQ ID NO: 277271 - DNA, 763 bp, Homo sapiens
  misc_feature: GYAE6OF01BDV6X.29.35.D02.1.454.CMB.1.raw
  modified_base (204)..(204): a, c, t, g, unknown or other
  misc_feature (204)..(204): n is a, c, g, or t
tcagatagagtactcacgaccggtgctcgatttagcacacgatagttgggtttgggggaggaactgctcagttaggacccagacggaaccatggaagccccagctcagcttctcttcctcctgctactctggctcccagataccagcggagagattgtgttgacacagtctccagccaccctgtctttgtctccgggagaaagngccaccctctcctgcagggccagtcagagtgttaacaactacttggcctggttccaacagaaacctggccaggcctcccaggcctcctcatctatgatgcactacccgaagacgggcccacgtcggccaacgttcccccgagcccgtaacgggtttccaggttcggactacggggttcgggggttcctacggggggaaccctaacggttacccgtttaccgtaaaccgttcccgttacccaaaccccgtaacgtttacccgaaccgggtacccccggtacccgttaaaccgggtaaccgggtaccccgttaagggtaacgggtaactttccggttacggtttacccgttttaagttttaacgttttcggttaccggttttcggggacgttacgtaccgtaaccgttacggtccccgttacccggtcttacccgttttcgggacccgtaggggacccctaggtccgtagggacgtacgtacggaacgtaaccggtaaccgtggttaccggccgttaggaccctaccgttacttaccgttacgttcccgttaccttacccg

SEQ ID NO: 277272 - DNA, 646 bp, Homo sapiens
  misc_feature: GYAE6OF01BNWN7.29.35.D02.1.454.CMB.1.raw
  modified_base (200)..(200): a, c, t, g, unknown or other
  misc_feature (200)..(200): n is a, c, g, or t
  modified_base (263)..(263): a, c, t, g, unknown or other
  misc_feature (263)..(263): n is a, c, g, or t
  modified_base (402)..(402): a, c, t, g, unknown or other
  misc_feature (402)..(402): n is a, c, g, or t
tcagatagagtactcacgaccggtgctcgatttagcacacgatagttgggtttgggggaggaactgctcagttaggacccagacggaaccatggaagccccagctcagcttctcttcctcctgctactctggcctcccagataccagcggagagattgtgttgacacagtctccagccaccctgtctttgtctccggganaaagcgccaccctctcctgcagggccagtcagagtgttaaacactacttggcctggtaccaanagaaacctggccaggcctccgaggctcctcatctatgatgcatccaagacggccacgtcgactactcccgagcctaaggttccaggtcgacgtaggtcgggtcgtagggacaggtaccttacgaccttcctacaacctntccgacgtcccgacgtacgacgcgtagtacgtacttcgtacggttaccgttttattacgtttcggtcggtttacgggacttacggaccttaaccggtccggttaccccgttcccgttaccgttaccggttttccgggaccggtaacgggtacccgtaacgtcggtacggagtacgttacggaacgtaccgtaagtcggttcggccttacgaccttaccgacttccgtacgttcgtcgttacccg

SEQ ID NO: 277273 - DNA, 733 bp, Homo sapiens
  misc_feature: GYAE6OF01CPN0Z.29.35.D02.1.454.CMB.1.raw
  modified_base (270)..(270): a, c, t, g, unknown or other
  misc_feature (270)..(270): n is a, c, g, or t
  modified_base (298)..(298): a, c, t, g, unknown or other
  misc_feature (298)..(298): n is a, c, g, or t
tcagatagagtactcacgaccggtgctcgatttagcacacgatagttgggtttgggggaggaactgctcagttaggacccagacggaaccatggaagccccagctcagcttctcttcctcctgctactctggctcccagataccagcggagagattgtgttgacacagtctccagccaccctgttcctttgtcgtccgggaagaaaagacgccacccctctcctgccgagggccagtcagagttagtaacactacgtggctggtaccaanagaacctgccaggcctccgagcctcctnagtctatgatgccataccgaaacgacgggacccacgtgacctaacctaccccgagtaccgtaacggttcgaacggttcggaaccggtagggttcgggggtacgtacggggaaaccgaacgttaccgttccaccgtttcaaccaaccgaataccgaccgtacccgccgttaacgacggtccgtacggtaaggtacttacgttccgttaccgtttttaattacgtttagttcgttagggtaccgttacggtacctaacgttccggtcccgttacccgttaccgttaaccggttttccggaacccgggttaaccgggaaccgaacggtcggtacgggtaaacgtacgtaacggtaacggtaaacggtaccgtaggttaccggtaccgttacgaccgtaccgtaactttacccggttacttcccgttacgttaaccccg

SEQ ID NO: 277274 - DNA, 553 bp, Homo sapiens
  misc_feature: GYAE6OF01B4FIU.29.35.D02.1.454.CMB.1.raw
  modified_base (199)..(199): a, c, t, g, unknown or other
  misc_feature (199)..(199): n is a, c, g, or t
  modified_base (204)..(204): a, c, t, g, unknown or other
  misc_feature (204)..(204): n is a, c, g, or t
tcagatagagtactcacgaccggtgctcgatttagcacacgatagttgggtttgggggaggaactgctcagttaggacccagacggaaccatggaagccccagctcagcttctcttcctcctgctactctggctcccagataccagcggagagattgtgttgacacagtctccagccaccctgtctttgtctccggganaaagngccaccctctcctgcagggccagtcagagtagttaacaactacttggcctggttaccaacgagaaacctggccaggctcccaggcctcctcatctatgatgcactccaacgacgggccacgtcggcactaccccgagccgtaggttcaggtcgcgaggtcggggtctggggactagacctttcactctcaccatcacgcccgactacgacgctgagtacttctgtcgtttattattgttcgtggcgtacgctaacgtcgtacccttcccgtctacgtttcggacgtacgggaaccacgcgtggagcgtacgagacgtagtggtcgcgtgctacactctcgtctcgtacc

SEQ ID NO: 277275 - DNA, 633 bp, Homo sapiens
  misc_feature: GYAE6OF01CO31T.29.35.D02.1.454.CMB.1.raw
  modified_base (150)..(150): a, c, t, g, unknown or other
  misc_feature (150)..(150): n is a, c, g, or t
  modified_base (196)..(196): a, c, t, g, unknown or other
  misc_feature (196)..(196): n is a, c, g, or t
  modified_base (203)..(203): a, c, t, g, unknown or other
  misc_feature (203)..(203): n is a, c, g, or t
  modified_base (210)..(210): a, c, t, g, unknown or other
  misc_feature (210)..(210): n is a, c, g, or t
  modified_base (255)..(255): a, c, t, g, unknown or other
  misc_feature (255)..(255): n is a, c, g, or t
  modified_base (277)..(277): a, c, t, g, unknown or other
  misc_feature (277)..(277): n is a, c, g, or t
tcagatagagtactcacgaccggtgctcgatttagcacacgatagttgggtttgggggaggaactgctcagttaggacccagacggaaccatggaagccccagctcagcttctcttcctcctgctactctggctccagataccagcgganagattgtgttgacacagtctccagccacctgtctttgcctcggganaaagtcnccacctntcctgcgaggccagtcagagtgtaacactacttgcctgtaccaanagaacctggcagctcagctctnatcatgatgcatccaagcggccagtgacactccgagcctaggttcaggtggacaggttgggctagggactagtacttcgactctacgaccagtcacgtccgacgttagacgccttagaggtacttcgtacgttacgttttaattacgtttcggtcgttcggggacttacggacgtaaacccgtcgggtcccgttacccggtcgtttaaccggttttcgggacccggtaacggggtaaccccgtaaacgggtccggttaacggaacggtaaccgttacgaaacggaccggttaaacccggtggtcgggccttacgaccgtaacccgaactttcgttcggttcccttacggttaaccc

SEQ ID NO: 277276 - DNA, 545 bp, Homo sapiens
  misc_feature: GYAE6OF01DRPO8.29.35.D02.1.454.CMB.1.raw
  modified_base (255)..(255): a, c, t, g, unknown or other
  misc_feature (255)..(255): n is a, c, g, or t
  modified_base (276)..(276): a, c, t, g, unknown or other
  misc_feature (276)..(276): n is a, c, g, or t
  modified_base (370)..(370): a, c, t, g, unknown or other
  misc_feature (370)..(370): n is a, c, g, or t
tcagatagagtactcacgaccggtgctcgatttagcacacgatagttgggtttgggggaggaactgctcagttaggacccagacggaaccatggaagccccagctcagcttctcttcctcctgctactctggctcccagataccagcggagagattgtgttgacacagtctccagccacctgtctttgtctcgggagaaagagccaccctctcctgcagggccagtcagagtgtaacactacttgcctgtccaanagaactgccagctccagctcncatctatgatcgcactccaacgacgggccacgtggacactcccagccaggttcaggtggcgaggtcgggtctgggacagtacttcactctcacntcagccgactagacgcgtagacgtacttctcgtccgtttattagttcgtcgttggcgtacgctaacgtcggtacctccgtctacgtttcggccgtacgggaccgagtcgtaggagactacgagacgtaagtggtcggacgtacgacctaccacttccgttacgttcgttctaccg

SEQ ID NO: 277277 - DNA, 741 bp, Homo sapiens
  misc_feature: GYAE6OF01CRSI2.29.35.D02.1.454.CMB.1.raw
  modified_base (265)..(265): a, c, t, g, unknown or other
  misc_feature (265)..(265): n is a, c, g, or t
tcagatagagtactcacgaccggtgctcgatttagcacacgatagttgggtttgggggaggaactgctcagttaggacccagacggaaccatggaagccccagctcagcttctcttcctcctgctactctggctcccagataccagcggagagattgtgttgacacagtctccagccaccctgtctttgtctccgggagaaagacgccaccctctcctgcagggccagtcagagtgttaaacacttacttggcctggttaccaanacgaaaccgtggccaggcctacccgaggcctcctacatctatgatcgcactaccgaaacgacgggcccacgtcggacctaacgtccccgagacccgtaggttcgaggttcggacgtagggttcggggtacgtaggggaacctaggtacctttccgaaccttcctacccgaaccctaacgtcccgacgtacccgtacccgtacggaccgtccgtagggtaacggttacgtttacgttacggttacccggtttttatttacgttttcggtttcggtttacggggtaccgttacgtaccgtaaccgttccgggttccccgttcccggttaccgttaccggtttttccgggacccggtaacggggtaacccgtacggtaccggtacgggtaacgtaacgtaccgtaacgggtaaaccgtaacggttcggtacggcgtacgaccgtaccgtacgttcgtttaccgttccttccgttacccg

SEQ ID NO: 277278 - DNA, 256 bp, Homo sapiens; identical to SEQ ID NO: 276990
  misc_feature: GYAE6OF01ASYZA.29.35.D02.1.454.CMB.1.raw
  modified_base (256)..(256): a, c, t, g, unknown or other
  misc_feature (256)..(256): n is a, c, g, or t

SEQ ID NO: 277279 - DNA, 606 bp, Homo sapiens
  misc_feature: GYAE6OF01A73IV.29.35.D02.1.454.CMB.1.raw
  modified_base (202)..(202): a, c, t, g, unknown or other
  misc_feature (202)..(202): n is a, c, g, or t
  modified_base (211)..(211): a, c, t, g, unknown or other
  misc_feature (211)..(211): n is a, c, g, or t
  modified_base (259)..(259): a, c, t, g, unknown or other
  misc_feature (259)..(259): n is a, c, g, or t
  modified_base (476)..(476): a, c, t, g, unknown or other
  misc_feature (476)..(476): n is a, c, g, or t
tcagatagagtactcacgaccggtgctcgatttagcacacgatagttgggtttgggggaggaactgctcagttaggacccagacggaaccatggaagccccagctcagcttctcttcctcctgctactctggctcccagataccagcggagagattgtgttgacacagtctccagccaccctgtctttgctccgggagaaangccaccctntcctgcaggccagtcagagtgttaacaactacttggcctggtccaaanagaaacctggaccaggcctccaggctcctcatctaatgatcgcatccaacaggccatcggcatccccaggccaggttcaggtgcgtagtgggctgggactaaggtaccttcaccgtctacgaacctagtccaacgccgacctagacgccgtgacggtattcgtgtaccgttttattattcggtcgttgggacgtagctaacgtcggtccttcccgtnttaaccggtttcggacccggtacgggacccgaaggtcccgtagggtactaacgtaccgaacggtaccggtaaacgttgggtaccggtaccgtacgaccgtaaccgtactcgtttacgtcgttacgtaccc

SEQ ID NO: 277280 - DNA, 591 bp, Homo sapiens
  misc_feature: GYAE6OF01B7LEH.29.35.D02.1.454.CMB.1.raw
  modified_base (198)..(198): a, c, t, g, unknown or other
  misc_feature (198)..(198): n is a, c, g, or t
  modified_base (203)..(203): a, c, t, g, unknown or other
  misc_feature (203)..(203): n is a, c, g, or t
  modified_base (258)..(258): a, c, t, g, unknown or other
  misc_feature (258)..(258): n is a, c, g, or t
tcagatagagtactcacgaccggtgctcgatttagcacacgatagttggggtttgggggaggaactgctcagttaggacccagacggaaccatggaagccccagctcagcttctcttcctcctgctactctggctcccagataccagcggagagattgtgttgacacagtctccagccacctgtctttgtctcggganaaagngccacctctcctgcagggccagtcagagtgttaacactcttggcctggttccaanagaaacctggccaggctcccaggctcctcatctatgatgcatccaacgcgggccagtggcactcccagcctaggttcaggtcggctagggttgggtactggggaactacggaacttcgacttctaccacctactcgacgcccgccgtagacgtcctagacggtacttcgtcgttcgtttattacgtttgttcgttgggtcgtacgtacctaaccgtcggtcccttacccggtcgttacgttttacgggaccgtacgggaccgacggtcgtaggtaacgactacgagtaccggtactcggtcggctcgacctactacttctcgttctcgtaccg

SEQ ID NO: 277281 - DNA, 713 bp, Homo sapiens
  misc_feature: GYAE6OF01E3VLQ.29.35.D02.1.454.CMB.1.raw
  modified_base (697)..(697): a, c, t, g, unknown or other
  misc_feature (697)..(697): n is a, c, g, or t
tcagatagagtactcacgaccggtgctcgatttagcacacgatagttgggtttggggaggaactgctcagttaggacccagacggaaccatggaagccccagctcagcttctcttcctcctgctactctggctcccagataccagcggagagattgtgttgacacagtctccagccctacctgtctttgtctccgggaagaaacgcgcccaccctctccgtgccgagggccagtcagtagttacgttaaacaacttcgtcggccttcggttaccaaacaacgaaaccgtggaccacggcctcccgaggtcctcctacattcctagtgactcgcctaacgtacccaacggacgggccctacgtcggacctaccgtccccgaggtcccgtaagggttccgagggttacggcgtagggttcggggtaccgtaggggaacctacggtaccttcgaccttccgtaccaaccgtcgtaccgaccggtacccgtaccgtacggtaccgtccggttaggtaacggttacctttcgtcggtttaccggttttatttcgttggtttcggtcggtacgtacgtaccgtacgttccggtcccgttcccgttcgtttacggtttcggaccggtaacgggtaccgtaacggtcgtaggacgtacgaccgtacggtaacgtacggtcggtcggctcgacctaccgtacgttnttcgttctcgttcccg

SEQ ID NO: 277282 - DNA, 580 bp, Homo sapiens
  misc_feature: GYAE6OF01BA8P8.29.35.D02.1.454.CMB.1.raw
  modified_base (199)..(199): a, c, t, g, unknown or other
  misc_feature (199)..(199): n is a, c, g, or t
  modified_base (204)..(204): a, c, t, g, unknown or other
  misc_feature (204)..(204): n is a, c, g, or t
tcagatagagtactcacgaccggtgctcgatttagcacacgatagttgggtttgggggaggaactgctcagttaggacccagacggaaccatggaagccccagctcagcttctcttcctcctgctactctggctcccagataccagcggagagattgtgttgacacagtctccagccaccctgtctttgtctccggganaaagngccaccctctcctgcagggccagtccagagtgtaacaactacttggcctggttccaacagaaacctgccaggctcccaggctcctcactctatgatgcatccaacagggccactggcacgtccccagccaggttcaggtcggccaggtcggggtcgttggggacacggtacttcactctcgaaccactccgacgcccgcctaagacgtccgtagtacggattccgttaggtaccgtttatttacgtttgttccgtttgggtcgtagtctaacgtgcccgtcccgttctacgttttcggccgtacggggaccacggcgtggacgtataccgaggtaccgtaacgtggtgcgtgctaccactctcgtcttccgtaccg

SEQ ID NO: 277283 - DNA, 745 bp, Homo sapiens
  misc_feature: GYAE6OF01EN7FX.29.35.D02.1.454.CMB.1.raw
tcagatagagtactcacgaccggtgctcgatttagcacacgatagttgggtttggggaggaactgctcagttaggacccagacggaaccatggaagccccagctcagcttctcttcctcctgctactctggctcccagataccagcggagagattgtgttgacacagtctccagccacctgtctttgtctccgggagaaagcgcccaccctctcctgcagggccagtcagagtagttaacaactacttggccttggttaccaacacgaaaccgtggaccacggcctcccgaggtcctcctcactctatgatcgactactaccaacgcgggccacgtcggcactcccagtcctaggttcaggtggactagggtcgggtacgtggggaacacggtacttcacctcgtacaacctataccgacgcccgtacgtacgacgtccgtaggtacgtacgttcgttacggttaccgttttagtttacgtttcggttcggtttacgggtacggttacggtaccgtaaccggttccggtaccccgttaccccggttacgtttacccgggtttttacgggaacccgggttaacggggtaacccgtaacggtaccgggttagggtaacggtacgttaaccggtaacgggtaaacccggttaacggttacgggttacgggtacccgttaccggaacccgtaacccgttaacgtttacccgttttcccggttttacccgtttacccgtttaacccccgg

SEQ ID NO: 277284 - DNA, 642 bp, Homo sapiens
  misc_feature: GYAE6OF01A8G3A.29.35.D02.1.454.CMB.1.raw
  modified_base (290)..(290): a, c, t, g, unknown or other
  misc_feature (290)..(290): n is a, c, g, or t
tcagatagagtactcacgaccggtgctcgatttagcacacgatagttgggtttggggaggaactgctcagttaggacccagacggaaccatggaagccccagctcagcttctcttcctcctgctactctggctcccagataccagcggagagattgtgttgacacagtctccagccaccctgtctttgtctccgggagaaagagccaccctctcctgcagggccagtcagagtgttaacaactacttggcctggttccaacagaaacctggccaggctcccaggctcctnatctatgatgcatacccaacgacgggcccacgtcggcactccccagccaggttcaggtcggctaggtgggtcgtgggacagtacttcactctacaccatcgacgccgccgtagacgtccgtaggacggacttccgtgtacccgttttatttacgtttcgttcgttgggccgttacgtctaaccgttcgggtcccttccccggttccgttacgttttccgggaccggtaaccggggacctacggtccgtagggtacgtacgtaccggaacggtaaccggttaaacgttcgggtcgggtaccgtacggacccgtaacccgtacgttacccgttcgttccgtttccgtaaccccg

SEQ ID NO: 277285 - DNA, 756 bp, Homo sapiens
  misc_feature: GYAE6OF01DH945.29.35.D02.1.454.CMB.1.raw
tcagatagagtactcacgaccggtgctcgatttagcacacgatagttgggtttgggggaggaactgctcagttaggacccagacggaaccatggaagccccagctcagcttctcttcctcctgctactctggctccagataccagcggagagtattgtgttgacacagtctccagccacctgtctttgtcgtcgggagaaagacgccaccctctcctgcgacgggccagtcagtagttacgtaacaacttacgttcggccttggttaccaacgacgtaaaccgtggaccaggcctccgacggtcctcctactactctatgattcgactacgtaccgaacggacggacctacgtcggacctaaccgtacccgacggtaccgttacgggttacgacggttcggtacgtacggggttacggggttcggtacggggtaacacggtacctttacgacctttcctaacgacctacgtaccgacggtacccgtaccgtacggtaccgtaccgttacgggtaacggttacgtttaccggtttacggtttaccgtttttaagtttacgtttcgggtttacgtttacgggtacgttacgtaaccgtaccggttcggtcccgtttacccgtttaccgttaccgggttttacggaacccgggtacgggtaaccgtacggtaccggtaggtaacggtactacggtaacggtaacgtaacgtgggtccgtacgtacacccgtactacgttacgttcgttcttcgtacccg

SEQ ID NO: 277286 - DNA, 732 bp, Homo sapiens
  misc_feature: GYAE6OF01C7EJG.29.35.D02.1.454.CMB.1.raw
  modified_base (204)..(204): a, c, t, g, unknown or other
  misc_feature (204)..(204): n is a, c, g, or t
  modified_base (694)..(694): a, c, t, g, unknown or other
  misc_feature (694)..(694): n is a, c, g, or t
tcagatagagtactcacgaccggtgctcgatttagcacacgatagttggggtttgggggaggaactgctcagttaggacccagacggaaccatggaagccccagctcagcttctcttcctcctgctactctggctcccagataccagcggagagattgtgttgacacagtcctccagcccacccttgtctttgtctccgggaanaaacgcgccaccctctcctgcagggccagtcagtagtgttaacaacttcgtggccttggttaccaaacacgaaaccgtcggacccgaggcctaccgacggtccttcctactactctagtcgtaatcgacactaccgaaacgacgggacctacgtcggacctaccgtaccccgacggtccgtaggttacgacgggttcggacgtaggggttcgggtacgtacggggaactacggtaccctttacgacccttacctaccgtaacctactaccggaaccgtcccgtaacctagggaccgtaccggtaggtacggtttacttcgttacggttttaccgttttatttacgtttcggttacggttcgggtaccttacggaccgttaacggtcccgggttaccttcccggttaccgttaccggtttaccgggacccggaggggtaaccctaggtcgttacgggactacgtacgaacggtacgaccgttggacggtcncggtacctacgtacgttccgttacgtccttcgttaccg

SEQ ID NO: 277287 - DNA, 822 bp, Homo sapiens
  misc_feature: GYAE6OF01AR3CN.29.35.D02.1.454.CMB.1.raw
tcagatagagtactcacgaccggtgctcgatttagcacacgatagttgggtttggggggaactgctcagttaggacccagacggaaccatggaagccccagctcagcttctcttcctcctgctactctggctcccagataccagcggagagattgtgttgacacagtctccagccaccctgttctttgtccgtccgggaagaaagacgcccaccctctcctgcgacgggccagtcagagttagtaaaccaacttacgttcggtccgttcggttaccaaacgaacgaaacccgtcgggaccgaacggtccctacccgacgggcccttaccgtacacttacctagtgtaatcggactacctacccgaaacggaccgggaccctaacgtcggacctaaccgtacccgacggtacccgtacggttacgacggtggaccgtagggttcgggtcgtagggaactacggtacttaccgtaccgtcgtacccaaccgtacgtaccgaccggtacccgtccgttaacggaccgtaccggtacgggtacggttacgtttccgttacggtttaccgtttttaacgttttagtttcggttttacgggttaccggggtacgttaccggtaccgtaaccggttcccgggttccccgttcccggtttaccgtttaccggttttaccggggacccgggtaaccggggtaaccgtaacgggtaccgttagggacgtaacgtacggtaacggtaaccggtacgttcgggtacggtccgttaccgacccgtaaccgttacgttaccgttactttacccttccgttacccgtttaccccccg

SEQ ID NO: 277288 - DNA, 612 bp, Homo sapiens
  misc_feature: GYAE6OF01ARKL9.29.35.D02.1.454.CMB.1.raw
  modified_base (198)..(198): a, c, t, g, unknown or other
  misc_feature (198)..(198): n is a, c, g, or t
  modified_base (289)..(289): a, c, t, g, unknown or other
  misc_feature (289)..(289): n is a, c, g, or t
  modified_base (358)..(358): a, c, t, g, unknown or other
  misc_feature (358)..(358): n is a, c, g, or t
tcagatagagtactcacgaccggtgctcgatttagcacacgatagttgggtttggggaggaactgctcagttaggacccagacggaaccatggaagccccagctcagcttctcttcctcctgctactctggctcccagataccagcggagagattgtgttgacacagtctccagccaccctgtctttgtctccggganaaagagccaccctctcctgcagggccagtcagagtgttaacaactacttggcctggttccaacagaaacctggccaggctccaggctcctnatctatgatgcatccaacgagggccactggcatcccaagccaggttcagtggctagtgggtctgggacngacttcactctcaccatcagccgcctagacgctggagtacttcgtgtaccgtttattacgtttgtcgtttcgggcgttagactaaccgttcgggtacccttcccggttacgtaccgtttttcgggacccggtacgggggtaaccctaacggtccgttacgggacgtacgtaccgaacggtaccgtaaacggttgggtacgggtcccgttacgaccctaacccgtactttccgttcggttccctttcgtaacccg

SEQ ID NO: 277289 - DNA, 863 bp, Homo sapiens
  misc_feature: GYAE6OF01AIO30.29.35.D02.1.454.CMB.1.raw
tcagatagagtactcacgaccggtgctcgatttagcacacgatagttgggtttggggaggaactgctcagttaggacccagacggaaccatggaagccccagctcagcttctcttcctcctgctactctggctcccagataccagcggagagattgtgttgacacagtctccagccaccctgtctttgtctccgggagaaacgcgcccaccctctcctggccaggggccagtcgaggagttacgtaaccaacgttacgtcggtaccgttcggtaaccaacgaacgtaaccgtcggaccgaccggtacctcccggaggtcccttaccgtactactttacctagtacgacgttcgactaacctaccgaaacggtccgggaacctcggtacggacctacccgtaccccgacggtaccggtttacggttacgtacggggtcggtacggtaggggtttccggggtacggtacggggtaacaaccggtttccgtaccgtaacccgtttcccgtaaccctaacgtaccgttacccgggaccggtaccccggttaaccggtaaccgggaaccgttcccgggtaaacgggtacccggtttacgtttaccgggttaccggtttttaccgttttaacggtttttaccgtttcggggtttaccgggtttacggggtaccggttaaccggttaaccgtacccgggtttacccgttccccggtttacccggttaccgtttaccgggtttcccgggacgggtaccgggtaaccgtacggtcggtacggtacgtaccgtaccggaacggtaaccggtaggtcggttcggtccgtacgacccgtaacttacccgtgtttcccgttcttcccgtttacccg

SEQ ID NO: 277290 - DNA, 710 bp, Homo sapiens
  misc_feature: GYAE6OF01CLPP2.29.35.D02.1.454.CMB.1.raw
tcagatagagtactcacgaccggtgctcgatttagcacacgatagttggggtttggggaggaactgctcagttaggacccagacggaaccatggaaaccccagctcagcttctcttcctcctgcttactctggctcccagataccagcggagagattgtgttgacacagtctccagccacccttgtctttgctccgggaagaaacgcgcccaccctctccgtgcgacgggccagtcagagttcgttaaacacttcgtggcctggttaccaacaggaacctggaccaggtcctccgaggtcctcctacacttctatcgactgacctactacccgaacggacggcccaacgtcggaccacgtcccaagtccgtaaggttcgaggtcggactagggtcgggttacgacgggaactacggttaaccttcgaccttacgtaccgactacgtacgacggcccgtaccgtacggacgtaccgtaggtacggtacgtttcgtacggttaccgttttagttacgtttcggttcggtttacgggtacgttacgtaccgtacgtccgtccgttcccgttacgttaccgtttaccggggaccgtacggggaacctaaggtcgtacgggtacgtacgtacgaacggtaaccggtaacgttcgggtacggtcgtacgacccgtacttccttaccgttaggtttacccttcgtccgtttaccccg

SEQ ID NO: 277291 - DNA, 868 bp, Homo sapiens
  misc_feature: GYAE6OF01AHBX8.29.35.D02.1.454.CMB.1.raw
  modified_base (222)..(222): a, c, t, g, unknown or other
  misc_feature (222)..(222): n is a, c, g, or t
tcagatagagtactcacgaccggtgctcgatttagcacacgatagttgggtttgggggaggaactgctcagttaggacccagacggaaccatggaagccccagctcagccttctcttcctcctgctactctggccccctagataccacgcggagagtattgtgttgacacagtctcctacgcctaccctcgttctttcgtacgtccgggtaaggaaagtacncccgaccccttcttcccgtgccgagggccctagtcgaaggtacgttagtttaaaccgaaccttaccgttggacccgttcgggttaaccaaaccaaacggtaaaacccttccgggaccgtaacgggtccccttaacccccgacgggacccttcccgttcctaagtactaaccgttgaacgttcgacccaattaccccgaaacccgtaggggtcccgaatccgggtacctaaaccctccccaacgggtcccgtaccgggtttaacgtaacggtcggggaactacggggtttcgggggtacgttccggggaaactaaggttaccccttactacccggttaccttacccgaaccgaaactttccccgaacggggtcccgtacccgttaaccggacgttaccggtacggtacggttaaaccgtttccgttaccgttaaccggttttacgttaacgttttcgttacggttcgggtacggttacgtaccgacggttccgttacccggttccccgttgttaaccggttttcggtaaccggtaccggggtaaccgtaacgtcgaacggttgaaccttagtaccggtaacgtacgggttaggtacgccggtacttaccggacgttccgttgttaccttcgttccgtccgttacccc

SEQ ID NO: 277292 - DNA, 906 bp, Homo sapiens
  misc_feature: GYAE6OF01D31OU.29.35.D02.1.454.CMB.1.raw
  modified_base (211)..(211): a, c, t, g, unknown or other
  misc_feature (211)..(211): n is a, c, g, or t
tcagatagagtactcacgaccggtgctcgatttagcacacgatagttgggtttgggggaggaactgctcagttaggacccagacggaaccatggaagccccagctcagcttctcttcctcctgctactctggcctcccagatacccaggcggagagtattgtgttgacacagtcctccagcccacccttgttctttgaccgtccggggaanaaacgcgcccaccctctcctgcgacgggccagtcaggtagttagttaaaccacttacgttcggtaccttaggttaaccaaacgaacggtaaacccgtcggacccgaagggtcccctacccggaacggtcccttaccctactaagttccttaagtacgtagtcgaacctaacgtaaccccgaacggtaccgggaccctaaccgggtcggaccctaaacccttccccggtaacggtacccggttacgggtttaccgaaggggttccgggacgttaacgggggtttcgggtaccgggtacggggtaaaccggtaacgttacccggtttacctaccgttacccgttaccgtaaacccgtacgttacccggaacccggtaccccggtaaccgtaacgggtaaccgttacccggtaacgggtaacggtttacctttaccggtttaccgggttttaaacccgttttaagttttaccggtttacgggttcgggttttaccgggtaccggtttaacggtacccgttaacggttcccgggtaccccgtttcccgggttaccgtttacccgggttttaccgggacccgggtaacggggtaacccgtaggtaccggtaagggacgtacgtaacggtaaccgtacggtaccggtggtccgaccgtacgtacccgtacgttactaccgtttcgttcctccgttaccccg

SEQ ID NO: 277293 - DNA, 856 bp, Homo sapiens
  misc_feature: GYAE6OF01B9TP1.29.35.D02.1.454.CMB.1.raw
  modified_base (153)..(153): a, c, t, g, unknown or other
  misc_feature (153)..(153): n is a, c, g, or t
tcagatagagtactcacgaccggtgctcgatttagcacacgataggttgggtttgggggaggaactgctcagttaggacccagacggaaccatggaagccccagctcagcttctcttcctcctgctactctggctcccagataccaggcgganagtatttgtgtgacacacgtctccagccctacctgttctttgtcctccgggaaggaaacgcgcccaccctcctcctgcgacgggccacgtacagtagttagttaactacgttaccgttggcccttgggttacccaacgaacgaaaacccgttcggacccgacggccctaccccgtacggccttaccctacgtacttacgttagtgacgttacgacctacgtacccgaaaacggccggggaccctaacggtcggacctacgtacccccgaaggccccgttaagggtttccaagggttcgggacgttacggggttcgggtaccgtaggggaccgtaacgtacctttccgtaccttcccgtaccaccgtaccgtaccgaccggtcccgtaccgttacggtacggtacccgtaacggtacggtacgttttcgttacggttaccgttttaacgttttacggttacggtttaccggtttacgggtaccgttaccggtaaccggtaccggttccggtcccgtttaccccggttaccgtttaccggttttccgggaacccgggttaaccggggtaacccgtacgggtaccgggttacgggaacgttacggtaccggtaaacgggtaaccggtaacgggttgggttaccggtaccgttacgacccgttaacccgtacgtttacccggttcgtttcccgtttaccttacccgg

SEQ ID NO: 277294 - DNA, 618 bp, Homo sapiens
  misc_feature: GYAE6OF01EIH8S.29.35.D02.1.454.CMB.1.raw
  modified_base (312)..(312): a, c, t, g, unknown or other
  misc_feature (312)..(312): n is a, c, g, or t
tcagatagagtactcacgaccggtgctcgatttagcacacgatagttgggtttggggaggaactgctcagttaggacccagacggaaccatggaagccccagctcagcttctcttcctcctgctactctggctcccagataccagcggagagattgtgttgacacagtctccagcccaccctgtctttgtctccgggagaaagagccaccctctcctgcagggccagtcagagtgttaacaactacttggcctggttaccaacagaaacctggccaggcctcccaggctcctcatctatgatgcatccaacngggccactggcatcccagccaggttcagtggcaggtgggtctgggacagacttcactctcaaccatcacgccgcctagacgccgttaggaaggtacttctcgtacccgttttatttagtttgttcgtttggggtaccggttacgtcaacgttcgggtacccttccccggttaccgtaccgtttttcgggacccggtacgggggaaccctaaggtccggttaggacggtactacggaacggaaccggtaaacgttcggtcgggacgtcggaccgtacccgaattaccgttcggttccttcttacccg

SEQ ID NO: 277295 - DNA, 724 bp, Homo sapiens
  misc_feature: GYAE6OF01C4HHZ.29.35.D02.1.454.CMB.1.raw
  modified_base (216)..(216): a, c, t, g, unknown or other
  misc_feature (216)..(216): n is a, c, g, or t
  modified_base (227)..(227): a, c, t, g, unknown or other
  misc_feature (227)..(227): n is a, c, g, or t
tcagatagagtactcacgaccggtgctcgatttagcacacgatagttgggtttgggggaggaactgctcagttaggacccagacggaaccatggaagccccagctcagcttctcttcctcctgctactctggcctccagataccagcggagagtattgtgttgaacacgagtcctccacgcccaccgttgttctttgccgtacgggaagaaacgcnccacctctcgngcgagggccagtcagtagttacgtaacaacttacgtcggccgttagtaccaaacgaacgaaaccgtggaccacggtcctaccgacggtcctacctactacttctaagtcggatcgacctaactaccaaacggacggcctaacgtcggacaccgtccccgagtaccgtaggttaccaggtcggcgtaagggtcgggtctagggactacgtacttccgactcctaccaacgtataccggacaccggtacctaaggaccgtccgaggtaacggttactttcggtacgtttaaccggtttttattaggtttcggttacggttcggggtaccttacggtactaacccgggttccggtacccctttaccggggtacgtttaaccggtttccggaaccggggaagggtaccccgtaaggtccggttaagggacgtaaaccgtacggaacgtaaaccggtagtcgggtcgacttacgacctactacgtcttcgttactcggtacc

SEQ ID NO: 277296 - DNA, 652 bp, Homo sapiens
  misc_feature: GYAE6OF01C85CD.29.35.D02.1.454.CMB.1.raw
  modified_base (198)..(198): a, c, t, g, unknown or other
  misc_feature (198)..(198): n is a, c, g, or t
  modified_base (211)..(211): a, c, t, g, unknown or other
  misc_feature (211)..(211): n is a, c, g, or t
  modified_base (215)..(215): a, c, t, g, unknown or other
  misc_feature (215)..(215): n is a, c, g, or t
  modified_base (264)..(264): a, c, t, g, unknown or other
  misc_feature (264)..(264): n is a, c, g, or t
  modified_base (309)..(309): a, c, t, g, unknown or other
  misc_feature (309)..(309): n is a, c, g, or t
tcagatagagtactcacgaccggtgctcgatttagcacacgatagttgggtttggggaggaactgctcagttaggacccagacggaaccatggaagccccagctcagcttctcttcctcctgctactctggctcccagataccagcggagagtattgtgttgacacagtctccagccaccctgtctttgtctcggganaaagcgccacctntccngcagggccagtcagagttacgtaacacttactggccttaggtaccaaanacggtaaaccctgggcctaggcctaccgaggtcctcctacacttntaactggaattcggcctaactcccaaaacggcgggaccaactggacctaacgtccccgagaccgtaggttcaggttcggactagggttcggtacgtggggaacctaggtacctttacgcctttacacacctaatcgaccgccacgtagacgcgtagacgtacttcgtacgttccgttttattacgtttcgtcggtttacggacgttacgacgtaccgtcgtcccttaccgtccgttacgtttcggaccgtacgggtaccgacgtgacggtagaacgtacggacgtaacgtaacgtggtacggtactgtacccgtactacttacgtacgtttccttcgttaccc

SEQ ID NO: 277297 - DNA, 669 bp, Homo sapiens
  misc_feature: GYAE6OF01AMC6V.29.35.D02.1.454.CMB.1.raw
tcagatagagtactcacgaccggtgctcgatttagcacacgatagttgggtttgggggaggaactgctcagttaggacccagacggaaccatggaagccccagctcagcttctcttcctcctgctactctggctcccagataccagcggagagattgtgttgacacagtctccagccaccctgtctttgtctccgggagaaagagccaccctctcctgcagggccagtcagagtgttaacaactacttggcctggttccaacagaaacctggccaggctcccaggctcctcatctatgatgcatccaacagggccacgtggcactcccagtccaggttcaggtggcgaggtgggtctggggacaggtacttcactctcaccactcacgcccgcctagacgcctggaggtactttcgtcgttaccgttttatttagtttcggttccgtttggggtaccgttagccctaacgttcgggtcccctttaccccggtcttaccggtttttccgggacccggtaacggggggtaacccctaagggtccgttaggggaacgtaccgttacggaaacgggtaaccggtaaaccggttcgggtcggggtacccgttacggtaacccgtaacccgttacgtttacccggttccgttttaccgtttcccgttaaaccccg

SEQ ID NO: 277298 - DNA, 597 bp, Homo sapiens
  misc_feature: GYAE6OF01BDGFN.29.35.D02.1.454.CMB.1.raw
  modified_base (199)..(199): a, c, t, g, unknown or other
  misc_feature (199)..(199): n is a, c, g, or t
  modified_base (275)..(275): a, c, t, g, unknown or other
  misc_feature (275)..(275): n is a, c, g, or t
tcagatagagtactcacgaccggtgctcgatttagcacacgatagttgggtttgggggaggaactgctcagttaggacccagacggaaccatggaagccccagctcagcttctcttcctcctgctactctggctcccagataccagcggagagattgtgttgacacagtctccagccacctgtctttgtcgtccggganaaaagcgcccaccctctcctgcgagggccagtcagtagtacgttaaacacgttacgttggccttggttacccaaanacggaaaaccctggaccaagggtcctacccgaggtcctcctcattctatgatcgcactaccaacgacgggcctaacgtggacactcccgagtccgtaggttccaggtcggactagggtggtcgtagggacacgtacttcacgtctacactatcacgccgacgtagacgtcctgacgtatcgtacgttacgtttattacgttgttcgttggtcgtagctaacgtcgcctccgtctacgttcggaccgtacgggactagcgtaggatacgacgaggacgtagtcggtcggactacgactacgacttacgtcgttcttctacccg

SEQ ID NO: 277299 - DNA, 862 bp, Homo sapiens
  misc_feature: GYAE6OF01B8VYK.29.35.D02.1.454.CMB.1.raw
  modified_base (231)..(231): a, c, t, g, unknown or other
  misc_feature (231)..(231): n is a, c, g, or t
tcagatagagtactcacgaccggtgctcgatttagcacacgatagttgggtttgggggaggaactgctcagttaggacccagacggaaccatggaagccccagctcagcttctcttcctcctgctactctggctccagataccagcggagagattgtgttgaacacacgtcctccagccctacccttgttcctttggtccgtaccgggaagaaagacgcccaccctctccngcagggccagtcagtagtattaaccaacttcgttcggccttggttacccaaacgaacgtaaacccgtgggaccctaggccctacccgaggtcctacccttactattctaatgaatccgactaactaccgaaacggcgggccctaacgtcgggcctaacctccccgaaggtcccttaagggtttcgaaggttcggacggtagggttcggggtaccggttaaggaccgtaacggtcccttacacccttcccgtaaccacccgtaaagtcccgaaccggcccgtaccgtaacgggtaccgtacgttacggtaaccggttacgtttaccgttaccggtttaccgttttacgttttacgtttccgggtttacggtttacggggtacggttacggtaccgttaaccggttccgggttacccccgttaccccggtttacccgttaaccgggtttttccgggaaccccgggttaaccggggtaacccggttaacggtaccggttaaccgggtaacgggtaacgttaaccgggtaaccggaaccggggttaaaccgttcgggttcccgggtaccggtaccgtacccgttaaccgttaccggttacccgtttacccgttcccgtttaacccgtttaccccg

SEQ ID NO: 277300 - DNA, 638 bp, Homo sapiens
  misc_feature: GYAE6OF01ANPWR.29.35.D02.1.454.CMB.1.raw
  modified_base (298)..(298): a, c, t, g, unknown or other
  misc_feature (298)..(298): n is a, c, g, or t
tcagatagagtactcacgaccggtgctcgatttagcacacgatagttgggtttgggggaggaactgctcagttaggacccagacggaaccatggaagccccagctcagcttctcttcctcctgctactctggctcccagataccagcggagagattgtgttgacacagtctccagccaccctgtctttgtctccgggagaaagacgccaccctctcctgcagggccagtcagagtgtaacaactacgtcggcctggttaccaatagaaacctggccaggctccaggctcctcatctangatgcactccaacgcgggaccacgtcggcactccagcctaggttcaggtggcaggtgggtctagggactacggtacttcactccgtcaccgtatccgacgccgtaccgtagaccgtcctggtaacggtacttcctcggtttacccgttttaagttgtttacggttcgttcgggtacgtcgtacgtaaccgttcggcccttccgtccgttacgtttcggaccgtacgggtaaccgaggtccgtaggacgtacgtacgaacggtaccggtaagttcgggtcggtaccgttacggtacccgtaacgttacgtttccgtaccggtttcttacccgttaaccccg

SEQ ID NO: 277301 - DNA, 794 bp, Homo sapiens
  misc_feature: GYAE6OF01DIVSE.29.35.D02.1.454.CMB.1.raw
  modified_base (214)..(214): a, c, t, g, unknown or other
  misc_feature (214)..(214): n is a, c, g, or t
tcagatagagtactcacgaccggtgctcgatttagcacacgatagttgggtttgggggaggaactgctcagttaggacccagacggaaccatggaagccccagctcagcttctcttcctcctgctactctggcctccagataccagcggagagtattgtgttgaacacagtctccagccacctgtcttgctcggagaaagcgccaccgtctccngcgagggccagtcgagtagtagttaacaacgttcgttcggaccgttggttaccaaacgacgaaacctcgggaccacgggcctcccgacggccttccctacacttaccttaagtcgtaagtcgacctaactacccgaaaccgaccggggaccctacgtacgggactaaccgtccccgaacgccggttaacggtttcgacggtacggtaccgagggttcgggtcggtacggggaactacggtaactttccacgttcctactaaccctacgtaccgaccgtacccgtaacccgtacggtaaccgtccggttacgtaacgggttacgttttaccgtacgggttttaccggttttaacgttttacgttttacggttaccggttttacggggtaccggttaccggttaccgtaaccgttaccgggttcccccgttacccggtttaccgttacccgggttttacggacccggtaacggggtaacccgtaacggtcgtacgggtaacgtacgtaaccgaacggtaacggtaacgtcggtcgtcgtaccgtacctaaccgttactaccgttcgttccttagttaccccg

SEQ ID NO: 277302 - DNA, 636 bp, Homo sapiens
  misc_feature: GYAE6OF01B53DW.29.35.D02.1.454.CMB.1.raw
  modified_base (224)..(224): a, c, t, g, unknown or other
  misc_feature (224)..(224): n is a, c, g, or t
  modified_base (319)..(319): a, c, t, g, unknown or other
  misc_feature (319)..(319): n is a, c, g, or t
tcagatagagtactcacgaccggtgctcgatttagcacacgatagttgggtttggggagaactgctcagttaggacccagacggaaccatggaagccccagctcagccttctctttcctcctgctactctggctcccagataccagcggagagatttgtgttgaaccacagttctccagccctaccttgttctttgctccgggagtaaagcgccaccctctccngcagggccagtcagagtgttaacactcttggccttggttaccaatacgaaacctcggccaggctcccaggcctctcatctatgatgcatccaacncgggccactggcatcccagccagttcagtgcaggtggctgggacaggacttcactctacaccatcacgccgcctagacgtccgtgacggattcttcgtccgttttattagtttcgttcgtttgggtacgttagtaccgtaaacgtcgggtcccttaccccggttacgttaccgttttttaccgggacccgtaacgggggtaacccgaaacggtccgttacgggaacgtacgttacgaaacggtaaccgtaaaggttcggtacgggtccgttacgggacctacctaacgtttcgttacgttccgtttcccttaacccg

SEQ ID NO: 277303 - DNA, 877 bp, Homo sapiens
  misc_feature: GYAE6OF01BGJAA.29.35.D02.1.454.CMB.1.raw
tcagatagagtactcacgaccggtgctcgatttagcacacgatagttgggtttggggaggaactgctcagttaggacccagacggaaccatggaagccccagctcagcttctcttcctcctgctactctggcctcccagataccaggcggagagattgtgttgacacagtcctccagcccacctgtctttgctccgggagaaagcgccaccctctcctgcagggccagtcagagtacgttaaacaacttacgttcggccttaggttaacccaaaacgtaacggtaaaacccgttggacccgaacgggtccctacccgaacgggtccttacccgtactaacgttaccgttaagtcggtaacgttacggaccttaaaccgttaccccgaaaacggtaaccgggggacccctaaacggtcgggaccctaacgttaaccccccgaggtacccccgtaaggggttttccaacgggtcggtaaccgtagggttccgggggtacgtaggggacctacggttaacctttcgacccttactaccaacccgtacgtccgaacggtacccgacgttaacggaccgtacccgtaaggtaacggtacgtttacggtacgtttaccgtttttaacgtttacgtttacggtttccgtttacggggtaacgttaacggtaccgtaaccgttccgggtaccccttaccccgggtttacccttaaccgggtttttaccgggaacccgggtaaccgggggtaacccgtaacgggttaccggtaacgggtaacgttacgtaacccgtaaacgggtaaccggttaaccggttacgggtcggtacccgtacggaacccgttacgtacgtttaccgttacgtttccgttacgttaccccg

SEQ ID NO: 277304 - DNA, 714 bp, Homo sapiens
  misc_feature: GYAE6OF01DWLTV.29.35.D02.1.454.CMB.1.raw
tcagatagagtactcacgaccggtgctcgatttagcacacgatagttgggtttggggaggaactgctcagttaggacccagacggaaccatggaagccccagctcagcttctcttcctcctgctactctggctcccagataccagcggagagattgtgttgacacagtctccagccaccctgtctttgtctccgggagaaagcgcccaccctctcctgcacgggccagtcagagttagtaaacaactacgttggcctggttaccaacacgaaacctggccaggcctacccgaggctcctcatctatgatcgctactaccaacgcgggccacgtggacctactacccgagtacccgtaggttacgacggttcggacgtaggggttcgggtcggtagggaaccgtaacggtaccttacgtaccttccgtacctaaccctacgttccgaaccggtcccggtacccgtaacggaccgtaccgttagggtaacgggttacgtttaccgttacggtttaccggtttttaacttttacggtttcggtttcgggttacgggttacggtacgtaccgtaaccgtccggttcccgttacccgttacgtttaccggttttccggacccggtacgggtaaccgtaacggtcgtacggtagtacgtaacgtacggaacgtacggtggtcggacgtcgaccgtactacgtactcgttccttcgtaccg

SEQ ID NO: 277305 - DNA, 758 bp, Homo sapiens
  misc_feature: GYAE6OF01AJA7L.29.35.D02.1.454.CMB.1.raw
tcagatagagtactcacgaccggtgctcgatttagcacacgatagttgggtttgggggaggaactgctcagttaggacccagacggaaccatggaagccccagctcagcttctcttcctcctgctactctggctcccagataccagcggagagattgtgttgacacagtctccagccaccctgtctttgctccgggagaaagcgccaccctctcctgcagggccagtcagagtagttaaccaactacgttggccttggttacccaacagaaaccctggcccaggcctcccgaggctcctcatctatgatgcactaccaacgacgggcccacgtcggcactccccgagcctaggttcaggtcggcgtagggtcgggtcgtcggggacctacggtaccttaccgacgttccctaccaacccgtacttcccgaacggccccggtaccgttaacggacggtacccgttagggtaacgggttaacgttttccggttacggtttacccggttttttaagttttaaccgtttttcgggtttaccgggttttacggggtacccggtttaacggtacccgtaaacccgggttcccgggtacccccgtttaccccggttccgtttaacccgggtttttccgggacccggtaacgggggtaacccgtaacggtccggtagggacgtacgtacgtaacggtaccggtaacgttgggtcggtccgtacggaccgtaacccgtacttaccgttccgttccgttcttaccccg

SEQ ID NO: 277306 - DNA, 782 bp, Homo sapiens
  misc_feature: GYAE6OF01EETCD.29.35.D02.1.454.CMB.1.raw
  modified_base (199)..(199): a, c, t, g, unknown or other
  misc_feature (199)..(199): n is a, c, g, or t
tcagatagagtactcacgaccggtgctcgatttagcacacgatagttgggtttgggggaggaactgctcagttaggacccagacggaaccatggaagccccagctcagcttctcttcctcctgctactctggctcccagataccagcggagagattgtgttgacacagtctccagccacctgtctttgtcgtccggganaaacgacgccaccgtctcctgccagggcccagtcagtagtcgttaaaccaactacgttggccttggttaccaacacgaaacctggcccaggcctcccgaggcctccgtcatcctatcgaatcgactactaccgaacgcggcccagtcggacactcccagacctagttcacggtcgacgtaggtcgggtcgtagggaactacggtaacctttcaaccttccgaccaacccgtcgtaaccgaccgacccggtacccgttaacggtaaccgtccccgtagggtacggtaaccgtttccgttacggtttacccgttttttaacgtttacgttttacggttaccggttttacggggtaccggttaacgtacccgttaacccgggttcgggttaccccgttccccggttttaacccgtttaccgggtttttaccgggaaccccgggttaacggggaacccggttaaacggtcccggttaaggtaaccggtaacgtaccggtaacgggtaaaccgtaaacggttcggtaccgggtaccgtcggaacccgtaacccttagttcccgtttaccggttccttccgttaacccg

SEQ ID NO: 277307 - DNA, 699 bp, Homo sapiens
  misc_feature: GYAE6OF01ANDUF.29.35.D02.1.454.CMB.1.raw
  modified_base (204)..(204): a, c, t, g, unknown or other
  misc_feature (204)..(204): n is a, c, g, or t
  modified_base (658)..(658): a, c, t, g, unknown or other
  misc_feature (658)..(658): n is a, c, g, or t
tcagatagagtactcacgaccggtgctcgatttagcacacgatagttgggtttgggggaggaacgtgctcagttaggacccagacggaaccatggaagccccagctcagcttctcttcctcctgctactctgcctccagactaccagcggagagattgtgttgacacagtcctaccagcccaccctgtctttgccgtccggganaaagcgcctaccctctcctgccagggccagtcagtagttacgtaaacactacgttggccttggtaccaaactacgaaccgtggaccacggcctcccgacggcctccgtccacgtctacgttacgacttcgaccgtactacccgaacgtaccgggacccacgtcggacctaaccgtccccgaacggtacccgtaacggtttccgaagggtaccggtaccgtacgggttacggggtcgtacggggaacctacggtaccttccgtaccgtactacctaaccgactacgaccgacccgtaccgtacggactccgtaggacggtaaccttcgtagttccgtttaactttagttcgttcgtcgggtacttacgtcctaacgtcggtcccttaccggttccgtacgtttacggaccggtacgacgtacgtcgtcgtacgtactgaacgtacgacgttaggnggtacctagacctacgcgttaccgtcgttccgttgtacccg

SEQ ID NO: 277308 - DNA, 285 bp, Homo sapiens
  misc_feature: GYAE6OF01BEOAN.29.35.D02.1.454.CMB.1.raw
  modified_base (202)..(202): a, c, t, g, unknown or other
  misc_feature (202)..(202): n is a, c, g, or t
  modified_base (226)..(226): a, c, t, g, unknown or other
  misc_feature (226)..(226): n is a, c, g, or t
  modified_base (260)..(285): a, c, t, g, unknown or other
  misc_feature (260)..(285): n is a, c, g, or t
tcagatagagtactcacgaccggtgctcgatttagcacacgatagttgggtttgggacagacttcactctcaccatcagccgcctagagcctgaggattctgccgtttattattgtcttgggcgtagcaactggcctcccgtctacttttggccaaggggaccaagctggagatcagacgactgtgctgcacatctgtctcnttcctccgctatctagtaatactntatcgtgacggcggctggacaagggcacagtagnnnnnnnnnnnnnnnnnnnnnnnnnn

SEQ ID NO: 277309 - DNA, 767 bp, Homo sapiens
  misc_feature: GYAE6OF01BO086.29.35.D02.1.454.CMB.1.raw
  modified_base (373)..(373): a, c, t, g, unknown or other
  misc_feature (373)..(373): n is a, c, g, or t
tcagatagagtactcacgaccggtgctcgatttagcacacgatagttgggtttggggaggaactgctcagttaggacccagacggaaccatggaagcccagctcagcttctcttcctcctgctactctggctccagataccagcggagagattgtgttgacacagtctccagcctacctgtctttgcgtcgggaagaaagcgccacctctctgcgacggccagtcgagagtacgtaacacttactcggcctggttaccaaactacgaaaccgtggccgtaacggcgtcccgaggcctcctactactcgtaatgactgaccactaccaacgtcgggacctacggcggcaaccgtcccgacgccgttacggtacncgggttaggaccgtagggtcgggttaccgtagggggtaccaacggtaccttaccggtaacctcctacctaacccgtaacgttccgaaccggtaccccgtacgttaaacgggccgtaccgttaagtacgggttaatttccgtaacgtttaccggtttatttacggtttcggttaccggtagggtaaccgttacgtacgttaaccggttccggtaaccccgtttccggtaccgtttaaccggggttttcccggaacccgggtaaacggggtaacccctaagggtccgggttaacgtaacgggaccgttaaaccgaacggtaaccgggtaacccgttgggtaccggtaccgtccgtaaccgtacttacggttcccgtcgtttaccttacctacccgg

SEQ ID NO: 277310 - DNA, 623 bp, Homo sapiens
  misc_feature: GYAE6OF01D1DA2.29.35.D02.1.454.CMB.1.raw
  modified_base (201)..(201): a, c, t, g, unknown or other
  misc_feature (201)..(201): n is a, c, g, or t
  modified_base (379)..(379): a, c, t, g, unknown or other
  misc_feature (379)..(379): n is a, c, g, or t
  modified_base (591)..(591): a, c, t, g, unknown or other
  misc_feature (591)..(591): n is a, c, g, or t
tcagatagagtactcacgaccggtgctcgatttagcacacgatagttgggtttggggggaactgctcagttaggacccagacggaaccatggaagccccagctcagcttctcttcctcctgctactctggctcccagataccagcggagagattgtgttgacacagtctccagccaccctgtctttgtctcgggagaaagngccaccctctcctgcaggccagtcagagtagttaacaactacttggcctggttccaacagaacctggaccaggcctcccaggctcctacatctatgtatgcatacccaacgacgggccacgtcggcactcccagcctaggtcagtggcaggtggtcgtggacagtactcactctcacntacacgccgctagacgtccgtgacgtacgttctcggttacgtttattacgtttggttcgtttggggtccgttacgtacgtaacccgttcggtccctttacccggtaccgttacgttttaccggggaccgtaaccggggtaaccgtaacggtcggtacggtaacgtacgacgtaagtaccggaacgttgggtacggtctcggactaacccgtnttacgttcgttaccttcccgtagtttcccccg

SEQ ID NO: 277311 - DNA, 601 bp, Homo sapiens
  misc_feature: GYAE6OF01DN9A1.29.35.D02.1.454.CMB.1.raw
  modified_base (264)..(264): a, c, t, g, unknown or other
  misc_feature (264)..(264): n is a, c, g, or t
  modified_base (314)..(314): a, c, t, g, unknown or other
  misc_feature (314)..(314): n is a, c, g, or t
tcagatagagtactcacgaccggtgctcgatttagcacacgatagttgggtttggggaggaactgctcagttaggacccagacggaaccatggaagccccagctcagcttctcttcctcctgctactctggctcccagataccagcggagagtattgtgttgacacagtctccagccaccctgtctttgtctcgggagaaagcgccaccctctcctgcagggccagtcagagtagttaaacaactacttggcctggttaccaanagaaacctggccaggcctccaggctcctcatctatgatgcataccaacgngggccagtcggcactccagccagttcagtgcaggtggtctgggacagtctcgactcgtcacatcacgccgactagcgtctggagtattcgtcgttacgttttattagtttgtcgtttgggtcgtacgtactaacgtcggtcccttacccgttcttaccgttttcggacccgtaacggggaacctacggacgtggtaacggacgttacgaacggtaaccgtaaacgttcggtcggtaccgttacgacccgtaacctacgttaccgtttcggttcctttcgttaccccg

SEQ ID NO: 277312 - DNA, 635 bp, Homo sapiens
  misc_feature: GYAE6OF01DI654.29.35.D02.1.454.CMB.1.raw
  modified_base (234)..(234): a, c, t, g, unknown or other
  misc_feature (234)..(234): n is a, c, g, or t
  modified_base (341)..(341): a, c, t, g, unknown or other
  misc_feature (341)..(341): n is a, c, g, or t
tcagatagagtactcacgaccggtgctcgatttagcacacgatagttgggtttggggaggaactgctcagttaggacccagacggaaccatggaagccccagctcagcttctcttcctcctgctactctggctcccagataccagcggagagattgtgttgacacagtctccagcccaccctgtctttgtctccgggagaaagagcccaccctctcctgcgagggccagtcagngtagttaaacaactacttggccttggttaccaaacgagaaacctggccaggcctcccaggctcctcatctatgatcgcactccaacgagggccacgtggcatacccngaccaggttcaggtggccaggtcgggtctgggactaggacttaccacttcctaccaaccgtatccacggcccgcctaagacgccgtaggaggtacttcgtcgtaccgttttattagttgttcgttgggtcgtagctaacgtcggtaccctcccgttcgtacgttttcggaccgtacgggggtaaccacggtcgtagggacgtacgtacgaacggtaaccggtaaagttacggtcgggtaccgttacggtacccgtaacctaacgttaccgtttcgttccgtttcccttaacccg

SEQ ID NO: 277313 - DNA, 891 bp, Homo sapiens
  misc_feature: GYAE6OF01CUNWA.29.35.D02.1.454.CMB.1.raw
tcagatagagtactcacgaccggtgctcgatttagcacacgatagttgggtttggggaggaactgctcagttaggacccagacggaaccatggaagccccagctcagcttctcttcctcctgcttactctggcctcccagataccagcggagagtattgtgttgacacagtcctccagccctacccgtgttcctttgtccgtaccgggaagaaacgacgccccacctctcctgcgacgggcctagtcaaggtcgttagttaaacaacttgtcggccttacggttaccaaagaacggaaccgtggaccacggcctacccgaggtccttccctagaacttcctaagtcgtatcgaccactaccgaaacgaccggggcctacgtcggacctaccgtccccgaaggtcccgtaacggttcgaacggtgggtaccgtaggggtttcgggtaccgtagggaaccctacggttacctttacaaccctttccgacccgaaacgttcccgtaccgacccgtaccccggtaacgttaacgggaccgtccggttaacgggtacggttttaccttaccggtttaccggtttttaccggtttttaaatttccgggttttccgtttacgggtttccggggttacctttaacccgggtaaccgttacccggtttaccccgggttaccccccgttttaacccgggttttaccgtttttacccggggtttacccgggaaccccggggttaacgggggtttaaaacccccgtgggttacccgggtaacgggttaacgttacccgtaaaccgggtaacggtaaaccgggtacggtttcgggtaacggtacccgttaccgttaacgtacccgtttacgtttccgttaacccggtttcctttacccgtcccg

SEQ ID NO: 277314 - DNA, 711 bp, Homo sapiens
  misc_feature: GYAE6OF01BOBB2.29.35.D02.1.454.CMB.1.raw
tcagatagagtactcacgaccggtgctcgatttagcacacgatagttgggtttggggaggaactgctcagttaggacccagacggaaccatggaagccccagctcagcttctcttcctcctgctactctggctcccagataccagcggagagattgtgttgacacagtctccagcccaccctgtctttgtctccgggagaaagacgcccaccctctcctgcagggccagtcagagtgttaaccactacttggccttggtaccaacacgaaacctggccaggcctcccgaggtcctcctcatctatgatgcatacccgaagacgggcccacgtcggcactcccgagcccgtaggttccaggtcggacctagggtcggggttccgtaggggaacctacggtacctttcacccttccgtaccaacccgtaacttccgaaccggcccgtaccctaacggaccggtccttagggaacggttacttcgttacggttacccgttttatttagtttcggttcggtttacgggtacggtacgtaccgtaacggtccggtcccgttacccgttccgttaccggttttacgggacccgggtaaccggggtaaccgacggtacggtagggtaccgtacgtaccgaacggtaccgtaacgttacgggtcgggtcctacggacccgtaactacgtttaccgttccgtttcgttcccgttaacccg

SEQ ID NO: 277315 - DNA, 782 bp, Homo sapiens
  misc_feature: GYAE6OF01BHULK.29.35.D02.1.454.CMB.1.raw
  modified_base (771)..(771): a, c, t, g, unknown or other
  misc_feature (771)..(771): n is a, c, g, or t
tcagatagagtactcacgaccggtgctcgatttagcacacgatagttgggtttggggaggaactgctcagttaggacccagacggaaccatggaagccccagctcagcttctcttcctcctgctactctggctcccagataccagcggagagattgtgttgacacagtctccagccaccctgtctttgtctcgggaagaaagcgccacctctcctgcagggccagtcagtagttagttaaacctaacttacgttcggccgttggttacccaaacgaacgtaaaaccgtcggaccgtaacgggccttacccgaaggcccttcccgtacaactttacctaagttcggacttggacctaacttacccgaaacggacggggaccctacggtacggacctaacgtacccccgtaacggaccccggttaagggtttacccgaacggggttcggaccgggttaacggggtttccgggggggtttaccggttacggggggaaacctaacggggttacccttaccgtaacccgtttcccggttaaccaaaccccgttacttacccgaaccgtaccccggtacccgtaaccggtaacggtcccgtagggtacggtaacgtttccgttacggtttaccgtttagtttagtttcgtttcggttcgggtaccgtagtacgtaaccgtcggtcccttaccgtcgtaccgtttcggaccgtacgggaccacgtcgtaggagtacgtaccgagtaccgtagtcgtggcgtagcgtacctatccgttntcgttctaccg

SEQ ID NO: 277316 - DNA, 652 bp, Homo sapiens
  misc_feature: GYAE6OF01CDDH9.29.35.D02.1.454.CMB.1.raw
  modified_base (198)..(198): a, c, t, g, unknown or other
  misc_feature (198)..(198): n is a, c, g, or t
  modified_base (211)..(211): a, c, t, g, unknown or other
  misc_feature (211)..(211): n is a, c, g, or t
  modified_base (215)..(215): a, c, t, g, unknown or other
  misc_feature (215)..(215): n is a, c, g, or t
  modified_base (260)..(260): a, c, t, g, unknown or other
  misc_feature (260)..(260): n is a, c, g, or t
tcagatagagtactcacgaccggtgctcgatttagcacacgatagttgggtttgggggaggaactgctcagttaggacccagacggaaccatggaagccccagctcagcttctcttcctcctgctactctggctcccagataccagcggagagattgtgttgacacagtctccagccaccctgtcttgtctccggganaaagagccacctntccngcagggccagtcagagtgttaaacaactattggcctggtccaaanagaaacctggccaggctccaggctctcatcgtatgatgcatccaaacgcgggaccacgtggcatccccagcctaggtcagtggcaggtgggtctagggacagacttcgactctcacctatacgacgcccgtctagacgtccgtagaagggtattactacgttccggttttaagtttacgtttacgttcgtttacggggcggttaacggtacctaaaccgtccggtcccgtttaccccgtaccgttaccggtttttacccgggccggtaaacgggggtaacccgtaacgtcggtaacgggttacggacgttaacgaacggtaaccggtaaacttcggggtacggtcccgttaggacccgtacctaacgttcttacggttcttaccgttaaccg

SEQ ID NO: 277317 - DNA, 789 bp, Homo sapiens
  misc_feature: GYAE6OF01AYN8T.29.35.D02.1.454.CMB.1.raw
  modified_base (196)..(196): a, c, t, g, unknown or other
  misc_feature (196)..(196): n is a, c, g, or t
  modified_base (201)..(201): a, c, t, g, unknown or other
  misc_feature (201)..(201): n is a, c, g, or t
  modified_base (264)..(264): a, c, t, g, unknown or other
  misc_feature (264)..(264): n is a, c, g, or t
  modified_base (751)..(751): a, c, t, g, unknown or other
  misc_feature (751)..(751): n is a, c, g, or t
tcagatagagtactcacgaccggtgctcgatttagcacacgatagttgggtttggggaggaactgctcagttaggacccagacggaaccatggaagccccagctcagcttctcttcctcctgctactctggctccagataccagcggagagattgtgttgacacagtctccagccaccctgtctttgctccggganaaagngccacctctcctgcagggccagtcagagtgttaaacaacttacttggcccttggttaccaacngaaaacccttgggaccaagggcctcccgaagggcccttccgtacttactaccgttagtaaccggtgtacgacttaccgaaccgaacggtaccggaccctaacggttcggtaccgtaaccctacccggtaccggtaaccgtttcggttacggttacggtaccggtacgtaacggggtttcccggttacgggtacggtaaacggtaaccgtttaaccgttacgtaccgtttacccgtaaccgtaaccgttacccggttacgacccggttccgaaccgttaacggtaccgtcggtaacgggtaaacgttcgttaccggttaaccggttttacgtttacgtttacgtttaccgttcggttacgggttcgtaccgtaaccgttacggtcccgttaccccggtacgttaccgtttacgggttcccggtacggaacccggttacgaaccgttcggaacgtagtaccgacgtacggtactacggtcggttccggntacggaccgtactcgttcctactttcgaccgttacccg

SEQ ID NO: 277318 - DNA, 594 bp, Homo sapiens
  misc_feature: GYAE6OF01CEW7L.29.35.D02.1.454.CMB.1.raw
  modified_base (261)..(261): a, c, t, g, unknown or other
  misc_feature (261)..(261): n is a, c, g, or t
tcagatagagtactcacgaccggtgctcgatttagcacacgatagttgggtttgggggaggaactgctcagttaggacccagacggaaccatggaagccccagctcagcttctcttcctcctgctactctggctcccagataccagcggagagattgtgttgacacagtctccagccaccctgtctttgtctcgggagaaagagccaccctctcctgcagggccagtcagagtgttaacaactacttggcctggttccaanagaaacctggaccaggcctcccaggctcctcatctatgatgcataccaacgacgggccacgtggcactccccgagcccgaggttccaggtcggctagggtcgggtctggggacaggtactttcaccttcctacaccctagtccaacgcccgacctacggacgtccgtggtacggtacttcgtcgttccgttttaagttagtttcgttcgttgggtacgtagtacgtaacgtcggtcccgttcccgtcctacgttttcggacccgtacggggaccgtagcgtggagatacgagtacgaatggtcggctcgcgactacttcgtcgtcttcgtacg

SEQ ID NO: 277319 - DNA, 673 bp, Homo sapiens
  misc_feature: GYAE6OF01ACXGP.29.35.D02.1.454.CMB.1.raw
  modified_base (197)..(197): a, c, t, g, unknown or other
  misc_feature (197)..(197): n is a, c, g, or t
  modified_base (203)..(203): a, c, t, g, unknown or other
  misc_feature (203)..(203): n is a, c, g, or t
  modified_base (506)..(506): a, c, t, g, unknown or other
  misc_feature (506)..(506): n is a, c, g, or t
tcagatagagtactcacgaccggtgctcgatttagcacacgatagttgggtttggggaggaactgctcagttaggacccagacggaaccatggaagccccagctcagcttctcttcctcctgctactctggctccagataccagcggagagattgtgttgacacagtcctccagccacctgttcttgtcgtcggganaaagcncccacctctccgtgcgcggaccagtcagtacgtcgttaaccaacgttctggcctgttaccaaacgacgtaaaccgtcggaccacggtcctacccgacggtcctccgttacacgttctagtacgtactcgacctacgtacccgaacgcgggtaccacgtacggcactcccgacgacccgtaggtacacggcggtcgtacggtggtccgaggacgtgtaccgttcacctacgtacccacgaccgttcggaaccgtccgaccgttacggcgtacgtcgaacgttacttcggtacgtttaacgtttnttacggttgtacgttcgggactacgtcgtacgtaccgtccttaccgttccgtgtttaccgggccgtaaggacccttagggtcgtcgaagttccgaacggtacgcccggttaagcgggttactccggtacaccgttacctacgtacgttcgtaaccgttcgtacccgg

SEQ ID NO: 277320 - DNA, 780 bp, Homo sapiens
  misc_feature: GYAE6OF01C361K.29.35.D02.1.454.CMB.1.raw
  modified_base (299)..(299): a, c, t, g, unknown or other
  misc_feature (299)..(299): n is a, c, g, or t
tcagatagagtactcacgaccggtgctcgatttagcacacgatagttgggtttgggggaggaactgctcagttaggacccagacggaaccatggaagccccagctcagcttctcttcctcctgctactctggctcccagataccagcggagagattgtgttgacacagtctccagccaccctgttctttgtccgtccgggaagaaacgacgccctacccctctcccgtgccgacggggcccagtcgaggagttacgttaaaccaactacgttggccttggttaccaaagaacgtaaccnggaccaggcctacccgaggcctcctcatctatgatcgacactaccgaaacgacgggccctaaggtcggacctaccgtccccacggtaccgtagggttaccaaggtcggaccgtagggtcggggtacgtagggaacctaggtaccttcaaccttccgtacacccgtagtcccgacgtcccgtaccgtacggtacgccgttaggtaacggttcgttacgttccggtttaccgttttttagtttaacgttttcgggtttacggtttacgggtaccggttaacgtaaccggttaaccgttcccgggttccccgtttaccccggtttaccgtttaaccgggtttttccgggacccggttaaccggggtaacccgtacgggtcggtacgggtaacgtaaccgtacgaaacggtaaccggttacgttacggtcggtccgttaccggaccctaccgttacttccgtttaccttccgtttcccgtacccg

SEQ ID NO: 277321 - DNA, 666 bp, Homo sapiens
  misc_feature: GYAE6OF01EAYFH.29.35.D02.1.454.CMB.1.raw
  modified_base (349)..(349): a, c, t, g, unknown or other
  misc_feature (349)..(349): n is a, c, g, or t
  modified_base (358)..(358): a, c, t, g, unknown or other
  misc_feature (358)..(358): n is a, c, g, or t
  modified_base (376)..(376): a, c, t, g, unknown or other
  misc_feature (376)..(376): n is a, c, g, or t
tcagatagagtactcacgaccggtgctcgatttagcacacgatagttgggtttgggggaggaactgctcagttaggacccagacggaaccatggaagccccagctcagcttctcttcctcctgctactctggctcccagataccagcggagagatttgtgttgacacagtctccagccaccctgtctttgtctccggagaaagagccaccctctcctgcagggccagtcgagagtgttaacaactacttggcctggttccaacagaaacctggccaggctcccaggctcctcatctatgatcgcatccaacgagggccacgtggacactccagccgtagttcagtgacnggtggtcgnggacagtacttcactccncaccatcgacgcgctagacgccgtagacgtacttcgtacgtttacccgttttattagtttcggtcgttcggggtacgtacgttaccctaaccgttccggtacccgtttccccggttaccgtttaccgggtttttaccggggacccgggtaaacgggggaacccgtaaacgggtcggtaacgggtaacggaaacgtacccgaaagggtaaccggtaacggttacgggttacgggacctcggtaacccctaccgttaacgtttcctttacgtttcccgttccgttaaccccg

SEQ ID NO: 277322 - DNA, 586 bp, Homo sapiens
  misc_feature: GYAE6OF01ATH0J.29.35.D02.1.454.CMB.1.raw
  modified_base (199)..(199): a, c, t, g, unknown or other
  misc_feature (199)..(199): n is a, c, g, or t
  modified_base (204)..(204): a, c, t, g, unknown or other
  misc_feature (204)..(204): n is a, c, g, or t
tcagatagagtactcacgaccggtgctcgatttagcacacgatagttgggtttgggggaggaactgctcagttaggacccagacggaaccatggaagccccagctcagcttctcttcctcctgctactctggctcccagataccagcggagagattgtgttgacacagtctccagccaccctgtctttgtctccggganaaagngccaccctctcctgcagggccagtcagagtgttaacaactacttggcctggttccaacagaaacctggccaggctcccaggcctcctcatctatgatgcatccaacgcgggccactggcactcccagccaggtcaggtgcagtgggtctagggacaggtacttcactccgtcaccatcacgccgccgtagacgccgtggacggtacttcgtcgtcccgttttattacgtttgttcgtttgggacgtacgctaacgtcggtcccgttacccggtctaccgttttcgggccgtaacggggtacccacggtcgtacgggagtacgtacgacggacgtaacgttggtcggtacgtcgcctacctacttcgtcgttccgttctaccg

SEQ ID NO: 277323 - DNA, 688 bp, Homo sapiens
  misc_feature: GYAE6OF01B27AJ.29.35.D02.1.454.CMB.1.raw
  modified_base (435)..(435): a, c, t, g, unknown or other
  misc_feature (435)..(435): n is a, c, g, or t
tcagatagagtactcacgaccggtgctcgatttagcacacgatagttgggtttggggaggaactgctcagttaggacccagacggaaccatggaagccccagctcagcttctcttcctcctgctactctggctcccagataccagcggagagattgtgttgacacagtctccagcccacccttgttctttcgtccgtccgggaagaaaacgcgcccaccctctccctgcgacggggccctagtcagtagtacgttaaaccaacttcgttcggcctggttaccaaagacgtaaacctcggcccaagggcctacccgaggacctcctcactctaagtgaactgactactaccaacggcgggaccacgtcgactaccctccgagtccgtaggttcaggtcggacgtagggtcgggtcgtaggggacctagtaccttcncctacgtccacctactcgaccgtccgacctacgcgaccgtaggtacgtacgtttacgtcgtttacgtttactttagttacgttcgttgggtcgtacgtacgtaccgtccgttcccgttccgttaccgttaccgttttaccggaccggtacgggaacctaaggtcggtaggtacggacgtaccgacggtacggtaacggttcggtcgtcgtaccgaccgtaacgtacgttaccttacgttcccgttcttacccg

SEQ ID NO: 277324 - DNA, 829 bp, Homo sapiens
  misc_feature: GYAE6OF01DTTEN.29.35.D02.1.454.CMB.1.raw
tcagatagagtactcacgaccggtgctcgatttagcacacgatagttgggtttggggaggaactgctcagttaggacccagacggaaccatggaagccccagctcagcttctcttcctcctgctactctggctcccagataccagcggagagattgtgttgacacagtctccagccaccctgtctttgtcgtccgggagaaagacgcccacctctcctgcacgggccagtcagtacgtagttaaaccaacttacgttggccgttaggttacccaaacgaacgaaaacccgttcggggacccaacggggcccttaccccgaacgggtccctttaccccgttacctaacttaccgttaacttagggaaacttcggacctaaacttaccccggaaaaccggtaacgggggacccctaacggttacgggaccctaaccgtccccccgaaacggaccccgttaagggtttacccgaagggttcggccgtaaggggttcgggggtaccgttagggggaaacctaacggtaacccgtttacaccgttcctaccgaaacccgttacgtaccgtaccggacccgtaccgtaacgacgtaccgtacggaggttacgttcgtacgttaccgttttagtttagtttggttcggttacgggtacgttacgtacgtaaccgttcggtacccgttccccggttacgtttaccggttttacgggacccgggttaacgggggaaccctaacgggtccggttaggtaacggtacgtacgaacggtaaccgtaacggtacggtacggtctcggacctaccgtacttcgttcgttccgttcgtaacccg

SEQ ID NO: 277325 - DNA, 644 bp, Homo sapiens
  misc_feature: GYAE6OF01AXMJZ.29.35.D02.1.454.CMB.1.raw
  modified_base (203)..(203): a, c, t, g, unknown or other
  misc_feature (203)..(203): n is a, c, g, or t
tcagatagagtactcacgaccggtgctcgatttagcacacgatagttgggtttggggaggaactgctcagttaggacccagacggaaccatggaagccccagctcagcttctcttcctcctgctactctggctcccagataccagcggagagattgtgttgacacagtctccagccaccctgtctttgtctccgggagaaagngccacctctcctgcagggccagtcagagtgttaacaactacttggcctggttccaacagaaacctggccaggctcccaggctcctcatctatgatcgcatccaacgcgggccacgtggcactcccagccaggttcaggtggcaggtcgggtctgggactagacttcacttcctacgaacctatccacgtcccgtacctagacgccgtgacggtacttcgtacgtccgttttattacgtttcgttcgtttcggggtacgttacgacgtaaccgttcggtcccttacccggtaccgttacggttttcgggacccgtaaccggggtaacccgtaacggtccggttacgggaagtacgtacgaacggtaaccggtaaacgttcgggttacgggtaccttcggtacctaacccgtacgttaccttcggttccctttacgtaacccg

SEQ ID NO: 277326 - DNA, 791 bp, Homo sapiens
  misc_feature: GYAE6OF01DRZ6Y.29.35.D02.1.454.CMB.1.raw
tcagatagagtactcacgaccggtgctcgatttagcacacgatagttgggtttgggggaggaactgctcagttaggacccagacggaaccatggaagcccagctcagcttctcttcctcctgctactctggcctccagataccagcggagagattgtagttgacacagtcctccgacgccacccttgttctttgccgtacgggaagaaacgcgccctaccctctccgtcgcgacgggccagtacgagtagttacgttaaacaacttcggttcggtccgtacgggttaaccaaagaacgtaaacccgtcgggacccgaacggcctcccgacggtccctcctactacgtcttaagtcggatcgacctaactaccgaacgacgggaccacggtcggacctaccgtaccacggtaccgtagggttccgtaaggtcgggtacgtaacggggttcggggttaccgacgggggtaactacggttaaccttccgaacttcctaccaaccgtactccgaccgtccgaccgtaacggcgtaccggtagacgttcgtttacgtacgtttaccgttttaagttcgttcggttcggttacgggtacgtacgtacgtacgttcccggtccccgtttacgttaccgttaccggtttacggacccgggtacgggttaaccgacggtaccgtagggtaaacgtaccggtaaccgtaaacggtacgggtaacgttcgggtccggtacccggttacgcccggttaaacctcgttaacccgtttcgggtttaaccccttcggtttaccccg

SEQ ID NO: 277327 - DNA, 567 bp, Homo sapiens
  misc_feature: GYAE6OF01B3HF0.29.35.D02.1.454.CMB.1.raw
  modified_base (205)..(205): a, c, t, g, unknown or other
  misc_feature (205)..(205): n is a, c, g, or t
  modified_base (548)..(548): a, c, t, g, unknown or other
  misc_feature (548)..(548): n is a, c, g, or t
tcagatagagtactcacgaccggtgctcgatttagcacacgatagttgggtttgggggaggaactgctcagttaggacccagacggaaccatggaagccccagctcagcttctcttcctcctgctactctggctcccagataccagcggagagattgtgttgacacagtctccagcccaccctgtctttgtctccgggagaaagngccaccctctcctgcagggccagtcagagtgttaacactacttggcctggtaccaacagaaacctggccaggctcccgaggcctcctcatctatgatgcataccaacgagggccacgtggacactcccagcctaggttccaggtggcaggtcggggtctagggacagtacgttcaacgtctacgaacctatcgacgccgcctacgacgcctgaggtacttctcgtccgtttattagttgtcgttgggacgtagctaacgtcggtaccctcccgtctacgttttcggaccgtacgggtaccagcgtggagactacgacggtacgtaactggtcggctcgctacnctactcgttcttcgtaccg

SEQ ID NO: 277328 - DNA, 609 bp, Homo sapiens
  misc_feature: GYAE6OF01DEJ3M.29.35.D02.1.454.CMB.1.raw
  modified_base (204)..(204): a, c, t, g, unknown or other
  misc_feature (204)..(204): n is a, c, g, or t
  modified_base (262)..(262): a, c, t, g, unknown or other
  misc_feature (262)..(262): n is a, c, g, or t
tcagatagagtactcacgaccggtgctcgatttagcacacgatagttgggtttggggaggaactgctcagttaggacccagacggaaccatggaagccccagctcagcttctcttcctcctgctactctggctcccagataccagcggagagattgtgttgacacagtctccagcccaccctgtctttgtctccgggagaaagngccaccctctcctgcagggccagtcagagtgttaacaactacttggcctggttccaanagaacctggccaggcctccgaggctcctcatctatgatcgcatccaaacgacgggccagtcggcactcccgagcctaggttcagtggcaggtcgggtcgtgggacagactttcgactcacgaacctatcgacgccgacctacggacgtaccgtggaggtacttcgttcgtacgttttattagtttcgttcgttcgggtcgttacggtactaaccgtcggtacccgttcccgttaccgttacgttttacgggcccgtaacggggaaccctaggtaccgtagggtagacgtacgacggaacggtacgtaggtcggactcgacctacctagttcgtcgttcttcgtaccg

SEQ ID NO: 277329 - DNA, 704 bp, Homo sapiens
  misc_feature: GYAE6OF01DPNF3.29.35.D02.1.454.CMB.1.raw
  modified_base (264)..(264): a, c, t, g, unknown or other
  misc_feature (264)..(264): n is a, c, g, or t
  modified_base (314)..(314): a, c, t, g, unknown or other
  misc_feature (314)..(314): n is a, c, g, or t
tcagatagagtactcacgaccggtgctcgatttagcacacgatagttgggtttggggaggaactgctcagttaggacccagacggaaccatggaagccccagctcagcttctcttcctcctgctactctggctccagataccagcggagagattgtgttgacacagtctccagccaccctgtctttgtctaccgggagaaagcgcccaccctctcctgccagggccagtcagagtagttaacaactacttggcctggttccaanagaaacctggccaggcctccaggctcctcatctatgatgcataccaacgngggtcccaactggacacgtccccgagccgtaaggttccaaggtcggtaccagggttcgggtaccgtggggaacctaggtaacctttcgaaccttcctaccaacctaacttccgaacgcccgtacccgtacggacgtcccgtagggtaacggtaacgtttccgttacggttaccgttttactttaacgtttcgtttaccggtttgggtaccggttacggtacgtaaccgttacggtccccttaccccggttcgttaccggtttttacgggacccgtaacgggggtaccctaacggccgttaggacgacgtaccgtaacggtaaccgaacgttacggtcggtaccgtacggtaccctaaccgtacttccgttacgttccgttccgttacccg

SEQ ID NO: 277330 - DNA, 817 bp, Homo sapiens
  misc_feature: GYAE6OF01E1UAV.29.35.D02.1.454.CMB.1.raw
tcagatagagtactcacgaccggtgctcgatttagcacacgatagttgggtttgggggaggaactgctcagttaggacccagacggaaccatggaagccccagctcagcttctcttcctcctgctactctggctcccagataccaggcggagagtattgtgttgacactagtctccagcccacccttgttctttgtccgtccggggaagaaacgacgcccacccttctcctgcgacgggccagtcagagttacgttaaccaacttacgttcggccgttacggttaccaaacgaacgtaaacccgtcgggacccgacgggtcccttaccccgacggtccttaccctactaacttaccgttagttaggacttcggacctaaccgtaaccccgaaacggtacggggccctaacgtcgggaccctaaccgtaccccgacggtacccgttacgggttaccgaggggttacggaccggtagggttacggggtaccgtacggggaactacggtaccttctacgtcctaccacctatccgacgcccgtaccgtagaccggtccgttagggtacgttaccgtttcggttcgtttaacgttttagttcggttcggttacggttacgggacgttaacgtaccgttaccggtcccggttcccgtttaccgttacccggtttacgggttacgggaacccggggttaacggaacgttacggtacggtacgggtaaacgtacggaacggaccgtaaccgggttaagtcgggggtcctaccggttacgacccgttacggtttcttacccggtttcgttaccttccgttacccg

SEQ ID NO: 277331 - DNA, 785 bp, Homo sapiens
  misc_feature: GYAE6OF01DVV1Q.29.35.D02.1.454.CMB.1.raw
tcagatagagtactcacgaccggtgctcgatttagcacacgatagttgggtttgggggaggaactgctcagttaggacccagacggaaccatggaagccccagctcagcttctcttcctcctgctactctggcctccagataccaggcggagagattgtgttgacacagtctccagcccaccttgttctttgtcgtaccgggaagaaacgcgcccaccctctcctagcacgggccagtcaagtacgttagttaaaccaacttacgttcgggcccttaggttacccaaaacgaacggtaaaacccgtcgggacccgaacggtcccgttaccccgacgggtcccttaccccgtactaacttaccgttagtacggtaacgtttcggaacctaacgttaaccccgaaacggtaccggggaccctaccgtacgggaccctaacccgttaccccgacggtacccgtaacgggtttccgaagggttccggtacggtaacggggttcggggtaccgttacggggaactaccggttaacttccgtaccttacctaccacctagtccgacgcccgacgtacgacgtccgtggtaacgtcttcgttcgttaccgttttatttacgttcgttacggttggtacgtacgtacgtaccgtcgtcccttaccgttcgttacggtttcggaccgtacgggtaacgacggtcgtagggactacggtacgaacgggtaccgtaggttggtaccgtccgtaccgtacctaccgttagttccgttacgttacccttcttacccgg

SEQ ID NO: 277332 - DNA, 610 bp, Homo sapiens
  misc_feature: GYAE6OF01DHGEC.29.35.D02.1.454.CMB.1.raw
  modified_base (194)..(194): a, c, t, g, unknown or other
  misc_feature (194)..(194): n is a, c, g, or t
  modified_base (198)..(198): a, c, t, g, unknown or other
  misc_feature (198)..(198): n is a, c, g, or t
  modified_base (250)..(250): a, c, t, g, unknown or other
  misc_feature (250)..(250): n is a, c, g, or t
  modified_base (266)..(266): a, c, t, g, unknown or other
  misc_feature (266)..(266): n is a, c, g, or t
tcagatagagtactcacgaccggtgctcgatttagcacacgatagttgggtttggggggaactgctcagttaggacccagacggaaccatggaagccccagctcagcttctcttcctcctgctactctggctcccagataccagcggagagattgtgttgacacagtctccagccacctgtctttgctcggganaagngccacctctcctgcaggccagtcagatgtaacatactgctgtcaacagaacngccagctccagctctnatctatgatgcatccaagcggccacgtggacactcccgagtccaaggttcaggtcggctagggtcgggtcgagggactaggtacttcaccgtctacaccgatccgacgtcccgactacgcgaccgtaggacgtcttcgttacggttacgtttatttagttcgttcgttgggcgtagtcctaagtccggttccttcccgttacgttaccggttttacgggaccggtaacgggtacccgtaaggtcgtaggagtaacgtaccggacgtaaaccggttaacggttggttacggtaccgtccgacctacccgtaattccgttacgttccttacctccgtttacccccg

SEQ ID NO: 277333 - DNA, 723 bp, Homo sapiens
  misc_feature: GYAE6OF01CI0IF.29.35.D02.1.454.CMB.1.raw
tcagatagagtactcacgaccggtgctcgatttagcacacgatagttgggtttgggggaggaactgctcagttaggacccagacggaaccatggaagccccagctcagcttctcttcctcctgctactctggctcccagataccagcggagagattgtgttgacacagtctccagccaccctgtctttgtcgtccgggagaaagacgccaccctctcctgcgagggccagtcagagtagttaaacaacttacttggcctggttaccaacgaacgaaacctggaccaggcctcccgaggcctcctcatctatgatgcactaccgaacgacgggccacgtggccactcccgagccgtaggttcgacggtggacgtagggtcgggtcgtagggactagtaccttcacttcctacacctatccgacgcccgaccgtacgacgtccgtaggtacggtacttcgttacggttaccgttttagtttacgttttcggttcgttagggttcgttacggtaccgtaacggtaccggttcccgtttaccccggttaccgttaccgggtttttaccgggacccgggtaacgggggtaacccgtaacggtaccggtaggggtaacgtacggtaaccggaacgggtaaaccggttaacggttcgggttacgggtaccgttacggtacccgtaacccgttacttacccggttccgttttcccgtttccgtttaccccg

SEQ ID NO: 277334 - DNA, 690 bp, Homo sapiens
  misc_feature: GYAE6OF01BJAD5.29.35.D02.1.454.CMB.1.raw
  modified_base (200)..(200): a, c, t, g, unknown or other
  misc_feature (200)..(200): n is a, c, g, or t
  modified_base (217)..(217): a, c, t, g, unknown or other
  misc_feature (217)..(217): n is a, c, g, or t
tcagatagagtactcacgaccggtgctcgatttagcacacgatagttgggtttgggggaggaactgctcagttaggacccagacggaaccatggaagccccagctcagcttctcttcctcctgctactctggctcccagatacccagcggagagatttgtgttgacacagtctccagccacctgtctttgtctccggganaaagcgccacctctccngcagggccagtcagagttgttaaaccacttacttggcctggttaccaaacgagaacctggcccaggcctcccgaggctcctcatctatgatgcactccaacgtcgggcctacgtcggacctacgtccccagtccgtaggttccaggtcggctaggtcgggtctgggactacgtacttccgactcctcacctatcgacgtccgcgtagacgtccgtaggtacgtacgtttcgtacggttaccgttttagtttacgtttcggttaccgtttacgggtaccggttacgtaccctaaccggttcgggtaccccgttacccggttaccgttaccggttttaccgggtacccggttaacgggggaacccgtaacggtaccggttacgggtacgtacgtaccggtaacggtaaccggtaaacgttgggtccggtacgttacgaccctaccgtacttaccgttcgttccttccgtaacccg

SEQ ID NO: 277335 - DNA, 734 bp, Homo sapiens
  misc_feature: GYAE6OF01A7D7M.29.35.D02.1.454.CMB.1.raw
  modified_base (200)..(200): a, c, t, g, unknown or other
  misc_feature (200)..(200): n is a, c, g, or t
tcagatagagtactcacgaccggtgctcgatttagcacacgatagttgggtttgggggaggaactgctcagttaggacccagacggaaccatggaagccccagctcagcttctcttcctcctgctactctggctccagataccagcggagagattgtgttgacacagtctccagccaccttgtctttaggtctccggganaaagcgccacccttcccgtgcgagggcccgtagtaccgagtagttacgtaaaaccaacttcgtttcggccttacggtttaacccaaaacgacggtaaaaccctggggacccacgggtaccttcccgaacggtcctacccgtacacttacctagttcggaactggtaccacgtaccgaaacgcgggacctaacgtcgggacctacgtaccgagaccgtagttcgacggtacggtaccgtagggttcgggtacgtacgggacgtaacggtaactttccgaaactttcccgtactaaacccggtctacgaacgtacccgtaccgtaacgtacgtaccgtacgtaaggttactacgttcgtacgtttacgttgttacgtcggttacgggtacgtacgacgtaacgtccggtacctccggttactaccggtttcggaccgtacgggtaacctacgtcggtagtaacggtcgtaccgtacggtaccgtaggtacggtcggtacgtcggacctacgtcttacggtcgttcgtacgtacccg

SEQ ID NO: 277336 - DNA, 873 bp, Homo sapiens
  misc_feature: GYAE6OF01DIA9R.29.35.D02.1.454.CMB.1.raw
tcagatagagtactcacgaccggtgctcgatttagcacacgatagttgggtttgggggaggaactgctcagttaggacccagacggaaccatggaagccccagctcagcttctcttcctcctgctactctggcctccagataccagcggagagattgtgttgacacagtctccagccacctgtctttgtcgtccgggaagaaagacgcccaccctctcctgcagggccagtcagagtagttaacaacttacgttcggccttggttaccaaacgaacgtaaacccgtgggacccaagggcccttacccgaaggtccttaccctactaacttcctagtggaattcgacaactacccgaaacgacggggccctaacgtcggacctaacgtaccccgacgtacccgtagggttacaaggtcggacgtagggttcgggggtcgttacgggggaactaacggtacctttaccaccttaccctaccgaaccctagttaccgaccggtacccgtaccgtacggaaccgtcccgtacgggtaacgggttactttaccggttacggtttacccgtttttaagttttacggttttcggtttaccgggtttcggggttaaccggtttaacggtacccgttaaccgggttccgggttacccccgttttaccccggtttacccgttttaacccggggtttttaccggggaaccccgggtaaccgggggtaacccgtaacgggttaccggggttaacgggtaaaccggtaaccgtaaccggtaaacggggtaaacccggtaacgggtttcggggtaccggtaccggtaccggtaacccgttaaccgttactttccggtttaaccgtttccgttacccgtttaaccccg

SEQ ID NO: 277337 - DNA, 823 bp, Homo sapiens
  misc_feature: GYAE6OF01C9XT1.29.35.D02.1.454.CMB.1.raw
tcagatagagtactcacgaccggtgctcgatttagcacacgatagttgggtttgggggaggaactgctcagttaggacccagacggaaccatggaagccccagctcagcttctcttcctcctgctactctggcctcccagataccagcggagagtattgtgttgacacagtcctccacgcccacccttgtctttgccgtaccgggaagaaagacgcccaccctctccgtagccgagggacctaggtacaggtacgtagttaaaccaaccgttacgttcggcccgttaggttaccccaaaagtaaccggtaaaacccgttcgggaaccccgtacggggaccccttaccccggaacgggtcccctttacccttacgtaaactttcgttaacgttcggtaactcgaccctaacgttacccgaaacggaaccgggtcctaaccgtggaccctaaacctcccgacgtccggttaaggttcaggggtccggaacgtggggtttacggggaccgttacggggaacctacggttacctttaccgtaacccttctaacccggtaccctaacggttaccggacggtaccccgtaccgtacgggtacgtacccgtacggtacggttacctttcggttaccggtttaccgttttagtttacgtttcgttacgggttacggtacggtacgtaccgtaccggttccggttacccttacccgttacgtaaccggtttcggaccggtaacggaccgtacggtcgtacggacgtacgtacggaacgtacgtacgtcgggtgccgcgtacctacggtacttcgtacggttcctcgtacccg

SEQ ID NO: 277338 - DNA, 531 bp, Homo sapiens
  misc_feature: GYAE6OF01AR3JL.29.35.D02.1.454.CMB.1.raw
  modified_base (373)..(373): a, c, t, g, unknown or other
  misc_feature (373)..(373): n is a, c, g, or t
tcagatagagtactcacgaccggtgctcgatttagcacacgatagttgggtttgggggaggaactgctcagttaggacccagacggaaccatggaagccccagctcagcttctcttcctcctgctactctggctcccagataccagcggagagattgtgttgacacagtctccagccaccctgtctttgtctccgggagaaagagccaccctctcctgcaggggccagtcagagtgttaacactacttggcctggttccaacagaaacctggccaggctcccaggctcctcatctatgatgcatccaacagggccactggcatcccagccaggttcagtggcagtgggtctgggacaggcttcactctcaccntcagccgcctagacgcctgaggacttctgtcccgtttattatttggtcgtttgggtcgtagcaacgtcggcctacccgtctacgtttcggccaggggaccaaggctgggagactcgagtaccgaatggtggcctgcacccatcgtcgttcttctaccg

SEQ ID NO: 277339 - DNA, 724 bp, Homo sapiens
  misc_feature: GYAE6OF01BCDBJ.29.35.D02.1.454.CMB.1.raw
  modified_base (292)..(292): a, c, t, g, unknown or other
  misc_feature (292)..(292): n is a, c, g, or t
tcagatagagtactcacgaccggtgctcgatttagcacacgatagttgggtttggggaggaactgctcagttaggacccagacggaaccatggaagccccagctcagcttctcttcctcctgctactctggctcccagataccagcggagagattgtgttgacacagtctccagccaccctgtctttgtctccgggagaaagacgccaccctctcctgcagggccagtcagagtgttaacactacttggcctggttccaacagaaacctggccaggcctcccaggcctcctnatctatgatgcatccaacgcggccacgtgctactcccagcctaggttcaggtcggcaggttcggggtctaggggactacgtacctttcgaacttccgtaccaccctattacccgaccggtcccgacccgttaggaccggtacccgttacgggaacggttactttacggttcggtttacccggtttttaagttttacgtttcggtttacccgttttagggggtaccgttaacggtccctaaacggttccgggtaccccgtttccccggttacctttaccggtttttaccgggacccgggtaacggggtaacccgtaggtccggttacggaacggttagtacccggtaacgggtaaccgttaaacggttcgggtccgggtcccgtacgtacccgtaccgtacgttcccgttacggttccttacgttaacccccg

SEQ ID NO: 277340 - DNA, 643 bp, Homo sapiens
  misc_feature: GYAE6OF01BULVP.29.35.D02.1.454.CMB.1.raw
tcagatagagtactcacgaccggtgctcgatttagcacacgatagttgggtttgggggaggaactgctcagttaggacccagacggaaccatggaagccccagctcagcttctcttcctcctgctactctggctcccagataccagcggagagattgtgttgacacagtctccagccaccctgtctttgtctccgggagaaagagccaccctctcctgcagggccagtcagagtagttaacaactacttggcctggttaccaaacagaaaccctggccaacggctcccaggctcctcatctatgatgcatccaacgagggccacgtggcactcccagccaggttcagtcggcaggtggtctgggacagtactcacgtctacaccatcgacgccgcctagacgtcctaggacggtattcgtacggtccgttttaatttagtttcggtcgtttcggggaccgttacgtacctaacgtcgggtaccccgttacccgttaccgttaccggtttttccgggacccgtaacgggggtaacccgaaacggtccgtagggtaacgtacgttaccgaaaggaaccgtaacggttacgggtcgggacgtcggaccctaaccgtacttacccgttgttcccgttcgttaacccg

SEQ ID NO: 277341 - DNA, 756 bp, Homo sapiens
  misc_feature: GYAE6OF01A7WLS.29.35.D02.1.454.CMB.1.raw
tcagatagagtactcacgaccggtgctcgatttagcacacgatagttgggtttgggggaggaactgctcacgttaggacccagacggaaccatggaagccccagctcagcttctcttcctcctgctactctggctcccagataccagcggagagattgtgttgacacagtctccagccaccctgtctttgtctccgggagaaagagccaccctctcctgcagggccagtcagagtgttaacaactactggcctggttccaacagaaacctggccaggcctcccgaggcctcctcatctatgatcgcactccaacgacgggccaacgtcggaccacgtcccccgaaggtcccccgtaagggtttccaagggtttcggaccgtaaggggttcgggggttaccgttagggggaaccctaacgggtaaccttttcccgaacctttaccctacccaaacccgtattccccgaacggtccccggacccgttaacggacggtacccgttacgggtaacgggttaacgtttccgttacggtttacccgtttttaagttttaacgtttcggtttaccggtttcggggtaccggttaacggtacctaaccgttcgggtaccccgttccccggttaccgttaccggtttttcgggacccggtaacggggtaacccgtaacggtccgtaggtacgtacgtacgaacggtacgtaacgttcggtcggccgtcggacctaccgacgttaccgtcgttccgttcgtacccg

SEQ ID NO: 277342 - DNA, 656 bp, Homo sapiens
  misc_feature: GYAE6OF01EM33U.29.35.D02.1.454.CMB.1.raw
  modified_base (200)..(200): a, c, t, g, unknown or other
  misc_feature (200)..(200): n is a, c, g, or t
  modified_base (268)..(268): a, c, t, g, unknown or other
  misc_feature (268)..(268): n is a, c, g, or t
tcagatagagtactcacgaccggtgctcgatttagcacacgatagttgggtttggggaggaactgctcagttaggacccagacggaaccatggaagccccagctcagcttctcttcctcctgctactctggctccagataccagcggagagtattggtgttgaacacagtctccagcccacctgttctttgcgtcggganaaagcgtccacctctcctgcgagggccagtcagagttgttaaacacttacgttggccttggtaccaanacgaaacctggaccaggcctcccaggcctccgtcatctatgatgcactcccaacgacggcctaacgttcggacctaccgtcccgtacgtaccgtacggttcaaggtcggacgtagggtcgggtcgtacgggactaacggtaccttcgtaccttccgtacgtacctacgtcacgccgtacctacgacgtaccgtaggtacggtacttcgttacgttaccgttttattagttcgtcgtttcgggacgttacgtactacgtccggtcccgtaccttcgttacgtttccggaccggaacgggtaacacggttcgtacgacggtactacgtaacggaccgttaacggtggtacgcctcgacctacgtacttccgtacgttcctacgttacccg

SEQ ID NO: 277343 - DNA, 764 bp, Homo sapiens
  misc_feature: GYAE6OF01DULGN.29.35.D02.1.454.CMB.1.raw
tcagatagagtactcacgaccggtgctcgatttagcacacgatagttgggtttgggggaggaactgatcagttaggacccagacggaaccatggaagccccagctcagcttctcttcctcctgctactctggcctcccagactaccagcggagagtatttggtgttgacacagttcctccacgccctacccttggttctttgtccgtccggggaagaaagacgcccaccctctccgtgcgacgggccagtcagtagttacgttaacaactacgttggaccttggttaccaaacgaacgaaaccgtcggaccacggccttacccgacggccttccactaatcctaattcggatcgccaactaccgaacggaccgggaccacgtcggacctaccgtcccgaacgaccgtaggttcgagggttcggcgtaacgggtcggggtacgttacggggaacctaagtacccgttacaccttcctaccgaaactactcgaccgcccgtaccgtaccggacgtccgtaggtacgttacgttcgttacggttaccgttttagtttacgttacggtttcgttacgggtacgttacgaccgttaacggtccggtcccgttccgttaccggttaccggtttccgggaccgggtaccgggtaacctacgggtcggtaggtaacgtccgtaacggaaccggtaacgtaacggttcgggtacgtccgtacggaaccccgtacgtacgttaccgttttctcccgttttacccggttcccccg

SEQ ID NO: 277344 - DNA, 590 bp, Homo sapiens
  misc_feature: GYAE6OF01CKMKV.29.35.D02.1.454.CMB.1.raw
  modified_base (205)..(205): a, c, t, g, unknown or other
  misc_feature (205)..(205): n is a, c, g, or t
  modified_base (516)..(516): a, c, t, g, unknown or other
  misc_feature (516)..(516): n is a, c, g, or t
tcagatagagtactcacgaccggtgctcgatttagcacacgatagttgggtttgggggaggaactgctcagttaggacccagacggaaccatggaagccccagctcagcttctcttcctcctgctactctggctcccagataccagcggagagattgtgttgacacagtctccagccaccctgtctttgtctccgggaagaaagngccaccctctcctgcagggccagtcaggagtgtaacaactacttggcctggttccaacagaaacctggccaggctcccaggctctcactctatgatgacactaccaagacgggccacgtcggacactcccagccaggttcaggtggcgaggtgggtctgggacagtacttctactctacaccatcacgccgacctagacgccgtagacgtacgttcgtacgttacgtttacgttagtttgtcgttgggcgttagctaacgtcgcccttccgtcgtaccgtttcggccgtacgggacctacggtcgtacggngacgtcgaacggtacgaacgttcggtcggtcgtacgaccgtaccgtacgttccttcggttccttacgttacccg

SEQ ID NO: 277345 - DNA, 837 bp, Homo sapiens
  misc_feature: GYAE6OF01ENAIJ.29.35.D02.1.454.CMB.1.raw
tcagatagagtactcacgaccggtgctcgatttagcacacgatagttgggtttgggggaggaactgctcagttaggacccagacggaaccatggaagccccagctcagcttctcttcctcctgctactctggctcccagataccagcggagagattgtgttgacacagtcctccagcccacccttgtctttgtcgtccgggagaaagcgcccaccctctcctgcagggccagtcagtagtacgttaaccaacttacgttggccttaggttacccaaagtacgaaaccgtggaccacggcctcccgaggtcctccctacactctatgatcgcaactcccaacgacgggcccacgtcggaccactaccccgacgtccgtaggttaccgagggtcggcggtacgggttcggggtacgtacgggacctacggtaaccttcctaaccgttcccttaaccaaccgtacttacccgaccggtaccccgtaccgtaacgggtaccgtaccccggttaggtaaccggttactttaccggttaccggtttaccgttttttaactttacggttttccggttccgggtttcggggtacccgttacggtacccgttaaccggttcccgggttacccccgtttaccccggtttaacgtttacccggggttttccgggaacccgggttaaccgggggtaaccctacgggttaaccggtaacggggtaacccggttaaagtaacccgggaaacggggttaacccgtaaaccgggttgggtacccggtacgttacccgtaacccgtacccgtttacttcccgggtttacttttaccccggtaactttacccccg

SEQ ID NO: 277346 - DNA, 724 bp, Homo sapiens
  misc_feature: GYAE6OF01APH86.29.35.D02.1.454.CMB.1.raw
  modified_base (173)..(173): a, c, t, g, unknown or other
  misc_feature (173)..(173): n is a, c, g, or t
  modified_base (201)..(201): a, c, t, g, unknown or other
  misc_feature (201)..(201): n is a, c, g, or t
  modified_base (219)..(219): a, c, t, g, unknown or other
  misc_feature (219)..(219): n is a, c, g, or t
  modified_base (660)..(660): a, c, t, g, unknown or other
  misc_feature (660)..(660): n is a, c, g, or t
tcagatagagtactcacgaccggtgctcgatttagcacacgatagttgggtttggggaggaactgctcagttaggacccagacggaaccatggaagccccagctcagcttctcttcctcctgctactctgacctccagataccaggcggagagtattggtgttgacacagtcnccagccaccttgtctttgtcgtcggganaaacgcgccacctctccngcgacgggccagtcagtagtacgtaacactcgtggccttacggtaccaacgacgaaaccgtcggaccgacggcctccgaggtcctcctactacgtctagtcgaactcgactactaccgaacggacgggacccacgtcggaccaccgtacccgacggtacccgtaggggttaccacgggttcggacggtaacggggtcggggtaccgtacgggggaacctacggttacctttaccacccgttaccttaccaaccgtactacccggacgtaccccggtacgacggtacggtaccgtagggtaacggttctttaccgttacggtttaccgttttaagtttacgtttcggttcgggttcgggtacgttacgtacgtacgttcggtcccttaccggttcgttacggttccgggacggtacggtacgacggacgtacggtagtaccncggtaacgaacggttcgtggtccggcgtacgtaccgacttacttacgtttcttgttccttaccg

SEQ ID NO: 277347 - DNA, 717 bp, Homo sapiens
  misc_feature: GYAE6OF01CKWN7.29.35.D02.1.454.CMB.1.raw
  modified_base (289)..(289): a, c, t, g, unknown or other
  misc_feature (289)..(289): n is a, c, g, or t
  modified_base (328)..(328): a, c, t, g, unknown or other
  misc_feature (328)..(328): n is a, c, g, or t
  modified_base (396)..(396): a, c, t, g, unknown or other
  misc_feature (396)..(396): n is a, c, g, or t
  modified_base (672)..(672): a, c, t, g, unknown or other
  misc_feature (672)..(672): n is a, c, g, or t
tcagatagagtactcacgaccggtgctcgatttagcacacgatagttggggtttgggggaggaactgctcagttaggacccagacggaaccatggaagccccagctcagcttctcttcctcctgctactctggcctccagataccagcggagagattgtgttgacacagtcctccacgccctaccctggttctttggtcctaccggggaagaaacggcgccaccctctcctgcgacggggccaggtcaagtagttacgttaaaccacttacgtggtcctggttaccaanaacggaaacctggcctagggcctccgacggtctccctanactcttaatcgagtcgactactaccgaacgacgggaccacgtcgacacctcccgagtaccgtacggtnacggtcggcgtagggtcgggtcgtagggactcggtacttctacgtcctacgtaccacgtcgaccgtcccggaacctaggaccgtaccgtaggtaaccgggttactttacggtacggttttacggttttaacgtttacggtttcggttccggtttacgggacggttacgtaacgtaaccgtcggttccccttacccggttacgttaccggtttcgggacccggtaacggggaacctacgggtagtacggtacggtacgaccgtagggaactaacggnggtacgtcccggtagacctacgttactcggttcttcgtccttccg

SEQ ID NO: 277348 - DNA, 616 bp, Homo sapiens
  misc_feature: GYAE6OF01A0RTT.29.35.D02.1.454.CMB.1.raw
  modified_base (293)..(293): a, c, t, g, unknown or other
  misc_feature (293)..(293): n is a, c, g, or t
tcagatagagtactcacgaccggtgctcgatttagcacacgatagttgggtttggggaggaactgctcagttaggacccagacggaaccatggaagccccagctcagcttctcttcctcctgctactctggctcccagataccagcggagagattgtgttgacacagtctccagccaccctgtctttgtctccgggagaaagagccaccctctcctgcagggccagtcagagtgttaaacaactacttggcctggttccaacagaaacctggccaggctcccgaggctccctnactctatgatcgcactccaacgagggccacgtggacactcccagcctaggttcaggtggcaggtgggtctgggactacgacttcacgtctacacactcagcagacgtcggggacctaggaacgtatcgtacatctagttgtattactgtactatactaattgttacgtttcttacgttcgtttcctccttaccgtacccgtttccgggaccgtaaaccggggtaccgaacccggtaacgttacggggtaaaggtaaacgtttaaaaccggaacgttcggttaccgggtacgttacgaacccgtaaccgtacgttcccgttacg

SEQ ID NO: 277349 - DNA, 564 bp, Homo sapiens
  misc_feature: GYAE6OF01DQS73.29.35.D02.1.454.CMB.1.raw
  modified_base (201)..(201): a, c, t, g, unknown or other
  misc_feature (201)..(201): n is a, c, g, or t
  modified_base (416)..(416): a, c, t, g, unknown or other
  misc_feature (416)..(416): n is a, c, g, or t
  modified_base (519)..(519): a, c, t, g, unknown or other
  misc_feature (519)..(519): n is a, c, g, or t
  modified_base (553)..(553): a, c, t, g, unknown or other
  misc_feature (553)..(553): n is a, c, g, or t
tcagatagagtactcacgaccggtgctcgatttagcacacgatagttgggtttgggggaggaactgctcagttaggacccagacggaaccatggaagccccagctcagcttctcttcctcctgctactctggctcccagataccagcggagagattgtgttgacacagtctccagcccaccctgtctttgtctccgggaanaaagacgccaccctctcctgcgagggccagtcagtagtacgttaaacaacttacgttggccttggttacccaaagtaacgaaaaccctggcccaaggcctacccaggtcctcctcatctaatgatcgacataccaacgacgggccaacgtcggcactccccgagccaggttcaggtggactaggtgggtcgtgggacagtacttcgactcacacntcgacgcgcagacgctagagtacttcgtcgtacgtttattagttgtcgttggtcgtagactacgtcgcctccgtctacgtttcgacgtacggacagcgagagngtacgagacgtagtggtcgacgtcgactacactntcgtctgtacc

SEQ ID NO: 277350 - DNA, 692 bp, Homo sapiens
  misc_feature: GYAE6OF01CT761.29.35.D02.1.454.CMB.1.raw
  modified_base (308)..(308): a, c, t, g, unknown or other
  misc_feature (308)..(308): n is a, c, g, or t
tcagatagagtactcacgaccggtgctcgatttagcacacgatagttgggtttgggggaggaactgctcagttaggacccagacggaaccatggaagccccagctcagcttctcttcctcctgctactctggctccagataccagcggagagattgtgtgacacagtctccagccacctgtctttgtcgtcgggaagaaagacgcctaccctctcctgcgagggcctagtcaagtagtacgttaaacaacttcgtcggcctggttaccaaagaacgtaaccgtggaccaggcctccgagtcctcctanactctatgatcgacacgtaccgaaaacggcgggacctacggtcggacctaccgtcccgaacgtcccggtaggttcaaccggttggcgtaagggttcgggtaccgtagggaacacggtaccttcgacttcaccacgtacttccgacgacccgtactacggtacgtccgtaggtacgtactttcgtacggttccttttagttcgttggtcgttacgacgttacacgtaaccgttcggtcccttaccggtccgttacgtttccggaaccggtacgggtaacccgtaggtccgtaaggtacgtacgtaccgtaaacgggtaaccgtaacgttggtaccgggtcctaaccgtcttaaccgtacttgtttacggtacccttcgttacccg

SEQ ID NO: 277351 - DNA, 811 bp, Homo sapiens
  misc_feature: GYAE6OF01DXGOU.29.35.D02.1.454.CMB.1.raw
tcagatagagtactcacgaccggtgctcgatttagcacacgatagttgggtttgggggaggaactgctcagttaggacccagacggaaccatggaagccccagctcagcttctcttcctcctgctactctggctcccagataccagcggagagtattgtgttgacacagtctccagccctacccttgttctttgtccgtaccggggaagaaagcgcccacctcgtcctgcgacgggcagtcagtagttacgtaaaccacgttacgttcggccgtttagggttaacccaaaacgtaacggtaaacccgtcgggacccgaacgggtccctaccccggagtccttcctactacttcctaagtgaacttcgacctaacgtacccgaacggaccgggacctacggtcggaaccctaccttacccgtaacgtacccggttaggtttaccgacggggttaccggtacggttacgggggtttaccgggggtaccggttacggggaaaccttaaccggttaccgttttaccacccgtttacccgtaacctaaccgtaacgttaccccggacgtaccccggtaaccgtaacggtaaccggtaccggttacgggttaacggttaacctttccggttacggtttaaccgtttttagtttacggttcggttacggtttcggtacggtacgtacgtaaccgttccggtacccgttaccgttcgttaccgtttcggaccggtacggacgtacgcggtacgagtactaacgacggtaacgtaggtggtcgacgtcgaccgtactacgtacttcgttctcgttacccg

SEQ ID NO: 277352 - DNA, 532 bp, Homo sapiens
  misc_feature: GYAE6OF01BKVEM.29.35.D02.1.454.CMB.1.raw
  modified_base (392)..(392): a, c, t, g, unknown or other
  misc_feature (392)..(392): n is a, c, g, or t
  modified_base (491)..(491): a, c, t, g, unknown or other
  misc_feature (491)..(491): n is a, c, g, or t
  modified_base (517)..(517): a, c, t, g, unknown or other
  misc_feature (517)..(517): n is a, c, g, or t
  modified_base (520)..(520): a, c, t, g, unknown or other
  misc_feature (520)..(520): n is a, c, g, or t
tcagatagagtactcacgaccggtgctcgatttagcacacgatagttgggtttgggggaggaactgctcagttaggacccagacggaaccatggaagccccagctcagcttctcttcctcctgctactctggctcccagataccagcggagagattgtgttgacacagtctccagcccaccctgtctttgtctccgggagaaagagcccaccctctcctgcagggccagtcagagtgttaacaactacttggcctggttccaacagaaacctggccaggcctcccagcctctcatctatgatgcataccaaagcgggccacgtggccatccccagcctaggttcaggtggcaggtcggggtctgggacaggtaccttcactctcaccatccngccgactagcgtctgagacttctgtcccgtttattgttgtcgttgggctagccacgtcgcctccgtctccgtttcggccggtagggacctagcgtgganatcgagacgagtggtgctgacgtacnctntgtcgtctaccg

SEQ ID NO: 277353 - DNA, 784 bp, Homo sapiens
  misc_feature: GYAE6OF01BC5QL.29.35.D02.1.454.CMB.1.raw
tcagatagagtactcacgaccggtgctcgatttagcacacgatagttgggtttggggaggaactgctcagttaggacccagacggaaccatggaagccccagctcagcttctcttcctcctgctactctggctcccagataccagcggagagattgtgttgacacagtctccagcccacctgtctttgtctccgggagaaagcgccaccctctcctgcacgggccagtcaggtagtagttaaacaacttacttcggccttgggttacccaaacacgaaaaccctggaccctaacgggcctcccgaggccttcctaccagtctatcggatcgcctaactacccaaacggacggggacccaacgttcgggacctaaccgtcccccgaaggtccccgttaaggggtttaccaagggtttcgggaccgtaagggggtttcgggggttcccgttacggggggaaccctaacggttaacccgtttacccaacccgtttcctaccggtaaaccctacgttacccgaaccggtaccccggtacccgttaacggaccggtaccgtacggtaacggtaccgtttccgttcggtttaccgttttatttacgtttcgttacggtttcgggtacgttacggtaccgtaaccgttcgggtacccgttcccggttaccttaccggttttcgggacccggtaacggggtaacccgtaggtccgttaggacgtacgtaccggtagaaccggtaagtcggtacggcgtacgactaccgacttccgtcgttcgtccgttaccg

SEQ ID NO: 277354 - DNA, 632 bp, Homo sapiens
  misc_feature: GYAE6OF01C2HAY.29.35.D02.1.454.CMB.1.raw
  modified_base (195)..(195): a, c, t, g, unknown or other
  misc_feature (195)..(195): n is a, c, g, or t
  modified_base (198)..(199): a, c, t, g, unknown or other
  misc_feature (198)..(199): n is a, c, g, or t
  modified_base (206)..(206): a, c, t, g, unknown or other
  misc_feature (206)..(206): n is a, c, g, or t
  modified_base (223)..(223): a, c, t, g, unknown or other
  misc_feature (223)..(223): n is a, c, g, or t
  modified_base (282)..(282): a, c, t, g, unknown or other
  misc_feature (282)..(282): n is a, c, g, or t
  modified_base (293)..(293): a, c, t, g, unknown or other
  misc_feature (293)..(293): n is a, c, g, or t
tcagatagagtactcacgaccggtgctcgatttagcacacgatagttgggtttggggaggaactgctcagttaggacccagacggaaccatggaagccccagctcagcttctcttcctcctgcctactctggcctccagactaccagcggagagattgtgttgactacagtctcagccacctgtcttgctcgganaannccacctnctgcaggtccagtcagngtataacaacttctggccttggtaccaacagaacctggccaggtctaccaggtctcctnatctatgagtnactactaccaacgcgggaccacgtggacaacgtcccaagccgtaggtcaggtgcgtaggtgggcgtggactgtactcactctcgactactacgacgccgtaccgtacgacgtcctacggtaggtaacttcgttacgtttaccgtttaagttttacggttcgtttcgtacgggttaccggtttaagtaccctaacggttcccgggtcccttacccggttaccgttaacggttttcggaccggtaacgggacccgtacggtacgtaggacgtacgttaacgaggtaccgtaaggtcgtcggtacgtcgtaccgtaacctcttacttcgtcttccttacccg

SEQ ID NO: 277355 - DNA, 723 bp, Homo sapiens
  misc_feature: GYAE6OF01A4G1M.29.35.D02.1.454.CMB.1.raw
  modified_base (200)..(200): a, c, t, g, unknown or other
  misc_feature (200)..(200): n is a, c, g, or t
  modified_base (363)..(363): a, c, t, g, unknown or other
  misc_feature (363)..(363): n is a, c, g, or t
tcagatagagtactcacgaccggtgctcgatttagcacacgatagttgggtttgggggacggaactgctcagttaggacccagacggaaccagtggaagccccagctcagcttctcttcctcctgctactctggctcccagataccagcggagagattgtgttgacacagtctccagccaccctgtctttgctccggganaagacgccacctctcctgcagggccagtcagagtgttaacacttctggcctggttaccaacacgaaacctggaccagggcctacccgaggtcctcctcgatctatgatgctatccaacgacgggccaacgtcggacctactcccgaacgccgtacggtttccnggttacggcgtacggttggggtccgttagggggaacctacgggttaacctttccgaacccgtttccgttaccgaacccgtattacccgaaccggtaccccggtacccgtaacggtaccggtaccgtacgggtaacggttacgtttcgtacgtttaccgtttactttacgtttcgttacgttgggtacggttacgtaccgtaccgttcggtaccccgttcccggttaccgttaccggttttccgggacccgtaccgggtaaccgacggtaccgtacggacgtaccgtacgaacgtacggtaacgttacgggtccgtacgtcgaccgtaacctcgttaccgttcgttccgttacgttacccg

SEQ ID NO: 277356 - DNA, 572 bp, Homo sapiens
  misc_feature: GYAE6OF01CAS73.29.35.D02.1.454.CMB.1.raw
  modified_base (200)..(200): a, c, t, g, unknown or other
  misc_feature (200)..(200): n is a, c, g, or t
  modified_base (261)..(261): a, c, t, g, unknown or other
  misc_feature (261)..(261): n is a, c, g, or t
  modified_base (314)..(314): a, c, t, g, unknown or other
  misc_feature (314)..(314): n is a, c, g, or t
tcagatagagtactcacgaccggtgctcgatttagcacacgatagttgggtttgggggaggaactgctcagttaggacccagacggaaccatggaagcccagctcagcttctcttcctcctgctactctggctccagataccagcggagagattgtgttgacacagtctccagccacctgtctttgtctcgggagaaagngccacctctcctgccagggccagtcagagtagttaacaactacttggcctggttaccaaanagaaacctggaccaggcctcccaggcctcctcactctatgatgactatccaanacgggccactggacactcccagccaggtcagtggcaggtgggtctgggacagacttcactctacaccatcgacgccgcctagacgtcctaggaggtattcgtgtcgtttattagtttcgttcgtttgggtcgtagtcgtaacgtcggtcccttcccgtccgtacgttttcgggaccgtaggggaccctaaggccgtaggacgtatcgacggtaacgtactagggtcgacgtcgacctacacttctcgttcttctaccg

SEQ ID NO: 277357 - DNA, 621 bp, Homo sapiens
  misc_feature: GYAE6OF01BJGB6.29.35.D02.1.454.CMB.1.raw
  modified_base (204)..(204): a, c, t, g, unknown or other
  misc_feature (204)..(204): n is a, c, g, or t
  modified_base (294)..(294): a, c, t, g, unknown or other
  misc_feature (294)..(294): n is a, c, g, or t
tcagatagagtactcacgaccggtgctcgatttagcacacgatagttgggtttgggggaggaactgctcagttaggacccagacggaaccatggaagccccagctcagcttctcttcctcctgctactctggctcccagataccagcggagagattgtgttgacacagtctccagccaccctgtctttgtctccgggagaaagngccaccctctcctgcagggccagtcagagtgtaacaactcttggcctggtaccaacagaaacctggccaggctcccagctctcatcttgngcatctacgaggccactcggcactcccagtaccgttcagtggcaggtcggtctgggacagtacttcactctaccactatcgacgcagacgtcggggacctagaacgtgtgctaagtcgtaagtagttacttaacgtgtactactactaaagtttcgtacgggttttcttacgtacgttttccgaccttaccgtacccggtttaccggaccgtaacgggacctaaccggacgttacgggtaaacgttaaacgtttaaaaccggaacgttcgggtacgaccgttacgacccgtaacttacgttaccgttcgtttccgtcgttaaccccg

SEQ ID NO: 277358 - DNA, 765 bp, Homo sapiens
  misc_feature: GYAE6OF01A0ZMQ.29.35.D02.1.454.CMB.1.raw
  modified_base (206)..(206): a, c, t, g, unknown or other
  misc_feature (206)..(206): n is a, c, g, or t
  modified_base (213)..(213): a, c, t, g, unknown or other
  misc_feature (213)..(213): n is a, c, g, or t
  modified_base (226)..(226): a, c, t, g, unknown or other
  misc_feature (226)..(226): n is a, c, g, or t
tcagatagagtactcacgaccggtgctcgatttagcacacgatagttgggtttgggggaggaactgctcagttaggacccagacggaaccatggaagcccagctcagcttctcttcctcctgctactctggcctcccagactaccgagcggagagattgtgttgacacagtcctccagcccacctgttctttgtccgtaccggganaaacgcnccaccctctccgngccgacgggccagtcaggtagtcgttaaacactacgttcggccttacggtaccaacgacgaaaccgtcggaccgtacggccctcccgaggtccctaccgtacacttcgtaatcgtaagtcgacctaacgtaccccaaaccggtcgggaccctacggtacgaccgtacctaccccgaggtaccccgtaggtacgtaggtcggaggtacggggttcgggtaccgtgggaaccgttaactaacccggtttcctaccgtaacctaccgaaccgtactaccccggaaccgtcccgtaccgtacggtaccgtaccgtaccgggtacggtacgtttaccgtccggtttaaccggtttactttacgtttacggttcgggttacggtaccgttacggtaccgtaccgggttcccggttcccgttacccggttcgttaccggtttaccgggaccgggaacggtaccgtacgtacggtagggtaactcgtaacgacggtacgtagtcggtcgtcgacgtaccctagtacgttcttcgtcgttcgtacccg

SEQ ID NO: 277359 - DNA, 690 bp, Homo sapiens
  misc_feature: GYAE6OF01DUOJT.29.35.D02.1.454.CMB.1.raw
tcagatagagtactcacgaccggtgctcgatttagcacacgatagttgggtttggggaggaactgctcagttaggacccagacggaaccatggaagccccagctcagcttctcttcctcctgctactctggctcccagactaccagcggagagattgtgttgacacagtctccagccaccctgtctttgtctccgggagaaacgcgcccaccctctcctgcgagggccagtcagagtagttaacaactcgttggcctaggttaccaaacaacgaaaccctggcccaggcctcccaggcctcctcatctatcgatcgcactaccaacgcgggaccacgtcggaccactaccccgagaccgtacggttcgaacgttcggacgtagggtcggggtacgtacggggactacggtaacctttccgaccttcctaccaacccgtacttaccgaacgtcccgtaccgtacgacgccgtaggacggtattccgttgttaccgtttattacgtttcgttccgttcgggtacgttacgtacgtaaccgtcggtcccgttacccggttcgttaccggttttccggacccgtaacggggaaccgtacggtcgtaggtacgtacgtacgacgtaacggtaacgttcgggtacggtccgtacggcccctaaccgttacgttaccgtcgttaccttcgttacccg

SEQ ID NO: 277360 - DNA, 745 bp, Homo sapiens
  misc_feature: GYAE6OF01ANFZK.29.35.D02.1.454.CMB.1.raw
tcagatagagtactcacgaccggtgctcgatttagcacacgatagttgggtttggggaggaactgctcagttaggacccagacggaaccatggaagccccagctcagcttctcttcctcctgctactctggctcccagataccagcggagagattgtgttgacacagtctccagccaccctgtctttgtcgtccgggagaaagcgcccaccctctcctgcgagggccagtcagagtagttaacaacttactggcctggttaccaacagaaacctggccaggcctccgaggcctcctcatctatgatgcactaccaacgacgggccacgtcggacactccccgagtccgtaggttcgaggtcggcgtagggttcggggtcgtaggggacctacggtacctttaccacgttcctaccgacctacgtccgaaccgtcccgtaccgtacggtacggtacccgtaggtacggttacgtttcgttacggtttacccgttttaagtttagtttcggttccggtttggggtaccggttaacggtaccgtaaccggttccgggtcccccgtttacccggttaccgttacccggtttttaccggggacccgggtaacgggggtaacccgtaaccggtccggttagggaccgtaacggttaccggaaacgggtaccggtaacggttcgggttcgggaccgttaccggtaccctacccgttacgttacccgttcgttcccgtttaccgttaaccccg

SEQ ID NO: 277361 - DNA, 723 bp, Homo sapiens
  misc_feature: GYAE6OF01C5IT2.29.35.D02.1.454.CMB.1.raw
tcagatagagtactcacgaccggtgctcgatttagcacacgatagttgggtttggggaggaactgctcagttaggacccagacggaaccatggaagccccagctcagcttctcttcctcctgctactctggctcccagataccagcggagagattgtgttgacacagtctccagcccacctgttctttgtctcgggagaaagcgccaccctctcctgcgacgggccagtcagtagtacgttaaaccaacttacttcggccttcggttacccaaacgaacggaaacccgtgggacccgaacggcctaccccgaggtccttcccttacgattcctaatgacttcgcctaactacccgaacgaccggggacctacggtcggacctaaccgtccccgaaggtccccgtaagggtttccagggttcgggacgtaaggggttcgggtacggtacggggaactacggtacctttccgaccgttcctaccaacctacgtccgacgcccgtaccgtacggaccgtaccgtaggaacggttactttccgtacggttaccgttttattcgtttcggttcggttcgggtacgttacgtccgtaacgttccggtcccttacccgttacgtttacggtttcgggaccgtaccgggacctaggtcgtacggaagtacgtacgacggtaacggtagtcgggtcggctcgaccgtactacgttcgttcgtcttcgtcccg

SEQ ID NO: 277362 - DNA, 842 bp, Homo sapiens
  misc_feature: GYAE6OF01C72RI.29.35.D02.1.454.CMB.1.raw
  modified_base (172)..(172): a, c, t, g, unknown or other
  misc_feature (172)..(172): n is a, c, g, or t
  modified_base (200)..(200): a, c, t, g, unknown or other
  misc_feature (200)..(200): n is a, c, g, or t
tcagatagagtactcacgaccggtgctcgatttagcacacgatagttgggtttggggaggaactgctcagttaggacccagacggaaccatggaagccccagctcagcttctcttcctcctgctactctggctccagataccagcggagagtattgtgtgacacagtctcanccacctgtctttgctcgggaagaaagcnccacctctccagcagggccagtacgaagagttacgttaaacaacgttacgttcgggacccttaggggttacccaaaacgtaacggaaaacccgtcgggacccgtaacgggcccttaccccggaagggtccctttaccctacgaacgttcttaaagttggaactagaccctaactaccccgaaaaccgacgggggtacccaaccggttacgggacctaaccgttaccccgaaggaccccgtttaagggttaccgaaggggttacgggaccgttaaggggtccgggggtttacgtacgggggaaacttacgggtaaacctttcgtacccttaccttaacccgaaacctaacgttaccggaaccggacccgtaaccgttaacggaaccggtaccgtaacgggtaacggtacgtttaccggtcggtttaaccgttttagtttaacgtttcgttacggttttacgggaccggttaacggtacgaaacgtccgggtcccttacccggtaccgttaccggtttacggaccggtaacgggtaacccggaggtacgtagggaacgtacggtaacgaacgtaacgggtaacgtacggtcgggtaccgtgaaccctacccgttaacttccggttactttccgtactttacccg

SEQ ID NO: 277363 - DNA, 630 bp, Homo sapiens
  misc_feature: GYAE6OF01EBF8O.29.35.D02.1.454.CMB.1.raw
  modified_base (204)..(204): a, c, t, g, unknown or other
  misc_feature (204)..(204): n is a, c, g, or t
tcagatagagtactcacgaccggtgctcgatttagcacacgatagttgggtttggggaggaactgctcagttaggacccagacggaaccatggaagccccagctcagcttctcttcctcctgctactctggctcccagataccagcggagagattgtgttgacacagtctccagcccaccctgtctttgtctccgggagaaagngcccaccctctcctgcagggccagtcagagtgttaaacaactcgttggcctggttacccaaacagaaacctggccacggcctcccgaggcctcctcactctatgatgcatccgaacgacgggcccacgtcggaccactccccgagacccgtaggttcgaggttggacgtaggtggggtcgtggggacacgtacttcgactctaccacctatccgacgacccgtctacggacgtcgtaggtagtacttcgttcggttacgttttattagtttcgttcgttgggtcgttacgtacgtaacgtcggtccttacccgtcttaccgtttcggaccggtacgggacctaggtcgtagggagtacgtcgaacggacgtaagttcggtcggaccgtgaccctaccgtacgttagttccgttccttcgttacccg

SEQ ID NO: 277364 - DNA, 843 bp, Homo sapiens
  misc_feature: GYAE6OF01BD9F1.29.35.D02.1.454.CMB.1.raw
  modified_base (540)..(540): a, c, t, g, unknown or other
  misc_feature (540)..(540): n is a, c, g, or t
tcagatagagtactcacgaccggtgctcgatttagcacacgatagttgggttggggaggaactgctcagttaggacccagacggaaccatggaagccccagcttagcttctcttcctcctgctactctggctcccagataccagcggagagattgtgttgacacagtcctccagccctacccttgttcctttagccgtaccggggaagaaacgacgcccctaccctctccctggccgtacggggcccaggtcaggtacgttacgttaaaccaacttacgttcggccgttacggttaccaaaacgacgtaaacccgtcgggacccgtacgggtcccctacccgacggtcccttaccctactacttaccgttagtcggaacttcggaccctaacctacccgaaaaccggtacggggtacccctaacggtccgggaccctaccgtacccccgaaggtccccggtaaggtttcccgaagggttccggaacgtcgggttcggggtacgtacgggactacgtaccttcgacttccgtaccaacgtntccgacgtcccgtaccgtacgtacggccgtacggacgttacttccgttacggttacgttttaagttacgtttcgggttaccggttacgggtacgtttaccgaccgtaaccggtcccggtacccgttcccggttaccgttaccgggtttccgggacccgggtaacgggtaacccgtaaggtccggtaacgggtacgtaccgtacggtaaacggtaaccggtaacgttgggggttaccgtacgtaccgtaacccgtaccgttacttaccgttacgtttcccgttaccgtaaccgtttccccccgg

SEQ ID NO: 277365 - DNA, 611 bp, Homo sapiens
  misc_feature: GYAE6OF01EZLFQ.29.35.D02.1.454.CMB.1.raw
tcagatagagtactcacgaccggtgctcgatttagcacacgatagttgggtttggggaggaactgctcagttaggacccagacggaaccatggaagccccagctcagcttctcttcctcctgctactctggctcccagataccagcggagagattgtgttgacacagtctccagccaccctgtctttgtctccgggagaaagagccaccctctcctgcagggccagtcagagtgttaacaactacgttggcctggttccaacagaaacctggccaggcctcccgaggctctcatctatgatgcatccaacgcgggccacgtcggcactccccagccaggttcagtggcaggtgggtctgggacagtcttcacgtctcacctatcacgccgctagacgcctagagtattcgtgttaccgttttattacgttggttcgttgggtacgtacgtaccgtaacgttccggtccccttccccggttacttacccggttttcggacccggtacggggtaacccgaaggtcggtaggacgtacgtacgaacggtaaccgtaacgttggtcgggtctacggacccgtaccgtacgttacctcgtttccgttacttacccg

SEQ ID NO: 277366 - DNA, 718 bp, Homo sapiens
  misc_feature: GYAE6OF01ADFFS.29.35.D02.1.454.CMB.1.raw
  modified_base (415)..(415): a, c, t, g, unknown or other
  misc_feature (415)..(415): n is a, c, g, or t
tcagatagagtactcacgaccggtgctcgatttagcacacgatagttgggtttgggggaggaactgctcagttaggacccagacggaaccatggaagccccagctcagcttctcttcctcctgctactctggcctcccagataccaggcggagagattggtgttgacactagtctccagcccacctgtctttgcgtaccgggagaaagcgccaccctctcctgcgagggccagtcgagtagtagttaaaccaacttacgttcggcccttggttacccaaacgacgaaaccctgggacccacggtcctacccgaggtccttccctctacttcctaagtggtaactcgacctactacccgaaacgtcggggaccacgtggacctaaccgtccgagtccgtaaggttcgagggtcggngtacgggttggggtacgtggggaactacggtcctttacaccgtctacctacacgtaccgacgtcccgtaccgtagaccggtccgtagggtaacgtactttcgtaccgttacgttttaagttgttacggttcgttaggggtaccgtacggtactaacggttccggtccccgttaccgttaccgttaaccgtttcgggaccggtaacgggactacggacggtacgagtaaccgtagaaccggtaacgtacggttcggtcggtcctaggacctaccttacgttcgttcgttacttcccgtaacccg

SEQ ID NO: 277367 - DNA, 775 bp, Homo sapiens
  misc_feature: GYAE6OF01DZ2XB.29.35.D02.1.454.CMB.1.raw
  modified_base (195)..(195): a, c, t, g, unknown or other
  misc_feature (195)..(195): n is a, c, g, or t
  modified_base (201)..(201): a, c, t, g, unknown or other
  misc_feature (201)..(201): n is a, c, g, or t
  modified_base (208)..(208): a, c, t, g, unknown or other
  misc_feature (208)..(208): n is a, c, g, or t
  modified_base (760)..(760): a, c, t, g, unknown or other
  misc_feature (760)..(760): n is a, c, g, or t
tcagatagagtactcacgaccggtgctcgatttagcacacgatagttgggtttggggaggaactgctcagttaggacccagacggaaccatggaagccccagctcagcttctcttcctcctgctactctggctcccagataccagcggagagattgtgttgacacagtctccagccacctgtctttgctcggganaaagcnccacctncctgcgacgggccagtcagtagtacgttaacaacttcgttggcctggttaccaagacgaacctggaccaggtccgtacccgggctcctcactctagtaggactgcctactacccaaacgacgggccctacggtcgacctactacccgaacggtccgtacgttaccgaggttcggacgtaggtcggggtacgtcggaactaacggtccttacgtacccttacaccgaacctacgtaccgaacgtccccgaccgttacggaaccggtccttaagggtacgttaacgtttcccgttacggtttaccgtttttaagttacggtttccggtttacggtttacggggtaacgttaccgttaacccgtaacggttcccgggttaccccctttaccccggttaccggtttaacccggttttccgggggaacccgtttaacggggaaccccgtaacggtccgttaaggggacctaacggttacaaacgggtacccgttaacgttgggtaccggtaccggttacgacccgaaccgtcgtttacggttaccgttactttcccncccggtttaaccccc

SEQ ID NO: 277368 - DNA, 558 bp, Homo sapiens
  misc_feature: GYAE6OF01CLFB5.29.35.D02.1.454.CMB.1.raw
  modified_base (204)..(204): a, c, t, g, unknown or other
  misc_feature (204)..(204): n is a, c, g, or t
  modified_base (264)..(264): a, c, t, g, unknown or other
  misc_feature (264)..(264): n is a, c, g, or t
  modified_base (385)..(385): a, c, t, g, unknown or other
  misc_feature (385)..(385): n is a, c, g, or t
tcagatagagtactcacgaccggtgctcgatttagcacacgatagttgggtttgggggaggaactgctcagttaggacccagacggaaccatggaagccccagctcagcttctcttcctcctgctactctggctcccagataccagcggagagattgtgttgacacagtctccagccaccctgtctttgtctccgggagaaagngccaccctctcctgcagggccagtcagagtgttaacaactacttggcctggttaccaaanagaaacctggccaggctccaggctcctcatctatgatgcatccaacaggccacgtggcactcccagcctaggttcagtggcaggtgggtctgggacaggacttcactctacacatcagccnctagagcctgagattctagtcctttagttatgtcttgggctagctaacgtcggccctccgtctaccgtttggcccgaggggtaaccaaggccgttaggacgtaactacgaacggtaaccgtaacgtggtcggtacgtcgaccctaacctattacctgttccgtttctaacccg

SEQ ID NO: 277369 - DNA, 833 bp, Homo sapiens
  misc_feature: GYAE6OF01A0QOB.29.35.D02.1.454.CMB.1.raw
tcagatagagtactcacgaccggtgctcgatttagcacacgatagttgggtttgggggaggaactgctcagttaggacccagacggaaccatggaagccccagctcagcttctcttcctcctgctactctggcctccagataccaggcggagagtattgtgttgacacagtctccagccaccctgtctttgtccgtccgggaagaaagcgccacctctcctgcgacgggccagtcagagtagttaaacaactcgttggccttacggttaccaaacgaacgaaaccgtcggaccacggcctccgacggcctcctctacttctagtgaactcgactacgtaccgaaacggcgggacccacgtcggactacgtaccccgagtccgtaagggtctaacgggtcggtacgtagggttcggggtaccgtaggggaacctaacggtactttacccgtaaccttccgtaaccaaccgtacgtacccgaaccggccccgtaaccgtaacggtaccgtaccggttaaggggtaacgttacgttttaccggtacggtttaacccgttttttaagttcggttttcgggttacgggttttacggggaccttaacgggtaacccgttaaccgttcccggggttacccccttttaccccgggtttaccgtttaacccgggttttaccggggaacccggggttaaacggggtaacccgtaaggtccgggttaagggaaacgtaccggtaaaccggtaacgggaaccggttacgtaggggttccgaccgttaccggtacccgttaaccgtagttttacccggtttcgtttaacccgtcgtttaaccccgg

SEQ ID NO: 277370 - DNA, 654 bp, Homo sapiens
  misc_feature: GYAE6OF01BJW87.29.35.D02.1.454.CMB.1.raw
  modified_base (198)..(198): a, c, t, g, unknown or other
  misc_feature (198)..(198): n is a, c, g, or t
tcagatagagtactcacgaccggtgctcgatttagcacacgatagttgggtttggggaggaactgctcagttaggacccagacggaaccatggaagccccagctcagcttctcttcctcctgctactctggctcccagataccagcggagagattgtgttgacacagtctccagccaccctgtctttgtctccggganaaagcgcccaccctctcctgcagggccagtcagagtgttaacactacttggccttggtaccaagagaaacctggccaggcctcccgaggtcctcctcatctatgatcgctactaccgaacgacgggccacgtcggactacgtccccagtccgtaggttccagggtcggacgacggggtggggtaccgtaggggactacgtacctttccgacgttcctacaccctagtaccgacgtcccgtaccgtagaccgtccgtaggtacggtactttcgttacggttaccgttttagtttacgtttcggttcgttcgggtaccgttacgaccgtaaccgttcggtaccccgtttacccgttccgtttaccgtttcgggtaccggtacgggtaccgacggtcgtaggacgtacgtacgacgtacgtacgtggtcgctgaccgtctacttcgtcgtcttctaccg

SEQ ID NO: 277371 - DNA, 781 bp, Homo sapiens
  misc_feature: GYAE6OF01EPACQ.29.35.D02.1.454.CMB.1.raw
  modified_base (260)..(260): a, c, t, g, unknown or other
  misc_feature (260)..(260): n is a, c, g, or t
  modified_base (396)..(396): a, c, t, g, unknown or other
  misc_feature (396)..(396): n is a, c, g, or t
  modified_base (721)..(721): a, c, t, g, unknown or other
  misc_feature (721)..(721): n is a, c, g, or t
tcagatagagtactcacgaccggtgctcgatttagcacacgataggttgggtttgggggaggaactgctcagttaggacccagacggaaccatggaacgccccagctcagcctttctccttcctcctgtctacgtctcggcctcccaagactacccgaggcggagagtatttggtagttcgacaccgagttccctacccgaacgcccctacccgtttgtttccttttacggtcccggtaccggggaaagaaaacggtccncccctacccgttcctaccgtcggaccggacgggacctagtacgaagtacgttaacgttaaaccaacttcgttcggtaccgttacggtaccaaacgacgtaaaccgtcgaccgtacgcctaccgcgtccttccgtanacgttctatcgtactcgactacgaacccgaacggtcggaccctagccgtacacctaccgacgtccgtaaggtcgtacggcggtacggtggtcgggttacgacgggtactaacggttccttaccgaccgttacctaacccgacttaccgaccgacccggtaccgtacgaaccggttcgacgttcggtaaaggttccttacggtttacgtttactttttagtcgtttccgtgggttaccggtacgtacgaaccgttcccgtccggtttcccgttcgttaccgttaccgggttacgggaccgttaaccggacgtgtcgtacgaacgtntaccggaaagtccgtcgaggtccaacgttgacccctgtactttcgaccttcgtcgtaccc

SEQ ID NO: 277372 - DNA, 709 bp, Homo sapiens
  misc_feature: GYAE6OF01AQONF.29.35.D02.1.454.CMB.1.raw
  modified_base (202)..(202): a, c, t, g, unknown or other
  misc_feature (202)..(202): n is a, c, g, or t
tcagatagagtactcacgaccggtgctcgatttagcacacgatagttgggtttggggaggaactgctcagttaggacccagacggaaccatggaagccccagctcagcttctcttcctcctgctactctggctcccagataccagcggagagattgtgttgacacagtctccagccaccctgtcttgtctccgggagaaagngccacctctcctgcagggccagtcagagtagttaacaactacttggccttggttaccaacagtaaaccctggaccaggcctacccgaggcctccgtcatctatgatcgcactccaagacgggccacgtcggacgactccgagccgaggttcagtggcaggttcgggtctaggggactacggtacttcgacctcgtaccacctacgtaccgacggtacccgaccgtaacggaccgtaccgtagggtaacgggtacttccggttacggttaccggtttttaactttaacggtttcggttaccgtttcggggtaccggtttaacggtaccgtaaaccggttccgggtccccgtttaaccccggttccgttacccggtttttccgggaacccggtacggggtaacccgtaacgggtccggttacggaacggtacgtacggtaacggtaccgtaacggtcggtacggtacgtaccgaccgtactacggttacttcgttcgttccgttacccg

SEQ ID NO: 277373 - DNA, 592 bp, Homo sapiens
  misc_feature: GYAE6OF01C5HQA.29.35.D02.1.454.CMB.1.raw
  modified_base (200)..(200): a, c, t, g, unknown or other
  misc_feature (200)..(200): n is a, c, g, or t
  modified_base (293)..(293): a, c, t, g, unknown or other
  misc_feature (293)..(293): n is a, c, g, or t
  modified_base (573)..(573): a, c, t, g, unknown or other
  misc_feature (573)..(573): n is a, c, g, or t
tcagatagagtactcacgaccggtgctcgatttagcacacgatagttgggtttgggggaggaactgctcagttaggacccagacggaaccatggaagccccagcccagcttctcttcctcctgctactctggctcccagataccagcggagagattgtgttgacacagtctccagccaccctgtcttttgctccgggganaaagcgccaccctctcctgcagggccagtcagagtgtaacaactacttggcctggttaccaacagaaacctggaccaggctccgaggctcctnatcatgatgcatccaagacggccactgcatcccagccagttcagtgcaggtggctggactagtactcactctacactatcacgccgtactacgacgtccgtaggaagtacttcgttcgttaccggtttactttagtttcggttcggtttcgggtacgttacgtacgtaacgtccgtcccgttacccgtcttaccgttttacgggccgtacgggtaaccgtaacgtcgtaggtacgtagtacgacggacgtacgtggtggcgtcgaccgactacgttactnttcgttcctcgttaccccg

SEQ ID NO: 277374 - DNA, 649 bp, Homo sapiens
  misc_feature: GYAE6OF01AMAVL.29.35.D02.1.454.CMB.1.raw
tcagatagagtactcacgaccggtgctcgatttagcacacgatagttgggtttgggggaggaactgctcagttaggacccagacggaaccatggaagccccagctcagcttctcttcctcctgctactatggctcccagataccagcggagagattgtgttgacacagtctccagcccaccctgtctttgtctccgggagaaagacgccaccctctcctgcagggccagtcagagtgttaacaactacttggcctggttaccaacagaaacctggccaggcctcccgaggcctcctcatctatgatgcactccaacgacgggcccacgtggccactccccgagccgtaggttcaggtggctagggtgggtcgttaggggacctaggtacctttccgaccttcctaccaccactccgacgtcccgaccgtacggcgtccgtacggtaggtactttcgttcggttaccgttttagtttacgtttgttcgtttgggtaccgttacgtcgtaaccgtccggtcccgttccccggttccgttaccgttttcgggacccggtaacggggtaacccgaacggtccggtagggacgtacgtacgaacggtacgtaacgtggtcggctcgccgacctacttcctcgttcgttctaccg

SEQ ID NO: 277375 - DNA, 903 bp, Homo sapiens
  misc_feature: GYAE6OF01DH5BA.29.35.D02.1.454.CMB.1.raw
  modified_base (240)..(240): a, c, t, g, unknown or other
  misc_feature (240)..(240): n is a, c, g, or t
tcagatagagtactcacgaccggtgctcgatttagcacacgatagttgggtttgggggaggaactgctcagttaggacccagacggaaccatggaagccccagctcagcttctcttcctcctgcctactctggctcccagataccagcggagagattgtgttgacacagtctccagccaccctgtctttgtctccgggagaaagacgcccaccctctcctgcacgggccagtcagagttnttaacactacttggcctggttccaacagaacctggccaggcctccaggctcctcatctatgatgcactccaacgacgggcctacctgggacaactccccaggtacccgtaacgggttcaaggttcgggacgtacgggttcgggggttccgtgggggtaaccctaacgggtacctttacccgacctttaccctacccgtaacccgtagttcccgaacggtcccggtaccctaacggtaaccggtacccgttacgggtaacgggtacgtttaccgtttacccgggttacccggtttttttaacgttttaacgttttccgggttttaccgggttttacggggtaccggtttaaaccggtacccgtaaacccggtttcccgggttacccccggtttacccccccgggtttacccgtttaaccgggtttttttacccggggaacccccggggttaaaccggggggtaacccccggttaaacggttacccgggttaaccggggttaaacgggtaaccggtttaaccgggtaaacccgggtaaacccgggttaaacccgggtttaccgggttacgggggttaccccgttacggttaccccggtaaacccccttaacgttttacccgtttacccggttttccccgttttaccccgttttaaccccccccgg

SEQ ID NO: 277376 - DNA, 828 bp, Homo sapiens
  misc_feature: GYAE6OF01AVEC6.29.35.D02.1.454.CMB.1.raw
  modified_base (220)..(220): a, c, t, g, unknown or other
  misc_feature (220)..(220): n is a, c, g, or t
  modified_base (290)..(290): a, c, t, g, unknown or other
  misc_feature (290)..(290): n is a, c, g, or t
tcagatagagtactcacgaccggtgctcgatttagcacacgatagttgggtttggggaggaactgctcagttaggacccagacggaaccatggaagccccagctcagcttctcttcctcctgctactctggcctcccagataccaggcgggagagtatttggtgttcgaccactagtcctccagccctacccttggttcctttggtccgtaccggggaanaaaacggcgccctacccttctccgtgcgacgggccagtcagtgtataacactcgttggccttgtaccaanacgaaccgtcggccacggcctacccgaggtcctcctcacttctatgatgccataccgaacgcggtcctacgtggaccacgtccacggtaccgttagggttaccagggtcgggacgtaggggttccgggtacggttacggggaactacggttaccttaccctacccgttaccgtacctaaccgtaccgtaccgacccggtacccgtacccgtaacgggtaccgtaccggttacgggtaacgggttaccgtttacggttaccgtttttacccggttttttaagtttccggttttacggggtttaccgggtttacggggttaccggtttacggggtacccttaaccccgggtttcccgggttcccccgtttaaccccgggtttaccgttttcccggggttttaccgggaacccgggttaccggggtaacccgtaacgggtcggttaaccgggagtaccggttacggaacggtaccgttacggtagggtcggtacgtccgtaacccgtacgtaccgtttacttcgttccccgtttctacccg

SEQ ID NO: 277377 - DNA, 717 bp, Homo sapiens
  misc_feature: GYAE6OF01DSXA3.29.35.D02.1.454.CMB.1.raw
  modified_base (196)..(196): a, c, t, g, unknown or other
  misc_feature (196)..(196): n is a, c, g, or t
  modified_base (209)..(209): a, c, t, g, unknown or other
  misc_feature (209)..(209): n is a, c, g, or t
  modified_base (258)..(258): a, c, t, g, unknown or other
  misc_feature (258)..(258): n is a, c, g, or t
  modified_base (303)..(303): a, c, t, g, unknown or other
  misc_feature (303)..(303): n is a, c, g, or t
tcagatagagtactcacgaccggtgctcgatttagcacacgatagttgggttgggggaggaactgctcagttaggacccagacggaaccatggaagccccagctcagcttctcttcctcctgctactctggctcccagatacccagcggagagtattgtgttgacacagtctcagccacctgtctttgctcggganaagcgccacctcncctgcaggccagtcagagtagtaacaactacttggccttggtaccaaanaacgtaaaccgtcggaccagggtcctacccgtaggtcctcccgtntacttctatgaatcgactactaccgaaacgcggcctagtcggctaccgtccccgaagtccgtaggttcaggttcgaccgtagggtcggtctagggacaggtaccttcacgttccaccactacgtccgacgtccgtaccgtacggacgtaccgtacggtacggttacttccgttacggttaccgttttagtttacgttcggttaccgttacggggttccgtaacgtaccgtaaccggttaccggtccccgttacccggttacgtttaccggtttccgggaccggttaccgggaacgtacggtacgtacggtaacgtacgttaccgaaacggtaaccggttagttacgggtcggtacccgttaccggacccgttaccgtacccgttacggtttcccgttaccgttaccgttacccg

SEQ ID NO: 277378 - DNA, 926 bp, Homo sapiens
  misc_feature: GYAE6OF01CEAQF.29.35.D02.1.454.CMB.1.raw
  modified_base (201)..(201): a, c, t, g, unknown or other
  misc_feature (201)..(201): n is a, c, g, or t
  modified_base (258)..(258): a, c, t, g, unknown or other
  misc_feature (258)..(258): n is a, c, g, or t
tcagatagagtactcacgaccggtgctcgatttagcacacgatagttgggtttggggaggaactgctcagttaggacccagacggaaccatggaagccccagctcagcttctcttcctcctgctactctggctcccagataccagcggagagattgtgttgacacagtctccagccacctgtctttgctccgggagaaagngccaccctctcctgcagggccagtcagagtgttaacactacttggcctggtaccaanagaaacctggccaggcctcccaggcctcctcatctatggatcgcactaccaacgcgggaccctacgtcggacactccccgagccgtaggttcaggtcggactagggttggggtacgtggggaactacggtacctttaccgaccgttcctacccgtaacccgtacgtacccggtaacccgggtacccccggttacccgttaaaccgggtacccgggtacccccggttaaggggtaaacccggggtttaaaccgtttttacccgggtttaccgggttttaacccccgggttttttttaaacgtttttaacggttttttaccggggttttaccggggtttttaccgggggggttaacccggtttaaaccgggtaaccccgggtttaaacccggtttcccggggtttacccccccgttttaccccccgggttttaacccggttttaaccccggggtttttttaccgggggaaccccccggggttaaacgggggggttaaaccccccgtaaaggggtttaaccccgggtttacggggtaaaccgggttaaccgttaaccgggaaaccgggttaaacccgggtaaaccggtttacgggttccgggtacccgtacggtaaccccgttaacgttaacccgttccggtttaccgtttcccgtttcgttaacccccgg

SEQ ID NO: 277379 - DNA, 779 bp, Homo sapiens
  misc_feature: GYAE6OF01CJYMN.29.35.D02.1.454.CMB.1.raw
  modified_base (205)..(205): a, c, t, g, unknown or other
  misc_feature (205)..(205): n is a, c, g, or t
tcagatagagtactcacgaccggtgctcgatttagcacacgatagttgggtttgggggaggaactgctcagttaggacccagacggaaccatggaagccccagctcagcttctcttcctcctgctactctggcctccagataccagcggagagattgtgttgacacagtcctccagcccaccctgttctttcgtcgtaccggganaaagcgccctaccctctcctggacacgggccagtcaaggtacgttacttaaacacttacgttcggtcctggttacccaaagacgtaaacccgtggaccaaggtcctacccgacggtcctcctacgattctaagttgatcgactactacccgaaacggtcgggaccctagtcggacctaaccgtcccgaacggaccgtaaggttcaaggggttcgcgtaagggttcggtacgtacgggaacaacgtaccttcgaccttactacgaacctgtaccgacgccgtacgtaacggtacgtacccgtggtaacgttcgttacgttcggtttaccgttttagtttacggtttcggttccggtttacgggtaccgtaacgtaccgttaaccggttcccggtaccccgtttacccggttaccgttaccgggttttaccgggacccgggttaacgggtaaccgtacggtaccggttacgggtaacgtaaccgtaccggtaaacggtaaccggtaacggttcgggtccggtacgttaccgtaaccgtaacctacgtttccggtaacttttccgtccgtttacccg

SEQ ID NO: 277380 - DNA, 745 bp, Homo sapiens
  misc_feature: GYAE6OF01C303E.29.35.D02.1.454.CMB.1.raw
  modified_base (261)..(261): a, c, t, g, unknown or other
  misc_feature (261)..(261): n is a, c, g, or t
tcagatagagtactcacgaccggtgctcgatttagcacacgatagttgggtttggggaggaactgctcagttaggacccagacggaaccatggaagccccagctcagcttctcttcctcctgctactctggctcccagataccagcggagagattgtgttgacacagtctccagccaccctgtctttgctccgggagaaagacgccaccctctcctgcaggccagtcagagtgttaaacactacgttggcctggttccaanacgaaacctggccaggctcccaggcctcctcatctatggatgacataccaacgacgggccacgtcggctaactccccagccctaggttcaggttcggacgtagggttcggggtcgtaggggactaacggtacctttcaccgttcgaccaccctataccgacgcccgtaccgtacgaccggtccgttaggtaacggttactttacggttacggtttacccgtttttagtttacgttttacggtttccgtttcgggggttaccgtttacggaccttaaaccggttcccggtcccggtttaccccggttaccgttttaccggttttaccggggacccggtaacgggggtaacccctaacgggtccggttaacggtaacgggtaaccgttacggaaaccgggtaaccggtaacggtttacgggttccgggtaccgttcggaccctaacccgttcgttaccgtttacgtttaccgtttcgttaaccccg

SEQ ID NO: 277381 - DNA, 767 bp, Homo sapiens
  misc_feature: GYAE6OF01DDZ0T.29.35.D02.1.454.CMB.1.raw
  modified_base (143)..(143): a, c, t, g, unknown or other
  misc_feature (143)..(143): n is a, c, g, or t
  modified_base (152)..(152): a, c, t, g, unknown or other
  misc_feature (152)..(152): n is a, c, g, or t
  modified_base (196)..(196): a, c, t, g, unknown or other
  misc_feature (196)..(196): n is a, c, g, or t
  modified_base (202)..(202): a, c, t, g, unknown or other
  misc_feature (202)..(202): n is a, c, g, or t
tcagatagagtactcacgaccggtgctcgatttagcacacgatagttgggtttgggggaggaactgctcagttaggaccagacggaaccatggaagccccagctcagcttctcttcctcctgctactctggctccagataccngcggagagnttgtgttgacacagtctccagcccacctgtctttgtcgtcgganaaagcnccacctcgtctgcagggccagtcagtagtcgttaaacaactacgttggcccttaggttacccaaacgaacgtaaaccgtggtaccgaggcctacccgaggtctcctacatctagtgactgcactaccgaacgcggaccacgtcggactacgtacccgacgaccgtacggttacgacgtggtacgtagggttcggggtacgtaggggtaacacgggtactttaccacttaccgtacctaaccgtacgttaccgaccggtacccgtaccggttaacgaccggtaccgttacgggtaacggttaccgtttacgttacggtttaccgtttttacgttttacgtttacggtttacggtttcggggtttaccgttaacgggtacctaaccggttccggttaaccccttcccggttccgtttaaccgggttttccgggaacccgggtaaccggggttaacccggtacggtaccggtacggaacgtacgtaccgtaacggtaaccggtaacgttacggtcggtaccgtacgtacccgtaaccgtaccgttacgttcgtaccgtttacgtcccg

SEQ ID NO: 277382 - DNA, 748 bp, Homo sapiens
  misc_feature: GYAE6OF01EZVKV.29.35.D02.1.454.CMB.1.raw
  modified_base (212)..(212): a, c, t, g, unknown or other
  misc_feature (212)..(212): n is a, c, g, or t
  modified_base (217)..(217): a, c, t, g, unknown or other
  misc_feature (217)..(217): n is a, c, g, or t
  modified_base (225)..(225): a, c, t, g, unknown or other
  misc_feature (225)..(225): n is a, c, g, or t
tcagatagagtactcacgaccggtgctcgattttagcacacgatagttgggtttaggggagaactgctcagttaggtacccagacggaaccatggaaggaccccgagtctcagcttctcttccgtcctgctactctggctacccaagataccagcggagagtatttgtgttgacacgaggtctccacgccacctggtctttgtcctcggganaaagngccacctncctgcagggccagtcagagtcgttaacaactacttcggccttcggtccaacagaaacctggccaggctcccgaggcctcctcatctatgatgctactccgaaggacgggccacgtcggaccaccgtccccgaaggtccgtaagggtttccgaaggttcggacgtaggggttcgggttacgttacggggaactaacgggtaacctttcgaaccgttaccttaccgaaccctaacgttaccgaacggtacccgtaccgtaacggacgacctaggtaacgtacttacgtacgttaccgtttaacgtttaacgtttacgttacgtttacgggtaccgttaacggtaccgtaacgttcggtcccttccccgttaccgtttacgtttttaccgggacccggtaaccgggtaaccgtaacggtacggttacgggtaacgtacgttaaccgtaacggtaaccggtaacgttcggttacggaccgtaccggaccgtaaccgtacgttcgttcgtttccgtttcgttaacccg

SEQ ID NO: 277383 - DNA, 805 bp, Homo sapiens
  misc_feature: GYAE6OF01DCNHU.29.35.D02.1.454.CMB.1.raw
tcagatagagtactcacgaccggtgctcgatttagcacacgatagttgggtttggggaggaactgctcagttaggacccagacggaaccatggaacgcccagctcagcttctcttcctcctgcttactctggctccagactaccagcggagagtattgtgtgacacagtctcacgcctaccttgttctttggccgtaccgggaagaaacgcgtccaccctctcctcggcgacgggcctagtcgaagtagttaacgttaacaaacgttcgttacggccgttcggttaccaacgtaacgaaaccgtgaccgacggtcctccgacggtcctacctacgtacgtactaagtacgtaactacggaccttaaccgtaccgaaaccggacgggtaaccctaccggtacggaccttacccgtaacccgtacggaccgtttaaccggtaccggacggtttacggacgggtaaacgggttcgggggttaacgtacggggtaacgtacggtaacctttaaccgacctttccgtaaccccgtaacgttacctccgacccgggtacccggtaacgtacggaaccggtccgttaagggacgtttaccgtttacgttcggttttaaccgtttaagtttcgggttttacgcgggtttcggaacctttcggaacctcgggttccgtaaccgtcccgtttaggtccgggtttacggaaccgcgggaaccttacgcggtaagaccggttacgccgttaagggaaccgttagtcgggtcgtactacggtccctaacgttcgtccgttccgttaccgtcttacccg

SEQ ID NO: 277384 - DNA, 718 bp, Homo sapiens
  misc_feature: GYAE6OF01DB8X8.29.35.D02.1.454.CMB.1.raw
  modified_base (196)..(196): a, c, t, g, unknown or other
  misc_feature (196)..(196): n is a, c, g, or t
tcagatagagtactcacgaccggtgctcgatttagcacacgatagttgggtttgggggaggaactgctcagttaggacccagacggaaccatggaagccccagctcagcttctcttcctcctgctactctggctccagataccagcggagagattgtgttgacacagtctccagccacctgtctttgtctcggganaaagcgccaccctctcctgcagggccagtcagtagttacgttaaacaacgttacgttggccttggttacccaaacgaacgaaaccgtgggcccaggcctcccgaggcctcctcaatctagtgaatgacactaccgaaacgacgggccctaacgtcggacacgttaccccaggaccgtaggttccaggtcggacgtagggttcggggtcgttaggggaactacgtacttcacgttcacaccactaccgaccggcccgtaccgtaacggtaccggtcgtacgggtacggttactttcggttacggtttaccgttttagtttagttttcggttaccggttgggtaccggttacgaccgtaacggttccggtccccgtttaccgttaccgttaccggttttaccgggaccggtaccgggggtaacctagggttccgtaggggtacgtacgttacggaacgtaccgtaacggttcggtacggtcgtacgaccgtaactacgttacgttcgttccgttccgttacccg

SEQ ID NO: 277385 - DNA, 687 bp, Homo sapiens
  misc_feature: GYAE6OF01E1407.29.35.D02.1.454.CMB.1.raw
  modified_base (300)..(300): a, c, t, g, unknown or other
  misc_feature (300)..(300): n is a, c, g, or t
tcagatagagtactcacgaccggtgctcgatttagcacacgatagttagggttgggggaggaacgtgctcacgttaggacccagacggaaccatggaagccccagcctcagcttctcttcctcctgctactctggctcccagactaccagcggagagattgtgttgacacagtctccagccacctgtctttgctccgggagaaagcgccaccctctcctgcagggccagtcagagtgttaacactacttggccttggtaccaacgacgaaacctggaccacggcctcccgaggcctcctnactctatcgatcgctactacccgaacgacgggaccctacgtcggacctacgtacccgagtccccgtaagggttccagggtcggactaggggttcgggtacgtggggaactacggtactttaccacgtcctaccgaccactccaccgtccgaccgtacgacgtccgtagacggtacttcgtacgttaccgttttattacgtttcggtttcgtttacgggtccgttagtacccgtaacgttccggtcccgttacccggttccgtttaccgtttccgggaccgtaacggggtacccacggtccgtaggacgtaacgtacgaacggtaaccgtacgttcgggtcggtacgtacgaccctaccgtacttaccgtctttcccgttattacccg

SEQ ID NO: 277386 - DNA, 888 bp, Homo sapiens
  misc_feature: GYAE6OF01CK1LU.29.35.D02.1.454.CMB.1.raw
  modified_base (150)..(150): a, c, t, g, unknown or other
  misc_feature (150)..(150): n is a, c, g, or t
  modified_base (160)..(160): a, c, t, g, unknown or other
  misc_feature (160)..(160): n is a, c, g, or t
tcagatagagtactcacgaccggtgctcgatttagcacacgatagttgggtttggggaggaactgctcaggttaggacccagaccggaaccatcggaagcccctagcttcagcttctcttcctcctgctactctcggcctccagataccnggcggagagnttggttgttgacactagttctccgagcccacctgtcgtttgtccgtaccgggaagtaaacgcgccctaccctcgtccgtggtcgacgggccaggtccgagtacgttaacgttaacctaacttacgttcggccctttcgggttacccaaacgtaacggtaaaacccttcggggacccgtagggtccccttaccccgtaacgggtcctttaccctactacgtttcctaagtcgtaacgttcggaccaccgtaacccgaaccggtaccgggacccgtacgggtccgacgtaccgtacccgacggtaccgtacggttaacaagggtcggtacggtaacggggttacgggttaaccggtaacggggtactacggttacctttcccgaccgtttaccgtaccgtaaccgtactacccgtaaccggcccgtaaccgtaacgaccgttaccggtaagggtaaccggttacgtttacccggttaacgttttaccggtttttaagtttcgttttcggttacccgggttagggttaaccgtaaccggtaaccgttaacccgggtcggttccccgttaaccgtttccggttaacccgggtttacgggacccggtaacgggggtaacctcggtaacgttagggactaaccggttcggaaaccggtccgggtaaaggtcggtccgtacgtcccgtaaccgttaccttactttacgggttcctttaccgttccgtttacccgg

SEQ ID NO: 277387 - DNA, 794 bp, Homo sapiens
  misc_feature: GYAE6OF01AYDRM.29.35.D02.1.454.CMB.1.raw
  modified_base (244)..(244): a, c, t, g, unknown or other
  misc_feature (244)..(244): n is a, c, g, or t
tcagatagagtactcacgaccggtgctcgatttagcacacgatagttgggtttgggggaggaactgctcagttaggacccagacggaaccatggaagccccagctcagcttctcttcctcctgctactctggctcccagataccagcggagagattgtgttgacacagtctccagcccaccctggttctttgtccgtccgggaagaaacgacgcccaccctctcctgcgacgggccagtcaagngtagtaacaactcgttcggccttaggttaccaaagaacgtaaaccgtggaccaggcctaccgaggtcctcctcactctaagtcgatcgactactaccgaacggcgggaccacggtcggacctaacgtccccgaggcccgtaaggttccaagggtggaccgtagggtcggggtcgtacggggacgtaacgtaccgttaccaccgttcctaaccaaccgtactaccggaaccggtcccggtaccgtaacggaccgtaccgtaggtaacggttacgtttaccggtaccggtttaccgtttttaagtttacggtttcggtttacggtttacggggtaccgttaacggtaccgtaaccgggttcccggttacccccgtttacccgggtttaccgtttaaccgggtttttccggggaacccgggttaacggggtaacccgtaagggtaccgtacggggtaacttaccgtaacggtaaccgtaacgggtaacgttcgggtaccggtcgtacgtacccgttaccgtaacgttccttcggttcccttacggttaccccg

SEQ ID NO: 277388 - DNA, 256 bp, Homo sapiens
  misc_feature: GYAE6OF01DE1RC.29.35.D02.1.454.CMB.1.raw
  modified_base (254)..(256): a, c, t, g, unknown or other
  misc_feature (254)..(256): n is a, c, g, or t
tcagatagagtactcacgaccggtgctcgatttagcacacgatagttgggtttgggacagacttcactctcaccatcagccgcctagagcctgaggattctgccgtttattattgtcttgggcgtagcaactggcctcccgtcacttttggccaggggaccaagctggagatcagacgaactgtggctgcaccatctgtcttcatcttcccgcatctgaagtactctatctgagcggctggcaaggcgcatagnnn

SEQ ID NO: 277389 - DNA, 777 bp, Homo sapiens
  misc_feature: GYAE6OF01AV3D9.29.35.D02.1.454.CMB.1.raw
  modified_base (723)..(723): a, c, t, g, unknown or other
  misc_feature (723)..(723): n is a, c, g, or t
tcagatagagtactcacgaccggtgctcgatttagcacacgatagttgggtttgggggaggaactgctcagttaggacccagacggaaccatggaagccccagctcagcttctcttcctcctgctactctggcctccagataccagcggagagattgtgttcgacacagtcctccacgcccacccttgttcctttggtccgtaccggggaagaaaacgcgccctaccctctcctgccgagggccagtcaggtagttacgtaaacaacgttacgttcggaccttacggttaccaaacgaacgtaacccgtggacccgacggtccctacccgaggtcctacctactacttctagtgactcgaccaactaccgaaacggcgggtaccacggtacggacctaacccgtcccggaacgtaccgttagggttaccgaaggtcgggtacgtacggggttcggggtaccggtaggggaacctaacggttacccttacgtaaccctccgtacaacctagtaccgaccgtcccgacgtacgaccggtcgtaggtacggttaccttcgtacgtttacgttttaattcgtttcggttacggttcgggtaacttacggaccctaaccgggttccggtacccctttacccggtacgtttacccggtttaccgggacccggtaacgggtaccaacggtgggtacgaacgacggttaaccgaaacggtaccgttacggngggtcccgtaacgtccgaaccgtaccgttattccgtttctaccttccgtacccg

SEQ ID NO: 277390 - DNA, 843 bp, Homo sapiens
  misc_feature: GYAE6OF01DQK4E.29.35.D02.1.454.CMB.1.raw
  modified_base (211)..(211): a, c, t, g, unknown or other
  misc_feature (211)..(211): n is a, c, g, or t
tcagatagagtactcacgaccggtgctcgatttagcacacgatagttgggtttgggggaggaactgctcagttaggacccagacggaaccatggaacgccccagctcagcttctcttcctcctgctactctggcctcccagataccagcggagagtattggtgttcgacactagtcctccagcccacctgttctttgtccgtaccgggaanaaacgacgcccctaccccttctccgtgaccgacgggtccctaagtccgaagtaggtttacgttaaaacctaacttacgttcggcccgttacgggttacccaaacgtaacgaaaccgtcggacccagggtccctacccgacggtcctcctacattctaatgatcgactaccgtaccgaaacggccgggtaccacgtcggacctaaccgtacccgacggaccggtaggttcgacggttcgggaccggtaggggttcgggtcggtaagggacctaacggttaccttaccgtacccttactcctaaccgtacgtaccgaccggtcccgaccgtacggaccgtcccggttaaggtacggttacgttttccggttaccgtttaccgtttttaagtttcggtttacggtttaccgggtttacgggtaccggtaacggttaacccgtaccggttcccgggttacccccgtttaccggtttaccgtttacccgggttttaccgggaacccgggtaccggggtaaccgtacggtaccggtagggtaaccgtacggtaaccgaacggtaaccggtacggttcggtccggtaccgttaccgacccgtaaccttcgttacccttcgtttccgttccgttaccccg

SEQ ID NO: 277391 - DNA, 731 bp, Homo sapiens
  misc_feature: GYAE6OF01BOT2K.29.35.D02.1.454.CMB.1.raw
  modified_base (201)..(201): a, c, t, g, unknown or other
  misc_feature (201)..(201): n is a, c, g, or t
tcagatagagtactcacgaccggtgctcgatttagcacacgatagttgggtttgggggaggaactgctcagttaggacccagacggaaccatggaagccccagctcagcttctcttcctcctgctactctggctcccagataccagcggagagattgtgttgacacagtctccagcccaccctgtctttgtctccgggganaaagcgcccaccctctcctgcagggccagtcagtagtagttaaaccactacgttggccttggtaccaacagaaacctggccaggcctcccgaggtcctcctcactctatgtatcgcactaccgaacggacgggacccacgtcgggccactccccgacggtacctagggttaccgaggtcggacgtagggtcggggttacgcgggtaacgacgtacctacgtacctcctacgacctacgtccgaacgcccgtaccgtacggaccgtccgtaggtacggttacctttcgttacggtttaccggtttttatttagtttccggttacggtttcggggaccgttacggtacccgttaaccggtccgggttacccccgttccccggtttacctttaccgggtttacccggggaccggtaacgggggtaccctaacggtcccggtaagggtacgtaaccggtccgtaaaggtaccgtaacggttgggtccggcttccggacctaccgtacgttccttcggtttccttccgttacccg

SEQ ID NO: 277392 - DNA, 716 bp, Homo sapiens
  misc_feature: GYAE6OF01ERBH8.29.35.D02.1.454.CMB.1.raw
tcagatagagtactcacgaccggtgctcgatttagcacacgatagttgggtttggggaggaactgctcagttaggacccagacggaaccatggaacgccccagctcagcttctcttcctcctgctactctggctcccagactaccagcggagagattgtgttgacacgagtcctccagcccacctgttcctttgtcgtccgggaagaaacgcgccctaccctctccctgcgacgggccagtacagtagtacgttaaacaacttacgttcgccttggttaccaaacgtacgaaacccgtcggacccgacggcctacccgtacggccttcccgtactacttccttaagtcgaacttcggacctaactcccgaaaccggacgggtacctacggtcgacctactcccgaacgtccgtaagttcgacggtcggtaccggtagggtcggggttcgaacgggtactaacggttacctacgtacctcctaaccaccgtactccgaaccggcccgtaccgtagaccgtcgtaggtacgtacgttcgtacgtttacggtttactttaggttcgttcgtacggtacgttacggtaacctacggtccgttccgtcccgttacgttaccggtttcggaccggtacgggtacgtacggacgtaggaacgtacgtacggacgtacgtacgtcgtcggcgtacgacgactacgttaccttgtctcgttaccc

SEQ ID NO: 277393 - DNA, 634 bp, Homo sapiens
  misc_feature: GYAE6OF01C63BC.29.35.D02.1.454.CMB.1.raw
  modified_base (193)..(193): a, c, t, g, unknown or other
  misc_feature (193)..(193): n is a, c, g, or t
  modified_base (246)..(246): a, c, t, g, unknown or other
  misc_feature (246)..(246): n is a, c, g, or t
tcagatagagtactcacgaccggtgctcgatttagcacacgatagttgggtttggggaggaactgctcagttaggacccagacggaaccatggaagccccagctcagcttctcttcctcctgctactctggctccagataccagcggagagattgtgttgacacagtctcagccacctgtcttgtctcggganaagcgccacctctcctgcaggccagtcagatgtaacactcttggctgtccaanaaagaactggccaggctcccgggctcctcatctatgatcgcaatcccaaacacgggccacgtggcactcccagccaggttcaggttgctaggtcgggtcgtggactaggtctcaacttcgtacaccgtatccaacggtcccgaccgtagacggccttaggacggtacttcgtcggttaccgtttattacgtttagtcgttcggggcttacgacgtaacgttcgtccttcccggttcttaccgttttcgggaccgtaacggggacctaaggtccgtagggtacgtacgtaccgaacggtaaccgggaacgttagggttaccggtacgtttcgacccgttacccgtaactttcccggttaggtttaccttacccggtacttttacccccg

SEQ ID NO: 277394 - DNA, 727 bp, Homo sapiens
  misc_feature: GYAE6OF01EE6PS.29.35.D02.1.454.CMB.1.raw
tcagatagagtactcacgaccggtgctcgatttagcacacgatagttgggtttggggaggaactgctcagttaggacccagacggaaccatggaagcccagctcagcttctcttcctcctgcttactctggctcccagataccagcggagagattgtgttgacacagtctccagcccaccttgttctttgtcgtccgggaagaaagcgccaccctctcctgcgacgggccagtcgagtagttagttaaaccaacgttacgttcggccttacggttaccaaacgaacggaaaacccgttcggaccgtacggcctacccgacggtcctcctactactcttagtacgtatacgactaactaccgaaacgaccgggtcctaacgtcggacctactacccgaacgtccgtaggttcgacggtcggcggtacggtcggggtcgtagggaacagttacctacgttacctcctaccgtaaccgtcaccgtacggcccgtaccgttacgacgtccgtagggagtactttcgtcggttactttagtttcgttaggttcgtttcgggactagaccgtacgtcggtccgttcccgttaccgttacgtttccgggaccgggtaacggggaacctacgggtacgttagggaacgtaccgtacgtaacgggacgttaacggtcgggttcgccgtaacggacccttaacgtctttaccggtttcgtaccctttcggtaacccg

SEQ ID NO: 277395 - DNA, 629 bp, Homo sapiens
  misc_feature: GYAE6OF01D5E87.29.35.D02.1.454.CMB.1.raw
  modified_base (144)..(144): a, c, t, g, unknown or other
  misc_feature (144)..(144): n is a, c, g, or t
  modified_base (267)..(267): a, c, t, g, unknown or other
  misc_feature (267)..(267): n is a, c, g, or t
  modified_base (391)..(391): a, c, t, g, unknown or other
  misc_feature (391)..(391): n is a, c, g, or t
tcagatagagtactcacgaccggtgctcgatttagcacacgatagttgggtttgggggaggaactgctcagttaggacccagacggaaccatggaagccccagctcagcttctcttcctcctgctactctggctccagataccngcggagagattgtgttgacacagtctcagccaccctgtctttgtctccgggagaaagacgccaccctctcctgcagggccagtcagacgtgttaacaacttcttaggccttcggttaccaaanacgaaaccgtggaccaggcctcccaggcctcctacatctatgatgacactccaacgcgggccacgcgtacactacccgagtcccgaggttccaggtcggactaggttcggggtactcggggaanacgtacctttcaaccgttcctaccaacctataccgacgcccgtacctacgacgtccgcggtaggtacttcgttcgttaccgttttagttgtttcgttcgttgggtacgtacgtaccgtacgtcggtccctccgttccgttacgttttccggaccggtacgggaccacgggtcgtacggacacgtacgacgaacgtacttcggtcgtacgtcgacgtacacttcgtcgttctcttaccg

SEQ ID NO: 277396 - DNA, 771 bp, Homo sapiens
  misc_feature: GYAE6OF01CV2H0.29.35.D02.1.454.CMB.1.raw
  modified_base (698)..(698): a, c, t, g, unknown or other
  misc_feature (698)..(698): n is a, c, g, or t
tcagatagagtactcacgaccggtgctcgatttagcacacgatagttgggtttgggggaggaactgctcagttaggacccagacggaaccatggaagccccagctcagcttctcttcctcctgctactctggcctccagatacccagcggagagattgtgttgacacagtctccagcccaccctgtctttgtcgtaccgggagaaagcgcccaccctctccgtgcgacgggcctagtcaaggtagttacgttaaacaacgttacttgggcccttaggttacccaaacgtaacgtaaacccgttcgggaccgaacgggtccctaccccggtaaggtccttaccctacaacgttccttaaagttcggaacttacggacctaacgttacccgaaaacggtaccgggacccaacggttcgggacctacccgtaccccgaggtacccgttaacgggttcaacggggttcggaccgtaagggttcggggtaccgtaggggaacctacggtactttaccaccttcgtaaccctactacgtaccgaccggacccgtaacgtaggtaccgtccgtaggacggtttactcgttacgtttaccgtttattacgttcggtaccggttgggactttacggactaccgtcggtcccctacgttcgtttaccggttacgggcccgtaacgggaccctaggtcgtacgggtaanaccgttaagaaccggtacgttaaccggtggtacggctacggaacctcctacgttcgttacgcctttccgtacc

SEQ ID NO: 277397 - DNA, 645 bp, Homo sapiens
  misc_feature: GYAE6OF01CYXK2.29.35.D02.1.454.CMB.1.raw
  modified_base (264)..(264): a, c, t, g, unknown or other
  misc_feature (264)..(264): n is a, c, g, or t
tcagatagagtactcacgaccggtgctcgatttagcacacgatagttgggtttgggggaggaactgctcagttaggacccagacggaaccatggaagccccagctcagcttctcttcctcctgctactctggctcccagataccagcggagagattgtgttgacacagtctccagcccaccctgtctttgtctccgggagaaagagccaccctctcctgcagggccagtcagagtgttaaacaactacttggcctggttccaanagaacctggccaggcctcccgaggctcctcatctatgatcgcactaccaacgacgggaccacgtggccactccccgagcccgtaggttccaggtcgggtacgtagggttcggggtacgtaggggaacctacggtacctttcaccttcctccaacctacgtccgacgcccggtaccgtacgacgtccgtacggtaggtactttcgtacgttccgttttatttacgtttggttccgttgggtccggttagtaccgtaacgttcggtacccttccccgtcgttacgttttcggaccgtacggggtaaccgtacgcgtaggacgtacgtacgacggtacgtaacgtggtggcctacgacctacctacttctacgttcttctaccg

SEQ ID NO: 277398 - DNA, 599 bp, Homo sapiens
  misc_feature: GYAE6OF01CMVLP.29.35.D02.1.454.CMB.1.raw
  modified_base (198)..(198): a, c, t, g, unknown or other
  misc_feature (198)..(198): n is a, c, g, or t
  modified_base (267)..(267): a, c, t, g, unknown or other
  misc_feature (267)..(267): n is a, c, g, or t
  modified_base (310)..(310): a, c, t, g, unknown or other
  misc_feature (310)..(310): n is a, c, g, or t
  modified_base (352)..(352): a, c, t, g, unknown or other
  misc_feature (352)..(352): n is a, c, g, or t
  modified_base (417)..(417): a, c, t, g, unknown or other
  misc_feature (417)..(417): n is a, c, g, or t
  modified_base (422)..(422): a, c, t, g, unknown or other
  misc_feature (422)..(422): n is a, c, g, or t
  modified_base (432)..(432): a, c, t, g, unknown or other
  misc_feature (432)..(432): n is a, c, g, or t
  modified_base (449)..(449): a, c, t, g, unknown or other
  misc_feature (449)..(449): n is a, c, g, or t
tcagatagagtactcacgaccggtgctcgatttagcacacgatagttgggtttgggggaggaactgctcagttaggacccagacggaaccatggaagccccagctcagcttctcttcctcctgctactctggctcccagataccagcggagagattgtgttgacacagtctccagccacctgtctttgtctccggganaagagcccacctctcctgcgagggccagtcagagtagttaacaactacgttggccttggttacccaaanacgaaacctggacccaggcctccgagcctcctcattctttggnccatcctaccgagggccactcggcactcccgagtaccggttnaggtcgcgaggttcgggtctgggacacgtacttcactctcacatcagcagcgtgggcctagaagntcganagtctaggtnttacttatgtctaactntaattgttgtttcgttattacgttcgtaccttccgtacccgtttcgggacccgtaacggtacgtaccgggtcgtaggtaacgttaaacgtaaacggtacgttcggtggtacctagacccgtacttacgttcttcgtttacctcgtacccg

SEQ ID NO: 277399 - DNA, 792 bp, Homo sapiens
  misc_feature: GYAE6OF01BPC3Z.29.35.D02.1.454.CMB.1.raw
tcagatagagtactcacgaccggtgctcgatttagcacacgatagttgggtttgggggaggaactgctcagttaggacccagacggaaccatggaagccccagctcagcttctcttcctcctgctactctggcctcccagataccaggcggagagatttgtgttgacacagtctccagcctaccctgttctttgtctccgggagaaacgcgcccaccctctcctgcgagggccagtcagtacgtacgttaaacaacttcgttcggccttaggttacccaactacggaaaaccctggacccaaggcctacccgaggcctccgtacacttctatgtactcgacaactaccaacgtacgggaccctacgtacgcacgtaccccgagtaccgtaaggttccgaaggtcggacgtaagggttgggtaccgtggggacctaaggtaccttcgaaccgtctaccgacctatccgacgtacccgtaccgtacggacgtacccgtaggtaacggttacgtttccgttacggtttacccgtttttatttacgtttcggtttccggtttacggggtaccgttaacggtaccgtaaccgttccgggttccccctttaccccggtttaccgtttaaccgggtttttacccgggaacccggtaacggggtaacccgaacggttaccggttagggaacgttacgtaaccggtaacggtaaaccggttaacggttcgggttaccggtaccgttaccggtaacccgtaccgttaccgtttacgttcggtttaccccttcgtttaccccg

SEQ ID NO: 277400 - DNA, 690 bp, Homo sapiens
  misc_feature: GYAE6OF01BBPH6.29.35.D02.1.454.CMB.1.raw
  modified_base (151)..(151): a, c, t, g, unknown or other
  misc_feature (151)..(151): n is a, c, g, or t
  modified_base (168)..(168): a, c, t, g, unknown or other
  misc_feature (168)..(168): n is a, c, g, or t
  modified_base (199)..(199): a, c, t, g, unknown or other
  misc_feature (199)..(199): n is a, c, g, or t
  modified_base (271)..(271): a, c, t, g, unknown or other
  misc_feature (271)..(271): n is a, c, g, or t
  modified_base (301)..(301): a, c, t, g, unknown or other
  misc_feature (301)..(301): n is a, c, g, or t
  modified_base (307)..(307): a, c, t, g, unknown or other
  misc_feature (307)..(307): n is a, c, g, or t
  modified_base (310)..(310): a, c, t, g, unknown or other
  misc_feature (310)..(310): n is a, c, g, or t
  modified_base (621)..(621): a, c, t, g, unknown or other
  misc_feature (621)..(621): n is a, c, g, or t
tcagatagagtactcacgaccggtgctcgatttagcacacgatagttgggtttggggaggaactgctcagttaggacccagacggaaccatggaagccccagctcagcttctcttcctcctgctactctggcctcccagataccagcgganagtattgtgttgacacngtctccagccacctgttcttgcctacggganaaacgcgcccaccctctcctgcgacgggccaggtcaagtagtacgttaacactcgttggccttggtaccaanacgaacctggccaggcctccgagcctcctnatctancgntcgaccactccgaacgacgggtacccacgttcggaccctccgtacccgacgtcccggtaaggtttacgaggggttccggcgttaaggggttccgggtcgtacggggacgtaaacggttccttacgtaccttccgtacccaacctaacgtcctaccgacccgtaccgtaacgcgtcccgtaggtaacgtcgtttcgtacgttaccgtttagtttacgttcgttcggttcggtcgtacgtacgttaccgtcggtcccttccgtcgttaccgtttcgggaccgtaacggggttacccaagggtccgtgggtaanacgtacgaacggtacgtacgtacgggtcgaccgttaccacgtactactagtttcctccgttcgtacccg

SEQ ID NO: 277401 - DNA, 696 bp, Homo sapiens
  misc_feature: GYAE6OF01BYN9K.29.35.D02.1.454.CMB.1.raw
  modified_base (304)..(304): a, c, t, g, unknown or other
  misc_feature (304)..(304): n is a, c, g, or t
tcagatagagtactcacgaccggtgctcgatttagcacacgatagttgggtttggggagggaactgctcagttaggacccagacggaaccagtggaagccccagctcagcttctcttcctcctgctactctggctcccagataccagcggagagtattggtgttgacacagtctccagcccaccctgtctttgtcctccggggaagaaagcgcccaccctctcctggccagggccagtcagagtgtaaccactacttggcctggtaccaagacgaaacctggccacggcctcccaggcctcctnatctatgatcgcactccgaacgcgggccactcggccactcccagccgtaggttcaggtcggcgtaggtcggggtactaggggactaggtaccttccgaccttcctaccacccgtactaccgaccgtcccggtaccgtacggacgtaccgtacggacggttacttcggttacggtttaccgtttttaactttacgtttcggttcgtttcggggtaccgttacgtaccgtaaccgttccggtcccgttccccggttccttaccggttttaccgggaccggtaacgggggtacccgtaacgggtcggtagggtaacgtacgtacgtaacggtacggtaacgttgggtcggtacgtacgcctaaccgtacgttaccgtcgtttccttccgtacccg

SEQ ID NO: 277402 - DNA, 635 bp, Homo sapiens
  misc_feature: GYAE6OF01BS6EO.29.35.D02.1.454.CMB.1.raw
  modified_base (201)..(201): a, c, t, g, unknown or other
  misc_feature (201)..(201): n is a, c, g, or t
  modified_base (262)..(262): a, c, t, g, unknown or other
  misc_feature (262)..(262): n is a, c, g, or t
  modified_base (297)..(297): a, c, t, g, unknown or other
  misc_feature (297)..(297): n is a, c, g, or t
tcagatagagtactcacgaccggtgctcgatttagcacacgatagttgggtttgggggaggaactgctcgagtttaggacccagacggaaccatggaagccccagctcagcttctcttcctcctgctactctggctccagataccagcggagagattgtgttgacacagtcctccagccacctgtctttcgtctccggganaaagcgccaccctctcctgcagggccagtcagatgtaaacactactggcctggtaccaaanacgaaacctggaccaggctacccgacggctcctanactcctatgatgactaactaccaacgaacgggaccaacgtcggactaacctcccgaagaccgtacggttccaaggttcgggaccgtacgggttcggggtccgtaggggaactaacgtaaccgtttccaactcccgttaccaaccgtaacttcgaacgccgtaccgtaagaccggacgtaggacggtacttcgtacgtccgttttatttactttggtcgttcgggtccgttaagtctaacggtcgtccttccgtacttacgtttcgggaccgtacggacaacgtcgtaggacgtatcgagtacgaagtcgtggctagcctaactatcgtcgtctgtacc

SEQ ID NO: 277403 - DNA, 799 bp, Homo sapiens
  misc_feature: GYAE6OF01EONW7.29.35.D02.1.454.CMB.1.raw
  modified_base (212)..(212): a, c, t, g, unknown or other
  misc_feature (212)..(212): n is a, c, g, or t
tcagatagagtactcacgaccggtgctcgatttagcacacgatagttgggttgggggaggaactgctcagttaggacccagacggaaccatggaacgccccagctcagcttctcttcctcctgctactctggctcccagataccagcggagagtatttgtgttgaacactagtcctaccgagccacccttgttctttgtccgtaccgggaanaaacgcgccctacctctctgacgacgggccagtcaagtagttagttaaccaatacgttggaccttggttaaccaaacgaacgtaaaccgtggacccgtacggccctccccgagggtcccttaccctacacttaccttaattggacttacgcctaacgttaccccgaaaacggacgggtaccctaacgtcgggacctcctaaccccgacggtaccgttacgggtttaccgagggtcggtaaccgtagggttccggggttcgacgggtactacgtacgtttaccgaccttcctaaccaccgtactccgacggtaccctaccgttaacggccgaccttaggtaccgttactttccggttacggtttaccgttttaatttacggttacgggttcccgtttagggtaccgtacgtaccgtaaccggtccgttaccccgttacccgtttacggtaccgttttacgggaacccgtacggggtaacctaacgggtcctaggggtaactaacgtaccgaaaggtaccggttaacgtcggtaccgggcttaccggacctaacccggattcccgtttcgttaaccgtccgttaacccg

SEQ ID NO: 277404 - DNA, 721 bp, Homo sapiens
  misc_feature: GYAE6OF01BRW8D.29.35.D02.1.454.CMB.1.raw
  modified_base (205)..(205): a, c, t, g, unknown or other
  misc_feature (205)..(205): n is a, c, g, or t
  modified_base (480)..(480): a, c, t, g, unknown or other
  misc_feature (480)..(480): n is a, c, g, or t
  modified_base (486)..(486): a, c, t, g, unknown or other
  misc_feature (486)..(486): n is a, c, g, or t
  modified_base (497)..(497): a, c, t, g, unknown or other
  misc_feature (497)..(497): n is a, c, g, or t
  modified_base (534)..(534): a, c, t, g, unknown or other
  misc_feature (534)..(534): n is a, c, g, or t
tcagatagagtactcacgaccggtgctcgatttagcacacgatagttgggtttgggggaggaactgctcagttaggacccagacggaaccatggaagccccagctcagcttctcttcctcctgctactctggctcccagataccagcggagagattgtgttgacacagtctccagcctacctgtctttgcgtaccgggagaagcnccaccctctcctgcgacgggccagtcgaagtagttacgttaaaccaacgtttacgttcggacccttggtacccaaacgaacgtaaaccgtcgggaccgaacggccctacccggaggtcccttccgtactacttccgttaatcggacgtacgactaaccgtacccgaaacggcggtacctacgtcggtacccacgtccccgacggtccgtaggttccgaggtcgtacgtggggtcggtacggaggaccgtagtacccgttacacgtcctaccaccngtaccncggtcccgtanacggcgtacgtaggacgttcttcgtcgttacgttttntacggtttcgcggttggaccgtacgtactaccgggttaccgcccgttaccgtcgtttacgggttccggaaccggtaacggtaccacggtcggttacggaacgttacgccggtaagaccgggttgtcggtacggtccgtaacgtaccctaacggttcttacccggttcgtttaaccgtacgttccccg

SEQ ID NO: 277405 - DNA, 684 bp, Homo sapiens
  misc_feature: GYAE6OF01BDSJX.29.35.D02.1.454.CMB.1.raw
  modified_base (217)..(217): a, c, t, g, unknown or other
  misc_feature (217)..(217): n is a, c, g, or t
  modified_base (359)..(359): a, c, t, g, unknown or other
  misc_feature (359)..(359): n is a, c, g, or t
  modified_base (364)..(364): a, c, t, g, unknown or other
  misc_feature (364)..(364): n is a, c, g, or t
  modified_base (469)..(469): a, c, t, g, unknown or other
  misc_feature (469)..(469): n is a, c, g, or t
  modified_base (479)..(479): a, c, t, g, unknown or other
  misc_feature (479)..(479): n is a, c, g, or t
  modified_base (657)..(657): a, c, t, g, unknown or other
  misc_feature (657)..(657): n is a, c, g, or t
tcagatagagtactcacgaccggtgctcgatttagcacacgatagttgggtttgggggaggaactgctcagttaggacccagacggaaccatggaacgccccagctcagcttctcttcctcctgctactctggctccagactaccagcggtagagtatttgtgttgaacacgagtcctccagccctaccgttgttccttttggccgtaccggggaanaaaacggtccgccctacccttgtccaggccgacgggcctagtcgaacgtagtttacgttaaaccaacttcggttcggccgtttaaggtccccaaagtaacgtaaaccgtcggtacgacggtcctaccgacggtcctaccgtnacttntataggtctcgacactacgaacgtcggaccacggtcactactccgacggccgtaggttcgaggttacggcgtagggtcggtacgcggtacagtctacgcgttacncgactcgacncggtcactgtacgtctaggtacttctcgtacgttcgtttatcgttgtcggtaggtacgtacgacgtacgtcggtccttccgtacgttacgggttccggacggtacggaccctagttccggagtacgtaacgtcgacggttaaccgtaggccggttacggccttcgaaccggtttaccnttttacggccttacgttccgttacccg

SEQ ID NO: 277406 - DNA, 914 bp, Homo sapiens
  misc_feature: GYAE6OF01DW87N.29.35.D02.1.454.CMB.1.raw
  modified_base (211)..(211): a, c, t, g, unknown or other
  misc_feature (211)..(211): n is a, c, g, or t
  modified_base (231)..(231): a, c, t, g, unknown or other
  misc_feature (231)..(231): n is a, c, g, or t
tcagatagagtactcacgaccggtgctcgatttagcacacgatagttgggtttggggaggaactgctcagttaggacccagacggaaccatggaagccccagctcagcttctcttcctcctgctactctggcctcccagatacccagcggagagtattggtgttgaacacagtcctccacgccacccttgttcctttgccgtccggggaanaaagcgcccaccctctccgngccgcgggccagtcagtagttacgtaaccaactcgttcggaccttcggttacccaaacgaacgtaaacccgtcggaccctaagggtccccttcccgaacggtcctcccgtacacttccgtagtacgtacgtcgaccgttaacacccgaacggacgggacctacgttcgggacctacgtacccgacgtccgtaggttcgaggtcggtacgtaggttcgggtacggtacggtacgtaaccggttacctttccgaccttccgtaaccgtaaccgtacgtaccgtaccggtaccccggtaccgtaaaccggtacccggttaccggtacgggtaaaccggtttcgttaacccgttttacgggtttttaaccccggttttttaagttttacccgggtttttaagggtttcccggggtttaacggggttaccgttaaccggtttaaccccggtaacccgggtttacccggttacccccggttaccccggttttacccggtttaaccggggttttttaacccggggaacccgggttaaaccggggttaaccctacggggttaaccggtacgggttaaccggtacgttaaaccggtaaccgggtaccggttaacggttcgggtaaaccggttaccgttccgtaaacccgtacgttcgtttacccgttcggtttccccgtcgtttaacccccg

SEQ ID NO: 277407 - DNA, 662 bp, Homo sapiens
  misc_feature: GYAE6OF01BCD5S.29.35.D02.1.454.CMB.1.raw
  modified_base (193)..(193): a, c, t, g, unknown or other
  misc_feature (193)..(193): n is a, c, g, or t
  modified_base (228)..(228): a, c, t, g, unknown or other
  misc_feature (228)..(228): n is a, c, g, or t
  modified_base (536)..(536): a, c, t, g, unknown or other
  misc_feature (536)..(536): n is a, c, g, or t
  modified_base (645)..(645): a, c, t, g, unknown or other
  misc_feature (645)..(645): n is a, c, g, or t
tcagatagagtactcacgaccggtgctcgatttagcacacgatagttgggtttggggaggaactgctcagttaggacccagacggaaccatggaagccccagctcagcttctcttcctcctgctactctggctccagataccagcggagagattgtgttgacacagtctcagccacctgtcttgtctcggganaaagcgccaccctctcgtagcagggccagtcaggngttagtaacaacttcgttggccttaggttaccaaacacggaaaccgtcggaccgacggtcctcccgacggccttccgtacacttctatcgtatcgacactaccgaacgacgggcctacgtcggactaaccgtccgagccgtaaggttccgaaggtggcctaaggggtcgggttacgacggggactaacgtaccttacaaccgttcaactacccataccgaccgtacccgacgtacggaacgtccgtaggtacgtagttccgtacgtttaccgtttaatttacgttcggttcgttacgggtcgttaacnccgttaaccggtccgtaccctcccggttacgttaccggtttcggaccggtacgggtaaccaggtccgttcgaagcgtaacgcgtacgaccgtggtccgctcgactacgnttcctgtcctcgtcccg

SEQ ID NO: 277408 - DNA, 705 bp, Homo sapiens
  misc_feature: GYAE6OF01EGZ4D.29.35.D02.1.454.CMB.1.raw
  modified_base (267)..(267): a, c, t, g, unknown or other
  misc_feature (267)..(267): n is a, c, g, or t
tcagatagagtactcacgaccggtgctcgatttagcacacgatagttgggtttgggggaggaactgctcagttaggacccagacggaaccatggaagccccagctcagcttctcttcctcctgctactctggctcccagataccaggcggagagattgtgttgacacagtctccagccaccctgtctttgtctccgggagaaagagccaccctctcctgcagggccagtcagagtagttaacaactacgttggccttggttaccaanacgtaaaccgtggaccaggcctcccgaggacctcctcactctatgatgcactccgaacgcgggaccacgtggacactcccagtccgaggttccaggtcggctagggtcgggtctggggactaggtacttcaccgtctcgaacctactccgacgccgaccttacggacgtccgtaggacggtacttccgttggttaccgttttaagtttagtttcggttcggtttcgggtacggttacggtactaaccgttcgggtcccgttacccggttaccgttaccggttttcgggacccggtaacggggtacctacgggtccggttagggaacgtacgtaccggtaacggtaaaccgtaacggtttcgggtcgggacccgttaacgggtacccttaacccgtaccgtttaccgtttccggtttacccgtttccgtttaaaccccg

SEQ ID NO: 277409 - DNA, 720 bp, Homo sapiens
  misc_feature: GYAE6OF01BR8E0.29.35.D02.1.454.CMB.1.raw
  modified_base (206)..(206): a, c, t, g, unknown or other
  misc_feature (206)..(206): n is a, c, g, or t
  modified_base (226)..(226): a, c, t, g, unknown or other
  misc_feature (226)..(226): n is a, c, g, or t
tcagatagagtactcacgaccggtgctcgatttagcacacgatagttgggtttggggaggaactgctcagttaggacccagacggaaccatggaagccccagctcagcttctcttcctcctgctactctggctcccagataccaggcggagagatttgtgttcgaacacagtctccagcccaccttgttctttgtcgtccgggaanaaagcgcccaccctcctccngcacgggccagtcagagttattaaacacttgtcggaccttgtaccaaacgagaaacctcggaccacggcctacccgaggtcctacctacgtacttcgtaatgaagtcgactaccgtaaccgaacggcgggacctaacgtacggctaaccgtccccaaggtcccgttagggttaccaaggtcggcgtacggggttcggtacggtagggaaccttacgttaacttaccgtacctaccgtaccaaccgtactacgacccggtcccgacgttacggacgtccgtaggtaacgttacttcgtacgtttacgttttatttaggttcgttcggttacggtcgtaagtccgtaacgtccgtacccgttcccgttagtaccggtttcgggacccgtaacgggtaccacggttcgaggtacgtacgtacgaacggtaacgtacgttacggtcgtaccgtaccgtacctaccgtacgttccgttacgttccttaccgttaccccg

SEQ ID NO: 277410 - DNA, 829 bp, Homo sapiens
  misc_feature: GYAE6OF01CQ513.29.35.D02.1.454.CMB.1.raw
  modified_base (221)..(221): a, c, t, g, unknown or other
  misc_feature (221)..(221): n is a, c, g, or t
tcagatagagtactcacgaccggtgctcgatttagcacacgataggttggggtttggggaggaactgctcagttaggacccagacggaaccatggaagccccagctcagcttctcttcctcctgctactctggctccagataccgagcggagagattgtgttgacacagtctccagcctacctgttcttgtcgtaccgggagaaagcgcccaccctctccngccgacgggccagtcagtacgtacgttaaacaacttacgttcggaccttcggttaccaaacgaacggaaaccgtcgggaccgtacggaccctacccggacggtccttcctactacttcgtagtcggtacgtacggacctaacgtaacccgaaacggtacggggaccctaacggtcggacctacctaccccgacggtacccggtaacgggtttcgaacgggtcggtacggtaaggggttcggggtacgtaacggggaacctaaggtacccttttacgaccgttccgtaaccaccgtacgtaccgaccggtacccgtacgtacgaccgtaccgttagggaaccgtttacgttacgttacggtttacttttagtttacgtttcggttcgggttacggtacgttaacggacccttaaccggtccggtaccccgttccgtaccgttaccggtttaccgggaccggttaacgggtaacccgtaggtccggtaaggtaacgtacgttaaccggaaacgggttaacccgtaggtttcggggtacgtaccggttacccgaacccgttaccggttaaccgttcccggttttaaccgttcccgtttaaccgttccccgg

SEQ ID NO: 277411 - DNA, 628 bp, Homo sapiens
  misc_feature: GYAE6OF01DWGCB.29.35.D02.1.454.CMB.1.raw
  modified_base (204)..(204): a, c, t, g, unknown or other
  misc_feature (204)..(204): n is a, c, g, or t
  modified_base (293)..(293): a, c, t, g, unknown or other
  misc_feature (293)..(293): n is a, c, g, or t
  modified_base (312)..(312): a, c, t, g, unknown or other
  misc_feature (312)..(312): n is a, c, g, or t
tcagatagagtactcacgaccggtgctcgatttagcacacgatagttgggtttgggggaggaactgctcagttaggacccagacggaaccatggaagccccagctcagcttctcttcctcctgctactctggctcccagataccagcggagagattgtgttgacacagtctccagccaccatgtctttgtctccgggagaaagngccaccctctcctgcagggccagtcagagtgttaacaactacttggcctggtaccaacagaaacctggaccaggcctcccaggctcctnatctatgatgcatccaacngggccatggcactcccagccaggttcagtcggcaggtggtctgggaacagtaccttcactctacaccatcacgccgctagacgccgtggaggtacttacgtcgttccgttttattacgtttgttcgttcgggtcgttacggtaccgtaacgtcggtccccttcccggttacgttaccgtttttcgggacccgtaacgggggaccctaacgggtaccgtagggaacgtacgtaccggtaacggtaaccggttaacggttgggtacggtcgttaacggccctaacccgtagtttacccgttggtttccctttaacccg

SEQ ID NO: 277412 - DNA, 744 bp, Homo sapiens
  misc_feature: GYAE6OF01DTTY6.29.35.D02.1.454.CMB.1.raw
  modified_base (284)..(284): a, c, t, g, unknown or other
  misc_feature (284)..(284): n is a, c, g, or t
tcagatagagtactcacgaccggtgctcgatttagcacacgatagttgggtttggggaggaactgctcagttaggacccagacggaaccatggaagccccagctcagcttctcttcctcctgctactctggctcccagataccagcggagagattgtgttgacacagtcctccagcccacccttgttctttcggtcgtccgggaagaaacgacgcccaccctcctcctgcgacgggccagtcagtagttagttaaccacttacgttggccttaggttaccaaanaacgaaacctggccaacggcctacccgaggcctctacattctatgatcgacactaccaacgacgggccctaacgtcggacctactaccccgacgacccgtaggtttccgaaggtcggacgtacgggttggggtaccgtaggggaacctacggtacctttaccacgttcctaccgacctacttaccgaccgtacccgtaccgtacggaccgtccgtacggtacggtactttcgttcggtttaccgttttattacgtttcgttccggttacgggtccggtaacgtaccgtaaccggttccggtaccccgttaccccgttaccggttaccgttttccgggacccggtacggggaacctacggtcggttacggacgtacgtaccgtaacggaacggtaccgttagggtccggtacgtcgacccgtaccgtaactttcccggttactttccgttacgttaccccg

SEQ ID NO: 277413 - DNA, 658 bp, Homo sapiens
  misc_feature: GYAE6OF01CXFKZ.29.35.D02.1.454.CMB.1.raw
  modified_base (146)..(146): a, c, t, g, unknown or other
  misc_feature (146)..(146): n is a, c, g, or t
  modified_base (252)..(252): a, c, t, g, unknown or other
  misc_feature (252)..(252): n is a, c, g, or t
  modified_base (286)..(286): a, c, t, g, unknown or other
  misc_feature (286)..(286): n is a, c, g, or t
  modified_base (318)..(318): a, c, t, g, unknown or other
  misc_feature (318)..(318): n is a, c, g, or t
  modified_base (411)..(411): a, c, t, g, unknown or other
  misc_feature (411)..(411): n is a, c, g, or t
  modified_base (427)..(427): a, c, t, g, unknown or other
  misc_feature (427)..(427): n is a, c, g, or t
  modified_base (624)..(624): a, c, t, g, unknown or other
  misc_feature (624)..(624): n is a, c, g, or t
tcagatagagtactcacgaccggtgctcgatttagcacacgatagttggggtttgggggaggaactgctcagttaggacccagacggaaccatggaagccccagctcagcttctcttcctcctgctactctggctcccagataccngcggagagtattgtgttgacactagtctccacgccctaccttgttcctttgtccgtaccgggaagaaagcgcccaccctcctccgtcgacgacgggccagtcgagngttacgtaaacacttacgtcgccttggtaccaanacgaaccgtgccgagcctacccgagtcctccntaactctatgtatcgactactaccgaaggccggcctagcgtacactccgagcctaggtcagtgactaggtcggtcgtaggaactcgtctaccncttaccgaccacgtanaccgaccgtccgacgtacggactacgtaggaacgttcgtttcgtacgtttacctttagttacgtttcggttacgttggaccgttacgaccgttaacgtccgttccccgttccgttaccgtttaccggttacggacccggtacggaccgacggtcgtaaggtccaagtcaaacggttacgacgttaggtccggtctanaccgttaccgtatcctttcgtcccttcgtacccg

SEQ ID NO: 277414 - DNA, 768 bp, Homo sapiens
  misc_feature: GYAE6OF01B58LY.29.35.D02.1.454.CMB.1.raw
tcagatagagtactcacgaccggtgctcgatttagcacacgatagttgggtttggggaggaactgctcagttaggacccagacggaaccatggaacgccccagctcagcttctcttcctcctgctactctggcctccagataccagcggagagattgtgttgacacagtctccagccacctgtctttgtcgtcgggagaaacgcgccacctctcctgcgagggccagtcagtagtacgttaacaacttcgttcggccttggttaccaaacgaacgaaaaccgtcggccgacgggcctacccgacgggtccttccctactacttactattacggatcgactactacccgaaacgaccggggacctaacgttcgggcctaacgtccccgaggccccgtaagggttccaagggtcgggacgtaggggttcggggtcgtacggggaactacgtaaccgtttcaaaccttcttaccgaacccgattaccggaccggacccggtaccgttaacggaccggtacccgttagggtaaacggttcgtttaccgttacggtttaccgttttaacgtttagtttcggttcggttcgggtacgtacggtacgtaaccgtcggtcccgttacccgttcgttaccggttttccgggaccggtaacggggtaaccaacggtcggtacgggtacgtaacgtacggtaaacggaccggtaacggttcggtcgggtaccgtcggtacctaccgaacgtttccgttcgttccgtttcgttaccccgg

SEQ ID NO: 277415 - DNA, 277 bp, Homo sapiens
  misc_feature: GYAE6OF01BMA0L.29.35.D02.1.454.CMB.1.raw
  modified_base (257)..(277): a, c, t, g, unknown or other
  misc_feature (257)..(277): n is a, c, g, or t
tcagatagagtactcacgaccggtgctcgatttagcacacgatagttgggtttgggacagacttcactctcaccatcagccgcctagagcctgaggattctgccgtttattattgtcttgggcgtagcaactggcctcccgtcacttttggccaggggaccaagctggagatcagacgaactgtggctgcaccatctgtcttcatcttcccgccatctgaagtactctatctgacggcggctggcaaggcgcatagnnnnnnnnnnnnnnnnnnnnn

SEQ ID NO: 277416 - DNA, 757 bp, Homo sapiens
  misc_feature: GYAE6OF01BT898.29.35.D02.1.454.CMB.1.raw
  modified_base (165)..(165): a, c, t, g, unknown or other
  misc_feature (165)..(165): n is a, c, g, or t
  modified_base (196)..(196): a, c, t, g, unknown or other
  misc_feature (196)..(196): n is a, c, g, or t
  modified_base (199)..(199): a, c, t, g, unknown or other
  misc_feature (199)..(199): n is a, c, g, or t
  modified_base (209)..(209): a, c, t, g, unknown or other
  misc_feature (209)..(209): n is a, c, g, or t
  modified_base (211)..(211): a, c, t, g, unknown or other
  misc_feature (211)..(211): n is a, c, g, or t
  modified_base (215)..(215): a, c, t, g, unknown or other
  misc_feature (215)..(215): n is a, c, g, or t
tcagatagagtactcacgaccggtgctcgatttagcacacgatagttgggtttggggagaactgctcagttaggacccagacggaaccatggaagccccagctcagcttctcttcctacctgctactctggcctccagataccagcggagagattgtgttgacanagtctccagcccaccttgtctttgctcgganaancgccacctcncngcgnggccagtcagtagtacgtaacacttacgtggaccttggtaaccaagacgtaaacccgtggaccgtacggcccttacccgaggtccttacccgtataacgttcctatcggtacgtcgaccctacgttaacccgaacgtacgggccctaacgttcgggacctaccgtcccgacgccttaagggttccaagggtcggtaccggtaggttacggggtacgtacggggtaaaccacggttaacccgttacgaccgttacccttaccgaacccttacgtaccggacccggtaccccgtaccgtacgaccggttaccgtacggtaacggttaactttccgttacggtttaccgttttaacgtttcgtttacggttcggtttacgggtaccgttaacggtacgtaaccggttccgtcccgttaccccggttacgttaccggttttaccggaccggtacgggaccgtacgtcggtaggtacgacgtacgacggtaccgttaagtcggtcgtcgtacgtacctacgtactaccgttcgttccgtcgtacccg

SEQ ID NO: 277417 - DNA, 833 bp, Homo sapiens
  misc_feature: GYAE6OF01DWY6Y.29.35.D02.1.454.CMB.1.raw
tcagatagagtactcacgaccggtgctcgatttagcacacgatagttgggtttgggggaggaactgctcagttaggacccagacggaaccatggaagccccagctcagcttctcttcctcctgctactctggctcccagataccagcggagagattgtgttgacacagtctccagccaccctgtctttgtctcgggagaaagagccaccctctcctgcagggccagtcagtagtagttaacaactacttggccttggttcccaaacgaagaaacccgtggaccaggcctacccgaggtcctcctcatctatgatgcactaccgaacgacgggccacgtcggactactccccgagaccgtaggttaccgaggtcggacgtagggttcggggtacgttacgggggaactaacggtactttaccacctttcgttacccaaccgtacgttaccgaccggtccccgtacccgtaacggtaccggtcccgtacgggtaacggttacgtttaccgttacggttacccgtttttaagtttacgttttacgggtttaccgtttcggggttaccggttacggtaacccgtaaccggtttccgggtaccccgtttacccccggtttaccgtttaacccgggttttttaccgggaccccgggttaaccggggggtaacccgttaacgggttaccgggttaacgggtaacgggttaaccgttacccggtaaaccgggtaaccggtttaaaacccgggttcgggttacggtaccccggttaggtaaccccgtacccgttaaccgtttacccggtttaccggtttccccgtttacgtttaaacccccg

SEQ ID NO: 277418 - DNA, 797 bp, Homo sapiens
  misc_feature: GYAE6OF01DT9X0.29.35.D02.1.454.CMB.1.raw
  modified_base (197)..(197): a, c, t, g, unknown or other
  misc_feature (197)..(197): n is a, c, g, or t
tcagatagagtactcacgaccggtgctcgatttagcacacgatagttgggtttgggggaggaactgctcagttaggacccagacggaaccatggaagccccagctcagcttctcttcctcctgctactctggctccagataccaggcggagagatttgtgttgacacagtctccagccacctgtctttgctcggganaaagcgccaccctctcctgccgagggccagtcgagtacgtagttaaccaacttacgttggccttaggttacccaaacgaacgaaccgtcggacccgtaaggtccctcccgaaggccttaccgtactaacttaccttagttcggaacttcggacctaaccttacccgaaacggtaacgggtccctaacggttcggactaccgttaccccgacgtaccccggttaggttccgaaggttcgggacgtacggggttcggggtacggttgggaaacctagtaccgttaccgaccgtttactaccgaaacctagtacccgaacgacccgtaccggtaccgtaacgtacccggttaggtacggttacgtttcccggttagtttacccggttttttaagtttacttttcggttaccggtttacgggtaccgttaacgtaccgttaaccgttccggtaccccgttcccgtttaccggtttaccgttttacccgggaacgggtaaccgggtacctaacggtcggttaggtacgtacgttacgaacggtaacggtaacggttgtacggtacgtcgtaccgtacctactacgtttcgttcgttcttaccccg

SEQ ID NO: 277419 - DNA, 707 bp, Homo sapiens
  misc_feature: GYAE6OF01DHVKV.29.35.D02.1.454.CMB.1.raw
tcagatagagtactcacgaccggtgctcgatttagcacacgatagttgggtttgggggaggaactgctcagttaggacccagacggaaccatggaagccccagctcagcttctcttcctcctgctactctggctcccagataccagcggagagattgtgttgacacagtctccagccaccctgtctttgtcgtccgggagaaagagcccaccctctcctgcacgggccagtacagagtacgttaaccaacttacgttcggccttggttacccaaaacgaacgtaaaccctcgggaccgacggtccctccccgaggtcctcctcatactataggtatcgactactcccgaaacgacgggtccctaacgtcggacctaccgtaccccgacgtaccgtacggttccgaggttcggcgagggttcgggtcgtgggaactacgtacttcaccgttactccacctactccgaccgacccgacctacggaccgtcgtagggtacggttactttacgtcggtttaccgtttatttacgtttcgttcgttgggtacgttacgtccgtaacgttcggtacccttccggttaccgtttacggtttcggaccggtaccggggaacctacggtcggtacggtaatacgtaccgaaggaaccgttacgtcgggtacggtccgtaccgacctaccctaagttccttcgttcccttgtacccg

SEQ ID NO: 277420 - DNA, 1043 bp, Homo sapiens
  misc_feature: GYAE6OF01BQVBF.29.35.D02.1.454.CMB.1.raw
  modified_base (201)..(201): a, c, t, g, unknown or other
  misc_feature (201)..(201): n is a, c, g, or t
  modified_base (207)..(207): a, c, t, g, unknown or other
  misc_feature (207)..(207): n is a, c, g, or t
tcagatagagtactcacgaccggtgctcgatttagcacacgatagttgggtttgggggaggaactgctcagttaggacccagacggaaccatggaagccccagctcagcttctcttcctcctgctactctggcctcccagataccagcggagagatttgtgttgacacagtctccagcccacctgtctttgtctccggganaaagcnccaccctctcctgcgacgggcaggtcagtagtagttaacaacttacgttggccttggttaccaaacgaacgaaacccgtcggaccgaacggtcctaccccgacggtcctcccgtactaacgttcttaagtgtaagtcgacctaactacccgaaacgaccgggtaccaacgtcggccaaccgttccccgaaacgccgttaacgggttaccgtagggtcggtaccggtaagggttcggggtaaccgtaggggtaacctaacggttaccgtttacccgtaacgttacccgttaaccaacccgtaacgttacccggaacccggtaccccggtaacccggttaaaccgggaccgggttaccccggttaacggggttaaccgggtttaaaccgtttttcccgggtttaacccggtttttaacccggtttttttaagtttttacccgggttttaccgggttttacccgggtttttaaccgggggtacccgggtttaaacccggtaacccggttaaacccgggtttaccccgggttacccccggttttaccccccgggtttaccggtttttaaccccggggttttttacccgggggaaaccccggggttttaaacccgggggggaaacccccgtttaaacgggggtaccggtttaaacggggtaacccggtttaaacccgggtaaccggggttaaaaacccgggttaaacccgggtttaacccgggtttaaccgggggttaccggggtttaaccccgtaacccggggttaaccccgttaaacccggtttaacggttttcccggttttacccgttttaccccgtttaacccggtttaacccccgg

SEQ ID NO: 277421 - DNA, 644 bp, Homo sapiens
  misc_feature: GYAE6OF01CSDBB.29.35.D02.1.454.CMB.1.raw
  modified_base (151)..(151): a, c, t, g, unknown or other
  misc_feature (151)..(151): n is a, c, g, or t
  modified_base (170)..(170): a, c, t, g, unknown or other
  misc_feature (170)..(170): n is a, c, g, or t
  modified_base (201)..(201): a, c, t, g, unknown or other
  misc_feature (201)..(201): n is a, c, g, or t
  modified_base (210)..(210): a, c, t, g, unknown or other
  misc_feature (210)..(210): n is a, c, g, or t
  modified_base (213)..(213): a, c, t, g, unknown or other
  misc_feature (213)..(213): n is a, c, g, or t
  modified_base (265)..(265): a, c, t, g, unknown or other
  misc_feature (265)..(265): n is a, c, g, or t
  modified_base (585)..(585): a, c, t, g, unknown or other
  misc_feature (585)..(585): n is a, c, g, or t
tcagatagagtactcacgaccggtgctcgatttagcacacgatagttgggtttggggaggaactgctcagttaggacccagacggaaccatggaagccccagctcagcttctcttcctcctgctactcgtggcctccagataccagcgganagattgtgtgacacagtcnccagccacctgtctttgccgtacggaagaancgccacctntcngcgaggccagtcagtatacgttaacacttacgtcggaccttaggtaccaaanacgtaaacgtcggaccgacggtcctacccgaacggtcctaccttacaacgttctaagtgaactcgactaccaccgaaaccgcgggacctacgtacggaccgtacctacccgacgtaccgtacgggttacacgggtcggacgtagggtcggttacgacggggaactcgtacgttactactctaccgacgtataccgacgccgtacgacgacgcgtagacgttctagttcgttacttactagttacgtcgtaggacgtagtcaacgtcgtaccgtccgtacttacgttccgggacgacgggttacgacggtacggtaggacncgttaacaacgggaccgttagcggtcgcgtacacggtactctagtcctcgttactaccg

SEQ ID NO: 277422 - DNA, 928 bp, Homo sapiens
  misc_feature: GYAE6OF01BM3M1.29.35.D02.1.454.CMB.1.raw
  modified_base (215)..(215): a, c, t, g, unknown or other
  misc_feature (215)..(215): n is a, c, g, or t
  modified_base (227)..(227): a, c, t, g, unknown or other
  misc_feature (227)..(227): n is a, c, g, or t
  modified_base (291)..(291): a, c, t, g, unknown or other
  misc_feature (291)..(291): n is a, c, g, or t
  modified_base (515)..(515): a, c, t, g, unknown or other
  misc_feature (515)..(515): n is a, c, g, or t
tcagatagagtactcacgaccggtgctcgatttagcacacgatagttgggtttgggggaggaactgctcagttaggacccagacggaaccatggaagccccagctcagcttctcttcctcctgctactctggcctccagataccagcggagagattgtgttgacacagtctccagccctaccgttgttccttttgccggtacgggaagaaacgcncccacctctccngcgacgggcagtacagtagttactaactactcgtcggccttacggtaccaaacgacgtaaccgnggccgacggtcctaccgacggtcctcctactacttcgtaatcggactcgaacctacctaaccggaacggaccggaccttaacggtcgacctacccgtacccggaacgtacccggttaagggttccgaaggggtccggtaccgggttaaggggggttccggtacggggtaccggtaaacgtaaccggttactttaccctaccgtaccctaaccgtaccgttaacncccggaccggacccggtaccgtaacggaccggttccggtaacgggttacggtttaccgtttaccgttacccgggtttttaacgtttttaacgttttccggttttagggtttacccgggtttacggggtaccgttaacggttaccggttaaacccgggttcccgggttaccccccgttttaaccggggttccccgttttaacggggttttaccccgggggaaccgggtttaaacccgggggtaacggtaaccggttacgggtaacgggtaaacggttaacctaccgggttaaaccgggtaaaccgggttaccgggttacggggtacccggttacccgtaaccccggtacccgttaaacccgtttccgggtttaacgttttccccggtttacgttacccccggtttaacccccgg

SEQ ID NO: 277423 - DNA, 822 bp, Homo sapiens
  misc_feature: GYAE6OF01BBQMH.29.35.D02.1.454.CMB.1.raw
  modified_base (201)..(201): a, c, t, g, unknown or other
  misc_feature (201)..(201): n is a, c, g, or t
tcagatagagtactcacgaccggtgctcgatttagcacacgatagttgggtttggggaggaactgctcagttaggacccagacggaaccatggaagccccagctcagcttctcttcctcctgctactctggctcccagataccagcggagagatttgtgttgacactagtcctcagcccacctgtctttgtctccgggaanaaacgcgcccaccctctccgtgcgacgggtccaggtccaagtagtacgttaaaccaacgttcgttcggcccttggttacccaaagtacgaaaacctgggacccgaacgggcccttacccccgaacgggtccctttaccctacactttaccgtaagttacggtaacgttcggacctaaccgtaccccgaaacggaccggggacccctaacggtcgggtaacctaacccgttaccccgacgtaacccgtacgggttacctaacgggtcggtaccggtaagggttcggggtacgtacggggtaactacgtacgttactaccgtccctaccgtaccacttaccgaccgtacccgtaccgtacggacggtacccgtagggtaacggttaccgttcgttaccgtttaacccgttttagtttacgtttacggttccggtttacgggccgttaaccggtaccgtaaccggtccggtaccccgttccgttacgttccggtttccggaccgggtaacgggtaaccgacggtccgtaggtacgtacgtacgtaacggtaccgttacggtcggtcggtacccgtagaccccgttacgtacgttttccgtccgttttccgttacccttacccgg

SEQ ID NO: 277424 - DNA, 612 bp, Homo sapiens
  misc_feature: GYAE6OF01BDHF1.29.35.D02.1.454.CMB.1.raw
  modified_base (291)..(291): a, c, t, g, unknown or other
  misc_feature (291)..(291): n is a, c, g, or t
  modified_base (299)..(299): a, c, t, g, unknown or other
  misc_feature (299)..(299): n is a, c, g, or t
tcagatagagtactcacgaccggtgctcgatttagcacacgatagttgggtttggggaggaactgctcagttaggacccagacggaaccatggaagccccagctcagcttctcttcctcctgctactctggctcccagataccagcggagagattgtgttgacacagtctccagccacctgtctttgtctccgggagaaagcgccaccctctcctgcagggccagtcagagtgttaacaactacttggccttggttaccaacagaacctggccagctcccgaggcctcctnatctagtnatgcatccaaagcgggccacgtggccactcccgagccgaggttccaggtcggacgtagggttcggggtactggggaacctaggtaccttcacctctacacccatcacgccgacgtagacgaccgtgaaggtcttcgtacgttaccgtttagtttagtttcgttcgtttgggtaccgttaacgtacgtaaccgtcggtacccttcccgttcgttaaccgtttggaccggagggaaccagccgtaggactagtaccgtaagacggtaacgtcggtggtctcggactaccgtacgttcttcgttaccgttctaccg

SEQ ID NO: 277425 - DNA, 679 bp, Homo sapiens
  misc_feature: GYAE6OF01D9JR8.29.35.D02.1.454.CMB.1.raw
  modified_base (200)..(200): a, c, t, g, unknown or other
  misc_feature (200)..(200): n is a, c, g, or t
tcagatagagtactcacgaccggtgctcgatttagcacacgatagttgggtttggggaggaactgctcagttaggacccagacggaaccatggaagccccagctcagcttctcttcctcctgctactctggctcccagataccagcggagagattgtgttgacacagtctccagcccacccttgtctttgtctccggganaaagacgccaccctctcctgcacgggccagtcagagtagttaacactacttggccttggtccaacagaaacctggccaggcctcccaggcctcctcatctatgatcgacactaccaacgacgggccacgtcggactactcccgagccgtaggttccgaggtcggacgtagggtcgggtcgtggggacaacggtaccttacctactccgtaccaaccgtactacgacggtcccgtaccgtacggaacgtccgtacgggtacggtactttacgtacgtttaccgtttttaacgtttagtttcggttcggtttcggggtacgttacggtacctaaccggttcgggtcccctttcccggttacgtttaccggttttccgggaccggtaacggggtaaccgtaaggtcgtaggagtactacggaacggaccgtaagtggtcggcctacggaccctactacgttctttacgttccttcgtacccg

SEQ ID NO: 277426 - DNA, 725 bp, Homo sapiens
  misc_feature: GYAE6OF01EPQKX.29.35.D02.1.454.CMB.1.raw
  modified_base (209)..(209): a, c, t, g, unknown or other
  misc_feature (209)..(209): n is a, c, g, or t
  modified_base (521)..(521): a, c, t, g, unknown or other
  misc_feature (521)..(521): n is a, c, g, or t
  modified_base (712)..(712): a, c, t, g, unknown or other
  misc_feature (712)..(712): n is a, c, g, or t
tcagatagagtactcacgaccggtgctcgatttagcacacgatagttgggtttgggggaggaactgctcagttaggacccagacggaaccatggaagccccagctcagcttctcttcctcctgctactctggctcccagataccgagcggagagtattgtgttgacactagtctaccagccctacctgttctttgtcgtaccggggaanaaaagcgcccacccttctccgtgcgacgggccagtacagtagtgttaaaccactacgttcggccttcggtaccaaacgaacggtaaacctcgggaccgaacggtccctacccgagggtccttacccgtactaacttacctagttacgtaacgttcggaccctaagtacccaaacggacgggtaccccaacgttacgggacctaccgtaccccgtaacggtcccgtaagggttttacccgaggtttccggaaggtacggtcggggttaccgtaggggaaccagttacctagtactcctaaccgactacgtacnccgaccgtctaacgcgtacgtaggacggtacttacgtcgttaaccgtttttattaacgtttggttaccgttacggtacgtaagtccgtaacgtcgtcccttaccggttcttacggttcggaccgacgggtaactacggtctacgggactacgagtaacgtacgtagtcgcgcgtacgaccaacttcttacncgttctacgtacc

SEQ ID NO: 277427 - DNA, 660 bp, Homo sapiens
  misc_feature: GYAE6OF01E52JM.29.35.D02.1.454.CMB.1.raw
  modified_base (202)..(202): a, c, t, g, unknown or other
  misc_feature (202)..(202): n is a, c, g, or t
tcagatagagtactcacgaccggtgctcgatttagcacacgatagttgggtttgggggaggaactgctcagttaggacccagacggaaccatggaagccccagctcagcttctcttcctcctgctactctggctcccagataccagcggagagattgtgttgacacagtctccagcccaccctgtctttgtctaccgggganaaacgcgcccacccgtctcctgcagggccagtcagagtgtaacactacgtggcctggttccaacagaaacctggccaggcctcccgaggcctcctcatctatgatcgcactaccaaacgcgggccacgtggccactcccgagtccgtaggttcaggtggacgaggttcgggtcgtgggacaggtaccttcgacctcctaccaccagtcccgaacggtcccgacccgtagaccgtccgtagggtacgttacgttccgttcggttaccgttttattagtttcgttcgttgggtcgttagaccgtaacgtccgtcccgttacccgttccgttaccggttttcggacccggtaacgggtaccgacggtaccgtacgggtacgtacgtacgaacggtaccgtaagttcgggtcggtaccgcgtaccacccgttacgttccgttcgttcccgttccgttacccg

SEQ ID NO: 277428 - DNA, 268 bp, Homo sapiens
  misc_feature: GYAE6OF01EET65.29.35.D02.1.454.CMB.1.raw
  modified_base (253)..(253): a, c, t, g, unknown or other
  misc_feature (253)..(253): n is a, c, g, or t
  modified_base (258)..(268): a, c, t, g, unknown or other
  misc_feature (258)..(268): n is a, c, g, or t
tcagatagagtactcacgaccggtgctcgatttagcacacgatagttgggtttgggacagacttcactctcaccatcagccgcctagagcctgaggattctgccgtttattattgtcttgggcgtagcaactggcctcccgtctacttttggccaggggaccaagctggagatcagacgaactgtggctgcaccatctgtcttcatccttcccgcatctagaagtctctagtctgagcgggctggacaggccnatagnnnnnnnnnnn

SEQ ID NO: 277429 - DNA, 745 bp, Homo sapiens
  misc_feature: GYAE6OF01AJJ0J.29.35.D02.1.454.CMB.1.raw
tcagatagagtactcacgaccggtgctcgatttagcacacgatagttgggtttgggggaggaactgctcagttaggacccagacggaaccatggaagccccagctcagcttctcttcctcctgctactctggctccagataccagcggagagattgtgttgacacagtctccagccaccctgtctttgctccgggagaaagcgccaccctctcctgcgagggccagtcagtagtagttaaccaacttcgttggccttggttacccaaacgacgaaacccgtggacccagggcctcccgaggccttcccgtctacttccttaagtgactcgactactacccgaaacggacgggtaccctacgtcggacctacctccccgaaggtcccgtagggttcacggtcggacgtagggttcggggtactaggggacctaaggtacctttcgaacccttcctaaccgacctacgtaccgaccggtacccgtaccgtacggtaccgtccgtagggtaacggtacgtttcgttacgtttaccgttttagtttacgtttacggttcggttacgggtacggtacgtaccgtaaccggtcggttaccccgtacccgtttccgttaccggttttaccgggaccggtaacggggtaccgtaacgggtcgttacgggacgtacgtacggtaacggtaaccgtacggttacggtcggtacgtacgtaccgtaccgtacgttcgttcgttccttcgttacccg

SEQ ID NO: 277430 - DNA, 765 bp, Homo sapiens
  misc_feature: GYAE6OF01CRI38.29.35.D02.1.454.CMB.1.raw
  modified_base (365)..(365): a, c, t, g, unknown or other
  misc_feature (365)..(365): n is a, c, g, or t
tcagatagagtactcacgaccggtgctcgatttagcacacgatagttgggtttgggggaggaactgctcagttaggacccagacggaaccatggaagccccagctcagcttctcttcctcctgctactctggctccagataccagcggagagtattgtgttgacacagtcctaccagccctacccgttgttccttttggtccgtaccggggaagaaaacgacgccctacccctctccgtgaccgacgggccagtcgaagtacgttaagttaaaccaacttcgttggcctttcggttacccaaaagaacggtaaacccgtcggaccctaggccctacccgaggtccctccttacacttccgttagngtaactcggtacctaaaccgtacccgaaaaccgggaccgggtaccctaaccggtcggtaccccgtaacctacccccgacggtaccccgggttaacgtttccggacggttcgggtacgttacggggttaggggttcccgttaggggaacctacggtaacctttacccgacgttaccacctactcaccggtaccggcccgtacgtacgaccggcgttaagggacgtttccttacgttacgtttacgtttaattacggtttcgttacggtcggtacgtacgtacgtaccgtcgtccctccgtttgtccgttgggacccgtagggaactacgtcggagtactacgtgaaccgtaacgtcggttggacgtcgctacctacgtattaccttcgtcgttccgtaacc

SEQ ID NO: 277431 - DNA, 742 bp, Homo sapiens
  misc_feature: GYAE6OF01AHVX9.29.35.D02.1.454.CMB.1.raw
  modified_base (500)..(500): a, c, t, g, unknown or other
  misc_feature (500)..(500): n is a, c, g, or t
tcagatagagtactcacgaccggtgctcgatttagcacacgataggttgggtttgggggaggaactgctcagttaggacccagacggaaccatggaagccccagctcagcttctcttcctcctgctactctggctcccagataccagcggagagattgtgttgacacagtctccagcctaccctgtctttgtcgtcgggagaaagcgccctaccctctccgtgcgagggccagtcaagtagttacttaacaacttacgttcggccttacggttaccaaacgtaacggaaaccctggacccgagggtcccctacccgaggtccttccgtacacttctagtggtactcgacctactaccgaacggcgggaccctacggtcggaccctacgtccccgacgtcccgtagggttcacgggtcggcgtaggggtcgggtcgtcgggaactcgtaccttccgtactcccgtaccaccacgttccgaccggcccgtcgtagccgtacncgggtaagtctttcgtcggtttactttagttcgtttcgtcggttcggacgttacggctaccgtccggtacccttccggttacgtttccgggttacggtacccggtaacggggtaacctacgggtaccggtagaacgttaaccggtaaccaacggggtaaccttaacggggttcggttaccggtccctaccggtaaccctacgttaccgtttacccttcggttttaaccctcggttaccccgg

SEQ ID NO: 277432 - DNA, 944 bp, Homo sapiens
  misc_feature: GYAE6OF01BOVGO.29.35.D02.1.454.CMB.1.raw
  modified_base (434)..(434): a, c, t, g, unknown or other
  misc_feature (434)..(434): n is a, c, g, or t
tcagatagagtactcacgaccggtgctcgatttagcacacgatagttgggtttgggggaggaactgctcagttaggacccagacggaaccatggaacgccccagctcagccttctcttcctcctgcctactcgtggcctacccagactaccaggcggagagtatttgtgttagaacacgagttcctccacgccctacccgttgtttccttttcggtaccggtaccggggaagaaaacgtccgacccctacccttccgttcccgtcggaccggtaccgggtaccctaggtaccgaaggtacggtttaacgttaaaaaccctaccgttaccggttcgggtaccttaccggttaacccaaaacgtaaccggtaaaccgtccgggacccaacgggtcccctacccgacggtcccttcctacgtaacttccttaacggngacgttaccgacctaacccgtaacccggaaaaccggtccgggtacccctaacgggtccggaccctaacccggttacccgaacccggttaccggtttaaagggttcccggaaggggttcccggtaacggttacgggggtttaccggggtaccggttaaacggggacttaaccggtttacccttacccggtacctaccgttaaccaaccgtaaccgccgtaaccgtacccgtaccggtaaacgtaccggtcggtaacgggttacgttcggtttaccgttacgtttaacggttttcgttaacggtttcggttccggtttaacggcgttacgacccgttaaccggttcccggtaccctttacccggttacgtttacccggtacgggaacccggtaacgggttacgtaacgtcggtacgggaacttaccggaacggtaccgtaacgttaccgggcggttaacgcccgtacgacccgttaacgacgttttccgtacttaccggttccttaccccgg

SEQ ID NO: 277433 - DNA, 807 bp, Homo sapiens
  misc_feature: GYAE6OF01BZL3Y.29.35.D02.1.454.CMB.1.raw
tcagatagagtactcacgaccggtgctcgatttagcacacgatagttgggtttgggggaggaactgctcagttaggacccagacggaaccatggaagccccagctcagcttctcttcctcctgctactctggctcccagataccagcggagagattgtgttgacacagtctccagccctacccttgttctttcgtccgtaccgggaagaaagcgcccaccctctcctgcgacgggccaggtcagtagtagttaaaccacgttacgttcggccctggttaacccaaacgaacgtaaaccgtcggacccgaaggtccctacccggtacggtcccttaccctcgtacttacccgttagtacggtactacggacctaaccgttacccgaaacggaccggggacccctacgtccggaacctaccgtccccgtaaggtcccgtaacgggtttaccagggtcggaccgttagggttcgggtccggtagggaccgtaacgtccgttactaacgttccgtaacctaacccgtaattcccgaccggtacccgtaccgtaacggtaccgtacccgttacgggtaacgtttacggtttaccgttacggttttaaccgtttttacgtttacgtttcgggtttacggttcggggtaccgttacggtaccgttaccgttccggttccccgttaccgttccgtttaccggtttcggaacccggtacgggtaaccgacggtcgtagggactacgtaccgaggtaccgtaaggtcggtacgtcgtacgaccttacgtactttcgttccgttctacccgttacccg

SEQ ID NO: 277434 - DNA, 838 bp, Homo sapiens
  misc_feature: GYAE6OF01B480S.29.35.D02.1.454.CMB.1.raw
  modified_base (204)..(204): a, c, t, g, unknown or other
  misc_feature (204)..(204): n is a, c, g, or t
tcagatagagtactcacgaccggtgctcgatttagcacacgatagttgggtttgggggaggaactgctcagttaggacccagacggaaccatggaagccccagctcagcttctcttcctcctgctactctggctcccagataccagcggagagattgtgttgacacagtctccagccaccctgtctttgtctccgggagaaagngccaccctctcctgcagggccagtcagagtgttaacaactacttggcctggttaccaacacgaaacctggccaggcctcccaggcctcctcactctatgatgcatacccgaacgcggggacccacgtcgggaccaaccgtccccgaacggtccccgtaagggttttaccgaagggttcggacggtaaggggtttcgggggtaccgtaggggggaaccctaacggtaacccgttttaccgaacctttcccgttaacccaaccccgtaaacgttcccgaaccggtccccggacccgttaaccgggaccgggtccccgttacggggtaacgggttaacgtttaccggtttacggttaacccggttttttaacgttttacgttttcgggtttccggttttcgggggtaccgtttaacgggtaaccgttaaaccggttccgggtacccccgtttccccgggtttaccgtttacccgggtttttacccggggacccgggtaaccgggggtaacccgtaacgggtccggtacgggtaacggtaccgtaccggaacgggtaaccggtaacggttacgggttcgggcccgttacgtacccgtaaccgttacgttaccgttccgtttaccttaccgttaacccg

SEQ ID NO: 277435 - DNA, 869 bp, Homo sapiens
  misc_feature: GYAE6OF01C5ZZF.29.35.D02.1.454.CMB.1.raw
  modified_base (230)..(230): a, c, t, g, unknown or other
  misc_feature (230)..(230): n is a, c, g, or t
  modified_base (241)..(241): a, c, t, g, unknown or other
  misc_feature (241)..(241): n is a, c, g, or t
tcagatagagtactcacgaccggtgctcgatttagcacacgatagttgggtttgggggagaactgctcagttaggaccagacggaaccatggaacgcccagctcagcttctcttcctcctgctactctggcctccagactaccgaggcggagagtatttggtagttagaactacgtacgtcctaccgacgcccctaccgttgtttcgttttcggccgttaccggggaaanaaacggtaccncccacccttctccgtggaccgacgggccaagttcgaaggtacgtttaacgtaaaacctaaccgtttcggttcgggacctttacggggttaaccaaaaacgtaaaccggtaaaccgtcgggaccccgacgggtacccttacccggaacggtcccttcctaactagttaccgtaagtgtaacgtaccgtactaccgaaccggaacggaccggcctaacggtcgaccaaccgtaccacggtaccgtacggttacgacgggttcggacggttgggtacgggtcgtacgggactaacgtacttcgtactccaacgtactaacgtacgaccggtacctacgtacgacggttcgacggtagttacttacggttacggtttacgttttagtttaacgttcgggttacggttacgggtaccgttaccgtaccgttaccgggtcccggtttcccgttacccggtttacccggtttacggtttaccgggaccgggtaaaccgggttaaccgtacggtacgggaaccggttaagaccgggttaacgaaaccgggtccgtaacggtttacgggtacggtacccgtacgttaccgtaaccgttacggttacgtttacccgttacgttacccgtttaacccgg

SEQ ID NO: 277436 - DNA, 513 bp, Homo sapiens
  misc_feature: GYAE6OF01A93OZ.29.35.D02.1.454.CMB.1.raw
  modified_base (311)..(311): a, c, t, g, unknown or other
  misc_feature (311)..(311): n is a, c, g, or t
  modified_base (389)..(389): a, c, t, g, unknown or other
  misc_feature (389)..(389): n is a, c, g, or t
  modified_base (505)..(505): a, c, t, g, unknown or other
  misc_feature (505)..(505): n is a, c, g, or t
  modified_base (510)..(510): a, c, t, g, unknown or other
  misc_feature (510)..(510): n is a, c, g, or t
tcagatagagtactcacgaccggtgctcgatttagcacacgatagttgggtttgggggaggaactgctcagttaggacccagacggaaccatggaagccccagctcagcttctcttcctcctgctactctggctcccagataccagcggagagattgtgttgacacagtctccagccaccctgtctttgtctccgggagaaagagccaccctctcctgcagggccagtcagagtgttaacaactacttggcctggttccaacagaaacctggccaggctcccgaggctcctcatctatgatgcatccaacngggccactggcatcccagccaggttcagtgcagtgggtctgggacagtacttcactctcaccatcacgccgcctagancctagaggtattctgtccgtttattattgtcgttgggcgtacgcaactcggccctccgtctactttcggaccgaggggaccagcgtggagatcagacgaatggtgctgcacatctnttctntac

SEQ ID NO: 277437 - DNA, 798 bp, Homo sapiens
  misc_feature: GYAE6OF01BKX2T.29.35.D02.1.454.CMB.1.raw
tcagatagagtactcacgaccggtgctcgatttagcacacgatagttggggtttgggggaggaactgctcagttaggacccagacggaaccatggaagccccagctcagcttctcttcctcctgctactctggctcccagataccagcggagagattgtgttgacacagtcctccagcccacccttgtctttgtccgtaccggggaagaaacgcgccctaccctctccctgcgacgggccagtcagtaagttacgttaaaccaacttacgttcggcctttaggttaccaacagaaaccgtcggaccgacggcctacccgaggtcctcctactacttactagtcgattcgaccactaccaaccggtacgggacccaacggtcggacctaccgtcccgaacgtccgtaagggtttccgaagggtcggacggtaagggtccgggggttcgtacggggtaaccgtagtaccctttaccgtaccttccgtaaccaaccctaacgtccgacccggtacccgtaccgtacggaccgtccggtaggtacgtacgttacgttccggtttaccgtttttaatttcgtttacggttcggtttacgggtaccgttaacggtacccgtaaccggttccgggttacccccgttcccggtttaccgtttaccgggtttttaccgggacccgggtaaccggggttaaccgaccggtacgggttacggaaccgttagaaccggtaaggtaaaccggtacgttacgggtcgtccgtacgacccgtactcgttaccttacgttccgttcttaccccg

SEQ ID NO: 277438 - DNA, 547 bp, Homo sapiens
  misc_feature: GYAE6OF01E0XN6.29.35.D02.1.454.CMB.1.raw
  modified_base (256)..(256): a, c, t, g, unknown or other
  misc_feature (256)..(256): n is a, c, g, or t
tcagatagagtactcacgaccggtgctcgatttagcacacgatagttgggtttgggggaactgctcagttaggacccagacggaaccatggaagccccagctcagcttctcttcctcctgctactctggctcccagataccagcggagagatttgtgttgacacagtctccagccaccctgtctttgtctccgggagaaagagccaccctctcctgcagggccagtcagagtgttaacactactggcctgtccaanagaactgcagctccagctctcatcatgatgcatccaagagggccactggcatcccagccaggttcagtggcagtgggtctgggacagacttcacttctacacgatccagcccgcagacgcctggagggtactttcgtgttccgtttattagttgtcgtttgggcgttgactaaccgtggcccttcccgtctacgttttcggccgacggggtaccaagcgtggagacgttacaggtaaccgaacgttgtcggcttacgccacccgtactcttgttcccttgtactttccccg

SEQ ID NO: 277439 - DNA, 815 bp, Homo sapiens
  misc_feature: GYAE6OF01EJZNL.29.35.D02.1.454.CMB.1.raw
  modified_base (258)..(258): a, c, t, g, unknown or other
  misc_feature (258)..(258): n is a, c, g, or t
tcagatagagtactcacgaccggtgctcgatttagcacacgatagttgggtttggggaggaactgctcagttaggacccagacggaaccatggaagccccagctcagcttctcttcctcctgctactctggctcccagataccagcggagagattgtgttgacacagtctccagccacctgtctttgtctccgggagaaagcgccaccctctccttcgaggccagtcagagtgttaacactactggcctggtaccaanagaacctggccaggcctcccgaggcctcctcatctatgtatgactactaccgaaacgacggggcccaacgtcgggacctactccccgaagtccccgtaagggttccaagggtcggacgtagggttcggggtcgtaggggaacctaggtacctttcgacttcctacccaacacttcccgacggtccccgtacccgtaacgtacggacccgttaggaacggttactttccgttacggtttaccgttttaacgtttacgtttcggtttccggtttggggtaccgttaacggtacccgtaaccggtttccgggtcccccgtttacccggttacccgtttaaccggtttttccggggaaccccgggttaaacgggggtaaccccgtaaacgggtccggttaacggggacggttaacgttacccggtaaacgggtaacccggttaaaccgggtttacgggttaccgggtccggttaacccggtacccgttaaaccccggttacgtttaccccggtttaccggttttccccgttttaacccggtcccgtttttaacccccccgg

SEQ ID NO: 277440 - DNA, 984 bp, Homo sapiens
  misc_feature: GYAE6OF01DFQQM.29.35.D02.1.454.CMB.1.raw
tcagatagagtactcacgaccggtgctcgatttagcacacgatagttgggtttgggggaggaactgctcagttaggacccagacggaaccatggaacgccccagctcagcttctcttcctcctgctactatggcctccagataccgagcggagagtattgtgttgacacgtagtcctccagccctacccttgttctttcgtcgtaccgggaagaaacgacgccctacccttcctaccgtcggacgaccggggcctaacgtcgaaggtaagttacgttaaacctaacgtttcgttggtacccgtttacggttacccaaaagaaccggtaaacccgttcggacccgacgggtaccctcccggtacggtcctccctactacttcgttaacgtcggtaatttcgacctaaccgtaacccgaaacggacccggggaccctaaccggtaccgggacctaacccggtaccccgtaacggtaccccggttaacgggttaaccgtacggggttacggtaccggttaacggggggtttcccggggttacggttaacggggggtaactaaacccgggtcctttaacccgtaaccgtttccgaaacccctaccgttacgtaacccgacccggtacccggtaccccgtaacgggtacggttaaccccggttacggaacgggtttaccgtttaaccggttttccggttttaacccggttttttaagttttaccgggtttttacgggttttacccgggttcgggggttaacgttaacccgggtacgttaaccccgggttccccggtttacccgtttaccccgggttacggtttacccgggttttaacccgggacccgggtaacggggtaaccccgtagggcggttaaaccggtacggtaccgtaaccgggtaaacggtacggttaacccgggttaggtacccggtcgtacccgtaacccgttactacccgttcccgttacttttcccgtacgttacccc

SEQ ID NO: 277441 - DNA, 731 bp, Homo sapiens
  misc_feature: GYAE6OF01A71GP.29.35.D02.1.454.CMB.1.raw
  modified_base (701)..(701): a, c, t, g, unknown or other
  misc_feature (701)..(701): n is a, c, g, or t
  modified_base (713)..(713): a, c, t, g, unknown or other
  misc_feature (713)..(713): n is a, c, g, or t
  modified_base (718)..(718): a, c, t, g, unknown or other
  misc_feature (718)..(718): n is a, c, g, or t
tcagatagagtactcacgaccggtgctcgatttagcacacgatagttgggtttggggaggaactgctcagttaggacccagacggaaccatggaagccccagctcagcttctcttcctcctgctactctggcctccgagactaccagcggagagtattgtgttacgacacgtacgtctccacgccctacccgttgttccgttttgtccgtaccggggaagaaacgccgacccctacccttcgtacccgtggccgacgggccagtaccgaggtagttacgttaaaccaaccgttacgttcggtacccgttggttaacccaaacgtaaacgtaaacccgtcggacccgaacggtccctcccgacggtcccttcccactacttcgtaagtcggaagtccgtacaactacccggaaacggccggaccctaccgtcggtaccacctcccgaccgtaccgtacgttacgaggtccgcgtacgggttcggcggtacgggaactacggtaccttacctacctaccgtaccaccgtatacccgtaccgtacccgtacgtaacgccgtcgtacgcggttactcgttacgtttacctttagttacgttcggtgttcggcgtacgaccttcgtccgtcccttccgtccgttacggttaccggcggtaaccggactacgtcgtaggcgtaccagaacgtacgtattcgggctcnccgactaccgtntcttnttccgtcgtcccg

SEQ ID NO: 277442 - DNA, 766 bp, Homo sapiens
  misc_feature: GYAE6OF01DDK95.29.35.D02.1.454.CMB.1.raw
tcagatagagtactcacgaccggtgctcgatttagcacacgatagttgggtttgggggaggaactgctcagttaggacccagacggaaccatggaagccccagctcagcttctcttcctcctgctactctggcctcccagactaccgagcggagagtattgtgttgacacagtctccagccctaccttgttctttgtcgtaccggggaagaaagacgcccaccctctccgtgaccgacgggccagtcaaggtagttacgttaaaccaacttacgttcgggaccgttacgggttaccaaaacgtaacggtaaacccgtcgggacccgacgggtccctacccggacggtccttccctcattacctagtaggactcgacctactacccgaaacgacgggtcccaggtcggacctaactacccgagtccgtacggtcgaacggtcggacggtagggttgggtacgacgggtaactacggtaccttccaacgttcacctaaccctctaccggaccggtacccgtacgtacggtaccgtccgttagggtacgttactttcggttaccgtttacgttttacgtttaggtttcggttacgggttcgggtacgtaccggtacgttaccggttcccggtcccgtttacccgttacgttaccggtttaccgggaccggtacgggtaaccgacggtcgtaggtactacgtacggacggtaacgtaggttcggtcggtacgtacgcccgtacgtactcgttacctccgtccgttacccg

SEQ ID NO: 277443 - DNA, 338 bp, Homo sapiens
  misc_feature: GYAE6OF01D92LL.29.35.D02.1.454.CMB.1.raw
  modified_base (199)..(199): a, c, t, g, unknown or other
  misc_feature (199)..(199): n is a, c, g, or t
  modified_base (213)..(213): a, c, t, g, unknown or other
  misc_feature (213)..(213): n is a, c, g, or t
  modified_base (313)..(338): a, c, t, g, unknown or other
  misc_feature (313)..(338): n is a, c, g, or t
tcagatagagtactcacgaccggtgctcgatttagcacacgatagttgggtttgggggaggaactgctcagttaggacccagacggaaccatggaagccccagctcagcttctcttcctcctgctactctggctcccagataccagcggagagattgtgttgacacagtctccagccaccctgtctttgtctccggganaaagagccaccctntcctgcagggccagtcagagtagttaacaactacttggccttaggttaccaaaacgaagaaaacccgtgggacccaaggcctaccccaaggcctcctacnnnnnnnnnnnnnnnnnnnnnnnnnn

SEQ ID NO: 277444 - DNA, 838 bp, Homo sapiens
  misc_feature: GYAE6OF01C40AZ.29.35.D02.1.454.CMB.1.raw
  modified_base (211)..(211): a, c, t, g, unknown or other
  misc_feature (211)..(211): n is a, c, g, or t
tcagatagagtactcacgaccggtgctcgatttagcacacgatagttgggtttggggaggaactgctcagttaggacccagacggaaccatggaagccccagctcagcttctcttctcctgctactctggctcccagataccagcggagagattgtgttgacacagtctccagccacctgtctttgccgtcgggagaaagcgccaccctcncctgcgagggccagtcgagtatagtaacaactacgttcggccttaggtaccaaacacggaaaccctggaccgaggcctacccgaggcctccgtactatctaagtcgatgaccaacgtacccgaaacgtcgggaccctaacgtacggacctaacgtccccgaacggtaccgtaccgggttaccaaggggttcggaaccgtaaggggtttcgggggtacccgggttaacggggaacctaaacgggttaaccctttacccgtaaaccgttaccccgttaaacccaaccgtaccgttaacccgaccgggtacccccgtaccgtaaaccgggtaacggttaccccggttaagggtaacgggttaacgtttaccgttacggtttaaccgttttaagtttacgttttacggtaccggtttacggggttacgtacggtaacgtaaccggttcggtacccccgttaacccggttcccgttaaccgggtttttaccgggaacccgggtaacgggtaaccccgtaacgggacccgttaagggaccgtaaacgtaaccgtaaaccggtaaccggttaaggtccggtacggtacgtaccgtaacctaaccgtacgttcgtacctttcgtcccgttacccg

SEQ ID NO: 277445 - DNA, 779 bp, Homo sapiens
  misc_feature: GYAE6OF01DTYS4.29.35.D02.1.454.CMB.1.raw
  modified_base (201)..(201): a, c, t, g, unknown or other
  misc_feature (201)..(201): n is a, c, g, or t
  modified_base (364)..(364): a, c, t, g, unknown or other
  misc_feature (364)..(364): n is a, c, g, or t
tcagatagagtactcacgaccggtgctcgatttagcacacgatagttgggtttgggggaggaactgctcagttaggacccagacggaaccatggaacgccccagctcagcttctcttcctcctgctactctggcctcccagataccagcggagagattgtgttgacacagtctccagcccacctgttctttgcgtcggganaaagcgccacctctcctgcgagggccagtcagtagttcgtaacactgtcggcctggtaccaaacacgaaaccgtggaccaggcctcccgacggtcctaccgtcattccgtagtgacttcgactaactacccgaacgtaccgggacctaacgtggaccctaacnccccgtaagccgtaaggttcgacggttggcgtagggtcgggtacgtacggggaactacggtaccttacaccgtttacacctaaccgtacgtaccgaccgcccggtaccgttaacggccgtaccgttacgggtaaggttacgtttccgtttaccggtttacgttttacgtttacgtttcggttacggtttacggggtacgttaacggtacgttaccggttaccggttaccccgtttacccggttaccttttaaccggggtttaccggaacccggggtaacggggtaacccgtaacgggtcgtaacgggtaacgtaccgtaacgtaacgggtaaccgttaacgggttcgggtaacccggcgttaacccggaccctaaccgttacgtaccggtttcctttaccgttcccgttaacccg

SEQ ID NO: 277446 - DNA, 879 bp, Homo sapiens
  misc_feature: GYAE6OF01EOYEP.29.35.D02.1.454.CMB.1.raw
  modified_base (473)..(473): a, c, t, g, unknown or other
  misc_feature (473)..(473): n is a, c, g, or t
tcagatagagtactcacgaccggtgctcgatttagcacacgatagttgggttgggggaggaactgctcagttaggacccagacggaaccatggaacgccccagctcagcttctcttcctcctgctactctggcctcccagatacccaggcggagagtattgtgttgacactagtctccgacgccctaccgtgttctttggtctaccgggaagaaacgcgcccaccctctcctgcgagggccagtcaagtagtacgttaaactaacttacgttcggtccttacggttacccaaacgtaacgaaacccgttcgggacctaacgggtccccttacccgtaaccgggtcccttaccgtactacttaccgtaagttcgaaactcggacctaaccgttaaccccgaaacggaccgggtccctaaccggttggaccaaccgtacccgaaccggtaccgtacgggttaccgaggttccggnggttaacggtcggggttacgacggggcctaaacggttccgttaccgtaccgttacccaacgtacccgtaacgtacgacccggtacccgtaaccgtacggtaaccgtacgtacgggttaacgtccgttttacgttaccgggtttaaccgttttagtttacggttttcggttcggtttaccggtacgttacgtaccgtaaccggtttccggtacccgtttacccggtttcctttaacggggtttaacccggacccggtaaacggggtacccgtaacgggtacccgtaaggggtaaccgtacggttaaaccacgggggtaaacccttaggggttaccgggttaggacccgttaacggtaccctaaccccggttactttccggtttacccgttccctttacgttaccccg

SEQ ID NO: 277447 - DNA, 715 bp, Homo sapiens
  misc_feature: GYAE6OF01DIN3V.29.35.D02.1.454.CMB.1.raw
  modified_base (195)..(195): a, c, t, g, unknown or other
  misc_feature (195)..(195): n is a, c, g, or t
  modified_base (200)..(200): a, c, t, g, unknown or other
  misc_feature (200)..(200): n is a, c, g, or t
  modified_base (208)..(208): a, c, t, g, unknown or other
  misc_feature (208)..(208): n is a, c, g, or t
  modified_base (294)..(294): a, c, t, g, unknown or other
  misc_feature (294)..(294): n is a, c, g, or t
  modified_base (307)..(307): a, c, t, g, unknown or other
  misc_feature (307)..(307): n is a, c, g, or t
tcagatagagtactcacgaccggtgctcgatttagcacacgatagttgggtttgggggaggaactgctcagttaggacccagacggaccatggaagccccagctcagcttctcttcctcctgctactctggcctcccagataccagcggagagattgtgttgacacagtctccagccacctgtcttgctcggganaagcnccacctcncctgcagggcctagtcagtatacgttaaacaactcgttcggccttggtaccaaacaagaacctggaccaggcctcccaggcctccnctatcctatgatnacactaccgaagaccgggtccaacgtcggacctactacccgacgccgtaagttccgaaggtcggacgtaggggttcgggttaccgtacggggtaacctaacggtacctttaccaccgttacctacccaaaccgtctacccggacggacccgtaccgtaggtaccgtaccgtagggacgttacttacgttacgtttccgttttaagttcgtttacggttcggttagggtccgttaacgaccgtacgttcggtccccttacccggttacttaccgggtttacggacccggtaacgggtaaccgtacggtacggttagggaacgtacgttacggaacgtaaaccgtaggttacggtcgggtactaccgaaccggtacctaacgttccgtttacgttaccgttcttacccgg

SEQ ID NO: 277448 - DNA, 826 bp, Homo sapiens
  misc_feature: GYAE6OF01BRNHA.29.35.D02.1.454.CMB.1.raw
tcagatagagtactcacgaccggtgctcgatttagcacacgatagttgggtttggggaggaactgctcagttaggacccagacggaaccatggaagccccagctcagcttctcttcctcctgctactctggcctcccagataccagcggagagattgtgttgacacagtcctccagccctaccgtgttctttgtccgtaccgggaagaaacgcgccctaccctcgtcccgtgacgacgggacctagtacgaagtacgttaacttaaaccacttacgttcggccttacggttaccaaacgtaacgaaacccgtcggacccgtacggtccctacccggacggtcccttacccgtactacgtttccggttttggacgtccacttacccgtaaccgaacgggtcccacggttcggacccgtaccgtaccccgtaacggttcccgggttacacgggtcggtaccgtaggggtcggtaccgtacgggacctacgtacttacctccgttacctaccgaacctagtaccgacggtaccgtaacgggtccgggttaccggggtaccttagggaaaggtctacgaccgttaattaccgttaagttacgttactttacgtcgttaacctagttaaccgttaagtttacggtttaccgtttcgtttaaccggttaccgtttaccgtccgtttaaccccgtaccggtttacccgggaaccggtaacgggtacccgtacggttaaacggtacggtaaaaccgttaacggttaaaccggttagttcgggtacccgtaccgtacggtacctacgttcgttacgtttcgtacctcgtaacccg

SEQ ID NO: 277449 - DNA, 736 bp, Homo sapiens
  misc_feature: GYAE6OF01E5TM5.29.35.D02.1.454.CMB.1.raw
  modified_base (426)..(426): a, c, t, g, unknown or other
  misc_feature (426)..(426): n is a, c, g, or t
tcagatagagtactcacgaccggtgctcgatttagcacacgatagttgggtttgggggaggaactgctcagttaggacccagacggaaccatggaagccccagctcagcttctcttcctcctgctactctggcctcccagataccagcggagagattgtgttgaacactagtctccagccctaccctgtctttgtcgtaccgggaagaaagcgcccaccctctcctgcgagggccagtcagtagttagttaaaccaacttcgttggccttcggtaccaaacgagaaaacccgtggacccgaggcctcccgacggtcctcctcgactcttaatgatgccactaccgaacgtcgggacctacgtacggccacgtcccgacgtccgtaggttcgaggtcggacgtaggggtgggtccgtaggggtaacncggtaaccttcgacctccgtaccacctacgaccgtaccggcccgtaccgtaggtccggtaccgtagggtacggttacttccgttacggtttaccgttttaagtttgttacggtttccggtaggtacccgttacgtaccgtaccgtcggttacccccgtcccgttccgtttagggtttcccggaccggtaacggggtaacctacgggacggttacggaacgttaacgtaccgaaacggtccggtaaccgtggtccgggtactaccgtaccctaacgttacgtttcccgtcgtttcccgttcgttacccccg

SEQ ID NO: 277450 - DNA, 997 bp, Homo sapiens
  misc_feature: GYAE6OF01CY9FM.29.35.D02.1.454.CMB.1.raw
tcagatagagtactcacgaccggtgctcgatttagcacacgatagttggggtttgggggaggaactgctcagttaggacccagacggaaccatggaagccccagctcagcttctcttcctcctgctactctcggctcccagactacccgaggacgggagtagtatttggtgttgaacacgagttcctccacgtccctacccgttggttcctttaggtccgttaccggggaacgaaaacggcgtaccctacccttcctccgtaggaccgaacggggaccctaggtaacctaaggtaacggtttaacggttaaaaccctaaccgtttaacggtttccgggaacccgttacggggtttaacccaaaaaccgtaacgggtaaaaaccccgtccggggtaacccggaaccgggtaccccgtaccccgtaaacgggtcccttacccgttacctaactttacccgttaattacgaagttaccgtacctaccgtaccgaaaccgacgggggccctaacggtcggaacctaccgtaccccgacgtaccggttacggttacggtacgggtagggtacctaacgggggttcggggttaccgtaggggtaacccgtaacggttacctttacccgaccgttaccctaacctaacccgtactacccggttaacgggccccgtaacggtaacggttaccgtaccggtaaggttaacggtttcccgtttaaggtttacccgggttttacgtttttaacgtttacggtttccggttaacgggtttaccggggtccttaaaccgggtaacccgtttaacgggtcccgggttacccctttcccgggttaaccggttttaccggttaccggggtacttaaccggggaacggttacccgaaagggttcggttaaccgggaaaagttccttaaccggaaagggttaccccgtaaggtccgggtaccgtacggactaaccccgttactcgtttaaccgtttcggttcccttaaacccggg

SEQ ID NO: 277451 - DNA, 747 bp, Homo sapiens
  misc_feature: GYAE6OF01DVJLG.29.35.D02.1.454.CMB.1.raw
tcagatagagtactcacgaccggtgctcgatttagcacacgatagttgggtttgggggaggaactgctcagttaggacccagacggaaccatggaagccccagctcagcttctcttcctcctgctactctggcctcccagactaccaggcggagagtatttgtgttgacacagtcctccagccctaccttgttctttcgtcgtaccggggaataaacgcgccctaccctctccgtgcgacgggccaggtcagtagttacgttaaaccaacgttcgttcggccgttaggttacccaaacgtaacgtaaacccgtcggacccgacggtccctacccgtacggtcccttaccgtcacttctagtcgtatcgactactaccgaacggccggaccacgtcggacacctaccgacgtaccgtaggttacgacggtcggtacgtagggttcgggtaccgtagggacacgttactcctaccgttacctacctaaccgtacgtaccgaccgtcccgtactacgacgtcgtaggacgttcgttacgtcgtttaccgtttagttacggtttgttcggttcgggtaacgtcggtaccgtaccggtccggtaccccgttacccggttacgtttaccgggtttaccgggacccgggttaacgggaacccgtaggtcggtagggactacgtacgtaacggtacgtacgttgggtaccgcgtacggtaccctaacgttcttcgtacctttccgtcttacccgg

SEQ ID NO: 277452 - DNA, 743 bp, Homo sapiens
  misc_feature: GYAE6OF01EV3E7.29.35.D02.1.454.CMB.1.raw
  modified_base (319)..(319): a, c, t, g, unknown or other
  misc_feature (319)..(319): n is a, c, g, or t
tcagatagagtactcacgaccggtgctcgatttagcacacgatagttgggtttgggggaggaactgctcagttaggacccagacggaaccatggaagccccagctcagcttctcttcctcctgctactctggcctcccagactaccaggcggagagattgtgttgacacagtcctccacgcccacccttgttcctttgtccgtaccgggaagaaagcgccccacccttctcctgcgagggccagtcagagttagttaaaccaacttcgtggccttggtaccaacgaacgaacgtcggccaggcctcccgagtcctaccncatctatgatcgccactccaaacgcggacctacgtcggacctacgtcccagtacccgtagggttccaggttcggcgtaggtcggggtcgtaggggacctaacgtaccttacaccttaccgtaccaccgtaacgtcgaaccggtccgtaccgtacggaaccgtccgtaggacggttacgttccgttacgtttacttttagtttacgtttggtttacggtttcgggtaccgttaacgtacccgtaaccggttccggtccccggtttcccgttaccgttacggtttcccgggaacccgggttaacgggtaacccgtaggtccggtaacggtaacgtccgtaacggtaacgtaaccggtaacggtagggtcgacccggtccgtaacctaacccgttcgttaaccgttccgttaccttccgttaccccg

SEQ ID NO: 277453 - DNA, 924 bp, Homo sapiens
  misc_feature: GYAE6OF01DXN8I.29.35.D02.1.454.CMB.1.raw
  modified_base (908)..(908): a, c, t, g, unknown or other
  misc_feature (908)..(908): n is a, c, g, or t
tcagatagagtactcacgaccggtgctcgatttagcacacgatagttgggtttggggaggaactgctcagttaggacccagacggaaccatggaagccccagctcagcttctcttcctcctgctactctggctcccagataccagcggagagattgtgttgacacagtctccagccaccctgtctttgtcgtccgggagaaacgacgcccctaccctctcctgcgacgggccagtcagtacgttagttaaacctaacttacgttggaccgttcggttaaccgaaaactaacggaaaacccgttcgggaccccgtaacgggtcccttcccccggaagggtcccttaccccgtaccgtaacttaccgttaacgttcggtaacgtttcggaaccctaaccgttaaccccgaaaaccggaaccgggggtacccctaaccggtttaccggggaccctaaacccgttaccccccgaacggtacccggttaacgggttttaccgtaacgggggttcgggaccgggtttaacgggggttacggggggttacccgggttaacgggggtaaaccgtaacggtttaaccccgttttaacccggaaccctttttccccgaaaccccgtaacccgttaaccgttaccggaccggtacccggttaaccccgttaacgggtaccgttacccggttacgggttacggttaacgtttccggttacggtttaccgtttttaagtttacgtttcgggtttaccggttacggggttaccggttacgtaccgttaaccggttccgggtacccgttacccgtttacggttacccggttttcggacccggttacggggtaaccgtaggtaccgtaggtaacgtacgtacgtaacgtaccgtaacgtcggtcgactcggacctactacgttntcgtcgttcgtacccg

SEQ ID NO: 277454 - DNA, 727 bp, Homo sapiens
  misc_feature: GYAE6OF01B5ENV.29.35.D02.1.454.CMB.1.raw
tcagatagagtactcacgaccggtgctcgatttagcacacgatagttgggtttgggggaggaactgctcagttaggacccagacggaaccatggaagccccagctcagcttctcttcctcctgctactctggctcccagataccagcggagagattgtgttgacacagtctccagcctaccctgtctttcgtctccgggagaaagacgccaccctctcctgcagggccagtcagagttagttaaccaactacttcggccttaggttacccaacaacgaaaccgtcggaccgacggccgtccccgacggcctcctacctactcttactagactcgcctactacccgaacgacgggccaacgtcggacaccgtacccacgccgtacggttacgacggtggacgtagggtcgggtcgtacggggtacgtaacgtaccttactaccttacctaccgacctaacgtcaccgaccgtaccgtaacgccgtaccgtacggtacgtacgttaccgttacgttaccgttttaacgtttagtttcgttcgttacgggtacgttacgacgtaaccgtcggtaccccgttccgttaccgttaccgtttccgggaccggtaacgggaccgtaacggtccggtaggtacggtaacgtacgaaggtaaccggtaacgtcgggttacgtaccgtacggacccgtaacccttacgttaccgttccggtttcttaccgttacccg

SEQ ID NO: 277455 - DNA, 1034 bp, Homo sapiens
  misc_feature: GYAE6OF01A2RCS.29.35.D02.1.454.CMB.1.raw
tcagatagagtactcacgaccggtgctcgatttagcacacgatagttgggtttgggggaggaactgctcagttaggacccagacggaaccatggaagccccagctcagcttctcttcctcctgctactctggcctcccagataccaggtcggaagagtatttaggtgtttaggaccacgtacggttcctaccgacgcccctacccgttggtttccgttttacggtccgttaaccgggggaaagaaaacggaccgtaccccctaaccccgttcttcccggtcggaccggaccggggtacctagtaccgaaaggtacggtttacgttaaacctaaccgttacggtacggtaccgttacggttaacccaaaacgtaaccggtaaaccgtcgggacccgacggtccctaacccggtacggtcccttcgtacctacgttaccttagttcgtaacgtccggtaacctaacccgtaaaccccggtaacggacccgggggtacccttaacggtcccgggtaaccctaaccccggttacccccggaacggttaacccgggtttaaccggggttaaccgtacgggggttaacgggtaacccgggttagggggtttacccggggaccgggtaaaccggggtaaacccctaacggttttaacccccttaacccgaccccgttttacccgtaaaccccgtaaacccgttaaacggttcccccgaacccgggttaccccgtaacccggttaaccggtaccgttacggtaacggggttaacgtttaccgtttacccggtttacggtttaaccgttttacggttttacgtttaccgggttacggttacgggtaccgttacggtaccggtaaccgggttcccggttaccccgtttaccggttaccgtttaccggggttccgtaacccgggtaacggtaccgtacggcgtaacggtacgtaaccgtaacggtaccggtaacggttacgggtacggttccggtacgtaacccgccgttaaccgtccgttacgttctacccgtttccgtacccg

SEQ ID NO: 277456 - DNA, 765 bp, Homo sapiens
  misc_feature: GYAE6OF01BGZ86.29.35.D02.1.454.CMB.1.raw
  modified_base (197)..(197): a, c, t, g, unknown or other
  misc_feature (197)..(197): n is a, c, g, or t
tcagatagagtactcacgaccggtgctcgatttagcacacgatagttgggtttggggaggaactgctcagttaggacccagacggaaccatggaagccccagctcagcttctcttcctcctgctactctggctcccagataccagcggagagattgtgttgacacagtctccagccacctgtctttgtctccggganaaacgcgccaccctctcctgcgagggccagtcagagtacgttaaacaactacgttcggccttcggttaccaaacgtaacgtaaaacccgttcgggacccaacggccttacccgaggtccttccgtactacttccgttagtcggtatcgacctactacccgaaacggacgggacccacggttcggaccacgttccccgagaccgtaggttcgacggtacggacgtaggggttcgggtacgtacggggaaccgtacggttaaccttccgtaaccgtcccgtaccgtaacctacgtaccgaccgggtacccgtacccgtaacggaccgtccgtaggtaacgttacgtttccgttacggtttaccgtttttaagtttagtttcggtttacggtttacgggtacgttacgtaccgtaaccgtccggtaccccgttacccgttaccgttaccggttttaccgggaccggtaacggggaccgtacggtacgtacggacgtacgtaaccggaacggtaccgtacgtgggttcggaccttacggacccgtactacttgttccgttcttcgttacccg

SEQ ID NO: 277457 - DNA, 827 bp, Homo sapiens
  misc_feature: GYAE6OF01BV50V.29.35.D02.1.454.CMB.1.raw
  modified_base (160)..(160): a, c, t, g, unknown or other
  misc_feature (160)..(160): n is a, c, g, or t
tcagatagagtactcacgaccggtgctcgatttagcacacgatagttgggtttggggaggaactgctcagttaggacccagacggaaccatggaagccccagctcagcttctccttcctcctgctactctcggcctcccagactaccaggcggagtagtnttgtgttagacacgtgtcctccacgtccctacccgttgttctttcgtccgtacgggaagaaacgcgaccctaacccctctccctggacgacgggaccagtacgagaagttacgtaaacactacgttggaccgttagtaccaaagtaacgaaccgtcggacacggacctacccgaggtcctacctacacttacttacgtaagtaactcggtacctaactaacccgaaacgaaccgggtacctaaccggacggacctaaaccctccgaaccggtacccgttacggttacgaaggttcggacgtaaggggttcgggttaccggacgggtacaaaccggttaccgttaccaaaccgttcccgtaccaaaacgttccgaccgtacccgtaccgacccgttaggacccgtaacgtaacgtttacgtaccgtttacgtaaccgttttagttttaacgtttacgggtcgttaccgggttagggtacccctaagtacccgttacccggtacccgtttccccggtttaaccgtttacggtttaacccgggtccgggaaccgggttaacccgaagtaacggtaccggtagtaacgtaaccgtacggtaaggtaaccgtagggtccgggtacaccgttacgaaactttacggacttacgttacgttccacccgttaccc

SEQ ID NO: 277458 - DNA, 904 bp, Homo sapiens
  misc_feature: GYAE6OF01A3VXC.29.35.D02.1.454.CMB.1.raw
  modified_base (166)..(166): a, c, t, g, unknown or other
  misc_feature (166)..(166): n is a, c, g, or t
  modified_base (265)..(265): a, c, t, g, unknown or other
  misc_feature (265)..(265): n is a, c, g, or t
tcagatagagtactcacgaccggtgctcgatttagcacacgatagttgggtttgggggaggaactgctcagttaggacccagacggaaccatggaagccccagctcagcttctcttcctcctgctactctggctcccagataccagcggagagtattgtgttgacncagtctccagcccacctgtctttgtccgtcgggagaaacgcgcccaccctctcctgaccgacggggccagtccaaggtagttacgttaaacaaccgttnttcgggcccttacgggttacccaaacgtaacgaaacccgtcgggaccctacgggtccctaccccggaggtaccttccctacaacttcctaagttacggaacttcggacctaacttaaccccgaaacggtaccgggggtaccccaacggttcgggacccttaacccgtacccccggtaacggtaaccccggtaacggggttttaccaacgggggtttaccgggtaaccggtaacgggggttcggggggtttaacccgtacgggggtaacccgtaaaaccgggtttaccctttaccggtaaacccgttaccccgttaccccggtaaacccctaagttaccccggtaacccgggtaccccggtaccccgtttaaacggggacccgttacccgggtacgggttaacggtaacccgttttacgttaaccgggtttttaccgtttttaacggtttacgtttcgggtttaccggtttcggggtaacgtttacggtaccgttaaccgggtcccggttaccccggtttcccgttaaccggttaggtttacccgggaccgggttacgggaacccgtagacggtagtacgtacgtacgaacggtacggtacgtggtcgacgtcgacctctacgtctcgttcttcgtaccg

SEQ ID NO: 277459 - DNA, 816 bp, Homo sapiens
  misc_feature: GYAE6OF01EMYBN.29.35.D02.1.454.CMB.1.raw
tcagatagagtactcacgaccggtgctcgatttagcacacgatagttgggtttgggggaggaactgctcagttaggacccagacggaaccagtggaacgccccagctcagcttctcttcctcctgctactctggcctcccagactaccgaggcggagagtatttgtgttagacactagtcctccacgccctacccttgttcgtttcgtccgtaccggggaagaaaggccgcccctaccctcctccgtgcgacgggcctagtcgagtagttacgttaaaccaacttacgttcggcccgttacggtacccaaacaacgtaaacccgtcggaccgtaacggtccctacccgagtccttacccgtactaacgttaccttaagtacggtacgtacgacctaaccgtaacccggaaaccggaccgggtaccctaaccggtcggacctaccgtccccgaacgtcccgttaggttaccgaggtcggacgtagggttcgggtacggtagggacctacgtacctacacccttcgtaccaacctactccgaccgtcccgtaccgtacggacgtccgtaggtacgttactttcgttcggtttaccgttttagtttacgtttcgttacggttcggtacgttacgtaccgtaccgtccggtcccgttacccgttacgttaccggtttcgggacccggtaacgggtaaccgtacggtaccggtagggtacgtacgtaaccggtaacggtaaaccggtacggttcgggtccggtaccgtacgttaccgtaaccgttacgtttaccgtttccgtttccgttaccgttaccccg

SEQ ID NO: 277460 - DNA, 625 bp, Homo sapiens
  misc_feature: GYAE6OF01AL32M.29.35.D02.1.454.CMB.1.raw
  modified_base (203)..(203): a, c, t, g, unknown or other
  misc_feature (203)..(203): n is a, c, g, or t
  modified_base (289)..(289): a, c, t, g, unknown or other
  misc_feature (289)..(289): n is a, c, g, or t
tcagatagagtactcacgaccggtgctcgatttagcacacgatagttgggtttgggggaggaactgctcagttaggacccagacggaaccatggaagccccagctcagcttctcttcctcctgctactctggctcccagataccagcggagagattgtgttgacacagtcctccagccaccctgtctttgctccgggagaaancgccacctctcctggcagggccagtcagatagttaaccaactctggcctgtaccaacagaacctggtcaggcctcccgagcctccnatctatgatcggcactaccaaacgtcgggaccctacgtacggacctaacgtccccaggtacccctaagggtttccaaggtcggtacgaagggttcggggtctacggggaacacggtaccttacaccgttctcaaccctagtaccaccgtccgtaccgtagacgtcctaggaggtacttcgtacggtttacgtttatttacgttgttccgttcgggacgttacgactaaccgtcggcccttccccgtgtaccgtttcgggaccggtaacgggacctagcggtagagtacacgaacgtacatgggtcacgtcaccgacctatcgttcgtctcgtaccg

SEQ ID NO: 277461 - DNA, 756 bp, Homo sapiens
  misc_feature: GYAE6OF01ETIQP.29.35.D02.1.454.CMB.1.raw
  modified_base (227)..(227): a, c, t, g, unknown or other
  misc_feature (227)..(227): n is a, c, g, or t
tcagatagagtactcacgaccggtgctcgatttagcacacgatagttggggtttggggaggaactgctcagttaggacccagacggaaccatggaagccccagctcagcttctcttcctcctgctactctggctcccagataccaggcggagagtattgtgtcgacactagtctcagcccacctgtctttgtccgtaccgggaagaaaacgcgcccaaccctctccncggacacgggtccaagtccgaagtagttacgtaaaccaaacttcgtcggtaccttagggttacccaaacgaccgtaaaaccgtcggtacccgaacggtcccgtacccgaggtcctacctactacgtcttaagagtacgttcgacctaacgtacccgaacgacggggcctaacgcggtaccacgttcccgacggaccgtaggtaccgaggtcggtacgtacgggtcgggtaccgacgggactaacggttaccttaacgtacctacgtaccgaaccgtagtacccggaaccgccgtaaccctagggcctacgttaagggtacgtacgttcgttacgttaccgtttattcgttacgtggttacggtgtaacgaccgtacgtccgtaaccttcccggtacgttacgttacccgggacgtaacgggtaccacggtacggtaggacggtacaccggtaacggaccggtaagtcgggttaccgaccgttaccgaaccgttaccttacgttacccttcgttcccgtcgttaaccccg

SEQ ID NO: 277462 - DNA, 851 bp, Homo sapiens
  misc_feature: GYAE6OF01BM3Y2.29.35.D02.1.454.CMB.1.raw
tcagatagagtactcacgaccggtgctcgatttagcacacgatagttgggtttgggggaggaactgctcagttaggacccagacggaaccatggaagccccagctcagcttctcttcctctgctactctggctcccagataccagcggagagtagttgtgtgacacagtctccagcccaccctgttctttgtccgtccgggaagaagcgccacctctccgtgcgaggccagtcgagtagtacgtaacctaacttacgttcggccttaggttaccaaagaacgtaaaccgtcggaccacggtcctacccgacgtcctccctacattacctagtcgaacgtcgctaacgtacccgaaacggtaccgggaccctaacgtcggacctaccgtaccccgaacgtacccggtaaacggttcgtaacggtggacgtagggttcggggtaacgagggtaactacgtacttaccgtactaccgtaacccacgtacgtacggaacccgtcccggtaaccgttaacggaacggtacccgtagggtacggtttaacgttccggttaccggttttaaccggtttttaactttacggttttccggttacgggtttacgggtaacccgttacggtaacccggtaaccgtttccgggttacccccccgttccggttttaacccggttaccggtttaaccgggtaacccgggtaacgggtaaccccgtaaagggttcccgtaaggggtaaaccgttaccgtaaacggtaaccggggtaaaccgttacggttcgggtaccgtacccggtaacgacccgttaaaccgacggttttcccttaaccgttttcccgtccggttttaacccccg

SEQ ID NO: 277463 - DNA, 775 bp, Homo sapiens
  misc_feature: GYAE6OF01D6IWQ.29.35.D02.1.454.CMB.1.raw
tcagatagagtactcacgaccggtgctcgatttagcacacgataggttggggtttggggggaggaactgctcagttaggacccagacggaaccatggaacgccccagctcagcttctcttcctcctgctactctggctcccagataccaggcggagagtattgtgttagacacagtcctccagccctacccgttgttccttttggtccgtaccggggaagaacgaccgcccctacccttcctccgtggccgacgggcctaggtacgaaggtagttacgtttaaaccaaccgtttacgttcggtacccgttacggttaacccaaaacgtaaccggtaaaccgtccgggacccgaccggtccctacccgtacggtcccttacctctacgttcctaagttggacgtcgacctaacgtaaccccgaacgggtaccggcccgtaacgtccggacctaccgtccccgaacgtaccggttacggttacgtagggtcggccggttagggtcgggtacggtacggactaacgttcccgttacacccttcgaccaccgtacgtaccggaccgtacccgtacgtacggacgttccgtacggttacgttacgttccgtttacgtttacgttttatttcgggttcgggtacgttacgggactacgtcgtaccggttccgtacccgtttcggtacgttccggttcgggaccgaggttcagggtcgtagactcgtaacgcgtaacgtagtcgcggtacctgaccctacgttcttactcgttctcctcccg

SEQ ID NO: 277464 - DNA, 825 bp, Homo sapiens
  misc_feature: GYAE6OF01ENBIF.29.35.D02.1.454.CMB.1.raw
  modified_base (738)..(738): a, c, t, g, unknown or other
  misc_feature (738)..(738): n is a, c, g, or t
tcagatagagtactcacgaccggtgctcgatttagcacacgatagttggggtttggggggaggaactgctcagttaggacccagacggaaccatggaagccccagctcagcttctcttcctcctgctactctggcctcccagataccaggcggagagatttgtggtttgaactacagttcctccacgccctacccttgttccttttaggtccgtaccggggaagaaacggaccgcccctaccccttctccctaggccgacgggcctaggtacagggtaagttacgtttaaacccaacgttcgttcgggtacccgtttacgggtaacccaaagaaccggtaaaccgtcgggaccgtaccgggacccttccccggacggtcccttaccctaccgtaacgttctacgttacgagttaccgacttaccgtaacccgaaacggccggggaccctacggttcggaccctacgtccccgtaacggtcccgtaagggtttccgagggtacggtcgtacggggtttcggggtacggtacggaacggtaacggttacctccttaaccgtctacctaccaacgttcgaccggcccggtacgaacggtacgtccggtagttacggttacgtttacgttcggtttaaccgtttttagttcggttttcggttacggttcgggtacttacgtaccgttaccgtccgttcccgttccgttccgttcggttacggaccgggtacgtaacgtcggngtaggacgtactacggacgtacggtaaggttcggtacgacccgtcggaacctaccgttacttaccggttctttcccttacgttcccg

SEQ ID NO: 277465 - DNA, 762 bp, Homo sapiens
  misc_feature: GYAE6OF01EOI49.29.35.D02.1.454.CMB.1.raw
  modified_base (199)..(199): a, c, t, g, unknown or other
  misc_feature (199)..(199): n is a, c, g, or t
  modified_base (693)..(693): a, c, t, g, unknown or other
  misc_feature (693)..(693): n is a, c, g, or t
tcagatagagtactcacgaccggtgctcgatttagcacacgatagttgggtttggggaggaactgctcagttaggacccagacggaaccatggaagccccagctcagcttctcttcctcctgctactctggctcccagataccagcggagagattgtgttgacacagtctccagcccacctgtctttgtcgtcgggaanaaagcgccaccctctcctgcgaggccagtcagtagttagttaaaccaacttacgttcggcccttggttacccaaacgaacgtaaacccgtcggacctaacgggcccttccccgaaggtcccttacccttacgtacttacttaacgttcggtatcggtactaaccgtaacccgaaaccgggtaccggggtccctaacgttccgggaccaccttaccccgaacggtaccggttaacgggttcgaacggggttcgggaccgttaagggggttccggggttaccgtacgggggtaaacctaaccgggtaacctttacggtaccccttcgttacccacccgtaacgttaccgaaccggtccgtacccgtaacggaccgtcccgtagggtaacggttacttccgttggttacccgttttatttacgtttcgttaggttcggtacgtacgtaccgtaccgtcggttaccctccggttactcgtttcggacggacgggaacncggtgtagacgtatcgaacgtaccgtagtcgtcgggtcctcgacctctatccgttcttcgttactcccg

SEQ ID NO: 277466 - DNA, 663 bp, Homo sapiens
  misc_feature: GYAE6OF01ETV9G.29.35.D02.1.454.CMB.1.raw
  modified_base (199)..(199): a, c, t, g, unknown or other
  misc_feature (199)..(199): n is a, c, g, or t
tcagatagagtactcacgaccggtgctcgatttagcacacgatagttgggtttgggggaggaactgctcagttaggacccagacggaaccatggaagccccagctcagcttctcttcctcctgctactctggctcccagataccagcggagagattgtgttgacacagtctccagcccacctgtctttgtctccggganaaagagccaccctctcctgcagggccagtacagagtagttaacaacttacttggcctggttaccaacaagtaaaccctgggacccaggcctcccgaggctcctcatctatgatgcatcccaagacgggccagtcggcacgtcccagccctagggttacaggtaggccgtagggtcgggttactggggacctaggtaacccttcgtacctccttacaacctaacgtaccgtaaccgcccgtacccgtaaggaccgtacccgtagggtacggttaacttaccgttcggttacccgttttaacgtttacgttttcggttcgtttacggggtcgtaagtaccgtaactccgggtcctcccggttacgttaccgttttcgggaccgtacggggtaacctacggtcgtagggacgtactacgacgtacgaagtcggtacggctagaccgtacacgtcttcgtctctaccg

SEQ ID NO: 277467 - DNA, 750 bp, Homo sapiens
  misc_feature: GYAE6OF01AR284.29.35.D02.1.454.CMB.1.raw
  modified_base (206)..(206): a, c, t, g, unknown or other
  misc_feature (206)..(206): n is a, c, g, or t
  modified_base (360)..(360): a, c, t, g, unknown or other
  misc_feature (360)..(360): n is a, c, g, or t
tcagatagagtactcacgaccggtgctcgatttagcacacgatagttgggtttgggggaggaactgctcagttaggacccagacggaaccatggaagccccagctcagcttctcttcctcctgctactctggctcccagataccagcggagagattgtgttgacacagtctccagccctaccctgttcctttgtcgtccggggaanaaagacgcccaccctctcctgcacgggccagtcagagttagtaaacctacttacgttggccttggttaaccaaacacgtaaacctggccaggcctcccgaggcctcctcattctatgatcgactactccaacgcgggccctacgacggctaacnccccgacgtccgtaggttccgaggtacggtcgtagggtcgggtgtacgggactacggtacttaccaccgttaccgtacccgacctacgtaccgtaccgacccgtaccgtacgacgtaccgtcggtaacggttacgttacgttacggtttaccttttagtttaacggtttcgggtttaccgtttacggggtaccgttacggtaccgttaacccggtccggttaccccgtccccggttaccgttaccgggtttttaccgggacccggtacgggggtaacccacggtaccggtacgggtaacgtacgtaccgaacgggtaaccgtaacggtcggttccgtacggtccgtacctaacgtaccctttaggttccgttacccgtttcgtttacccg

SEQ ID NO: 277468 - DNA, 786 bp, Homo sapiens
  misc_feature: GYAE6OF01BPP4H.29.35.D02.1.454.CMB.1.raw
  modified_base (199)..(199): a, c, t, g, unknown or other
  misc_feature (199)..(199): n is a, c, g, or t
tcagatagagtactcacgaccggtgctcgatttagcacacgatagttgggtttgggggaggaactgctcagttaggacccagacggaaccatggaagccccagctcagcttctcttcctcctgctactctggctcccagataccagcggagagatttgtgttgacacagtctccagccacctgtctttgtctcgggaanaaagcgcccacccttcgtcctgccgacgggccagtcaagagttacgttaaaccaacgtacgttcggccttacggttacccaaactacgaaacctcggaccgaggcctcccgacggtcctcctacacttctatcgtactgactaaccgtaccgaaacgaccgggacctaggtcggaccctaccgttaccccgagaccggtacggttacgtaacggtcggacggtacggggttcgggttaccggtcggggaacctaacgtaccgttacccacgttccctaaccgaactaccgtaccgaccgcccggtacctacggaccgtaccggttagggtaacggttactttccggtttaccgtttaaccgtttttatttacggtttcggtttaccgggtacggggttccgttaacggaccgttaacccgggtccggttccccgttacccgttacggtttacccggttttacggggaacccggaacgggggtaaccctaaggggccttgggaaaccgtcgtaaccggtaaggtaaccggtaggtcggtcggtaccgtaccgaccgtaacgtcttacggttcttcccgttacgtcccg

SEQ ID NO: 277469 - DNA, 837 bp, Homo sapiens
  misc_feature: GYAE6OF01A41U5.29.35.D02.1.454.CMB.1.raw
  modified_base (355)..(355): a, c, t, g, unknown or other
  misc_feature (355)..(355): n is a, c, g, or t
tcagatagagtactcacgaccggtgctcgatttagcacacgatagttgggtttgggggaggaactgctcagttaggacccagacggaaccatggaagccccagctcagcttctcttcctcctgctactctggcctcccagataccagcggagagattgtgttgacacagtcctccagccctaccctgttcctttgtccgtaccgggaagaaacgcgccccaccctctccgtgacgagggccctagtcaggtacgttacgttaaaccaacttacgttcggccttacggttaccccaaacggtaacgaaaccgtcgggaccctaacggtccctaccccgacgggcccttccccgtanacttcctagttggtaactcggacctaaccgtacccgaaaccggacgggacccctacggtcggacctaccgtccccgaacgtaccgtacgggtttaccgacgggtacggaccggttaaggggtcgggttacccggtaggggaaccgtacgttaccgttacctaccgtcctacccaccgtactaccgtaccggtcccgaccgtaacggtccgacgttaggtacggttacttcggttaccgtttaccggttttatttacggtttcggttcggtttacggggtcgttaacggtaccggtaaccgttccgggttccccgtttacccggtcgtttaccgggtttccgggacccgggtaacggggtaaccccgtagggtccggtaaggtacggtaactaaccgggtaacggtacgttaaaccgggttcggtacgggtccctaggacccgttaaccacgtttccgtttaacgttcccgtttcgttacccg

SEQ ID NO: 277470 - DNA, 650 bp, Homo sapiens
  misc_feature: GYAE6OF01BODA5.29.35.D02.1.454.CMB.1.raw
  modified_base (357)..(357): a, c, t, g, unknown or other
  misc_feature (357)..(357): n is a, c, g, or t
  modified_base (447)..(447): a, c, t, g, unknown or other
  misc_feature (447)..(447): n is a, c, g, or t
  modified_base (461)..(461): a, c, t, g, unknown or other
  misc_feature (461)..(461): n is a, c, g, or t
  modified_base (510)..(510): a, c, t, g, unknown or other
  misc_feature (510)..(510): n is a, c, g, or t
  modified_base (590)..(590): a, c, t, g, unknown or other
  misc_feature (590)..(590): n is a, c, g, or t
tcagatagagtactcacgaccggtgctcgatttagcacacgatagttgggtttgggggaggaactgctcagttaggacccagacggaaccatggaagcccagctcagcttctcttcctcctgctactctggctccagataccagcggagagattgtgttgacactagtcctccagccctacctgttctttgtccgtaccgggaagaaacgcgcccacctctcctgcgagggccaggtcagtagttcgtaaaccacgttcgttcggccttcggttaccaaacgaacggtaaaccgtcggtaccgacggcctaccgacggtcctcctacatctatgactgactacacctaacgcggccncgtacgcaactccgacgtccgtacggtcgaggtcgcgtacggtacggggtctacgggacgtacgtaccttacgtactctaaccgaccgtntaccgacggtaccncgtacgacgtccgtagtacggtacttggtaccgttctttagttacgttntcggtaggtactcgtactacgtcgtccctacgtcgttacggttcggaccgaacgggacctacggtcgtacgaatcgtaanacggtactacggtaggtcggtaccacgtacacttgttccgtcgttcccgttgtaaccccg

SEQ ID NO: 277471 - DNA, 725 bp, Homo sapiens
  misc_feature: GYAE6OF01CMAJ6.29.35.D02.1.454.CMB.1.raw
  modified_base (199)..(199): a, c, t, g, unknown or other
  misc_feature (199)..(199): n is a, c, g, or t
tcagatagagtactcacgaccggtgctcgatttagcacacgatagttgggtttgggggaggaactgctcagttaggacccagacggaaccatggaagccccagctcagcttctcttcctcctgctactctggctcccagataccagcggagagattgtgttgacacagtctccagccaccctgtctttgtctccggganaaagcgccaccctctcctgcgagggccagtcagagttgtaacacttacttggcctggttaccaacagaaacctggccacggccgtcccggctccgtcatctatgatcgacctactccgaacgacgggccctacggtcggccacgtccccgagtccgtaggttccgaggtggtcgagggttcgggtcgtacgggactacgtccttacaccttctaccgtaaccctatcccgaccggcccgtaccgttaacgacggtccgttaggacgggttactttcggttacggtttccgttttaaggtttacgtttacgggttccggtttacggggtaccgttacggtacccgttaccgggttaccgggtcccccgtttacccggttaccgttacccgggttttaccggggacccgttaacgggggaccctaacgggtcgtacgggacgtacgtaccggaacgtaaccggtacgtggtacggtcgtacgacccgtacctacgttccgttattcccgttactccgtttacccccgg

SEQ ID NO: 277472 - DNA, 744 bp, Homo sapiens
  misc_feature: GYAE6OF01ASLD7.29.35.D02.1.454.CMB.1.raw
  modified_base (207)..(207): a, c, t, g, unknown or other
  misc_feature (207)..(207): n is a, c, g, or t
  modified_base (435)..(435): a, c, t, g, unknown or other
  misc_feature (435)..(435): n is a, c, g, or t
  modified_base (678)..(678): a, c, t, g, unknown or other
  misc_feature (678)..(678): n is a, c, g, or t
tcagatagagtactcacgaccggtgctcgatttagcacacgatagttgggtttgggggaggaactgctcagttaggacccagacggaaccatggaagccccagctcagcttctcttcctcctgctactctggcctcccagatacccagcggagagattgtgttgacactagtcctccagcccacctgttctttgccgtaccgggaanaaagcgcccaccctctcctggcacgggccagtcagtagttactaaaccaacttcgttggcccttaggttacccaaaacgtacgtaaacccgtcggacccgacggtaccctacccgtaggtcccttcccgtactacttccgttaatccggaattcgacctaaccgtacccgaaccggacggccctacggtacggacctaccgtaccccgaacgtccgtaacgggttacncgggttcggacgtcgggttacggtcggttacgggacctacggtaccgtttactaccctaccgttaccactaccgtccgaccgtcccgtactaacgacgtaccgtaggtaacttccgttcgttacggttacctttagttacgtttcggtcggttacgggcgttaaccgtacgtaccgttacggtccccttaccgtacgtttccgtttacgggaccgttacgggaccctagtcgtacggacgtanaccggtacggacgttaggtcggtacgaccgtcgtacgtaccgtcgtacgtccttccttacggtccc

SEQ ID NO: 277473 - DNA, 921 bp, Homo sapiens
  misc_feature: GYAE6OF01E5K3P.29.35.D02.1.454.CMB.1.raw
  modified_base (217)..(217): a, c, t, g, unknown or other
  misc_feature (217)..(217): n is a, c, g, or t
  modified_base (241)..(241): a, c, t, g, unknown or other
  misc_feature (241)..(241): n is a, c, g, or t
tcagatagagtactcacgaccggtgctcgatttagcacacgatagttgggtttggggaggaactgctcagttaggacccagacggaaccatggaacgccccagctcagtcttctcttcctcctgctactctggcctcccagataccaggcggagagtattggtgttcgaacacacgtcctccacgccctaccgttgttctttcggcgtaccgggaanaaacgtccgccctacctcgtaccnggcgacgggacctagtcaagttacgtaacgttaaacctaaccttcgttcggtcccttacggtaaccaaacgaacgaaccgtcggcccgtacggccctcccgacgtccttacctactactcgtaatcgacgtcctaccaaccggtaaccgacggacccggtacctaaccggtccgtaccgaacccggtaccgttaacccgggtacggttaccgggtacggtcgggggtaacggtacggggtaggggttacccggtacgggtaaccggttaaccgtaccgtttaacccctcgttaacccctaccgtaaaccccgtaccgaacccggtaccggtaccggacccggttaacccggtaacggtcccgggttacggttaaccgggttaaccgttttccggtttaacggtttaccggtttttaaccgttttaacgtttccgggtttcgggttacccggggtttacggtaacccttacccggtacccggtttaccgttccccggttaaccccgtttaccgggttacccgtttacggggttacccggaaccgggtaaaccggacgttacgggaaccggttacgaaaccggttcaaccggggttaaccgttacggttacggccggttcgtaccgacccgttaaccttcggtttccccgttaactttccgttccctaccccgtttaccccg

SEQ ID NO: 277474 - DNA, 799 bp, Homo sapiens
  misc_feature: GYAE6OF01EC5AX.29.35.D02.1.454.CMB.1.raw
  modified_base (233)..(233): a, c, t, g, unknown or other
  misc_feature (233)..(233): n is a, c, g, or t
tcagatagagtactcacgaccggtgctcgatttagcacacgatagttggggtttgggggaggaactgctcagttaggacccagacggaaccatggaagccccagctcagcttctcttcctcctgctactctggctcccagataccagcggagagtattgtgttgacacagtctccagccctacccttgttctttcggtcgtaccggggaagaaacgtcgcccaccctctccgngaccgacgggaccagtcaaggtagttacgttaaaccaacttcgttcggaccttaggtacccaaagaacggtaaaccgtcggaccctaaggccctacccggaaggtccttaccctactacgttacctattgatcgactaactaccgaacgacggacctacgtggccaacgtcccacgtaccgtaggttacaggtcggcgtagggtgggtcgtaggactacggtaccttacgtacctccgtaaccacttacgaccgtaccggacccgtaaccgttacggaacggtccgttaacggtaggttacgtttaccgttacgggttttaccttttagttttacgtttcggtttacggtttggggtaccttaacggaccgttaaccggttccggtaccccgtttaccgttaaccgtttaccggttttcccgggaaaccgggtaccgggggtaaacctacgggttaaccggtacgggtaaattaccggaacgttaccggtaaacggttagtggggttacccgtacgtaccgtacccgtaccttacgttaccgtttacgttccgttacttaccccgg

SEQ ID NO: 277475 - DNA, 842 bp, Homo sapiens
  misc_feature: GYAE6OF01EJ007.29.35.D02.1.454.CMB.1.raw
  modified_base (394)..(394): a, c, t, g, unknown or other
  misc_feature (394)..(394): n is a, c, g, or t
  modified_base (809)..(809): a, c, t, g, unknown or other
  misc_feature (809)..(809): n is a, c, g, or t
  modified_base (823)..(823): a, c, t, g, unknown or other
  misc_feature (823)..(823): n is a, c, g, or t
  modified_base (833)..(833): a, c, t, g, unknown or other
  misc_feature (833)..(833): n is a, c, g, or t
tcagatagagtactcacgaccggtgctcgatttagcacacgatagttgggtttggggaggaactgctcagttaggacccagacggaaccatggaacgcccagctcagcttctcttcctcctgctactctggcctccagactaccgaggcggagagtattggttgttagaacctacgtagtcctccgacgtcccctacccgttgtttccttttcggtccgttaccggggaaagaaaacgtccgtacccctaccccttccgtacccgtcggaccgtacggggtcccaaggtacgtaggtaacgttacgtttaaaaacccaacgttccgttcggacccgtttaccggtaacccaaaacgtacggtaaacccgtcggccgtaacggtccctacccggnggttaccctcctactacttacgttaggtcgtaatcgaacctaacgttacccggaaaggcccgggaccctaacgggttccgaccctaaccgtaccccggtaacggccggttaacggttcgacggggtccggaacggttaggggttccgggggtaccggttagggaaacccgttaacgttaccgttcccgtaaccgtccccttacccgaaaccgtactaccccggaccgtcccggtaaccttaccggaacgttcggtaacggttacggtctttaccggtttacctttacgtttagttttacggttcggttacggttcggtacggtacgtaccgtcgtaccggtccccgttaccttcggttaccggtacgggccgtaacggtccgtaggcgtagacgtactacgacgtacgtagtcgngcgagtctaccgtntccgtttctntccgtaccg

SEQ ID NO: 277476 - DNA, 780 bp, Homo sapiens
  misc_feature: GYAE6OF01EYRYS.29.35.D02.1.454.CMB.1.raw
  modified_base (210)..(210): a, c, t, g, unknown or other
  misc_feature (210)..(210): n is a, c, g, or t
  modified_base (737)..(737): a, c, t, g, unknown or other
  misc_feature (737)..(737): n is a, c, g, or t
  modified_base (771)..(771): a, c, t, g, unknown or other
  misc_feature (771)..(771): n is a, c, g, or t
tcagatagagtactcacgaccggtgctcgatttagcacacgatagttgggtttgggggaggaactgctcagttaggacccagacggaaccatggaagccccagctcagcttctcttcctcctgctactctggcctcccagactaccgaggcggagagatttgtgttgacacagtctccagccctaccctgttctttgtcgtaccgggaanaaagccgccctaccctctaccgtgacgacgggcctagtcgaaggtaagttacttaaactaacgtacgttcgggaccttacggttaacccaaaacgtaacggaaacccgtgggacccgtaaggccctacccggacgtcctacctactacttctagtacgatcgactactacccgaacgtaccgggacctaaccggcgaccgtacccgttaccgaaccggtcccgttaaggttaccgagggtacggtacgtacggggttcgggtacgtacggggtactaccgttaccttcgtaaccttccctaacgaactacgtacccgaacgtaccgtcctaaagggccgtaccgtaggtacggttaacttccgttacggttaccttttaagttcggtttcgtacgggttacgtaccggttagaccctaaccgggttcgtccccgttttaaccgtaccgtttacgggtttaccggaccgggtaacgggtaaccagtccggttagggacctacggtactaacggtacgtaagttacggngaccgtacaaccctgtacctttcgacttttcccngtttacccg

SEQ ID NO: 277477 - DNA, 927 bp, Homo sapiens
  misc_feature: GYAE6OF01EVO8Y.29.35.D02.1.454.CMB.1.raw
tcagatagagtactcacgaccggtgctcgatttagcacacgatagttgggtttgggggaggaactgctcagttaggacccagacggaaccatggaagccccagctcagcttctcttcctcctgctactctggcctccagataccagcggagagtattgtgttacgacactacgtcctccacgccctacccgttgttcctttgtccgtaccgggaaagtaaaacgccgtccctacccttctccgtggaccgacgggcctagtccgaaggtacggttaactaaaccgtaacttacgttcggaccttacggtaaccaacgtaacgaaccgtcggaccgtacggtccctacccgacggtcctaccctagtacttctaagtcgtaactgacctaacgtacccgaaggtccggtacccgtacggtcggacctaccgtaccgacggtaccgttacgggttacacgggtacggtacggttacggggttcggggtacggtacggggtaacctaaccggttaccttacgacccgtttacccgtaaaccgtaaccgtaaccggttacccgaacccggtacccggttaaccgtaaccgggtaccgttaccccgggtagggtaacccggtttaccggtttaccggtttacggtttttaacccgttttttaagtttaccgggttacgggttttacccggttacggggttaaccggttacttaacccgggtttaaccgggttccccgtttccccgtttaaccccggtttacggtttaccggggtttaaccccgggaccgggtaaccgggttaacctaggggtacccgttaacggggtaaacgtacccggttaacgtaaacgggtaccgttaacgggtcgtaaccggttcccaccggtaccttacggttacttaccggtaccgtttactcccggttaaacccg

SEQ ID NO: 277478 - DNA, 681 bp, Homo sapiens
  misc_feature: GYAE6OF01A9BKY.29.35.D02.1.454.CMB.1.raw
  modified_base (308)..(308): a, c, t, g, unknown or other
  misc_feature (308)..(308): n is a, c, g, or t
tcagatagagtactcacgaccggtgctcgatttagcacacgatagttgggtttggggaggaactgctcagttaggacccagacggaaccatggaagcccagctcagcttctcttcctcctgctactctggctccagactaccagtggagagattgtgttgacacagtctcagccaccctgtctttgcctccgggagaaagcgccacctctcctgcagggccagtcagtagtgtaacatctggcctggtacaacagaaccgtgctagcctccgacgctccactactctagtcgatcgcactaccgaacncgggacctacgcggacacgtaccccagaccgtaggttcaggtcggcgtacggtacgggtcgtaggaacctaggtaacctttcgaccgttcctacgacccgtacgtaccaaccgtccgaccgtacggccgaccgttaggcggttacttcctcggttaccggttttactttagtttcgggttcgtttacgggggactttacgggacttaaccgggtcggtttccccgtacccggttacgttaacccgttttcgggtaccggtaacccgggttaaccgacggtaacgttcgggacgttaactaccggtaacgacggtaacgttcggtcggaccgttaccgacttaccgactttacgtccgttccttacggtacccc

SEQ ID NO: 277479 - DNA, 790 bp, Homo sapiens
  misc_feature: GYAE6OF01CQVC3.29.35.D02.1.454.CMB.1.raw
  modified_base (170)..(170): a, c, t, g, unknown or other
  misc_feature (170)..(170): n is a, c, g, or t
  modified_base (208)..(208): a, c, t, g, unknown or other
  misc_feature (208)..(208): n is a, c, g, or t
tcagatagagtactcacgaccggtgctcgatttagcacacgatagttggggtttgggggaggaactgctcagttaggacccagacggaaccatggaagcccagctcagcttctcttcctcctgctactcgtggcctccagactaccgaggcggagagattgtgtgacacngtctcactccacctgttactttcgtccgtaccgggaanaaacgcgaccctaccctctccgtgacgagggccagtcagtagtacgtaacacgttcgtcggaccttggtaccaagacgtaaccgtcggacgacggcctaccgacggtcctcctatacttctagtcggatcgactaacctaccgaacgccgggacctacggtacggacctaccgacccgaggtccggtacggttacggacggtcggacgtaaggggttcgggtaccggaggaccctacggttactaccgtactcccgttaacaccgtaactccggacccggtacctaccggtaacggccgacggttacggtaggtttacgtttcccggttacggtttaaccgttttagttttaccggttcgggttacggtttacgggtaacggtacgttaaaccgttcccggttcccgggttccctttaacccggtttacggtttacccgggtttacccggggaccggttaaacggggtaaccccgtacggggtaccgttagggtaacgttaccaacgggtaaccgtaacgggtacgttgggccggtctacgtaccctaacggtcttaaccggtccgttaccctcggttaccc

SEQ ID NO: 277480 - DNA, 907 bp, Homo sapiens
  misc_feature: GYAE6OF01AWMVK.29.35.D02.1.454.CMB.1.raw
tcagatagagtactcacgaccggtgctcgatttagcacacgatagttgggtttgggggaggaactgctcagttaggacccagacggaaccatggaagccccagctcagcttctcttcctcctgctactctggctccagataccagcggagagtattgtgttgacacagtctccacgccacccgttgttactttgtccgtccgggagaaacgacgccctacctcgtcctgacgacgggccagtcaagacgttacgttaaaccaacgttacgttcgggccttacgggttacccaaaacgacggaaaacccgttgggaccaacgggtccttaccccgacggtccctacccttactactttacctagttagaactttcggacctaacgtaaccctaaaaccggaccggggtaccctaaccggtcgggtacccaaccgtaccccgaacggtacccgttaagggtttacccaaggggtcggtaacggtacgggttcggggtccggttaggggaacctacggtaacctttcccgaacctttccgtacccaaccgtacgttacccgacgggtaccccgtaacgtaccggtaaccgccggttagggtaaccggttacgtttcgggttaccgttttaaccgtttttaacggttttacgtttcgggtttacgggtttttccggggaacgttaacgtaacccggttaacccggttcggtaacccccgtttcccgttaccggttttaaccgggttttcccggggacccgggttaaaccggggaacccgttacgggtaccggtaacgggtaacgttacgaccgggtaaacggtaaccggttaaacggtcggggttacgggacccgttacggtaacctaccccgttaaggtttcccgttacgttttccgttaccttaccccg

SEQ ID NO: 277481 - DNA, 655 bp, Homo sapiens
  misc_feature: GYAE6OF01B5FOG.29.35.D02.1.454.CMB.1.raw
tcagatagagtactcacgaccggtgctcgatttagcacacgatagttgggtttgggggaggaactgctcagttaggacccagacggaaccatggaagccccagctcagcttctcttcctcctgctactctggctcccagataccagcggagagattgtgttgacacagtctccagcccaccctgtctttgtcgtccgggagaaagcgcccaccctctcctgcgacgggccagtcagagtgtaaacactacttcggccttcggttccaaacgacgaaaccgtcggaccgacggcctcccgaggtcctcctcactctatgatcgcactaccgaacgacgggccacgtcggacactcccgagccgtaggttcgagtcggcgtaggtcggtcgtggacacgtacttcactctccactactccacgccgacgtacgacgccgtggaggttacttcgttcgtcgttttatttacgtttcggttcggttcgggtacgttaacggtactaaccgttccggtacccgttccccgtacgtttaccggttttccgggaccggtacgggaacctacgggtacgtacgggtacgtaacgtacgtaacggtaccggtaacgtcggtaccggtctacggccgtaacctcttacgtcttccgttacttccg

SEQ ID NO: 277482 - DNA, 740 bp, Homo sapiens
  misc_feature: GYAE6OF01D2RLL.29.35.D02.1.454.CMB.1.raw
  modified_base (261)..(261): a, c, t, g, unknown or other
  misc_feature (261)..(261): n is a, c, g, or t
tcagatagagtactcacgaccggtgctcgatttagcacacgatagttgggtttgggggaggaactgctcagttaggacccagacggaaccatggaagccccagctcagcttctcttcctcctgctactctggctcccagataccagcggagagattgtgttgacacagtctccagcccaccttgtctttgtcgtccgggagaaagcgcccaccctctcctgcagggccagtcagagtgtaaacactcttgcctgtaccaanagaacctggccaggcctccgagcctctacatctatgatgctactaccaacgcgggccagtgccactcccgagtccaggttcagtggctagggtcggcgtgggaactagacctttcacgtccctacactacgtcacgcccgtactaacggaccgtcgtacggacggttacgttccgttacggtttacccgtttttaagtttacgttttcggttacgggttttcggggtacgtttaacggaccgttaaaccgggtccggtaccccgtttaccccggttaccgtttaacccgggtttttaccgggacccggggttaacccggggtaacccgtaacgggtaccggtaacgggtaacggtaccgttaaccggaaaccggtaaacccggttaaccggttcgggtccggggtaacccgttaccgggaaccccttaacccggttaactttccccgtttaccgttttcccgttaccgtttaacccccg

SEQ ID NO: 277483 - DNA, 813 bp, Homo sapiens
  misc_feature: GYAE6OF01DOOVO.29.35.D02.1.454.CMB.1.raw
tcagatagagtactcacgaccggtgctcgatttagcacacgatagttgggtttgggggaggaactgctcagttaggacccagacggaaccagtggaagccccagctcagcttctcttcctcctgctactctggctccagataccagcggagagtattgtgttgacacagtcctccagccctacccgtgttctttgtccgtccgggaagaaacgcgcccacctctccgtgccgacgggtccagtacagtacgttacgttaaacacttacgtcggccttaggttacccaaaagaacgtaaaccgtcggaccaacggtccctacccgacggtcctccgtactactaccgtagtcgtatcgacctactaccgaacgacgggacctacgtcggaccacctaccgaacgtccgtaacggtacgaacggtcggtacgtaggggttcggtacggtacggaaccgtacgttaccgttactaacccttcgtacccgtaaccctagttacccgaacccgggtcccgtaaccgtaagggtacccgtacggttaacggtaacggttacgtttaccggtttccgtttaccggttttaatttcggtttccgggttacggttacgggtaaccgttaacggtaacctaaccggttcccggtcccgttaacccgtcggtttaacggtttaccgggaaccggtaaccggggaaccgttacgggacggttaacggcgtaaaccgtacggaaaccggttaacggtaccggttacggtccgggtactaaccggtaccctacgttactaccgtttcgtaccgttaccgttaccccg

SEQ ID NO: 277484 - DNA, 739 bp, Homo sapiens
  misc_feature: GYAE6OF01EDHV0.29.35.D02.1.454.CMB.1.raw
  modified_base (270)..(270): a, c, t, g, unknown or other
  misc_feature (270)..(270): n is a, c, g, or t
tcagatagagtactcacgaccggtgctcgatttagcacacgatagttgggtttggggaggaactgctcagttaggacccagacggaaccatggaagccccagctcagcttctcttcctcctgctactctggctccagataccagcggagagattgtgttgacacagtctccagcccacctgttctttgtcgtaccggggagaaaagacgcccaccctctcctgcgacgggccagtcagagtgttaaacactcttggccttggtaccaaanaacgaaaccgtcggccacggcctcccgaggccttcctacacttctatgatcgacaactaccgaacgacgggccacgtcggaccactcccgacgaccgtaggttcgaggtcggcgtagggtgggtacggtagggacacgtaccttcacgttcctaccgacctcgtaccgaccggacccgtaccgtaacggacgtcccgttagggtaacgttacgtttccgtacggttaccgtttttaagtttacgtttcgggttccggtttcggggtaccgttaacggttacccgtaaccggttccggtacccctttccccgggttacgtttacccggttttcggggaacccgggttaacggggacccgtaacgggcggttagggaacgttcgtaaccgtaacgggtaaaccggttaacgtcgggttcggaccgtccggaaccttaccgtacttcggtttcgttccgttcttaaccccgg

SEQ ID NO: 277485 - DNA, 692 bp, Homo sapiens
  misc_feature: GYAE6OF01BWR51.29.35.D02.1.454.CMB.1.raw
  modified_base (151)..(151): a, c, t, g, unknown or other
  misc_feature (151)..(151): n is a, c, g, or t
  modified_base (226)..(226): a, c, t, g, unknown or other
  misc_feature (226)..(226): n is a, c, g, or t
  modified_base (289)..(289): a, c, t, g, unknown or other
  misc_feature (289)..(289): n is a, c, g, or t
  modified_base (374)..(374): a, c, t, g, unknown or other
  misc_feature (374)..(374): n is a, c, g, or t
tcagatagagtactcacgaccggtgctcgatttagcacacgatagttgggtttggggaggaactgctcagttaggacccagacggaaccatggaagccccagctcagcttctcttcctcctgctactctggcctccagataccaggcgganagattgtgttgaacacagtctccagccctacctgttctttgtccgtaccgggaagaaaacgcgacccacccttcncctggccgaagggcctagtacgagtacgttagttaaaccacttagtcggctacggtaccaaanaacgtaaaccgtggccaggcctcccgaaggtcctcctagacttcgtagtagaatcgactacctaccgaaacgcgggacctacggngtaccaactaccccgagtacccgttaggttacccagggtcgaggtaacggtcggggttacagggtacaacgtacttccactacctaacactacgtccgaacgtccgaacgttacgacgtaccgtaaggtacgtattcgttacgttaccgtttattacgttgtacgtggtacctagacgtaacctcggtacctaccgttacgtcggtttaccgacgacgggaaccagtcggtaagtacgagtacggaacgtaacgtaggtaggtcccggattacggaacccttaccggtattaccgggtacttccgtaccgttaacccg

SEQ ID NO: 277486 - DNA, 933 bp, Homo sapiens
  misc_feature: GYAE6OF01BD3LR.29.35.D02.1.454.CMB.1.raw
  modified_base (223)..(223): a, c, t, g, unknown or other
  misc_feature (223)..(223): n is a, c, g, or t
tcagatagagtactcacgaccggtgctcgatttagcacacgatagttgggtttgggggaggaactgctcagttaggacccagacggaaccatggaagccccagctcagcttctcttcctcctgctactctggcctcccagataccagcggagagattgtgttgacacgagtcctccagcccaccctgtctttgtcgtccgggaagaagcgcccaccctctccngcaggccagtcagtatagttaaaccaacttctcggccttggtaccaaacaagaacctggacccacggcctcccgagtcctcctagactctatcgatcggacctaacgtacccgaaacgtccgggaccctaacggtcggaccctaaccgcccccgtaggaccccgtttagggtttacccaacggggttcggaccggtacggggtttcggggtacccgtagggggtaaacccctaacggttaaccccgttttcccgaaacccgttcccgttaacccccggtaaacctaaacccgttacccggtaacccggtaccccccgggtaacccgttaaaccgggtaccggttaaccccgggttagggttaaacccgggtttaccgttttacccggttaaccggggtttttaaacccgtttttttaagtttttaaccgggtttttccgggttttaccgggtttttacggggtaccggtttaaaccggtaccccgttaaccggttacccgggtttaccccccgtttccccggtttaccggtttaacccgggtttttacccgggacccgggtaacggggtaacccgtaacgggttaccggtacgggtaacggtaacgtaacccggtaaacggtaaccggttacggttcgggtccggtacgtttacccgacccgtaaccgttacccgttcggtttaaccctttcccttccggttaacccccg

SEQ ID NO: 277487 - DNA, 902 bp, Homo sapiens
  misc_feature: GYAE6OF01A2H0V.29.35.D02.1.454.CMB.1.raw
  modified_base (827)..(827): a, c, t, g, unknown or other
  misc_feature (827)..(827): n is a, c, g, or t
  modified_base (887)..(887): a, c, t, g, unknown or other
  misc_feature (887)..(887): n is a, c, g, or t
tcagatagagtactcacgaccggtgctcgatttagcacacgatagttgggtttgggggaggaactgctcagttaggacccagacggaaccatggaagccccagctcagcttctcttcctcctgctactctggctccgagataccagcggagagtattgtgttagacacgagtcctccagccctaccgttgtctttgtccgtaccgggaataaacgacgtccctacccttcgtccgtacgacgacgggccacggtcaggtacgttacgttaaaccaacttcgttacggaccttacgttaacccaaagtaacggtaaacccgtcggtaccgaccggtccctacccgacggtccttaccctacgtacttacgtacgtacgtaactcggacctacgtacccaaacggaccggtccaaccgtggtacccaaccgttcccgtaacggtacccgttagggttacccgtacggtacgggaacgttcggggtacgggttacggtaaccggtaaacggtacgttaaacccgttctaacccgtactacccgttaacccgacgttaccggaaccggaccccggtaacgtaaccggtaccggttaaccgttacgggtaaccggtttacgttcgttaaccgggtttacctttaaacgttttcgttaccgggttttacgggttaacggggttacctaacgggttaacctaacccgggtttaccgaccccggttttaccccgttacccggttaagggtttccccggaaccgggttaaacgggtaccctaagggtaccgtaacgggtcgtaaccggacgttaaaccggtacccgggttaaaccngggttaacccggcgttaaccgaacccggtaaccttacggttacggttttaccccggtttntaacccggttacccc

SEQ ID NO: 277488 - DNA, 717 bp, Homo sapiens
  misc_feature: GYAE6OF01BNL9J.29.35.D02.1.454.CMB.1.raw
tcagatagagtactcacgaccggtgctcgatttagcacacgatagttgggtttgggggaggaactgctcagttaggacccagacggaaccatggaagccccagctcagcttctcttcctcctgctactctggcctcccagactaccagcggagagattgtgttgacacagtcctccagccctacccgtgttcctttcgtccgtaccggggaagaaacgacgccccaccccttctcccgtgccgacggggccaggtcagaagttacgttaaacctaaacttacgttcggtacccgttaggtttacccaaacgacggtaaaaaccctgggacccgaaggccctacccgaggcccttccgtcaacttcctaatgtatcgactaactacccgaaacgcgggtaccaacgtcggacctaactcccccgaagtacccgtaggttaccagggtcggacggacgggttcgggtcgtacgggacgtacgtacctttaccactccaccaacctacgtaccgaccggtaccgcctaaggaccgtcgtacgggtagtaccgttcgtacgttaccgtttgtttaacgtttcggttacgttgggaccgttagccgtaacgtcggttccctccgttactacgtttcgaccgtacgggacacgcgtagagtactaacgacgtaccggtagtcggcgtacgccgcgtaccttacgtacttcgttcctcgtaccc

SEQ ID NO: 277489 - DNA, 818 bp, Homo sapiens
  misc_feature: GYAE6OF01CYLDD.29.35.D02.1.454.CMB.1.raw
  modified_base (184)..(184): a, c, t, g, unknown or other
  misc_feature (184)..(184): n is a, c, g, or t
  modified_base (224)..(224): a, c, t, g, unknown or other
  misc_feature (224)..(224): n is a, c, g, or t
  modified_base (245)..(245): a, c, t, g, unknown or other
  misc_feature (245)..(245): n is a, c, g, or t
  modified_base (429)..(429): a, c, t, g, unknown or other
  misc_feature (429)..(429): n is a, c, g, or t
tcagatagagtactcacgaccggtgctcgatttagcacacgatagttgggttgggggaggaactgctcagttaggaccagacggaaccatggaacgccccagctcagccttctccttcctcctgctactcgtggcctccagactaccaggcggaagtagtattggtgttcgaacactacgtccnccacgccctaccgttgttcgtttcgccggtaccgggaaanaaacggcgccctacctctccnggacgacgggaccagtagaaggtagttaacttaaaccgaaacttcggtcggtaccgtacgttaaccaaagaacgaaacccgcggaccgacggaccctaccggacgtccttactcaacttcgtaagtcggaatacgacccttaaccgaaccgaacggacgggaccctacgacggaccttaacccnccggaaacggttccaagggtttaccaggggtacggtaccgtaggggttagggtcgaaacggggacttaccggtaacttccacgtttacccaacgaaccttcggaccgaaccggtcccggtaactaacgggaccgtaccggtaggtaacgtacgtttaccggttacgtttacctttaaggttcgttacgggttacgttacgggtaccggtacgttaccgaccgttccggtaccccgttacccggttacgtttaccgggttaccggaaacggacggaccggtaaggtacggtaacggtaggacctaacgggtaacggacccggttaaggcccggttagggaccctacgtaacccggtattaaccggttccttcgttacctccgtttacccg

SEQ ID NO: 277490 - DNA, 887 bp, Homo sapiens
  misc_feature: GYAE6OF01E2YG1.29.35.D02.1.454.CMB.1.raw
tcagatagagtactcacgaccggtgctcgatttagcacacgatagttgggtttggggaggaactgctcagttaggacccagacggaaccagtggaacgccccagctcagcttctcttcctcctgctactctcggcctcccagactaaccaggcggagagtagtttggttgttacgaacactacgttcctcccacgcccctaccccttgtttcttttcggtccggtaccggggaagaaaacgacctcccctaccccttcctccgtcggaccgacggggacctaggtaccgtaaggtaacgtttaacgttaacctaaaccgtttacgttccggacccgttacggttaacccaaacgaaccggtaaacccgttcgggccccgtaacgggtcccctaccccgacggttccctttacccaccttagtaccttaagtcgggactcgtaaccctaccgaaccggaacccgccggaccgtacgtaccggtaccctaccggcccctaacggttcggtaacggttcgaacggggtccggttagggttacggggtacggggtacccggaaacggttacccgtaactttacccctacccgttttaaccctaccccttaaccggacccttaacccggacccgggtaccccgacccgtaccgttacggtacccgtacggtacggttacgttaaccgttttcccgttagttttaacgtttgtttacggttaccggtcggttacggtaccgtaccgtaccgtaccgtcccgttccctttaccggtccgttacgggtacggtaccggaacgtcgtacgtacggtagtacgtacgaaccggagtaccgtagtcggtactccgactacccgtattccccgttgtttacccttccgtctttcccccg

SEQ ID NO: 277491 - DNA, 1009 bp, Homo sapiens
  misc_feature: GYAE6OF01CU1V3.29.35.D02.1.454.CMB.1.raw
  modified_base (203)..(203): a, c, t, g, unknown or other
  misc_feature (203)..(203): n is a, c, g, or t
tcagatagagtactcacgaccggtgctcgatttagcacacgataggttgggtttgggggaactgctcagttaggacccagacggaaccatggaacgccccagctcagcttctcttcctcctgctactctggcctccagataccaggcgagagtattggtgttagacacagtctccagcctacctgtctttgacgtccgggaanaaacgcgaccaccctctccgtgcgaacgggccaaggtcaaggtagttacgttaaacacgttcgttcgccgttaggttaccaaacgacgaaccgtcggacctacggcccttacccgagggtccctccgtacacgttcgtacgtacgaacgttcggacctaacgttaacccgaaaccggtaccggttaccccgaacggttacgggacccctaaacccggttccccggaaccggtacccggtaaacgggtttccggtaaacggttcggggtaacggttacgggggttcgggttacggtaaccggggtaactaaccggttaaccgttccgtaaaccccgtttcgtaacccgtaaacccgtacgtaacccgggtaacccggtccccggttaaccggttaaaccggtaccgggttaaccccggttaacgggtaaaaccgggttttcccgttttaaccgggttttaacccgggtttttaacccggttttttaaacggttttacccggttttaaccgggttttacccgggtttaacgggggtacccgtttaaaaccgggtcccggtttaaacccgggtttccccgggttaacccccgtttaccccgggttttaacccgttttaccccggggtttttaaccgggggacccggttaaaccgggggttaacccgtaaacgggttcggtaacgggttaaacgtaccggttaacccggtaacgggtaacccggtttaacggtacgggttacgtaaccggttaccgtaccgtaaccgttacgttccgtttacgtttcccttcggttaccccgttaccccg

SEQ ID NO: 277492 - DNA, 1054 bp, Homo sapiens
  misc_feature: GYAE6OF01A1PLL.29.35.D02.1.454.CMB.1.raw
  modified_base (411)..(411): a, c, t, g, unknown or other
  misc_feature (411)..(411): n is a, c, g, or t
tcagatagagtactcacgaccggtgctcgatttagcacacgatagttgggtttgggggaggaactgctcagttaggacccagacggaaccatggaagccccagctcagcttctcttcctcctgctactctggctcccagataccagcggagagtattgtgttgaacactagtcctccacgccctacctgttctttcgtcggtaccgggaagaaacggccaccccgaccttccgtcgtcggacgacgggacctagtacgaaggtaacgtttacgttaaaccaaaccgtttcggttcgggtaccctttacggttaaacccgaaacgaaaccggtaaaacccgtcggaacccgtacgggtccctaaccccggacggttcccttaacccgtactacgtttaccgtaatcggtaanacggtacccttaaaccgaaccgaacggaccgggtaccctaacggtcggaccctaccgtccccggaataccggttacggtacgtacgggtcggaccgtagggttacgggaccgtaggggtaaaccgtacgttaacccttcccaacgtttccctaacgaaacccgtacgttaccccggaaccgttaccccgaaaccgggttaacggtccgttaaccggggtaaacgggttaaccggtttaacccgtttttacccggttacgggttttttaaacccttttaagttttcccggggtttaaccggggttttaacggtaacccggggtttaacacccggtttaaacccggacccggggttttttacccccacccccgggtttttaacgggtttaacccggtttttcccgggggtaaaccccgggtaaaccccggggttaaccgaaaaccggggttacgggtaaccgggttaaacgggtaacccggtttaaacggaacccggggttaaaagttaaacccggggttaggttttacccgggaccccgggttttaaacggtaacccccccgtttaacgggtttacccctttaaactttttccccgggggtttaaacctttttacccccgttaccggtttttaaccccccccgg

SEQ ID NO: 277493 - DNA, 878 bp, Homo sapiens
  misc_feature: GYAE6OF01AIUJY.29.35.D02.1.454.CMB.1.raw
tcagatagagtactcacgaccggtgctcgatttagcacacgatagttgggtttgggggaggaactgctcagttaggacccagacggaaccatggaagccccagctcagcttctcttcctcctgctactctggcctcccagactaccaggcggagagtattggtgttgacactacgtcctaccacgccctacccttgtttctttcggtccgtaccgggaagaaacgcgccctaccctctccgtgcgacgggccagtcagtagtacgttaaccacttcgttcggtccgttacggtaacccaaacgaacggtaaacccgtcgggtacccgacggggtccctaccccggtaacgggtcccttacccgttactaccgtttaccgttaacgttcggtaacgttcggaccctaaccgttaacccccggaaaacggggacccggggtaacccccttaacgggtaccgggtaccctaccccggttaacccccgaacccggtaccccggttaagggttaccggtacggtacgggttacggtacggggtttcggggtacggtacggggtaaccgtaccgttacttaccctacccgtttccgaaccctaccacgttccgaccgtccccgtacgtaacgacggtacccgtagggtacgtcgtttaccggtacgtttacggttttactttacggtttcggttacggttgggtaccttaacggtccttaccggtccgttaccccgttcccggtttaccgttaccggtttaccgggaccggtacgggtaacctacgggtacgtacgggagttacgtaaccgacgggtaacgttacgggtacggttcgaccgtacgtaccctacttcgttacgtttcgttccgttcgttaccccg

SEQ ID NO: 277494 - DNA, 720 bp, Homo sapiens
  misc_feature: GYAE6OF01AIFK9.29.35.D02.1.454.CMB.1.raw
tcagatagagtactcacgaccggtgctcgatttagcacacgatagttgggtttgggggaggaactgctcagttaggacccagacggaaccatggaagccccagctcagcttctcttcctcctgctaatctggcctcccagataccaggcggagagattgtgttgacacagtctccagcccacccttgtctttgtccgtccggggagaaacgcgccctaccctctcctggcagggccagtcagagtcttaacaacttacgttggccttggttacccaaacacgtaaacccgtcggaccacggctcccgaggtcctcctcactctatgatcgaccataccgaacgacgggccacgtcggccacgtcccgacgccgtaaggttcacggtcggtcgtagggttcggggtcggtacggggtaacacggtacttccgtaccttcctaccgacctacgtccaccggcccgtaccgtacggacgtccgtacggtaggttacgtttccgttacggtttacccgttttagtttacgtttcggttacgtttcgggtaccgttacgaccttaccgtcggttcccgttacccgttcgttacccggttttcgggacccggtacggggtaccctagggtacgtcggacgtacgtaccgacgggtaccgtacggttcggtccggtcgtaccggaccgtacccttaccgttaccgttcgttccgttccgttaccccg

SEQ ID NO: 277495 - DNA, 619 bp, Homo sapiens
  misc_feature: GYAE6OF01CMPD9.29.35.D02.1.454.CMB.1.raw
  modified_base (194)..(194): a, c, t, g, unknown or other
  misc_feature (194)..(194): n is a, c, g, or t
  modified_base (255)..(255): a, c, t, g, unknown or other
  misc_feature (255)..(255): n is a, c, g, or t
tcagatagagtactcacgaccggtgctcgatttagcacacgatagttgggtttggggaggaactgctcagttaggacccagacggaaccatggaagccccagctcagcttctcttcctcctgctactctggctcccagataccagcggagagattgtgttgacacagtctcagccacctgtctttgctcggganaaagcgccacctctcctgcagggccagtcagagtgtaacactacttggccttggtaccaanacgaaacctggaccaggcctccaggcctcctcatctatgatgcataccgaacgacgggccacgtcggacactcccgaagccaggttcaggtcggcgaggtcgggcgtagggactagtaccttcgactctacgactagtcacgtcccgacgtacgacgtcgtaggagtacgttcgtacgtaccgtttattacgtttgtcgttgggtacgtacgtctaacggtcgtacccgtcccgtacgttaccggtttcggaccggttacgggaacgtacggtacggtcggaacgtacgtacgaacggtacgtacggttcggtacggaccgtacgacccgtaccgtacgttaccttcggttccttcgttacccg

SEQ ID NO: 277496 - DNA, 660 bp, Homo sapiens
  misc_feature: GYAE6OF01B3EHV.29.35.D02.1.454.CMB.1.raw
  modified_base (214)..(214): a, c, t, g, unknown or other
  misc_feature (214)..(214): n is a, c, g, or t
  modified_base (338)..(338): a, c, t, g, unknown or other
  misc_feature (338)..(338): n is a, c, g, or t
  modified_base (375)..(375): a, c, t, g, unknown or other
  misc_feature (375)..(375): n is a, c, g, or t
tcagatagagtactcacgaccggtgctcgatttagcacacgatagttgggtttggggaggaactgctcagttaggacccagacggaaccatggaagccccagctcagcttctcttcctcctgctactctggctcccagataccagcggagagattgtgttgacacagtctcagccacctgtctttgtctccgggagaaagacgccacctctccngcagggccagtcagagtacgttaacactacttggcctggttaccaacagaaaccgtggaccacggcctcccgaggctcctacatctatcgatcgacactaccaacggacggccacgtcgacacnccagcctaggtcacggtcggcgtaaggtcggggtacngggtacgacgttaaccttacgtacctcgtacctaacccgtagtacccgaacggtcccgacgtaacggacgtcgtacggaggttacttcgttccgttaacgttttactttaggtttacgttcggttgggacgtacgcgtaacgtcgtcccgttccggtcttacggtttcggaccggacgggtaccgtacgtgtaacggtacgtacgtacggaacggtaaccgtaggttcggtacggaccttacggacctacccggtattaccggtactttcggtaccgtttacccg

SEQ ID NO: 277497 - DNA, 890 bp, Homo sapiens
  misc_feature: GYAE6OF01EOZ3K.29.35.D02.1.454.CMB.1.raw
  modified_base (201)..(201): a, c, t, g, unknown or other
  misc_feature (201)..(201): n is a, c, g, or t
tcagatagagtactcacgaccggtgctcgatttagcacacgatagttgggtttgggggaggaactgctcagttaggacccagacggaaccatggaagccccagctcagcttctcttcctcctgctactctggctcccagataccagcggagagatttgtgttgacacagtctcagccaccctgtctttgtactccgggaanaaagcgcccacctctcctgcgacgggccagtcagtagttacgttaaaccaacttacgttcgggccttacgggttacccaaaacgtaacggtaaaacccgttcgggacccgaacgggtcccttaccccgaagggtcccttaccctacctaacgttaccttaagtacgggtaactcggtaccctaaactaccccggaaaaccggaccgggggacccctaaccggtacgggtaccctaaacccgttcccccggaaccggtacccgttaacggggttttacccgaaggggtttcggaccggtaacgggggtttcgggggttaccggtacgggggtaaacctacgggttaacctttaccgaacccgttacctaccgtaaaccctaacgttacccgaccgggtaccccgtacccggtaaacggaccgggttacccgttacggggtaacggtttaacctttaccggttacggttttaaccccggtttttaagttttacggtttacggtttaccgggtttacggggtaccggtttaacggtacccgtaaccgttaccggttccccgtttacccgttacgtttaccggttttaccgggaccggtaacggggtaccgtaacggtcgtaggaacgtacgtacgacggtaacgtacgtggtcgtagtccgacctacgttactacgttcgttcttctacccg

SEQ ID NO: 277498 - DNA, 658 bp, Homo sapiens
  misc_feature: GYAE6OF01C8M7D.29.35.D02.1.454.CMB.1.raw
  modified_base (426)..(426): a, c, t, g, unknown or other
  misc_feature (426)..(426): n is a, c, g, or t
  modified_base (603)..(603): a, c, t, g, unknown or other
  misc_feature (603)..(603): n is a, c, g, or t
tcagatagagtactcacgaccggtgctcgatttagcacacgatagttggggtttgggggaggaactgctcagttaggacccagacggaaccatggaagccccagctcagcttctccttcctcctgctactctggctcccagataccaggcggagagtattgtgttgacacagtctcagcccaccctgtctttgtcgtccgggagaaagcgcccaccctctcctgcgagggccagtcagtagtacgttaacactacgttcgcgttgttaccaatacgaacctggaccaggcctcccgaggcctccgacactcatgatcgcataccgaacgacggcccaggtacgacctacgtacccaggccgtacgttcaggtcggagtacgggttgggtcgtgggaaccacggtactttacacttacaccactacncgacgtacccgtacgacgacgtacgtacgtagtacttcgttacgttaccgtttagtttcttacggttcgtaggtccgttagacctacggttccgtccgttacccgtttccgttacgtttcggaccggtacgggtaacgtacgtcggtacgtaggaccgtacgaacgaacgttaacgnggtcggtacgtacgaccgttaccgtacgttaccgttcgttccgttccgttacccg

SEQ ID NO: 277499 - DNA, 776 bp, Homo sapiens
  misc_feature: GYAE6OF01AYBC1.29.35.D02.1.454.CMB.1.raw
  modified_base (204)..(204): a, c, t, g, unknown or other
  misc_feature (204)..(204): n is a, c, g, or t
tcagatagagtactcacgaccggtgctcgatttagcacacgatagttgggtttgggggaggaactgctcagttaggacccagacggaaccatggaagcccagctcagcttctccttcctcctgctactctggctccagactaccagcggagagattgtgttcgacacagtctccagccaccctgttctttcgtcgtacgggaanaaacgcgccacctcgtcctgcagggccagtcagtagttataaaccgacttacgtcggtccttaggttaccaaacgtacgaaaaccgtcggaccgtaacggccttacccgaggtacccttcccgtactacgttacctaagttacggaacttcgacctaaacctacccgaaacggaccgggaccctaaacggtcggaaccctacgttaccccgaggtaccccgttaacgggttaccgtaacgggtcggtaaccgtacggggttacgggtccggtaaaggggaccctaggttaaccctttaccgaactcgtacccaaccgtactacgaaccggcccgtaccttaacggaccgtaccgtagggtacgttacttcggtagttaccgttttaactttacgttgggttaccgttaggggtacttacggtaactaaccgtttacggccccgttaccggttaccgttaacgtttccgggaaaccgggtaacgggtaacaacggtacgtacggagacgtaacgtaacgacgtaacgtacggtcgactagtacgaactacgttacgttacttccgttctaccg

SEQ ID NO: 277500 - DNA, 854 bp, Homo sapiens
  misc_feature: GYAE6OF01BZH26.29.35.D02.1.454.CMB.1.raw
  modified_base (235)..(235): a, c, t, g, unknown or other
  misc_feature (235)..(235): n is a, c, g, or t
  modified_base (780)..(780): a, c, t, g, unknown or other
  misc_feature (780)..(780): n is a, c, g, or t
tcagatagagtactcacgaccggtgctcgatttagcacacgataggttgggtttgggggaggaactgctcagttaggacccagacggaaccatggaacgccccagctcagtcttctcttcctcctgctactctggctaccagactaccagcggagagtatttggtgttcgaacactacgttcctccacgtcccctacccgttgtttcgttttcggtacccggtaccgggggaaanaaacggtccacccctacccttcgtccgtggaccgtacggggccctaaggttcgaaggtaacggtttaacttaaaccaactttcggttccgggtacctttgggtaacccaaaacgtaacggtaaaccgtcggaccgtacggtccctacccggacggtccctaccgttactacttaccgttaagtacggtactttacggacctaaccgtaacccggaacggtaccgggtaccacggtcggtacctaccgtacccgacggtaccgtacggttcgaggtcggtacggtacgggttcgggtaccgtagggaactacggttaccttacccgtaacttccctaaccaccgtacgttaccggacccgtaccgtacgtaacggtcgtacggtacgggtacgtttaccgttacgtttacggttttaaccgttttatttacggtttcgggttcggttttacggaccgttaacgtcccgttaaccgggttccgtcctttcccggttaaccggtttccggttaccgggaccggtaacggtacggacgttcgacggtanaccgtaaggacggtacggtagtcggtaccggtctcccgaacttacctcgttacttcgttaacccttccgtaccg

SEQ ID NO: 277501 - DNA, 806 bp, Homo sapiens
  misc_feature: GYAE6OF01AS3SQ.29.35.D02.1.454.CMB.1.raw
tcagatagagtactcacgaccggtgctcgatttagcacacgatagttgggtttggggaggaactgctcagttaggacccagacggaaccatggaacgccccagctcagccttctcttcctcctgctactctggcctcccagactaccgaggcggagagtatttggtgttcgaacactacgtcctccagtccctaccttgttctttcggtaccgtaccggggaagtaaacgccgtcccctacccgtctaccgtacgccgtacgggacctagtaccaggtacgttacgttaaaaccaacctttcggttcggtacccgtttacggtaaccaaaccgtagaaacccgtcggaccgtacggaccctaccgacggtcctccttacgacttcgtaagtcgacgtctacgacctaaccgaaccggaccggacctacgtacgacctaccgacccgtaccgacgttaggtcgacggtcggtacgagggttcggtacgtacggacacgtacctactaccgtcctaccacactaccgacgccgtacgtacgacgtcgtaggtagtacgttacgttcggttactttacgttagtttcggttaccggttacggtacgtacgtaccgttaccgtcccggtacccttacccggttacgtttaccgggtttacgggacccgggtaaccgggtaaccgtacggtaccggtacggtaccgtaaccggttaacgaaccgttaacggtccggttaggtacccgggacccttacggtacccggttacttaaccgttcgttaccgtttaccgttacccggtttaccccg

SEQ ID NO: 277502 - DNA, 665 bp, Homo sapiens
  misc_feature: GYAE6OF01DDMQK.29.35.D02.1.454.CMB.1.raw
  modified_base (210)..(210): a, c, t, g, unknown or other
  misc_feature (210)..(210): n is a, c, g, or t
  modified_base (288)..(288): a, c, t, g, unknown or other
  misc_feature (288)..(288): n is a, c, g, or t
  modified_base (336)..(336): a, c, t, g, unknown or other
  misc_feature (336)..(336): n is a, c, g, or t
  modified_base (466)..(466): a, c, t, g, unknown or other
  misc_feature (466)..(466): n is a, c, g, or t
  modified_base (616)..(616): a, c, t, g, unknown or other
  misc_feature (616)..(616): n is a, c, g, or t
  modified_base (629)..(629): a, c, t, g, unknown or other
  misc_feature (629)..(629): n is a, c, g, or t
tcagatagagtactcacgaccggtgctcgatttagcacacgatagttgggtttgggggaggaactgctcagttaggacccagacggaaccatggaacgccccagctcagcttctcttcctcctgctactctggcctccagataacccgagcggaagagtatttgtgttgaacacagtctccagcccacctgttctttagccgtacggganaaacgtacgcccacccgtctccgtgcgaggggtccagtcagagttcgttaaacaacttgttggcccttggtaccaaanacgaaaccctggaccaggccctccgagcctcctacagtctaatcgagngaccactaacccaacggccggtaccacggttacggacctaaccttcccgacaccggttaagttccgagggtacggccgtagggtacgggtccggtgggtaacgacgtctaccactcccgtacaccgttanaccggacgaccgaccgtaagacgcgtaggacggttacttcgtacgtttaccgtttagttagtttcgttaccgggttaggtcgtacgtcgtaacgtcgtccctaccgtcgttacccggtttcggaccggtacggtaacgacggtagtacgngtacgactaacgngacgttggacgcgcgaactcagttcacgttctgtcc

SEQ ID NO: 277503 - DNA, 774 bp, Homo sapiens
  misc_feature: GYAE6OF01CF03A.29.35.D02.1.454.CMB.1.raw
  modified_base (215)..(215): a, c, t, g, unknown or other
  misc_feature (215)..(215): n is a, c, g, or t
  modified_base (294)..(294): a, c, t, g, unknown or other
  misc_feature (294)..(294): n is a, c, g, or t
tcagatagagtactcacgaccggtgctcgatttagcacacgatagttggggtttgggggaggaactgctcagttaggacccagacggaaccatggaagccccagctcagcttctcttcctcctgcctactctgcctcccagactaccagcggagagattgtgttgacactagtcctccagccctaacccttgttctttgtaccgtaccggggaanaaaacggcgccctacccctctccgtgcgacgggccaggtacagagttacttaaacacttacgtggccctggttaccaanaacgaaacccgtcggccgacggccctcccgacggtccctccgtactacttacttaacgtggaactccgacctaccgtaacccgaacggaccgggtcctacggtacggacctaaccctcccgaacgtccggttaacggttcacgggtggtccggtaagggttcgggtacgtaacggggacttaaccggtacttaccgtacctaccctaccgaaccctcgtacgaccgcccgtacgtacgcggtaccgtagggtacgtcgtcttacggttccgtttaatttggtcgtttgttacgggcctacgtaccgtacggtccggtccttacccggttaccgttccgggtttaccgggaacggtaccggtaaccgtacggtacggttacgggaactacgtaaaccggtacggtaacgggttatcgggttccggtacgtacccggtcctaaaccttcggttaccttaccggtttaccgtcttaaccccgg

SEQ ID NO: 277504 - DNA, 825 bp, Homo sapiens
  misc_feature: GYAE6OF01CQZQ3.29.35.D02.1.454.CMB.1.raw
  modified_base (153)..(153): a, c, t, g, unknown or other
  misc_feature (153)..(153): n is a, c, g, or t
tcagatagagtactcacgaccggtgctcgatttagcacacgatagttgggttgggggaggaactgctcagttaggacccagacggaaccatggaagccccagctcagcttctcttcctcctgcttactctggcctcccagataccagcggganagtattgtgtcgacacgacgtctccagccctaccgttgttctttcgccggtaccggggaagaaagccgccctacccctcgttccgaggcgacggggccctaaggttccgaaggtacggtttaacttaaaccgtaaacttttccggtttcgggccctttaacgggttaaccccaaaaacgtaacggtaaaacccgtcgggaaccctacgggacccttccccggaacggtcccttccctaactaacgttccgttaagtcggtaagtaccggtaacctaaccgtaacccgaaaaccgggccgggtaccctaaggttaccggaaccctaacccgttaacccgacggtacccgtaaacggtttcgaaggttccggacggttagggtccgggttacggagactagaccttccgacttccacgtacctcgacgtccgcccgtacgtagaccgtccgtaaggacgtttcgttacgtaccggtttacttttactacgggtttcgtaccggtgggtaccgtaagacccgttacggtcccgttacccgttcccgttagtttacccggttcggaccgggaacggtcgacgtcgtaagggactacgtacgaacgggaaccgttgttgggccggtacttccggaccctaacgttacctttgttaccttccgtttaacccgtacccg

SEQ ID NO: 277505 - DNA, 815 bp, Homo sapiens
  misc_feature: GYAE6OF01C83V1.29.35.D02.1.454.CMB.1.raw
tcagatagagtactcacgaccggtgctcgatttagcacacgatagttgggtttggggaggaactgctcagttaggacccagacggaaccatggaagccccagctcagcttctcttcctcctgctactctggctcccagataccagcggagagattgtgttgacacagtctccagccacctgtctttgtctccgggagaaagacgccaccctctcctgcgacgggccagtcagagttagtaaacaactacgttggccttgggttaccaaacaagaaaccgtggacccgaagggccctcccgaggccttcctactaatctatgaatcgacaactccgaaacgtacggggaccctaacgtcggacctaactaccccgaggtacccgtaacgggttccgaacggttcgggacgtacgggttacgggggtccgttagggggaacctaacggtaaccctttacgtaacctttccgtaaacccaacccgtaacgttccgaaccgggtaccccgtacccggtaacggtaaccgtaccgtacgggttaacgggttacgtttaccgttacggttaccgttttttaacgtttacggttttcggtttacggtttacggggttaccgttaacggtaccgtaaaccggttcgggttaaccccttcccggtttaccgtttaccgtttttacgggacccgggtaacggggtaaccgacggtaccggtacgggtaacgacggtaaccgtaacggtaaaccggtaaggttcgggtacggtcgtaccgaccgtaacctaacggttccgttttacgttccgtttacgttaacccg

SEQ ID NO: 277506 - DNA, 736 bp, Homo sapiens
  misc_feature: GYAE6OF01E4CB4.29.35.D02.1.454.CMB.1.raw
tcagatagagtactcacgaccggtgctcgatttagcacacgatagttgggtttgggggaggaactgctcagttaggacccagacggaaccatggaagccccagctcagcttctcttcctcctgctactctggctcccagataccagcggagagattgtgttgacacagtctccagccaccctgtctttgctccgggagaaagcgccaccctctcctgcacgggccagtcagagttagttaaaccaacttacttggcccttcggttaccaaacagaaaacctgggacccaggcctcccgaggccttcctcatctatgatcgcactaccaacgcgggccacgtgcactcccgagcctaggttcagtcggacaggttcgggtcgtagggacacggtaactttcacttacctaccaaccctactaccgacggtacccgaccgtaacggacgtaccgtaggacggttaacgtttaccgttacggttacccgtttttagtttacgtttcggtttacgtttacggggtacgttaacgtaccgtaaccggtcggtccccggttaccccgttccgtttaccgggtttttcgggacccggtaacgggggtaacccgtaacgggtaccggttacgggaacgtaaccgttaccgaaacgggtaacccgtaaacggttacgggttcggtaccgttaccggtacccgtaacccttacgttccgtttcggtttcccttaccgtttaccccg

SEQ ID NO: 277507 - DNA, 757 bp, Homo sapiens
  misc_feature: GYAE6OF01EPK2P.29.35.D02.1.454.CMB.1.raw
tcagatagagtactcacgaccggtgctcgatttagcacacgatagttgggtttggggaggaactgctcagttaggacccagacggaaccatggaagccccagctcagcttctcttcctcctgctactctggcctcccagataccagcggagagattgtgttgacacagtctccagcccacctgtctttgtctcgggagaagcgccacctctcctgccagggccagtcagagttacgttaacaacttcgttggccttcggttaccaacgaagaaacccgtggaccgaggccgtccccgggactcctcgtatcctagtcgtaatcgacaactaccgaaacggcgggaccctacggtcggacctaccgttccccgaggtacccgtaacgggtttccgaacggttcggggtaccgtacggggtttcgggggttacgttacgggggaaacctacgggtttacctttaccgtacccgttaccgttaccaacccgtaacttaccgacggtacccgtacgtacgtaccgccgtaggtacgtacgtttcgtacggtttaccttttagtttacgttcgtttacggttcgggtacgttacgacgtaacgttccggtccccgttacccgttacgttaccgtttcgggacccgtaacgggtaaccgtaggtaccgtagggaactacggtacgaaacgtacggtacgttgggtccggtcctacgaaccgtaccttacgttccgttacgttcccttccgtacgtttcccccg

SEQ ID NO: 277508 - DNA, 783 bp, Homo sapiens
  misc_feature: GYAE6OF01CRO6Y.29.35.D02.1.454.CMB.1.raw
  modified_base (435)..(435): a, c, t, g, unknown or other
  misc_feature (435)..(435): n is a, c, g, or t
tcagatagagtactcacgaccggtgctcgatttagcacacgatagttgggtttggggaggaactgctcagttaggacccagacggaaccatggaagccccagctcagcttctcttcctcctgctactctcggcctcccagactaccagcggagagtattggtgttagaccacgacgttctaccacgtcccctaccgttgttcctttgccggtaccgggaagaaacgacgtcccctaccctctccgtgcgacgggtcccagtacacgtagttacgtaaaccacttacgttcggaccttcggttaaccaaacgtaacgtaaacccgttgggacccacggtcccgttacccgacggtcctacccgtctaactcgtacgtgaccgttcgacacttacccgaacggtaccggtcccaggtccgaccttaaccgaccccgnggtaccctaagggttcacggtcgaccgtgggtcgttacggaggtaccgtataccttcgaccttcaaccgtactacgtcaccgacccgtaccgtacgtacgaccgtcggtacgttacgttacgttacgttaccgttttacgttacgtttaggttaccggttggttaccggtacgtaccgttaaccggtccgttcccgttacccgttacccggttacgtttacccgggtaccggtaacgggtaccgacggtacgtacggtaacgtacgtacggtaacggtaacgttacggtacgggtccgtacgtacccgtacgtccgtaacccttcgtacttaccgttcccttaacccg

SEQ ID NO: 277509 - DNA, 670 bp, Homo sapiens
  misc_feature: GYAE6OF01C1BHN.29.35.D02.1.454.CMB.1.raw
  modified_base (170)..(170): a, c, t, g, unknown or other
  misc_feature (170)..(170): n is a, c, g, or t
  modified_base (210)..(210): a, c, t, g, unknown or other
  misc_feature (210)..(210): n is a, c, g, or t
  modified_base (365)..(365): a, c, t, g, unknown or other
  misc_feature (365)..(365): n is a, c, g, or t
  modified_base (370)..(370): a, c, t, g, unknown or other
  misc_feature (370)..(370): n is a, c, g, or t
  modified_base (414)..(414): a, c, t, g, unknown or other
  misc_feature (414)..(414): n is a, c, g, or t
  modified_base (664)..(664): a, c, t, g, unknown or other
  misc_feature (664)..(664): n is a, c, g, or t
tcagatagagtactcacgaccggtgctcgatttagcacacgataggttgggtttgggggaggaactgctcagttaggacccagacggaaccatggaacgccccagctcagcttctcttcctcctgcttactctggctcccagataccagcggagagattgtgttgacacngtctccagcccaccttgtctttgccgtccgggaagaaacncgccctacctctcctgcgacgggccagtccagacgttacgttaacaacttacgttggcccttaggttacccaaacgagtaaaccgtggaccacggtacctcccgaggtcctcctacactccgtagtcgatcgacactaccaagacggcctaacgnggacncgtccagaccgtaggtccaggtcggcgtagggttcggttaccgnggggaaccaggtacttcgtaaccttccacgaactctcgaaccgtccgacacgacgcctgtacgtactcttcgtactttagttagttcgttcgttcggacggtactacgaacgttccgtccgtcccgttacgttaccggttttccggaaccggttaacggggaccctaaggtccgtaaggtacgacgttacgaacggtacgtaacgttcgtaagtcccgtagtacccgacctagttacccttgtcccgttntacccg

SEQ ID NO: 277510 - DNA, 781 bp, Homo sapiens
  misc_feature: GYAE6OF01DVGQB.29.35.D02.1.454.CMB.1.raw
tcagatagagtactcacgaccggtgctcgatttagcacacgatagttgggtttgggggaggaactgctcagttaggacccagacggaaccatggaagccccagctcagcttctcttcctcctgctactctggctcccagataccagcggagagattgtgttgacacagtctccagccacctgtctttgtcgtcgggagaaagagccaccctctcctgcagggcctagtcagtagttagttaaaccaacgttcgttcggaccttggttaccaaacgtaacgtaaaacccgtcgggaccaaggccttaccccgaggtaccttccctactaacttccgttagttacggaattcggacttaactacccgaaacgacgggacctacgtcggactaaccgtacccgaacgccgtaacggttcgtaaggtcggacgtagggtcgggtacggtacgggaactaagtccttaacgtactccgtacaacctacgaccgacgtacccgtactaacggaccgtcgttaggacggttaacttcgtttacgttaccgttttagtttacgtttcggttaccggtttacgggtaccgttaacggtaccgtaaccgttccggtacccctttacccgggttacctttaccggttttaccgggaccggtaacgggtaaccggtaacggtcgttagggtaacgtaccgttaacggaacggtaaccggttaacggttacggtccgggtacgtacggaccccgttaacgtaccgttagtttccgttacgttaccgttaccccg

SEQ ID NO: 277511 - DNA, 584 bp, Homo sapiens
  misc_feature: GYAE6OF01A3EVX.29.35.D02.1.454.CMB.1.raw
  modified_base (199)..(199): a, c, t, g, unknown or other
  misc_feature (199)..(199): n is a, c, g, or t
  modified_base (204)..(204): a, c, t, g, unknown or other
  misc_feature (204)..(204): n is a, c, g, or t
tcagatagagtactcacgaccggtgctcgatttagcacacgatagttgggtttgggggaggaactgctcagttaggacccagacggaaccatggaagccccagctcagcttctcttcctcctgctactctggctcccagataccagcggagagattgtgttgacacagtctccagccaccctgtctttgtctccggganaaagngcccaccctctcctgcagggccagtcagagtgttaacaacttacttggcctggttccaacagaaacctggccaggcctcccaggcctcctcattctatgtatgactatcccaaacgagggcccacgtcggctactcccgacgccaggttcaggtgcgaggtcgggtctgggacagtaccttcactctacaccatccgacgcccgtcgtagacgaccgtgacggtacttcgtagtccgttttattacgttgtccgttggcgtagctaacgtcgcccttcccgtctacgtttcggaccgtacgggacctaggcgtaggacgtagtaccgagacgtacgtggtcggacgtcgaccgtactacgttctcgttccttcgtacccg

SEQ ID NO: 277512 - DNA, 575 bp, Homo sapiens
  misc_feature: GYAE6OF01CNCWL.29.35.D02.1.454.CMB.1.raw
  modified_base (149)..(149): a, c, t, g, unknown or other
  misc_feature (149)..(149): n is a, c, g, or t
  modified_base (193)..(193): a, c, t, g, unknown or other
  misc_feature (193)..(193): n is a, c, g, or t
  modified_base (196)..(196): a, c, t, g, unknown or other
  misc_feature (196)..(196): n is a, c, g, or t
  modified_base (204)..(204): a, c, t, g, unknown or other
  misc_feature (204)..(204): n is a, c, g, or t
  modified_base (207)..(207): a, c, t, g, unknown or other
  misc_feature (207)..(207): n is a, c, g, or t
  modified_base (235)..(235): a, c, t, g, unknown or other
  misc_feature (235)..(235): n is a, c, g, or t
  modified_base (296)..(296): a, c, t, g, unknown or other
  misc_feature (296)..(296): n is a, c, g, or t
  modified_base (305)..(305): a, c, t, g, unknown or other
  misc_feature (305)..(305): n is a, c, g, or t
  modified_base (320)..(320): a, c, t, g, unknown or other
  misc_feature (320)..(320): n is a, c, g, or t
tcagatagagtactcacgaccggtgctcgatttagcacacgatagttgggtttgggggaggaactgctcagttaggacccagacggaaccatggaagcccagctcagcttctcttcctcctgctactctggctccagataccagcgganagattgtgttgacacagtctcagccacctgtctttgctcggganaangccacctntcngcaggccagtcagagtgttaacaacttnttggcctggttaccaacagaaacctggcaggctccaggctctcatctatgatgcatccaanagggccaancggacaactcccganccgaaggttcaagtggacaggtcgggtcagggacagtacttcactctacaccatcaagccgtacagagcctagaggtacttcgcgtcggttttaattagttggtctttcgggaccgtaagctaaaaccgtcggtacccgtcccggtaactccgttttgggacccgaaggggaacccaaggacgttaggaagacttacgaaggttaacccgaaagtttggtcggtactacgacctactactcttcgtcttctaacg

SEQ ID NO: 277513 - DNA, 743 bp, Homo sapiens
  misc_feature: GYAE6OF01EM3CT.29.35.D02.1.454.CMB.1.raw
  modified_base (239)..(239): a, c, t, g, unknown or other
  misc_feature (239)..(239): n is a, c, g, or t
  modified_base (345)..(345): a, c, t, g, unknown or other
  misc_feature (345)..(345): n is a, c, g, or t
  modified_base (477)..(477): a, c, t, g, unknown or other
  misc_feature (477)..(477): n is a, c, g, or t
tcagatagagtactcacgaccggtgctcgatttagcacacgatagttgggtttgggggaggaactgctcagttaggacccagacggaaccatggaagccccagctcagcttctcttcctcctgctactctggcctcccagactaccaggcggagagtattgtgttcgacacagtcctccacgccctacccgttgttctttcgtacgtccggggaagaaaacgcgccctaccctctccgngcgacggcagtcagtagttacgtaaaccaacttacgttcggccttcggttaacccaaacgaacggaaacctcgggacccagggtccctacccgaggtcctccctanacttctaagtcgatacgactaacgtacccaaaggccgggtacccacggtacggacctaccgtaccgacgtaccgtacggttacgagtcggcgtacgggtggtcgtagggacagttacctcactcacacgtanaccgacgacccgtacacgcggtacctagggtacgtaccgttcgttacggtttacccttttaagtttcggtttacggttcgggtttacgggtaccgtttaacggaccttaccgggtacccgtcccgttaccccgttagtttaccgggtttccgggaccgggtaacgggcctaacggtcggtagggaactaccggtaacgacggtaaccggtagttcggtacggtccctagaccctaccgtattcccgtacgtttccgttactacccg

SEQ ID NO: 277514 - DNA, 731 bp, Homo sapiens
  misc_feature: GYAE6OF01CSGQE.29.35.D02.1.454.CMB.1.raw
tcagatagagtactcacgaccggtgctcgatttagcacacgatagttgggtttgggggaggaactgctcagttaggacccagacggaaccatggaagcccagctcagcttctcttcctctgctactctggctccagataccaggcggagagtattgtgttagacacagtctccagcccacctgttctttgtcgtacgggaagaacgacgcccacctctccgtgcgacgggccagtcgaagtagttacgttaaacaacttacgtcggtacctggttaccaaacgaacgaaccgtcggccgaacgggtcctaccgaggcctccgtactactactagtagtagtcacacgtaccaaacgcgggtcctacgtacggacctacgtacccagaccgtagggttacgtaggtcggacgtagggttcgggtcgttacggactacggtacttacctacgtcctaccgaactaccgtacgaccgtcccgaacgtacggaccgtcggtaggtaagttctttcggtactttacgttttattacggtttcggtacggtcgggtacgtcgtaaccgttacggtccggttacccttccgttccgttttacgggttaccgggaccggttacggggtaaccctacggtcggttaacggacgtactaacgggttaacgaaccggtaagtttccgggcggttacctaccggactaacccgttacgtcgtttccgtactttacggttaccc

SEQ ID NO: 277515 - DNA, 887 bp, Homo sapiens
  misc_feature: GYAE6OF01ETC2U.29.35.D02.1.454.CMB.1.raw
tcagatagagtactcacgaccggtgctcgatttagcacacgataggttgggtttggggggaggaactgctcagttaggacccagacggaaccatggaagccccagctcagcttctcttcctcctgctactctggctcccagataccaggcggagagatttgtgttgaacactagtctccagtcccacccttgtcctttgtcgtaccgggaagaaagcgccctaccctctcctgacgagggccaggtcaggtagttacgttaaaccaacgttcgttcgggccttacggttaccgaaaacacggaaaacccgtgggacccaagggccctcccgaagggtccttcctacagtcctaagtgatcgacacgtaccaacgtacgggcccaagtcgactactcccgagtccgtaggtcaggtggaccgtaggttggggtccgtagggaactacggtccttacgtacccgttccgacctacgtaccgtcggtaacccggtcccggtacccgtaacggtaccggtaccgtaacggggtacggttaccgtttacgttaccgttacccggttttttaattttaaccggttttcgttttacggtttaccgggggtacggttaaccggtaaccgtttaacccggttacccgggtaccccgtttccccggttaacccggtttaccgggtttttaccgggcccgggtaaaaccgggggtaacccggaacgggttaccgggtaacggggtaaccggttaccggtaaacggtaaacccggggtttaaccgttaccggggttacgggttaccccgggttaccggtaaacccgggtaaacccccttaggtttacccggtttaccgttttaaccggttttccccgtttaaccgtttacccccccggg

SEQ ID NO: 277516 - DNA, 735 bp, Homo sapiens
  misc_feature: GYAE6OF01BG8FF.29.35.D02.1.454.CMB.1.raw
  modified_base (273)..(273): a, c, t, g, unknown or other
  misc_feature (273)..(273): n is a, c, g, or t
tcagatagagtactcacgaccggtgctcgatttagcacacgatagttgggtttgggggaggaactgctcagttaggacccagacggaaccatggaagccccagctcagcttctcttcctcctgctactctggctcccagataccagcggagagattgtgttgacacagtctccagcccacctgtctttgtccgtccgggagaaacgcgccaccctctcctgcgacgggccagtcagagtcgttaaacaactcgttggccttggttacccaaanaagaaaccgtggaccaggcctcccgagcctcctcactctagtgatcgctactaccgaacgacgggcctacgtcggcaactccccgagtaccgtaggttccgaggttcggacgtagggtggggttccgtaggggaactacgggtacctttccgaacgtttcctaccaacctaacgtccgaaccgcccgtaccgtacggacgtccgtacggtaacggttacttaccgttcgtttaccgtttttagtttacggttttacggttcggtttacggggtaccggttacggttaacctaaccggttccggttccccgttcccggttaccgttacccgggttttccgggacccgggtaacggggtaacccgtaacggtccggtaagggacgtacgtaaccgtaacggtaaccggtaacgtggtcggccgtacggccgtaacctcgttaccgttcgtcgtttcctaacccg

SEQ ID NO: 277517 - DNA, 810 bp, Homo sapiens
  misc_feature: GYAE6OF01BWLKK.29.35.D02.1.454.CMB.1.raw
tcagatagagtactcacgaccggtgctcgatttagcacacgatagttgggtttgggggaggaactgctcagttaggacccagacggaaccatggaagcccagctcagcttctcttcctcctgctactctggctcccagataccagcggagagattgtgttgacacagtctccagccacccttgttctttcgtccgtccgggaagaaacgacgccctaccctctcctgcgacgggccagtcagtagtgttaaacacgtacgttcggccttggtaccaacgacgaaacctggaccgacggcctcccgaggccttccgtactattacctagtcgacttcggactaacgtaccgaaacgaccgggacccaacgtcggaccaccttacccgacggtacccgtaggttacgacggtcggacgtagggtcgggttcgtacggggaacctaaggtacccttcgaccgttccgtaccaaccgtactacccgaaccggtacccgacccgttaacggaccggtaccgttacgggtaacgttacgtttaccgttaccggtttaccggtttttaagtttacgtttcggttaccggtttacggggtaccgttaaccggtacccgttaaccgggttcccggtaccccgtttacccggttacccgtttaaccgggttttaccgggaacccgggttaacggggtaccccgtaacggtccgttagggaacgtaccgtaccgtaacggtaccggtaacggttcgggtcggtaccgttacggacccgtaccgttacgttacccgttacgttccgtttaccgttaccccgg

SEQ ID NO: 277518 - DNA, 720 bp, Homo sapiens
  misc_feature: GYAE6OF01EFQ4Z.29.35.D02.1.454.CMB.1.raw
tcagatagagtactcacgaccggtgctcgatttagcacacgatagttgggtttgggggaggaactgctcagttaggacccagacggaaccatggaagccccagctcagcttctcttcctcctgctactctggctcccagataccagcggagagattgtgttgacacagtctccagccaccctgtctttgtctccgggagaaagcgcccaccctctcctgcgacgggccagtcagagtgttaacacttacgtggccttggttaccaacacgaaacctggccacggcctcccaggcctcctcactctatcgatcgcactccaacgtacgggaccacgtcggacacgtccccaggacccgtaggttaccaggtcggacgtaaggggttcggggttactggggaaccaaggtacctttacgaccttaccgttccgaaaccctacgttaccgacggcccgtaccgttaacggacgtcccgttaggacggtactttccgttacggtttaccgtttttaacgtttacgtttcggtttacgtttacgggggttacgttacggttaaccgtaaccggttccgggttaaccccgtttcccggtttaccgttaaccggtttttcgggaccggtaacggggtacctaacggtcgttaggacgtactacggacgaccggtacgtcggtcggtacgtcggacctacgtacttacgttcgttacttcgttacccg

SEQ ID NO: 277519 - DNA, 760 bp, Homo sapiens
  misc_feature: GYAE6OF01CZBR8.29.35.D02.1.454.CMB.1.raw
  modified_base (186)..(186): a, c, t, g, unknown or other
  misc_feature (186)..(186): n is a, c, g, or t
  modified_base (219)..(219): a, c, t, g, unknown or other
  misc_feature (219)..(219): n is a, c, g, or t
  modified_base (291)..(291): a, c, t, g, unknown or other
  misc_feature (291)..(291): n is a, c, g, or t
  modified_base (312)..(312): a, c, t, g, unknown or other
  misc_feature (312)..(312): n is a, c, g, or t
  modified_base (395)..(395): a, c, t, g, unknown or other
  misc_feature (395)..(395): n is a, c, g, or t
  modified_base (656)..(656): a, c, t, g, unknown or other
  misc_feature (656)..(656): n is a, c, g, or t
tcagatagagtactcacgaccggtgctcgatttagcacacgatagttgggtttggggagaactgctcagttacggacccagacggaaccagtggaacgccccagctcagtccttctcttcctcctgcctactcgtcggccttcccgaagataacccgaggcggagagtattgtgttgacacagtcnccagccctacctgttcgttgtcgtaccgggaanaaacgcgccacctctccgtgcgacggccagtcagtagtagtaacacttgtcgcttgtaccaagacgaaccgnggccaggcctaccgagcctcnctacgtctagtgacgtcgactacgtaccgaaaccggcggaccctacggtcggaccttaccgacccacgtaccgttacggttanacggttggccgttaagggttccggggcgttacgggaacgtacgtaccgttcaccgttaccgacgacctacggccgaccgtacccgaccgtaacggtccgcgtaacggggtacttacgtttaccgtttacgggtttacccgtttttaagtttacggtttaccgtttggggaccggtttaacgtaacggtacccgttaacccggttccggtccccgtttaccggttaccgtttccgggttaccgaaccgggtaaggtaacccngggtacctggggaaacctacggtaaccggtaggaaaccgttcgtcggtaccgggttactacgggacccttaagtcccgtttagttcgttccgtttaaccgcccg

SEQ ID NO: 277520 - DNA, 793 bp, Homo sapiens
  misc_feature: GYAE6OF01CNBKW.29.35.D02.1.454.CMB.1.raw
tcagatagagtactcacgaccggtgctcgatttagcacacgatagttgggtttggggaggaactgctcagttaggacccagacggaaccatggaagccccagctcagcttctcttcctcctgctactctggcctcccagataccaggcggagagtattgtgttgacacagtctccagcccaccttgttctttgtccgtccgggaagaaacgacgccctaccctctcctgcgacgggccagtcagtagttacgtaacaacttacgttcggccttacggttaccaaagtaacgtaaaccgtggacccgacgggccctcccgaggtccttccctacagttactatcgagttacgactactacccgaaacggacggaccctaacggtcggacctacgtaccccaggtcccgtaggttcgtaacggtggtacgtagggttcggggtcgtacggggactaacggtaccttaccggaccttacctaccgtaaccacgttaccgaccggtcccgaaccgttacggacgtcgtaggtacgttacgtttacgttaccggtttaccgttttattttacgttcggtttaccggttaggggtaccgttaacggtaccgttaaccggtccgtaccccgtttcccggttaacgtttacccggtttaccgggacccggtaacggggtaaccctaggtcccgggttaggaacgtacggtaaccgtaacggtaaaccggactttacgggtacgtaccgtacgtaccctaaaccgtcgttacctttaccggttcccttaaccgtttaccccg

SEQ ID NO: 277521 - DNA, 813 bp, Homo sapiens
  misc_feature: GYAE6OF01DT8EQ.29.35.D02.1.454.CMB.1.raw
  modified_base (235)..(235): a, c, t, g, unknown or other
  misc_feature (235)..(235): n is a, c, g, or t
  modified_base (312)..(312): a, c, t, g, unknown or other
  misc_feature (312)..(312): n is a, c, g, or t
  modified_base (369)..(369): a, c, t, g, unknown or other
  misc_feature (369)..(369): n is a, c, g, or t
  modified_base (776)..(776): a, c, t, g, unknown or other
  misc_feature (776)..(776): n is a, c, g, or t
tcagatagagtactcacgaccggtgctcgatttagcacacgatagttgggtttggggaggaactgctcagttaggacccagacggaaccatggaacgccccagctcagcttctcttcctctgcttactctggcctcccagtataccagcggagagtattgtgtagacacgagtcctccacgtccctaccttgttcctttggtccgtaccgggaagaacgccgcccctacccttcnccgtggacgtacgggccctagtacgagttagttacttaaaacctaccgttacgttcggtccgttacgtaacccgaanaacggtaacccgtcgacccgtacggccctaccgacgtccctctactacgttactagngtactcgactaaccgtaccggaaaccggccgggtaccgtacgaccggacctacctaccccgacggttacccgtagggtaccgtacggggtcggtacggttagggggtcggttacggtacgggtaccgtaacggtttcccttaacggcccttaccctacgtacctaaccgttccgaccgtacccggaccgtagacccggttcgtcggtacgttactttcgttacgttttacgttttagtttacggttacggttcggttaccgggtaagtcccgtaacggtttacccggtcccggtccccgtttaccggttaccgtttcccggggttccggtaaccgggtaccgttaacggacggttaccggaggtacgtacgtaaacgtcggtaaccgtgggtatcccggcgtaaccnccctaagtttcgtacccgttctcccgttcgttacccg

SEQ ID NO: 277522 - DNA, 260 bp, Homo sapiens
  misc_feature: GYAE6OF01BKOVQ.29.35.D02.1.454.CMB.1.raw
  modified_base (258)..(260): a, c, t, g, unknown or other
  misc_feature (258)..(260): n is a, c, g, or t
tcagatagagtactcacgaccggtgctcgatttagcacacgatagttgggtttgggacagacttcactctcaccatcagccgcctagagcctgaggattctgccgtttattattgtcttgggcgtagcaactggcctcccgtcacttttggccaggggaccaagctggagatcagacgaactgtggctgcaccatctgtcttcatccttcccgccatctagaagtactctatctgagcgggctggcaaggcgcatagnnn

SEQ ID NO: 277523 - DNA, 785 bp, Homo sapiens
  misc_feature: GYAE6OF01CPVK2.29.35.D02.1.454.CMB.1.raw
tcagatagagtactcacgaccggtgctcgatttagcacacgatagttgggtttggggaggaactgctcagttaggacccagaccgaaccatggaagccccagctcagcttctcttcctctgctactctgcctccagataccagcggagactattgtgttgacacagtctccagcctaccgtgttcttgtcgtaccggagaaacgcgcctacccgtctccgtgaccgagggcccagttaccaggtagttaacgttaaacctaacgttacgttcggaccgttggttacccaaataacgtaaaccgtggacccgacgtccgttacccgaacggtcccttccgtacctacttccgttaagtcggtacgtcgacctacgtaaacccgaacgccgggaccctaacgtcggtacacccgtacccgacgtaccgtaggttaccgacgggttacggacgtacggggttcgggtaccgtaacgggtacctacggttaaccttacccgacgttcctaaaccgtacccgtagcccggtaacgtcccgtaccgttacggaccgtaccggtaggtaacggttcgttacgttcgtttaccgttttaagttacgtttcggttacggtacggttacgtaccgtacgttaacgttccgttcccgttaccgtttccttaaccgggttttccggaaccgggtaccggtaacgtacgttcggtacggtaacgtacgtacgtaaacgtcgtacgtagttcggacgtacccgacgtaccgttgtacgttccgttaccgttcgtacccg

SEQ ID NO: 277524 - DNA, 802 bp, Homo sapiens
  misc_feature: GYAE6OF01E3WSM.29.35.D02.1.454.CMB.1.raw
tcagatagagtactcacgaccggtgctcgatttagcacacgatagttgggtttgggggaggaactgctcagttaggacccagacggaaccatggaagccccagctcagcttctcttcctcctgctactctggctcccagataccagcggagagattgtgttgacacagtctccagccaccctgtctttgtcgtcgggagaaagacgcccacctctcctgcagggccagtcagagtagttaacaactactggcctcggttaccaacacgaaaccgtcggccgacggcctcccgaggcctcctacatctatgatgaccatacccgaacgacggggacccacgtcggacctacctacccgacgtaccggtagggttacgtaacgggtcggtacgtacggggttcggggttacggtacggggaacctacggtaaccctttccgtaacccttcctaacccgaaccctaccgttaccggaacccgtaccccggtccttaaacgggaccggtcccgttaaggggtaacggtttaacccgttttccgttacgggttttaacccgtttttagtttacgttttcgggtttcggtttacggggtaccggttaacggtaccgtaaccggttccgggtcccccgtttaccccggttacgtttacccgggtttcgggacccgggtaacggggaacccgtacgggtcgttaagggacgtaaccgtacgaacgggtaacccgtagggttcgggtcggtacccttaccggtaacctacccgttagttcccgtttaccggtttcccttaaccgttccccg

SEQ ID NO: 277525 - DNA, 643 bp, Homo sapiens
  misc_feature: GYAE6OF01E49Q1.29.35.D02.1.454.CMB.1.raw
  modified_base (457)..(457): a, c, t, g, unknown or other
  misc_feature (457)..(457): n is a, c, g, or t
tcagatagagtactcacgaccggtgctcgatttagcacacgatagttggggtttgggggaggaactgctcagttaggacccagacggaaccatggaacgccccagctcagcttctcttcctcctgctactctggctcccagataccagcggagagattgtgttgacacagtctcagcccacctgtctttgtctaccgggaagaaagcgccctaccctctcctgcacgggccagtcagagtacgttaaacaactacgttggccttaggtaccaaacacgaaaccgtggccaaggcctacccgaggtcctccctacatcctatcgatcgcaatacccaaaggacgggccaaacgtcggccaactcccgaacggtaccgaggttcaaggtcggacgtaggtcggggtctagggaactacgaactttcaaccgtctaccactatcgacgtccgactagacnccgtgaggtattcgtgtactttattagtttgtcgttggcgtagactaacgtcggtccgtcccgtacgtcgtttacgggccgtaacgggtaaccaaaggcggtaggacgtacgtaacaacggtaacgtaacgttcggacggtccgtacggtaccctaaccgttattacgttcgttccttctaacccg

SEQ ID NO: 277526 - DNA, 967 bp, Homo sapiens
  misc_feature: GYAE6OF01BQORL.29.35.D02.1.454.CMB.1.raw
  modified_base (159)..(159): a, c, t, g, unknown or other
  misc_feature (159)..(159): n is a, c, g, or t
tcagatagagtactcacgaccggtgctcgatttagcacacgatagttgggttggggggaactgctcagttaggacccagacggaaccatggaagccccagctcagcttctcttcctcctgctactctggcctcccagataccaggcggagagtacttgngttgacacgagtcctccagccctacccttgtctttcgcgttaccgggaagtaaacgcgtccccacccgtcctcctacggcgacgggccctaggaccgtaaggtagttacgttaaaaccaacctttaccgttcggacccgtttagggttcccaaaaacggtacgtaaaacccgttgggacccgacggtccctaccccggacggtacccgtttccctaacctacttcccttaagttggtaacgttcgaaccgttaacgtaccccgaaacggtaccgggtaccctacgtccggacctaacgtccccacgtaccgtaggttctaacggtcggtcgagggttcgggtaccgtcgggaacctaggtacctttcgaacccttctacccgacctaacgttccggaccggtacccgtacgtaacggtacccgtaccgttacggaacggtttaccgttacggtaccgttttaaccggtttacgttttagtttacgggtttccggtttacgggtaccgttaaccgggtaccggtttaacccgtcccggggtttacccttacccccgttacccgggttttaccggtttaccccggggtaacccggggttaaccgggtaaaccccggtaacgggttaccgggttaaacggtaccgggtaaaccgggttaccgaaaacccggggttacccgggtaaaacggtttcccggggttaaacggttccccgggttaacccggtaaccccgtttaaacccggtggttttaccccgggtttacccttttacccggttaaacccgtttccccggtttaaaccccccgggg

SEQ ID NO: 277527 - DNA, 716 bp, Homo sapiens
  misc_feature: GYAE6OF01A524X.29.35.D02.1.454.CMB.1.raw
tcagatagagtactcacgaccggtgctcgatttagcacacgatagttgggtttggggaggaactgctcagttaggacccagacggaaccatggaagccccagctcagcttctcttcctcctgctactctggcctcccagactaccgagcggagagattgtgttgacacagtctccagccctacctgtctttgcgtcgggaagaaagcgcccacctctcctgcgacgggccagtacagtacgttacgttaaccaacttacgttcggaccttggttaacccaaacgaacgtaaaacccgttcggaccgaaccggtccttaccccgaacgggtcccttaccctactacttaccgttaagtacggacttacggacctacgttaccccgaaacgtaccgggccctacggtcggacctaccgttacccacggtaccgttagggttaccgaggttacggcgtagggttcgggtaccgtgggaacacgtccttaccgaccttcgtaacctacccagttaccgaccggtcccgacgtacggaccgtcgtagggattacgtcgtacggtttacctttattggttcgttcggttcggacgtagacctacgtcgtcccgtacctcgtacgtttccggacgacgggacctaggacgtacgacgtagttaccgaggtacctagggcgttcgaccgtcgactacgtacgtccttagttcctccgttacccg

SEQ ID NO: 277528 - DNA, 730 bp, Homo sapiens
  misc_feature: GYAE6OF01DD5S2.29.35.D02.1.454.CMB.1.raw
  modified_base (214)..(214): a, c, t, g, unknown or other
  misc_feature (214)..(214): n is a, c, g, or t
  modified_base (220)..(220): a, c, t, g, unknown or other
  misc_feature (220)..(220): n is a, c, g, or t
  modified_base (238)..(238): a, c, t, g, unknown or other
  misc_feature (238)..(238): n is a, c, g, or t
  modified_base (428)..(428): a, c, t, g, unknown or other
  misc_feature (428)..(428): n is a, c, g, or t
  modified_base (724)..(724): a, c, t, g, unknown or other
  misc_feature (724)..(724): n is a, c, g, or t
tcagatagagtactcacgaccggtgctcgatttagcacacgataggttggggtttgggggaggaactgctcagttaggacccagacggaaccatggaagccccagctcagcttctcttcctcctgctactctggctccagtatacccagcggagagattgtgttgacacgtagtctccagcccaccgttgttcttttaggcctaccgggggaanaaacgngtccccacccttcaccgngccgacgggccaggtccgaaggtacgttacgttaaaccaacctttcggttcggcccttggttacccaaaaacgacggtaaaacccgtgggacccacgggcctacccgacggtcctctaccattacactgatcgctactacaacggcggcccaagtcgggacctacctaccgagacccggtaggtttacgnggttacgggcgtaggggttcggtacgtagggaactcgtaacttcgaactttccacacggtactaccggaacgcccgtactaggtaccgtccggtaggtaacggttctttcgttacggttctttaactttaggttcggttaccgggttggtacgtacggtaccttaacggtccggttccctacccggtttcgttaaccggtttcgggaccgggtacgtaaccgacgtcggtaacgtagaccgtagaacgtaacgtcctagggtcgactcaaccttcgtagtcccttgttaccccgtntcccgg

SEQ ID NO: 277529 - DNA, 946 bp, Homo sapiens
  misc_feature: GYAE6OF01ERYFB.29.35.D02.1.454.CMB.1.raw
tcagatagagtactcacgaccggtgctcgatttagcacacgatagttgggtttggggaggaactgctcagttaggacccagacggaaccatggaagccccagctcagcttctcttcctcctgctactctggcctcccagactaccaggcggagagtattgtgttgacacagtcctccagccctacccttgttcctttacggtccgtaccggggaagtaaaacgacgcccctaaccctcttcccgtggaccggacggggtccctaacggtccgaaggtaacgttaccgttaaaaccaaaccgtttcgttacgggacccgtttaggttaccccaaaacgtacggtaaaacccgtcgggaccccgtaagggtccccttacccggaacggtccctttacccgtactaacgtttaccgtaagttggaccttacggacctaaacgtaccccgaaaaccgggtccgggaacccctaggttcgggacctaccgttacccccgaagtacccggtacgggttccagggttccggacggtacggggttcggggtacgtacgggtaaccctaacgggttacccttaaccgtaacccgtccgtaaacccgtacccgtaaacggttcccccggtaacggtaccccggtacccggttaaccggtaccggttaccgtaacgggtaacgggtttaacgtttaccggttaccgggttttaccgtttttaacggttttaacggttttcggttacgggtttcggggtaaccggtttaacggtaccgttaacccggttccgggttccccgtttacccgggttaccgtttaccgggttttaaccggacccgggttaacgggaaccccgttacgggtaccggtaaggtaacggtacgtaccgtacgggtaaccgtacgtggtaccggtcgtactacgtaccgtcttaccgtacttccgttacgtacccg

SEQ ID NO: 277530 - DNA, 670 bp, Homo sapiens
  misc_feature: GYAE6OF01B7O4M.29.35.D02.1.454.CMB.1.raw
tcagatagagtactcacgaccggtgctcgatttagcacacgatagttgggtttgggggaggaactgctcagttaggacccagacggaaccatggaagccccagctcagcttctcttcctcctgctactctggctccagataccagcggagagattgtgttgacacagtctccagccaccctgtctttgtctccgggagaaagcgccacctctcctgcagggccagtcagtagtataacattacgttggcctggtaccaacgacgaacctggccaggcctccgacggcctcctacacttctatgtactcgactactaccaacgacgggaccctacgtggacctaccgtcccagtcccgtaggtcagggtcgacgagggtgggtccgtagggacctaagtaccttacgtactacctcgaaccacttcgacgacccgaccgtacggacgacgtaggtaacggtacgttcgttcgttacgtttatttacgtttcggttcgttacgggtacgtacgtcgtaccgttccggtcccgttcccgttacgttccggtttacgggaccggtaacgggtaacccgtaggtccggtaggagtaccgtacggtaaccggtaacgtacgtacggtcgggtcctacgtacctaaccgttctacgtttcttccgttccgttacccg

SEQ ID NO: 277531 - DNA, 1012 bp, Homo sapiens
  misc_feature: GYAE6OF01C2VSI.29.35.D02.1.454.CMB.1.raw
  modified_base (971)..(971): a, c, t, g, unknown or other
  misc_feature (971)..(971): n is a, c, g, or t
tcagatagagtactcacgaccggtgctcgatttagcacacgataggttgggtttgggggaggaactgctcagttaggacccagacggaaccagtggaacgccccagctcagtcttctcttcctcctgccttactcgtcggcctccagataccgaggcggtagagtattcggttgttacgaccacgtacgttcctaccgaacgtccccttaacccgttggtttccgttttacgggtacccggtaccgggggaaaagtaaaaccggtaccgccccctaaccccgttcgtaccggtacggacgggtaccgggaccctaggtactaaacggtacgtttaaccgttaaaccgtaaaccggtttcggtttacgggacccgtttacgggttaaccccaaaaagtaaacccggtaacccgttccgggaacccggtaacggtacccccggtaccccgtaaccgggttcccttacccgttacgtacctttaccgtaagttaccgggtactaccgtaaccgtaaccctaaacccggaaccggggtaccggaccccgtttaacgggtaaccgtaccctaaccccgggtaacccgttaccggaaccgggtttaacggtcgtaaccgggggttacgggtacgggtttacgggttaccgggggggtaccgttaaacgggggtaaacccttacgggtaaccctttttaccggaacccggtttaccaaaccctaaacccgtcgtaacccggtacggacccgtaaccggtacggtaccgtaccgtaacggttacgtttacgtttcccgttacgggttttacgtttacgtttcggtttacgggttaccgggttcggtaaccggttccggtaacgttacccgggttcgtacccggtttacggttaccggtttccggttacggaaccgggtaacggaacgtcgtacggtacgtcgtacgacgtaacggtacttaccgggtaggtcggtaacnccgggtaccctagttaccttgttaccctcgttccctacccg

SEQ ID NO: 277532 - DNA, 824 bp, Homo sapiens
  misc_feature: GYAE6OF01EMO53.29.35.D02.1.454.CMB.1.raw
tcagatagagtactcacgaccggtgctcgatttagcacacgataggttgggtttgggggaggaacgtgctcagttaggacccagacggaaccatggaagccccagctcagcttctcttcctcctgctactctggctcccagagtaccaggcggagagtctttgtgtcggacacagttcctaccgagtccctaccttgtactttggtccgtaccgggaagaaacgccgcctacccgtacgtaccgtggaccgtaacgggcccagtacaggttacgttacgttaaacctacgttacgtcgggtacctttacggtaacccaaacgaacggtaaccgtcgggtaccgaacgtcccgacccggtacggtaccttaccctacgtaacgtacggttagtacggtactacggaaccttacgtaaccccgaaacgggtccgggaaccctaccggtacggtacccgttaaccgtccgaaccggttaccgtaacggttaccgaaggttccggtaaggtggttacgggtacggtacgggaacttacggttaccttactacccgtacgttacccgaactccgtaaccggaccgttcccggaactaccgggtaacgtaccggtaggtaaccggtacgtttaccgttacggtttaaccgttttacgttacggtttacgtcgggttacggtaccgtacgtacgtaaccgggtccgtacccttaccggttaccggttaccgttcggtaccggtaccggtaacgacgtgtacggacgtacgtacgaccgtaacggtgagggccgaacggtcaaccctagttcgtactcgttcgtgtaccccg

SEQ ID NO: 277533 - DNA, 849 bp, Homo sapiens
  misc_feature: GYAE6OF01C407G.29.35.D02.1.454.CMB.1.raw
  modified_base (404)..(404): a, c, t, g, unknown or other
  misc_feature (404)..(404): n is a, c, g, or t
  modified_base (428)..(428): a, c, t, g, unknown or other
  misc_feature (428)..(428): n is a, c, g, or t
  modified_base (822)..(822): a, c, t, g, unknown or other
  misc_feature (822)..(822): n is a, c, g, or t
tcagatagagtactcacgaccggtgctcgatttagcacacgataggttgggttggggagaactgctcagttagacccagacggaaccatcggaagccccagtctcagtcttctcttcctcctgctactctcggcctccagtactaccgagacggagtagatttggtcgtacgaacacgtagtcctaccgacgcccacccgttgttcctttcgtaccgtccgggaagaaaactcgccctaccctcgtccgtggacgacggggccagtacgagtaacggttacgttaaaccaacgttacgttcgggccctttagggttaaccaaaacgaaggtaaaaccctcgggacctacgggacctacccgtaaggcctttcccgactacgtaccgtaaacgtgtaaacggttntaccgaaccgttaccaaaacccgnggggaccctaacgttgggaacccaccgttacccagggaaccaacggtttcgaaacggcggtacgtaacgggtcgggttcgttacggggaccaaaggtaacccgttccaacgtccttacaacgtaaacgttcgaaccgacccgtaaccgtacgtaacgtccgtagggtaaacgtccgttacgttacggttacccgtttaagtttactttcgggttaacggttcggtaacgttacggtactaaaccggttcggtcccgtttacccggtaccgttaaccgggtttttcgaacccgggtaacggggttacccgaaggtacccggttaagggtaactaccggtaacgttaacgggaaccgtaacggttagtaccggtcgtaaccggttcaacgttaccncgtttaacgttccgtacgttaacccgg

SEQ ID NO: 277534 - DNA, 701 bp, Homo sapiens
  misc_feature: GYAE6OF01A2HH2.29.35.D02.1.454.CMB.1.raw
tcagatagagtactcacgaccggtgctcgatttagcacacgatagtttgggtttgggggaggaactgctcagttaggacccagacggaaccatggaagccccagctcagcttctcttcctcctgctactctggcctcccagataccaggcggagagattgtgtttgacacagtctccagccacccttgtctttgtccgtcgggagaaaagcgccaccctctccgtgctacgggccagtcacgtagtagtttaaaccaacttacgttcgggcccttcggttaccaaacgaacgtaaaccgtcggacctacggccctacccgaggtcctacccttcgacttctaagtcgaacttggacctactacccaaacggacggtacccaccgttggaccctacttaccccgacggtaccttaggttaccgaagtcggacgtacggtggggttacgacggggtacctagttaccgtactaccgttcaccgtaccacgttaaccgccgcccgtacgtacgacgtcgtggtacgtacgttcgttacttacgtttattactttggtacgttcggtcgttagacgttaacgtcgtaccgtcccgttactcgtttcggacgtacgggacgtacgtcgtaggtacgtcgtacgaaggtaaccgtaagtcggttacgcgtataccgaccttattccgtacgttccgttacgtacccg

SEQ ID NO: 277535 - DNA, 818 bp, Homo sapiens
  misc_feature: GYAE6OF01C0VWC.29.35.D02.1.454.CMB.1.raw
  modified_base (152)..(152): a, c, t, g, unknown or other
  misc_feature (152)..(152): n is a, c, g, or t
  modified_base (204)..(204): a, c, t, g, unknown or other
  misc_feature (204)..(204): n is a, c, g, or t
  modified_base (222)..(222): a, c, t, g, unknown or other
  misc_feature (222)..(222): n is a, c, g, or t
tcagatagagtactcacgaccggtgctcgatttagcacacgatagttgggtttgggggaggaactgctcagttaggacccagacggaaccatggaagccccagctcagcttctcttcctctgctactctggcctcccagactaccagcgganagattggtgttgacacagtctccagccctacctgtctttgcgtaccgggaanaaacgtcgccctaccctntaccgtgccgaggggccagtacgaaggtagttagttaacaacttcgttggccctttaggttacccaaaacgtaacgaaacccgttggaccgaggaccttacccgaacggtcctacccgtacaacttcctaagtcgaactcgtaccactacccgaacgaccgggtacctaccggacggacctaaccgtccccgaaggacccgtagggtttacaacggggttcggaacggtacggggttcgggtaccggtacggggaactaacgggtactttaccgaactttaccccggtaacaacccgtaactccggtacccggacccgtacgttacggaccgtaccgttaggaacgttacgttacgttaccggttacgttttacgtttagttcggttacgttcgggtaaccgttaacgaccggtaccgttaccgggtaccccgttacccggttacccgtttaccgggtttacccgggaacccgggtaacgggggtaaacccctacggggtcggttacggggtaaacctacggtaccggtaaacggacccgttaaggtacggtcggtactacggacctacgtagttcccgtcttaccgttctacccg

SEQ ID NO: 277536 - DNA, 738 bp, Homo sapiens
  misc_feature: GYAE6OF01DOMYQ.29.35.D02.1.454.CMB.1.raw
  modified_base (732)..(732): a, c, t, g, unknown or other
  misc_feature (732)..(732): n is a, c, g, or t
tcagatagagtactcacgaccggtgctcgatttagcacacgatagttgggttgggggaggaactgctcagttaggacccagacggaaccatggaagccccagctcagcttctcttcctcctgctactctggctcccagataccagcggagagattgtagttgacacagtctccagccctaccctgtcttgtcgtaccgggagaaagacgcccaacccgtctcctgacgacgggcccaggtcaaggtagttagttaaaccaactacgtttggcccttaggttacccaaacgtaaggtaaaacccgtggggcccaagggcccttaccccgaggccttacctccaattacctaagtgaacttggacactacccaaacgacgggacccaacgtcggaccacgtacccacgcccaaggttccagtggctagggtgggtacgtgggaactaggaccttcgacgttccctaccaaccgacttaccgacgtacccgtaccgtaacggacgtccccgtagggtaaccggtagttaccggtcggttacccgtttttagtttaagtttcccgtttgggttacgggtacgttacgacccgtacgtaccggggtcccttaccccggttacgtttaccgttttacggacccggtacggggtaaccgaaggtccgtaggtacgacgtacgtaacgacggtaaagtggtacgggtactgacccgtaacacgttaccttagtcccgttntacccg

SEQ ID NO: 277537 - DNA, 702 bp, Homo sapiens
  misc_feature: GYAE6OF01CMWP1.29.35.D02.1.454.CMB.1.raw
  modified_base (199)..(199): a, c, t, g, unknown or other
  misc_feature (199)..(199): n is a, c, g, or t
  modified_base (203)..(203): a, c, t, g, unknown or other
  misc_feature (203)..(203): n is a, c, g, or t
  modified_base (417)..(417): a, c, t, g, unknown or other
  misc_feature (417)..(417): n is a, c, g, or t
  modified_base (443)..(443): a, c, t, g, unknown or other
  misc_feature (443)..(443): n is a, c, g, or t
tcagatagagtactcacgaccggtgctcgatttagcacacgatagttgggtttgggggaggaactgctcagttaggacccagacggaaccatggaagccccagctcagcttctcttcctcctgctactctggctcccagataccagcggagagattgtgttgacacagtctccagccacctgttctttgtctccggganaagngccacctctcctgcgagggccagtcagtagtacgttaacacgttacgtcggccttggttacccaagaacgtaaacccgtcggaccgacggtcctcccgaggtccctcctacctatctagtgactcgacactaccgaacggccgggcctacgtcggaccactccccgaagtccgtacggttcaggtcgacgtacgggttgggtcggtacgggaanacggtacttaccgaccttcctaaccncctacgtaccgaccgtaccgtaccgtacggtaccggacgtacgggtaagttccgtttacgttacggttttaccgtttagtttaggtttcggtacggtttcgggtacggttacgacgttaaccggttccggttcccgttaccggttcgttaccgtttcggaccgggtaacggaccgtagtcgtagggacgtagtacggacggtaacgtagtacggtcgtacgtcgtaccgtaccgtcttaccgttcttccgtcttacccg

SEQ ID NO: 277538 - DNA, 764 bp, Homo sapiens
  misc_feature: GYAE6OF01ER00B.29.35.D02.1.454.CMB.1.raw
  modified_base (231)..(231): a, c, t, g, unknown or other
  misc_feature (231)..(231): n is a, c, g, or t
  modified_base (310)..(310): a, c, t, g, unknown or other
  misc_feature (310)..(310): n is a, c, g, or t
  modified_base (676)..(676): a, c, t, g, unknown or other
  misc_feature (676)..(676): n is a, c, g, or t
  modified_base (741)..(741): a, c, t, g, unknown or other
  misc_feature (741)..(741): n is a, c, g, or t
tcagatagagtactcacgaccggtgctcgatttagcacacgatagttgggttggggaggaactgctcagttaggacccagacggaaccatggaacgccccagctcagcttctcttcctcctgctactctggcctcccaagactaccgaggacggagagtattggtagttacgacactacgtcctaccaacgccctacccgttggttacgtttcggtaccgtaccggggaanaaacggccaccctacccgttctacctgacgacggcacgtcaggtacttacgtaacacgttgtcgcgttacggtaccaanacgtaacctggaccgacgtccaccgtacgcctacctacgtactactagtagtacggtacacctaacgtaccgaaaccggacggtaccctaaggtacggacctaaccgtacccgaaggttcccgtaacggttacgtagggtacggtgtaacgggggttccgtacggtacggaaccgtacgtaccttacgtacccgtacgtaccaacgttacgaccaccggttaccaccggttagaccggtactacggggtatccgtttacggtactttaaccgtttatttacgttcggttacggtttaggactaacggtacctaacgggtccttccccgtaacgttcgttaccggttaccgggaccggtaacggtanaccggtcggtaagtaccgacgtaccgaaggtcctaagggcggttcgacgttaccactaccggttntaccgttcttactaacggttccc

SEQ ID NO: 277539 - DNA, 713 bp, Homo sapiens
  misc_feature: GYAE6OF01BZMPC.29.35.D02.1.454.CMB.1.raw
  modified_base (241)..(241): a, c, t, g, unknown or other
  misc_feature (241)..(241): n is a, c, g, or t
  modified_base (660)..(660): a, c, t, g, unknown or other
  misc_feature (660)..(660): n is a, c, g, or t
tcagatagagtactcacgaccggtgctcgatttagcacacgatagttgggtttggggaggaactgctcagttaggacccagacggaaccatggaagccccagctcagcttctcttcctcctgctactctggccttcccagactaccaggcggagagtatttggtgtttgaacacagtcctaccagccctacccttgttctttgtcctaccgggaagaaacgcgtcccaccctctcctgcgngggcctagtcagagttacgttaaacacttacgttggtccttggttacccaagaacgtaaaccgtcggaccgacggtcctacccgaggtaccttcctactaattcctaagtgtacgtcgtacctaccgtaccgaacgggtaccgggtccctaacgtcggaccttacccgtccccgaacgtcccgttaacggttccgaggggtcgcgtacgggtcgggtaccgtggacgaacgttctaaccgaccttcaccaacgtacgtcgacccggcccgtacgtagggtaccctacgtacgggttaaccgtcgttttccgtaacggttttcgttttaacttacggtttcggttacgggtcggtacgttacgtacgtcggttcccgccttaccgtcgttacgttcggacggtacgacgagcgtagacgntacggacgtacgtacgtggcgctacgctaacgtcttcttcgttcctgtccccg

SEQ ID NO: 277540 - DNA, 797 bp, Homo sapiens
  misc_feature: GYAE6OF01ALOQL.29.35.D02.1.454.CMB.1.raw
  modified_base (207)..(207): a, c, t, g, unknown or other
  misc_feature (207)..(207): n is a, c, g, or t
  modified_base (245)..(245): a, c, t, g, unknown or other
  misc_feature (245)..(245): n is a, c, g, or t
tcagatagagtactcacgaccggtgctcgatttagcacacgatagttgggtttgggggaggaactgctcagttaggacccagacggaaccatggaagccccagctcagcttctcttcctcctgctactctggctcccagataccaggcggagagtatttggtgttgaactacgagtcctccagcccaccttgttctttgctcggganaaagcgcccacctctctgcgacgggccagtcagtagtntaacacttcgtggcctgtaccaagacgaaccgtcggtccacggtcctcccgacggtcctcctacgtactccttaagtcgaacttcggacctaccgtacccgaaaacgggccgggtaccctacggttccgggacctacccgttaccccgaacggtaccgttacgggttaccgagggttaccgtcggacgggttcggggtcgttacgggaacttaccggtacttcgtaccttcctacgtaaccctacggtacccacggtacccgtacctacggaccgtccgtaggtaccggttctttaaccgttccggttttaaccgttttagtttaacggtttcggttaccgggtttacgggtaccgttaacgtacgttaccggttcccggtcccgttcccggtttacgttaccgggttttaccgggacccggtaacggggttaacccgacggttacgggtacgtaacgtaccgtaacggtaacggtaccggtaggttccgggtcgggttacctaccggtaccctacgttacggtcctttcggttcccgttcccgttaccccg

SEQ ID NO: 277541 - DNA, 757 bp, Homo sapiens
  misc_feature: GYAE6OF01C1PJ1.29.35.D02.1.454.CMB.1.raw
  modified_base (203)..(203): a, c, t, g, unknown or other
  misc_feature (203)..(203): n is a, c, g, or t
tcagatagagtactcacgaccggtgctcgatttagcacacgatagttgggtttggggggaactgctcagttaggacccagacggaaccatggaagccccagctcagcttctcttcctcctgctactctggctcccagataccagcggagagattgtgttgacacagtctccagcccaccctgtctttgctccgggagaaagcncccaccctctcctgcagggccagtcagtagtgtaaacactacttggcctaggtccaacagaacctggaccaggcctcccgaggcctccctacactactatgtatcgaccaactaccaacggacggacctacgtggcacctaccccagccgtacggttcgagtacggcggtagggtcgggttacggacgggtacacggttaccttaccaccttcgtaccaaccgtactaccgaccggtcccgtacctaacggaccgtaccgttacgggtaacggttacgtttccgttacggtttaaccgtttttagtttacgttttacggttccggtttacggggtaccgttaacggtaaccgttaaccggtccggtacccccgtttacccgtttacccggtttaccggtttttaccggggacccgggtaaccggggtaacccgtacggtaccggtagggtaacgtacgtaccggtaacgtaaccggtacggttcgggtcggtccgtaacggaccccttaaccgtcttacccgtttagtttacccttcgtacccgtttacccccg

SEQ ID NO: 277542 - DNA, 733 bp, Homo sapiens
  misc_feature: GYAE6OF01CS7FZ.29.35.D02.1.454.CMB.1.raw
  modified_base (491)..(491): a, c, t, g, unknown or other
  misc_feature (491)..(491): n is a, c, g, or t
tcagatagagtactcacgaccggtgctcgatttagcacacgatagttgggtttgggggaggaactgctcagttaggacccagacggaaccatggaagccccagctcagcttctcttcctcctgctactctggcctccagactaccgaggcggagagtattgtgttgacactagtctccacgccctacctgttcgtttgtaccgtaccgggaagaaacgcgccctaccctctccgtgacgacgggcctagtcgaggtacgttagttaaacctaacgttcgttcggccttacggttaccaaaagtaacgtaaaccgtcggaaccgacggtccctacccgacggtcctcctactacgttctagtgacgtcgacaacgtaccgaacggacggccacgtcggaccaccgtccgacgccgttagtcgacggttcggacgtacgggttcgggtacgacgggaactacgtactttccgaactttccgaaccaccgtacnccgtacgcccgtaccgtagaccgtcgtacggtacgtctttcgtacgtttacgttttattagttcggttacggttcggtacgtacgtactaaccggttcggtcccgttaccgttccgtttacgggttcgggaaccggttacgggaactacgggtacgtacgggtaacacggttacgaacgtacgttacggtggtacggtcgtaccgtaccgtcttacgttacgtttccgttcctcgttacccg

SEQ ID NO: 277543 - DNA, 666 bp, Homo sapiens
  misc_feature: GYAE6OF01BY7RN.29.35.D02.1.454.CMB.1.raw
  modified_base (192)..(192): a, c, t, g, unknown or other
  misc_feature (192)..(192): n is a, c, g, or t
  modified_base (209)..(209): a, c, t, g, unknown or other
  misc_feature (209)..(209): n is a, c, g, or t
  modified_base (259)..(259): a, c, t, g, unknown or other
  misc_feature (259)..(259): n is a, c, g, or t
  modified_base (266)..(266): a, c, t, g, unknown or other
  misc_feature (266)..(266): n is a, c, g, or t
tcagatagagtactcacgaccggtgctcgatttagcacacgatagttgggtttggggaggaactgctcagttaggacccagacggaaccatggaagcccagctcagcttctcttcctcctgctactctggctccagataccagcggagagattgtgtgacacagtctcagccacctgttcttgtctcggganaaagcgccacctctccngcgacgggccagtcagtagtcgtaaacactacgttggcctggttaccaanagaaccngccgagccgtccacggctcctcatctaagtgactgtacactaccaacgacggggtaccaacgtcggaccatccccgaagtaccccgaggttccgaaggttcggaccgtaagggttcggggtaccgtggggaaccacggtaacctttccgactacctaccgaaccatccgaacgcccgacgtagacgcgtgaaggtattcgttcgttacgttttagtttacttaggttcgttacgggtccggtaacgtacaaccggtcgtaccccgtcccgttaccgttaccggttttcgggaaccggtacgggggaacctaacgggtcggttagacgtacgtacggaaacgtacggtaacgtcggtcggtcgtacgtaccacctacgttacgtcgttccttacgtacccg

SEQ ID NO: 277544 - DNA, 793 bp, Homo sapiens
  misc_feature: GYAE6OF01BDAH4.29.35.D02.1.454.CMB.1.raw
  modified_base (771)..(771): a, c, t, g, unknown or other
  misc_feature (771)..(771): n is a, c, g, or t
tcagatagagtactcacgaccggtgctcgatttagcacacgatagttggggtttggggggaactgctcagttaggacccagacggaaccatggaacgccccagctcagtcttctcttcctcctgcttactctggcctcccagactaccagcggagagtattgtgttagacacagtcctccacgcctaccctgttctttgtccgtaccgggaagaaagacgccctacccttcgtccgtcgaccggacgggacctaggtaccgaaggtacgtttaacgttaaaacctaaccgtttacggttacgggtacccgtttacggttaaaccccaaaacgtaaccggtaaaaccgttccgggaacccgtaacgggtccctacccgtaacggtcccttacctactaacttacttagtaggacttccgacctaaccgtaccgaaacggtaccggtaccgtacggtacggacctaccgaccccgacggtaccgtacggttgaacggtgcggtagggttaccgggtagtacggaactcggttactaccgtacttacccgactaaccgtcgtaccaccggtaccgtaccgacgtacgtacgtaggtacgtacgtttcgttacgttacgtttacgtttagttcggttcgtcgggtacgtagtaccgtacgttccggtccttaccgtacgttaccgttacggacgtaacgggtactacggacgttaggactacgtacgaaaggtacgtagttacggtacgtcgtacgaccctaacgttcttacgtnttacctacgttccgttaccccg

SEQ ID NO: 277545 - DNA, 883 bp, Homo sapiens
  misc_feature: GYAE6OF01DPE3O.29.35.D02.1.454.CMB.1.raw
tcagatagagtactcacgaccggtgctcgatttagcacacgatagttgggtttgggggaggaactgctcagttaggacccagacggaaccatggaagccccagctcagcttctcttcctcctgctactctggctcccagataccagcggagagattgtgttgacacagtctccagcccacccttgtctttgccgtccggggaagaaacgcgcccaccctctcctcggcgaggggccctagtaccaggtagtacgttaaaccaaccttacgttcggcccttacgggttacccaaacgaacgtaaacccgtcgggacccgacgggtacccttccccgaacgggtcccttacccttacctacttccttaagtagtacgttcggactaacctacccggaaacggacgggacccgacgtcggaccaccgtaccccgacggtaccgtacggtttcgaaggtcggacgtacggggtcggggttaccgtacggggtaacctaacggttaccttacctacccttaccctacccgttaccacgtcccgaaccgtaccccgtacccgttacggacccgtcggttaacggtacggttacttttccgggttaccgttttacccggtttttaattttacggttttccgggtttcggtttacggggtaccgtttacgggaacctttaacccgggttcccgggttaacccccgttccccggtttaccggttttacccggttttccgggaacccggtaacgggggtaaccctacgggtacggttacgggaacgtacgttaacgggaaccgtaaaccgggtttaacggttgggttccgggaccgttccggaacccttacggacctttacgttcccgttttccggttcctttaaccccccgg

SEQ ID NO: 277546 - DNA, 910 bp, Homo sapiens
  misc_feature: GYAE6OF01DECL0.29.35.D02.1.454.CMB.1.raw
  modified_base (150)..(150): a, c, t, g, unknown or other
  misc_feature (150)..(150): n is a, c, g, or t
  modified_base (235)..(235): a, c, t, g, unknown or other
  misc_feature (235)..(235): n is a, c, g, or t
tcagatagagtactcacgaccggtgctcgatttagcacacgatagttggggttgggggaggaactgctcagttacggacccaggacggaaccatggaacgccccagctcagcttctcttcctcctgctactcgtgcctccagactaccgnggcggtagacgtagttgtgttagaccacgacgtcctccacgtcccgtacccttggttcgtttacggtccggtacccgggggaaanaaaacggaccgcccctaccccgttaccgtcccgtacggacggaccggggtaccctaggtaccggaagtttacggttaaccgttaaacctaacggttaccggttcggaccggttacgttacccaaacggtaacgaaccgtcggaccggacgtcccctaccgtacggtccttcctacaactttcgacgtacggtactaccgactaaccgtaccgaaacggggtccggaccccttaaggcccgtaacctaacccgtcccgggtaacgtaccgggtttaggaccggtaggggttccggaagggtttaccgggggttcggttaccgaacggggtaaacccttaccgggttacccttttaccgaaaccccgtttctaaaaccccccggtcgttaaaccgggacccccgttacgggtaacccgggtaacccggtacggtaaccccggggtttaccgtaacggttaacccgggtttctttaccggtttacggttttaacgttttaccgttaggttttacgtacgggttaccggtaccggtacgtaccgtaccgtcggtcccttaccgtcgttccgggttacgccggtaacggtaccgtagtaccgtaacgagtaccggtcaacggtaccggtagtacgcggtacctaggtcccttagtaccttccgacgtcttaccggtaccc

SEQ ID NO: 277547 - DNA, 787 bp, Homo sapiens
  misc_feature: GYAE6OF01ERRBT.29.35.D02.1.454.CMB.1.raw
  modified_base (326)..(326): a, c, t, g, unknown or other
  misc_feature (326)..(326): n is a, c, g, or t
  modified_base (501)..(501): a, c, t, g, unknown or other
  misc_feature (501)..(501): n is a, c, g, or t
tcagatagagtactcacgaccggtgctcgatttagcacacgataggttgggtttggggaggaactgctcagttaggacccagacggaaccatggaacgccccagctcagtccttctcttcctcctgctactctggcctcccagactaccgaggcggagagtagtttggttgttagaacacgtacgtcctccacgcccctacccgttgttccgtttcgccggtaccgggaaagaaaacggccgtcccctacccgtctaccgtagacggacgggcctagacgtagtacgttacgtaaactacgttcgtcgtaccttacggtaaccaanaaccggtaaccgtcggaccgtaccgtcctccgacgtcctcctacgtatctagtgactcgacctacgtaccgaacggccgtaccacggtcaccgactccccggtacgtaccggttggaccgtaggtcggagggttcgggtaggtccggttaaggacgtaaccgttcctaacccgtntaccctaccgacgtacttacccgcgtacccgtacgtacgccggtacgtacgtaacggttacttcggttaccgtttacgttttacgttacgtttcgggtcgttacggtaccgttaccggtaccgttaccgtcccggttcccctttaccgggttaccttaccgggtttcccgggaacgggttaccggtaaccgtcgggtaggtacgtaccgtactaccgggaccggtacgtaggtaccggtccggactcgtaaccgaccttcgtaggtttcccttcgtcccgttaccc

SEQ ID NO: 277548 - DNA, 780 bp, Homo sapiens
  misc_feature: GYAE6OF01A0UZU.29.35.D02.1.454.CMB.1.raw
  modified_base (339)..(339): a, c, t, g, unknown or other
  misc_feature (339)..(339): n is a, c, g, or t
tcagatagagtactcacgaccggtgctcgatttagcacacgataggttgggtttgggggaggaactgctcagttaggacccagacggaaccatggaagccccagctcagcttctcttcctcctgctctctggctcccagataccagcggagagtattgtgttgacacagtctccagcctaccttgttctttgtcgtacgggagaaacgacgccctaccctctcctcgcgtacgggccagtcagtagtacgttaaaccacttacgtcggtcctacggttaccaagaacgaaaccgttcggaccaggtccctccgaacggtcctcctactactacttacgngtaacgtcgcctaacgttacccgaaacggtaccggtacccaaggttccgacccgtaacccgtacccgacggtacccggaacggttttacacggggttacggaccgggtaagggttccggggtacgggttacggggaaactaaccggttaaccttccgaacccttcctaaccggtaacccagttcccggaacccgcccggtaccgtaacgtaccgttaccggttagtacggttacctttacgtttacggttacgttttacttacggtttcggttcggtttacgggtacgtacgtactaaccggttccggtaccgtttccggttcgttacggtttccgggaccggtagggtaaccaggtcgtacgaagtctaccggaaggttacggtaagtcgggtacgtccgtacggaccgtacgttacgtcgttcgttccgtatttcccgg

SEQ ID NO: 277549 - DNA, 781 bp, Homo sapiens
  misc_feature: GYAE6OF01DGTKM.29.35.D02.1.454.CMB.1.raw
  modified_base (156)..(156): a, c, t, g, unknown or other
  misc_feature (156)..(156): n is a, c, g, or t
  modified_base (176)..(176): a, c, t, g, unknown or other
  misc_feature (176)..(176): n is a, c, g, or t
  modified_base (222)..(222): a, c, t, g, unknown or other
  misc_feature (222)..(222): n is a, c, g, or t
tcagatagagtactcacgaccggtgctcgatttagcacacgataggttgggttggggagaactgctcagttaggacccagacggaaccatggaagccccagctcagcttctcttcctcctgcctactctggcctacccagactaaccgaggcgganagtattcgtagttcgactanacgttctccacgcccacccttgttctttacggtccgtaccgggaanaaacgcgaccctacctctacctggaccgacgggaccaggttaccaagtagtaacttaaacaacttcgttggaccctaggttaacccaaatacggtaaccgtcggaccagggccctacccgaggtcctcctactacgtactacgtggacctacgacctaacctacccgaaaacggtaccgggacctaacggtccggaaaccttaccgacccccgtaggtaccccgttaaacgggttcgacggttcggtaccggttagggttccgggttaacggtacgggtctaaacgggtccttccgtactaccgtaccgtaaacgtctacccgacgtaccggacccgtaaggaaccgtacgtacggacgttacgttaccgtttagtacccgttttagttaccgtttacggtacggttaggtaccgttaacgacgtacgttccgaccccggttcgtaaccgttcggttcggaccgtacgggaacgtacgcgggtaagtacgtacgaagacgtaacggattcggacgtcgtcaacccgtacgtacttccggttacttcgtaccgttacccg

SEQ ID NO: 277550 - DNA, 783 bp, Homo sapiens
  misc_feature: GYAE6OF01AMQFF.29.35.D02.1.454.CMB.1.raw
  modified_base (208)..(208): a, c, t, g, unknown or other
  misc_feature (208)..(208): n is a, c, g, or t
  modified_base (214)..(214): a, c, t, g, unknown or other
  misc_feature (214)..(214): n is a, c, g, or t
  modified_base (229)..(229): a, c, t, g, unknown or other
  misc_feature (229)..(229): n is a, c, g, or t
tcagatagagtactcacgaccggtgctcgatttagcacacgatagttgggtttgggggaggaactgctcagttaggacccagacggaaccatggaagccccagctcagcttctcttcctcctgctactctggcctcccagactaccaggcggagagattgtgttgacacagtcctccacgcccacccttgtctttgccgtccgggaanaaagcncccgaccctctccgnggcgacgggtccaggtcagagtacgttaaacaacttcgtggccttaggtaccaagacgaaaccgtcggaccgacggcctacccgaggtcctccgtcactctatcggaatcgactactaccgaacgaccgggccacgtggaccaccgtaccgacggtccgtaggttacccgaggtccgggtacgtacgggtacggggtccgtagggaacctacggtaccttcctaccgtcctaccaaaccgtcgtaccgaccggaccccgtacgttaacgccgggtacccttaaggggacgtaaccgtttccggttaacggttttaccccgttttaagtttccggttttacgggttccggtttacgggggtaacgttaaccgggtacctaacccggttccgggttccccttacccggttaccgtttacgggtttaccggggccccggtaacgggggaaccctaaggtcggttaacggacgtaccgtaccggtaacggtaaccggtaagttcgggtacgtaccttcggacccttaacgtcttaccgttcgttccttccgttacccg

SEQ ID NO: 277551 - DNA, 730 bp, Homo sapiens
  misc_feature: GYAE6OF01DWGMN.29.35.D02.1.454.CMB.1.raw
  modified_base (173)..(173): a, c, t, g, unknown or other
  misc_feature (173)..(173): n is a, c, g, or t
  modified_base (199)..(199): a, c, t, g, unknown or other
  misc_feature (199)..(199): n is a, c, g, or t
  modified_base (462)..(462): a, c, t, g, unknown or other
  misc_feature (462)..(462): n is a, c, g, or t
tcagatagagtactcacgaccggtgctcgatttagcacacgatagttgggtttgggggaggaactgctcagttaggacccagacggaaccatggaagccccagctcagcttctcttcctcctgctactctggctcccagactaccagcggagagtattgtgttgacacagtcnccagccacctgtctttgctacggganaaacgcgcccacctctccgtgacgacgggccagtcagtagttactaaacacttacgtggccttggtacccaaagaacgaacctggaccaggcctcccgaaggcctcctactatacgtatgagtcactactaccgaacgacgggtacccacggtggtaccaccgtaccccgagaccgtcggttacgacggttcggccgtaggggttcgggttaccggaggggtacctaaacggtcctttaccgaccgttactaccaaacccgtntaccgggaccgtaccgtaccgtacggaccgtcgtacggtacggttacttcgttacggttacgttttagtttacgtttcggtttacggttacgggtacgttacgtaccgttaaccgtcggtacccgttaccggttaccgttacggtttaccgggtaccggtaacgggtaaccgtacgtacgtacggtacgtaccgtacgaaccggaacgtaacgtcgggtcgtaccgttcgaccgttactacgttccgttacgttcgttacgttacccg

SEQ ID NO: 277552 - DNA, 951 bp, Homo sapiens
  misc_feature: GYAE6OF01DV0H0.29.35.D02.1.454.CMB.1.raw
  modified_base (460)..(460): a, c, t, g, unknown or other
  misc_feature (460)..(460): n is a, c, g, or t
  modified_base (879)..(879): a, c, t, g, unknown or other
  misc_feature (879)..(879): n is a, c, g, or t
tcagatagagtactcacgaccggtgctcgatttagcacacgatagttgggtttggggaggaactgctcagttaggacccagacggaaccatggaagccccagctcagcttctcttcctcctgctactctggctccagataccagcggagagtatttgtgttgacacgagtcctccagcccacccgttgttcctttgtcgtccgggaagaaacgcgcccctaccctctccgtgccgacgggtaccagtccgaaggtacgttagttaaaccaacgttacgttcggccttacggtacccaaaacgaacgaaaacccgtggaccctagggcccttacccgaacggtccttacctcgtaacttccgttaagttcgaacttcggactaaacctaccggaaaccggaccggggtccctaacggtcggaccctaacccgtaccccgaacggtcccgttaacgggttanacggggttcggacggttaggggtcggttacggagggaccgtaaacggtttacccttacccgaccttccgtacccaaacgttcggtacccgaccggtaccccggtaaccgtaccgggtaaccggtccggttaagggtacggttaccgttttaaccgggttcgttttaccggttttttaatttacggttttaccgggtttccgggtttaacggggtaccgttaacggtaccggttacccgggttcccgggttaccccctttaccccgggttaacgttttaacccggggtttttacccggggaccgggtaaacccggggggtaaacccttacggggtaccggggtaaagggtaaccggttaaacccgtacggggtaaaccggttaacccgggttaaacgggtttcgggtaccggggttaccncccgggtttaaaccctaccggtttaaacgttccccggtttttacgttaccccgttttcccgttaaaccccgg

SEQ ID NO: 277553 - DNA, 897 bp, Homo sapiens
  misc_feature: GYAE6OF01A85ED.29.35.D02.1.454.CMB.1.raw
  modified_base (135)..(135): a, c, t, g, unknown or other
  misc_feature (135)..(135): n is a, c, g, or t
  modified_base (163)..(163): a, c, t, g, unknown or other
  misc_feature (163)..(163): n is a, c, g, or t
tcagatagagtactcacgaccggtgctcgatttagcacacgataggttggggtttggggggaggaactgctcagttaggacccagacggaaccatggaacgccccagctcagcttctcttcctcctgctactcgnggcctccagactaccgaggcggagagtnttggtgttagacacgtgtcctccacgccctacccgttgttccgtttcggtaccggtaccggggaaaagaaacggtccgccccaccccttcgtccgtcggacgtacgggccgtaaggtcaaggtaggttacttaaactaacgttacgttcgggaccttcggttaaccaaacgtaacgtaaaccgtcggaccgacggtaccgtacccgaacggtccttccgtactacttaccgtattcgacgtcacctacaccgaacggcggaacctcggtacgcctacgacccgacgtaccggtacggtcgacggtcggtaacgtagggtcggggtaccgtagggtaccgtagtcccgttacgtccttaccgacccgtaacgtccgtaccgtaccgtaccccggtacgtaaccggtaccggtacccggttaagggtaggtttacccttacgggtttccgtttaaccgtttttacggtttacggttcggtttaccgggtttcgggtaaccgttacgggtaacccgtaccgggtttcccggtttaccccggttaaccccggtttccggtttaccggggttaccggggtaaccccgggtaacgggttaaccgttaacggggtccggtttaaacggaacggtttaaaccggtacgtaaaccgggtaacgggttcggtaccgggtacgtaccggtaccttacccggtacgtttcgaacgtttttccggtaaccctttcccggttaacccg

SEQ ID NO: 277554 - DNA, 850 bp, Homo sapiens
  misc_feature: GYAE6OF01DXQ4Q.29.35.D02.1.454.CMB.1.raw
  modified_base (168)..(168): a, c, t, g, unknown or other
  misc_feature (168)..(168): n is a, c, g, or t
  modified_base (200)..(200): a, c, t, g, unknown or other
  misc_feature (200)..(200): n is a, c, g, or t
  modified_base (207)..(207): a, c, t, g, unknown or other
  misc_feature (207)..(207): n is a, c, g, or t
tcagatagagtactcacgaccggtgctcgatttagcacacgataggttgggtttggggaggaactgctcagttaggacccagacggaaccatggaacgccccagctcagccttctcttcctcctgctactctgctccagactaccagcggagagattgtgttgacacngtctccagccacctgtctttgcgtccgggaanaacgacnccctacctcgtcctgccgagggccagtcagtagttacgtaacacgttcgttggcccttaggttaacccaaacgtaacggtaaacccgtcggaccgtaacggtccctaaccccgtaggtcccttacccgtacctaactttaccgtaagtacggtacctaccggtacctaacctaaacccggaaccggtaccgggaccctaacggttccggaccctaacctccccggtacggtaccgtacgggttacgaccgggtggtacggttacggggtcgggttacggacgggtaaacttacggtacccttacgtacccttaccgtacccgtaaactaccggttacccgacgtaccccgttacgtaacggaccggtaccgttacgggtacgtttacgttacggttaccgtttaacgtttttaacgttcgtttaccgggttaccgtttacggggactttacgtaccggttaccggtccggttacccccgtttaccggttccgtttaccggggtttaccgggacccgggtaaacgggtaccgtacgggtaccgtaagggactttaaccggacgggtaaacgtacccggttaagggttcgacccgggtactacccggacgttaccgtctttaccggttaccttctaccggttccc

SEQ ID NO: 277555 - DNA, 909 bp, Homo sapiens
  misc_feature: GYAE6OF01BS6WP.29.35.D02.1.454.CMB.1.raw
tcagatagagtactcacgaccggtgctcgatttagcacacgatagttgggtttggggaggaactgctcagttaggacccagacggaaccatggaagccccagctcagcttctcttcctcctgctactctggcctcccagactaccaggcggagagtattgtgttacgacacgtagtcctccagtccctacccttgttcgtttgtccgtaccggggaaagaaacgtccgcccctaacccctcttacccgtggacggacgggaccctaggtacgaagtagttaacgtttaaaacctaacgttacgttggtaccccgttaggtaacccaaaacgtaacgtaaaaccgtcggaccgacggaccctcccgaacggtccttacctacctaacgttactagtcggtaactcggacctaactacccgaacgtaccggaccgtacgtcggaccaccgttacccgacggtaccgtaacggttacgacggtacggtccgtacggggttacgggtccgtaacgggtaaccgtaacgtacctttaccgtaccgtactaacctaacctagtacgtacgacgacggtaccggtacgggtacctaagaagtactacggtacctagttacgttagggttaacttaacggtttacgttaacgtaaccgttaacttaaacgttaaacggttttaacggtttccgttttaccgttttaccggttaaccggttttcctaacccggtttaccgttaacccggtaacccggggtaaccggtaaccgggtaaacccggttaacggtaaacgggtaacgggttaaaaccggtttaaacgttaaaacccgggttaaacgggttccgggttaaacccggttacggttaacccgtaacccgttaaacccggtttaacgttcccggttttaaacccgg

SEQ ID NO: 277556 - DNA, 915 bp, Homo sapiens
  misc_feature: GYAE6OF01BN74F.29.35.D02.1.454.CMB.1.raw
tcagatagagtactcacgaccggtgctcgatttagcacacgatagttgggtttgggggaggaactgctcagttaggacccagacggaaccatggaagccccagctcagcttctcttcctcctgctactctggctcccagataccaggcggagagattgtgttgacactagtctccagccctacccttgttctttgtccgtaccggggaagaaacgcgccctacccttctccgtgacgagggaccctagtccaggtaagttacgttaaaccaacgtttacgttcggccttacggttacccaaaacgaacggtaaaacccgtcgggccgaaccgggtccctaccccgaaggtccctcccttacgtagtcctaagtcgtatcgacctacaccgaacgcgggtacccaggtcgactacctaccccgacggtaccgtaggttccgaggtggtaccgtaggggttcggtacgtacggggaacgtaccgttacttccgtaaccttcccgtacaacccgtactaccggaaccgttacccggtacccgtaacgggtaccgtacccggtttaaggtaaacgggtttctttacccggtttacgtttaaacccggttttttacgttttaacgtttccggggtttaccggtttcggggtaacccgtttacgtaacccggtaacccgggtttccggtcccccgtttaacccggtttacgtttacccgggttttacccggggaacccgggttaaacggggaacccgttaaccgggttaggtaaacggggtaccgttaaaccggtaacgggtaaaccgggttaaaccggtttaaccggggtttgggaaccccggtttcggtaacccgtaacccgtaaacccggtttcgtttccgtttaaacccgtttccgtttaccgtttaaccccccggg

SEQ ID NO: 277557 - DNA, 877 bp, Homo sapiens
  misc_feature: GYAE6OF01D6YZA.29.35.D02.1.454.CMB.1.raw
  modified_base (202)..(202): a, c, t, g, unknown or other
  misc_feature (202)..(202): n is a, c, g, or t
  modified_base (208)..(208): a, c, t, g, unknown or other
  misc_feature (208)..(208): n is a, c, g, or t
tcagatagagtactcacgaccggtgctcgatttagcacacgatagttggggttgggggaggaactgctcagttaggacccagacggaaccatggaacgccccagctcagcttctcttcctcctgctactctggcctccagataccaggcggagagtattgtgttgacacagtctccagccacctgtctttgtctccgggaanaaggcncctacctctcctgcacgggcctagtcagtacgtagttaaaccacttacgttggaccttcggttaccaaacgtaacgtaaaccgtcggacccgaacgggtaccctacccgaacggtccttacccgtactacttaccgttaacgttaggtactacggtacctaaccgttaaccggaaaccggtaccggggaccctaacggttccgggaaccctaccgttaccccgacggttaccccggtaacgggttttccgaagggttcggaccgggttaacggggttcgggggttacctacggggggtaacctaacgttaacgttccgtacctccgttaacccgacgttaccgtaccgaacggtacccggtaaccggtacggtaccgggtccttaacgggtaacggttacctttcggtacccgtttaacggttttaacgtttacgttaccgggtttacggtttacggggtaccgttaaacgtaccgggttaacccggttacccggtaccccgttttacccgggttacctttacgggttttacccgggaaaccggggtacccgggtaaccggtacgggtaacccgttaggggaacgtaccggtaacgaccgggtaacgtaaggttccggtacgtccgtacgacccgtacgtacgttcggttaccttcgttcctaccccgg

SEQ ID NO: 277558 - DNA, 821 bp, Homo sapiens
  misc_feature: GYAE6OF01AFY3Y.29.35.D02.1.454.CMB.1.raw
  modified_base (153)..(153): a, c, t, g, unknown or other
  misc_feature (153)..(153): n is a, c, g, or t
  modified_base (583)..(583): a, c, t, g, unknown or other
  misc_feature (583)..(583): n is a, c, g, or t
tcagatagagtactcacgaccggtgctcgatttagcacacgatagttgggtttggggaggaactgctcagttagacccagacggaaccatggaagccccagctcagcttctacttctcctgcttactctggctacccaagataccagcggtanagatttggtcgttgacactagtctcagccacctgtcctttgcgtaccgggagaaaccgcgcccgacccttctccggtagcgacgggccagtctagagttacgtaaccaacgttcggtacgtccgtacggttaccaaacgtacgaaaccgtcggtaccgacgggactacccggacggtccttacccgttacaacgttccgtaagttcggaacgttcggtaccctaacgtaacccgttaacggaaccggggttaccaaccgttaaccggggcccctaaaccctttaccccggaacggtttaaccgggaaccgggtttttccgacggggttaaccggtccggtacgggggttacgggtttaccgggaacggggaaacctacgggttaaccctttaccggtaacttcccggtaacccaaccgtacgttaacccncgacccggtaactacggacctcgtaagggtacgttacctaacggtttcgttaacgttttacgttcgttttaacggtaacggttcggtaccgtagtaccgtacggttacgtcgttacccgttagttcgttacggacgagggtacctagcggttacgagttccaggtaacggtacgtacggtaggttcccgacgttaaccgccctaaacgttacttacccggtaatttccgtaacgtccc

SEQ ID NO: 277559 - DNA, 743 bp, Homo sapiens
  misc_feature: GYAE6OF01BK794.29.35.D02.1.454.CMB.1.raw
  modified_base (184)..(184): a, c, t, g, unknown or other
  misc_feature (184)..(184): n is a, c, g, or t
  modified_base (682)..(682): a, c, t, g, unknown or other
  misc_feature (682)..(682): n is a, c, g, or t
tcagatagagtactcacgaccggtgctcgatttagcacacgatagttgggtttgggggacgaactgctcagttaggacccagacggaaccagtggaacgcccagctcagcttctcttcctcctgctactctggcctccacataccagcggagagtattcgtagttcgacagacgtcctccgacncccaccttgttctttcgtcggtaccgggaagaacggcgacccctaccgtccgtaccgtcgacggacggaccagtcgaagtacgttacgtaaaccgacttacgttcggtaccgtttcggtaaccaaacgaacggtaaacccgtcgggtaccgtaccggccctaccccggtagtccctttccgtagtacggttacttagtacggtacgtccggtaacctaccgtaccggaaaccggtaccgggtcccaacggttaccgacctacccggtaccgaacggtccgttaaggtacgacggtcggacgttacggggtcggtcggtacggtactaacgttctaaccgtccggttactaccgaaccgcgtaccggaccgtccgtacgtacgtcgacgtaaggtcgtaacgtttcgtactttacgttcgttacgttcgtacgttggacgtactccgtacgtcgtcccgttaccgttcgtacgtccggacggacggtacacgttacggngtacacgtacgcgtagtcgaggtcacggtcctacgtcttcttaggtccttccgtcgttccc

SEQ ID NO: 277560 - DNA, 872 bp, Homo sapiens
  misc_feature: GYAE6OF01AHZKD.29.35.D02.1.454.CMB.1.raw
tcagatagagtactcacgaccggtgctcgatttagcacacgatagttgggtttgggggaggaactgctcagttaggacccagacggaaccatggaagccccagctcagcttctcttctcctgctactctggctcccagataccagcggagagtattgtgttgaacacagtcctccacgccctacccgttggttctttcggtcgtaccgggaagtaaacgcggccccaccctcctcctggaccgacggggcctacggtcacggtacgttaagttaaacctaacttcgttcggtccttcggttaaccaaacgaacgaaaccgtcggaccgacggtcctcccgacggtcctcctcacttcgtaatgatcgactacgtaccgaacggcggtacctacgtcggacctaccgccccgtagtaccgtacggtttacggacggttaccgggacgttacggggtcgggggttaacgtaaccggggtaacgtaccggttacccttaccgtaccccgtacctaccccggaaaccttacgtcccgtaaacccgggtccctaaccgggttaacgggtacccggttccggttacgggtaaaccggttttcgtttaaccgttacccggttttacgttttttaagtttacgggttttaccggttccgggtttacgggtaccgttacggtaaccgttacggttaccccggtccccgttttccggtacgtttaccgggttttaccggacccggggtaacgggaacccgtaggttaccgggtaaggaccgttacggtaaaccgtaccgggtacggttaccggttaacgggttcaccggtaccgtaacccgtaccttacgttacccttggttaccctttaccggttaccccg

SEQ ID NO: 277561 - DNA, 822 bp, Homo sapiens
  misc_feature: GYAE6OF01AIDH9.29.35.D02.1.454.CMB.1.raw
  modified_base (121)..(121): a, c, t, g, unknown or other
  misc_feature (121)..(121): n is a, c, g, or t
  modified_base (152)..(152): a, c, t, g, unknown or other
  misc_feature (152)..(152): n is a, c, g, or t
  modified_base (240)..(240): a, c, t, g, unknown or other
  misc_feature (240)..(240): n is a, c, g, or t
  modified_base (657)..(657): a, c, t, g, unknown or other
  misc_feature (657)..(657): n is a, c, g, or t
  modified_base (784)..(784): a, c, t, g, unknown or other
  misc_feature (784)..(784): n is a, c, g, or t
  modified_base (805)..(805): a, c, t, g, unknown or other
  misc_feature (805)..(805): n is a, c, g, or t
tcagatagagtactcacgaccggtgctcgatttagcacacgataggttgggtttgggggaggaactgctcagttaggacccagacggaaccatggaacgccccagctcagcttctcttccncctgctactcgtggccttccgagactaccgnggacgggagagtagtttcgtggtttgaacacgtacgttcctccacgccctacccgttggttctttacgtccgtcgggaagaacgaccnccctacccgtctccgtgcgacgggcacggtcaaggtacgttacgtaaacctacgttacgttaccggccgtttacggttaaccaaaccgaaccggttaacccggtacgggacccgttaccggaccgttaacccggtaaccggtccggtttacccgttataaccgtttaacggtacttacgggtacgtttacggaccctaaccgttaacccggaaaccggaccgggtaccctccgttacgggacccttaccggaccctaacggttacggtacggttaccgaggttacgtaccggtagggtcgggtacggttacgaaccggtagtaccggtttcaccctttacgacgtacctacgaccggtccgaccggtaccttacggacgtaaccgtgggtactacggttcgttacgttattacgttnttcgggttacgtcggtacgtacgtacgtaccgtagtcccgtacgttccgtacgttaccgacgggtacggtaccgtactaccggtagtcaacgtacggtacgacgtagggtaccttaggccggttaancgttacctacgttaccggttnttacccggtattccccg

SEQ ID NO: 277562 - DNA, 1033 bp, Homo sapiens
  misc_feature: GYAE6OF01BYGUE.29.35.D02.1.454.CMB.1.raw
tcagatagagtactcacgaccggtgctcgatttagcacacgatagttgggtttgggggaggaactgctcagttaggacccagacggaaccatggaagccccagctcagcttctcttcctcctgctactctggcctcccagataccagcggagagtattgtcgttgaacactacgtctccacgccctacccttgttaccgtttgttccggtaccgggaaagaaacggaccgacccctaccccttcctcccgtaggaccgacgggggaccctagttaccgaggttaacggttaacgttaaaaccgtaacctttaccggttcggtcccggtttacggttaacccaaaacgtaacgtaaaaccccgtcgggtaacccgaccggtcccgttaccccgaggggtccttaccccgtactacggttacccttagtaacggtaccttcggtacctaaccgtaccccgaaaacggcggggtacccaacggttcggaacctaccccgttacccgacgtccggtaaggttcacggttcggcggttacgttcggggtcacggggaacctcgttaaccgttaccgccttacccgtaccgtaaaccgtacttaccggaccggtaaccccgtacgtaacgggtacccgggtaccgttagggtaacccggttaccggtttacgttaacccggttttacccggtttttaaggttttacccggggttttaggttaccccgggttttacggggacggtttaacccgtaacgggtttacccccgttccggggttaacccccccgttttccggtttaaccgggttttaccggttttaccccggggggaaccgggtaaaccccgggttaaccgggaaccggtttaaggggtacccggtaaaaccgggttttcggaaaaaccggtaacggggtttaaacccccgggtaaagtttcgggggtaaaccccggttacgtaaccccggtaaaccccgtttccggtttaaaccggttttccgaaacccccggtttttccggtttacccttaaccccccgggg

SEQ ID NO: 277563 - DNA, 852 bp, Homo sapiens
  misc_feature: GYAE6OF01B9D1E.29.35.D02.1.454.CMB.1.raw
  modified_base (198)..(198): a, c, t, g, unknown or other
  misc_feature (198)..(198): n is a, c, g, or t
tcagatagagtactcacgaccggtgctcgatttagcacacgatagttgggtttggggaggaactgctcagttaggacccagacggaaccatggaagccccagctcagcttctcttcctcctgctactctggctccagataccagcggagagattgtgttgacacagtctccagcccacctgtctttgtctccgggaanaaacgcgcccacccttctcctgccacgggcctagtccaggtacgttacgttaaaccaacttacgttcgggaccctttgggttaccccaaaacgtaacggaaacccgttcgggaccctaacgggcccttaccccggacggtcccttacccgtactaactttccgtagtggtaacttcggacctaaccgtaccaaaccggacggggtacccctaagtccgggaccctaacccggtaccccctaacggtaccccggttaaggtttcgaaaccgggttcgggtaaccgttaacgggggttcgggggttaccggttaagggggaaccctaaccggttaacctttccctaacgttcccgtaaccctaccctaaacgttacccgaacccggtacccggtacccgttaaccggtaccgtacccgttacgggtaacggttacgtttaccggttacggtttaacccgttttaacgttttacgtttacggtttcggttacgggtacggttacggtaccgtaacgtccgtcccgttacccgttacgtaccgtttccggaccggtaccgggacgtacggtacgtaggtacgacgtaacgacggtaacgtacggtacggtcggtcgtaccgaccctacgtaccttcgttaccttcgttccgttacccg

SEQ ID NO: 277564 - DNA, 822 bp, Homo sapiens
  misc_feature: GYAE6OF01B6AXH.29.35.D02.1.454.CMB.1.raw
tcagatagagtactcacgaccggtgctcgatttagcacacgatagttgggtttgggggaggaactgctcagttaggacccagacggaaccatggaagccccagctcagcttctcttcctcctgctactctggctcccagataccagcggagagtattgtgttgacacagtctccagccacctgtctttgtctcgggagaagcgccacctctcctgcacgggcagtcagagtacgttaaacaacttcgttcggccgttcggttaccaaacgacgaaacccgttcggaccgaacgggtccctaccccgaacggtccttaccgtacacgttactagtcggtattcgacctactacccgaacgtaccggggaccctacggtcggacctaccgtaccccgacggtacccgtaggttaccgacgggtcggtacgtagggttcgggtaccggtagggacctacggttaacctttccaccgtttacccgtaccaacccgtacgtaccggtaccggtacccggtaccgttaaccgggaccgtacccggttaagggtacgggttacctttccgggttaccggttttaccgtttttaacgttttaggttttccggttccggggtttcgggtacggtttaaccgtaccgttaaccggttccgggttcccccgtttacccggtttacccgtttaccgggttttacccgggaaccggttaccggggaacctaccgggtacgtaacgggtaacgtaccggtaacggtaacggacggttaaccggtgggtacggtaccgtacgacccgtactacgttctccgtttactccgttacccg

SEQ ID NO: 277565 - DNA, 755 bp, Homo sapiens
  misc_feature: GYAE6OF01BBWR3.29.35.D02.1.454.CMB.1.raw
  modified_base (474)..(474): a, c, t, g, unknown or other
  misc_feature (474)..(474): n is a, c, g, or t
  modified_base (489)..(489): a, c, t, g, unknown or other
  misc_feature (489)..(489): n is a, c, g, or t
tcagatagagtactcacgaccggtgctcgatttagcacacgatagttgggttgggggaggaactgctcagttaggacccagacggaaccatgggaacgccccagcgtcagcttctcttccgtcctgctactctcggctcccagataccaggcggagagtattggtgttgaacacgtagtcctcgaacgccctacccttggttcctttggtccgtaccggggaagaaacgcgcccctaccctctccgtgcgacgggccagtcagacgttacgttaaacacttacgttcggcctagtaccaaagtacgaaaccgtggaccacggtcctcccgaggtcctcctactactacctatacggatacggtcctaactacccgaaacgtccgggaaccctggtaccggacctacgtaccccgaggtacccgtaggttaccgaggtcggacgtagggtcggtacggtacggactagtccgtanaccgttcacgtaccngtacccgtaccgaccgtacctacggtacgtaccgtacggtaacggttacgttacgttacggttacgtttagtttacggtttcgttacgggttcgggtacgtacggtacggtaaccgttccggtacccgttcccgttacggttaccggtttaccggggacccgtaacgggtaccgtacgtccggtaggtacgtacgtaacggaacgtaccgtaaggttcggtccgtacgtacgtacccgtactacgtcgttacttcgtccgttaccg

SEQ ID NO: 277566 - DNA, 499 bp, Homo sapiens
  misc_feature: GYAE6OF02GBMCA.29.35.D02.1.454.CMB.1.raw
tcagatagagtactcacgaccggtgctcgatttagcacacgatagttgggtttggggaggaactgctcagttaggacccagacggaaccatggaagccccagctcagcttctcttcctcctgctactctggctcccagataccagcggagagattgtgttgacacagtctccagccaccctgtctttgtctccgggagaaagagccaccctctcctgcagggccagtcagagtgttaacaactacttggcctggttccaacagaaacctggccaggctcccaggctcctcatctatgatgcatccaacagggccactggcatcccagccaggttcagtggcagtgggtctgggacagacttcactctcaccatcagccgcctagagcctgaggattctgccgtttattattgtcttgggcgtagcaactggcctccgtcactttggcctagggaccaagctggagatcagacgaactgtgctgcaccatctgtctctac

SEQ ID NO: 277567 - DNA, 516 bp, Homo sapiens
  misc_feature: GYAE6OF02G5F44.29.35.D02.1.454.CMB.1.raw
tcagatagagtactcacgaccggtgctcgatttagcacacgatagttgggtttgggggaggaactgctcagttaggacccagacggaaccatggaagccccagctcagcttctcttcctcctgctactctggctcccagataccagcggagagattgtgttgacacagtctccagccaccctgtctttgtctccgggagaaagagccaccctctcctgcagggccagtcagagtgttaacaactacttggcctggttccaacagaaacctggccaggctcccaggctcctcatctatgatgcatccaacagggccactggcatcccagccaggttcagtggcagtgggtctgggacagacttcactctcaccatcagccgcctagacgcctgaggattctgtccgtttattattgttcttgggcgtagcactggcctccgtctactttcggccgtaggggaccagcgtggagatcgagacgaactggtcgcgtgcacctatcgtcgttctctaccg

SEQ ID NO: 277568 - DNA, 505 bp, Homo sapiens
  misc_feature: GYAE6OF02HBJGW.29.35.D02.1.454.CMB.1.raw
  modified_base (502)..(502): a, c, t, g, unknown or other
  misc_feature (502)..(502): n is a, c, g, or t
tcagatagagtactcacgaccggtgctcgatttagcacacgatagttgggtttgggggaggaactgctcagttaggacccagacggaaccatggaagccccagctcagcttctcttcctcctgctactctggctcccagataccagcggagagattgtgttgacacagtctccagccaccctgtctttgtctccgggagaaagagccaccctctcctgcagggccagtcagagtgttaacaactacttggcctggttccaacagaaacctggccaggctcccaggctcctcatctatgatgcatccaacagggccactggcatcccagccaggttcagtggcagtgggtctgggacagacttcactctcaccatcagccgcctagagcctgaggattctgccgtttattattgtcttgggcgtagcaactggcctcccgtcacttttggcctaggggaccaagctggagatcagacgaactgtggctgcaccatctgtcttntac

SEQ ID NO: 277569 - DNA, 503 bp, Homo sapiens
  misc_feature: GYAE6OF02GZ50M.29.35.D02.1.454.CMB.1.raw
tcagatagagtactcacgaccggtgctcgatttagcacacgatagttgggtttgggaggaactgctcagttaggacccagacggaaccatggaagccccagctcagcttctcttcctcctgctactctggctcccagataccagcggagagattgtgttgacacagtctccagccaccctgtctttgtctccgggagaaagagccaccctctcctgcagggccagtcagagtgttaacaactacttggcctggttccaacagaaacctggccaggctcccaggctctcatctatgatgcatccaacagggccactggcatcccagccaggttcagtggcagtgggtctgggacagacttcactctcaccatcagccgcctagagcctgaggattctgtccgtttattattgtcgttggtcgtagcaactggcctcccgtctactttggcctacgggaccaagcgtggagatcagacgaactgtggctgcacatctgtctctac

SEQ ID NO: 277570 - DNA, 515 bp, Homo sapiens
  misc_feature: GYAE6OF02HSA7V.29.35.D02.1.454.CMB.1.raw
tcagatagagtactcacgaccggtgctcgatttagcacacgatagttgggtttggggaggaactgctcagttaggacccagacggaaccatggaagccccagctcagcttctcttcctcctgctactctggctcccagataccagcggagagattgtgttgacacagtctccagccaccctgtctttgtctccgggagaaagagccaccctctcctgcagggccagtcagagtgttaacaactacttggcctggttccaacagaaacctggccaggctcccaggctcctcatctatgatgcatccaaacagggccactggcatcccagccaggttcagtggcagtgggtctgggacagacttcactctcaccatcagccgcctagagcctgaggattctgtccgtttattattgttcgttgggtcgtagcaacgtggccctcccgtctacttttcggccgtacggggaccaagctggagatcagacgaactgtggctgcaccatctgtcttctac

SEQ ID NO: 277571 - DNA, 314 bp, Homo sapiens
  misc_feature: GYAE6OF02JTWQZ.29.35.D02.1.454.CMB.1.raw
  modified_base (262)..(314): a, c, t, g, unknown or other
  misc_feature (262)..(314): n is a, c, g, or t
tcagatagagtactcacgaccggtgctcgatttagcacacgatagttgggtttggggacagacttcactctcaccatcagccgcctagagcctgaggattcgtgccgtttattattgtcttgggcgtagcaactggcctcccgtcacttttggccaggggaccaagctggacgatcagacgaactgtggctgcgaccatctgtcttcatcttcccgccatcctgaagtactctaatctgagcgggctggcaaggcgcatagnnnnnnnnnnnnnnnnnnnnnnnnnnnnnnnnnnnnnnnnnnnnnnnnnnnnn

SEQ ID NO: 277572 - DNA, 527 bp, Homo sapiens
  misc_feature: GYAE6OF02IQ72P.29.35.D02.1.454.CMB.1.raw
tcagatagagtactcacgaccggtgctcgatttagcacacgatagttgggtttgggggaggaactgctcagttaggacccagacggaaccatggaagccccagctcagcttctcttcctcctgctactctggctcccagataccagcggagagattgtgttgacacagtctccagccaccctgtctttgtctccgggagaaagagccaccctctcctgcagggccagtcagagtgttaacaactacttggcctggttccaacagaaacctggccaggctcccaggctcctcatctatgatgcatccaacagggccactggcatcccagccaggttcagtggcagtgggtctgggacagacttcactctcaccatcagccgcctagacgcctggaggtattctcgtccgtttattattgttcgttgggtcgtagcaacgtcggcctcccgtctacgtttcggccgacgggaccaagcgtggagacgtcgacgacgtaacgtggtggcgtgcaccatctcgtcttctac

SEQ ID NO: 277573 - DNA, 503 bp, Homo sapiens
  misc_feature: GYAE6OF02GL9Y6.29.35.D02.1.454.CMB.1.raw
tcagatagagtactcacgaccggtgctcgatttagcacacgatagttgggtttggggaggaactgctcagttaggacccagacggaaccatggaagccccagctcagcttctcttcctcctgctactctggctcccagataccagcggagagattgtgttgacacagtctccagccaccctgtctttgtctccgggagaaagagccaccctctcctgcagggccagtcagagtgttaacaactacttggcctggttccaacagaaacctggccaggctcccaggctcctcatctatgatgcatccaacagggccactggcatcccagccaggttcagtggcagtgggtctgggacagacttcactctcaccatcagccgcctagagcctgaggattctgccgtttattattgtcttgggcgtagcaactggcctcccgtcacttttggccaggggaccaagctggagatcagacgaactgtggctgcaccatctgtcttctac

SEQ ID NO: 277574 - DNA, 257 bp, Homo sapiens; identical to SEQ ID NO: 276983
  misc_feature: GYAE6OF02H37FZ.29.35.D02.1.454.CMB.1.raw
  modified_base (256)..(257): a, c, t, g, unknown or other
  misc_feature (256)..(257): n is a, c, g, or t

SEQ ID NO: 277575 - DNA, 499 bp, Homo sapiens
  misc_feature: GYAE6OF02HT5ZE.29.35.D02.1.454.CMB.1.raw
  modified_base (262)..(262): a, c, t, g, unknown or other
  misc_feature (262)..(262): n is a, c, g, or t
tcagatagagtactcacgaccggtgctcgatttagcacacgatagttgggtttgggggaggaactgctcagttaggacccagacggaaccatggaagccccagctcagcttctcttcctcctgctactctggctcccagataccagcggagagattgtgttgacacagtctccagccaccctgtctttgtctccgggagaaagagccaccctctcctgcagggccagtcagagtgttaacaactacttggcctggttccaanagaaacctggccaggctcccaggctcctcatctatgatgcatccaacagggccactggcatcccagccaggttcagtgcagtggtctgggacagacttcactctcaccatcagccgctagagcctgaggattctgccgtttattattgttcttgggtcgtagcaactggcctcccgtcactttggcagggaccaagctgagatcagacgaactgtggctgcaccatctgtcttctac

SEQ ID NO: 277576 - DNA, 508 bp, Homo sapiens
  misc_feature: GYAE6OF02GTFI9.29.35.D02.1.454.CMB.1.raw
tcagatagagtactcacgaccggtgctcgatttagcacacgataggttgggtttggggaggaactgctcagttaggacccagacggaaccatggaagccccagctcagcttctcttcctcctgctactctggctcccagataccagcggagagattgtgttgacacagtctccagccaccctgtcctttgtctccgggagaaagagccaccctctcctgcagggccagtcagagtgttaacaactacttggcctggttccaacagaaacctggccaggctcccaggctcctcatctatgatgcatccaacagggccactggcatcccagccaggttcagtggcagtgggtctggggacaggacttcactctcaccatcagccgcctagagcctgaggattctgtccgtttattattgtcttggtcgtagcaactggcctcccgtcactttggccgtagggaccagccgtggagatcagacgaactgtggctgcacatctcgtctctac

SEQ ID NO: 277577 - DNA, 257 bp, Homo sapiens; identical to SEQ ID NO: 276983
  misc_feature: GYAE6OF02F7ZP2.29.35.D02.1.454.CMB.1.raw
  modified_base (256)..(257): a, c, t, g, unknown or other
  misc_feature (256)..(257): n is a, c, g, or t

SEQ ID NO: 277578 - DNA, 515 bp, Homo sapiens
  misc_feature: GYAE6OF02G13FG.29.35.D02.1.454.CMB.1.raw
tcagatagagtactcacgaccggtgctcgatttagcacacgatagttgggtttggggaggaactgctcagttaggacccagacggaaccatggaagccccagctcagcttctcttcctcctgctactctggctcccagataccagcggagagattgtgttgacacagtctccagccaccctgtctttgtctccgggagaaagagccaccctctcctgcagggccagtcagagtgttaacaactacttggcctggttccaacagaaacctggccaggctcccaggctcctcatctatgatgcatccaacagggccactggcatcccagccaggttcagtggcagtgggtctgggacagacttcactctcaccatcagccgcctagacgcctgaggattctgtccgtttattattgttcttgggtcgtagctaacgtggcctcccgtctacgtttcggccgtaggggaccaagcgtggagatcgagacgaacgtgtggctgcaccatctgtctctac

SEQ ID NO: 277579 - DNA, 504 bp, Homo sapiens
  misc_feature: GYAE6OF02FPLZ0.29.35.D02.1.454.CMB.1.raw
tcagatagagtactcacgaccggtgctcgatttagcacacgatagttgggtttggggaggaactgctcagttaggacccagacggaaccatggaagccccagctcagcttctcttcctcctgctactctggctcccagataccagcggagagattgtgttgacacagtctccagccaccctgtctttgtctccgggagaaagagccaccctctcctgcagggccagtcagagtgttaacaactacttggcctggttccaacagaaacctggccaggctcccaggctcctcatctatgatgcatccaacagggccactggcatcccagccaggttcagtggcagtgggtctgggacagacttcactctcaccatcagccgcctagagcctgaggattctgtccgtttattattgtcttgggtcgtagcaactggcctccgtctactttggccaggggaccaagctggagatcagacgaactgtggctgcaccatctgtcttctac

SEQ ID NO: 277580 - DNA, 502 bp, Homo sapiens
  misc_feature: GYAE6OF02HDJZ6.29.35.D02.1.454.CMB.1.raw
tcagatagagtactcacgaccggtgctcgatttagcacacgatagttgggtttgggggaggaactgctcagttaggacccagacggaaccatggaagccccagctcagcttctcttcctcctgctactctggctcccagataccagcggagagattgtgttgacacagtctccagccaccctgtctttgtctccgggagaaagagccaccctctcctgcagggccagtcagagtgttaacaactacttggcctggttccaacagaaacctggccaggctcccaggctcctcatctatgatgcatccaacagggccactggcatcccagccaggttcagtgcagtggtctgggacagacttcactctcaccatcagccgcctagagcctgaggattctgtccgtttattattgttcttgggcgtagcactggcctccgtctactttggccgagggaccaagcgtgagatcgagacgactgtggctgcacatctcgtcttctac

SEQ ID NO: 277581 - DNA, 512 bp, Homo sapiens
  misc_feature: GYAE6OF02ID1RZ.29.35.D02.1.454.CMB.1.raw
tcagatagagtactcacgaccggtgctcgatttagcacacgatagttgggtttgggggaggaactgctcagttaggacccagacggaaccatggaagccccagctcagcttctcttcctcctgctactctggctcccagataccagcggagagattgtgttgacacagtctccagccaccctgtctttgtctccgggagaaagagccaccctctcctgcagggccagtcagagtgttaacaactacttggcctggttccaacagaaacctggccaggctcccaggctcctcatctatgatgcatccaacagggccactggcatcccagccaggttcagtggcagtgggtctgggacagacttcactctcaccatcagccgcctagacgcctgaggatctgtccgtttattattgttcttggtcgtagcaacgtgcctccgtctacgtttcggccgtacgggaccaagcgtggagatcgagacgaactgtggtctgcaccatctcgtctctac

SEQ ID NO: 277582 - DNA, 503 bp, Homo sapiens
  misc_feature: GYAE6OF02IR0PM.29.35.D02.1.454.CMB.1.raw
  modified_base (443)..(443): a, c, t, g, unknown or other
  misc_feature (443)..(443): n is a, c, g, or t
tcagatagagtactcacgaccggtgctcgatttagcacacgatagttgggtttgggggaggaactgctcagttaggacccagacggaaccatggaagccccagctcagcttctcttcctcctgctactctggctcccagataccagcggagagattgtgttgacacagtctccagccaccctgtctttgtctccgggagaaagagccaccctctcctgcagggccagtcagagtgttaacaactacttggcctggttccaacagaaacctggccaggctcccaggctcctcatctatgatgcatccaacagggccactggcatcccagccaggttcagtggcagtgggtctgggacagacttcactctcaccatcagccgcctagagcctgaggattctgtccgtttattattgttcttgggtcgtagcactgcctcccgtcnctttgcgagggaccaagcgtggagatcagacgaactgtggctgcaccatctgtcttctac

SEQ ID NO: 277583 - DNA, 257 bp, Homo sapiens; identical to SEQ ID NO: 276983
  misc_feature: GYAE6OF02HHMBY.29.35.D02.1.454.CMB.1.raw
  modified_base (256)..(257): a, c, t, g, unknown or other
  misc_feature (256)..(257): n is a, c, g, or t

SEQ ID NO: 277584 - DNA, 527 bp, Homo sapiens
  misc_feature: GYAE6OF02I2FYK.29.35.D02.1.454.CMB.1.raw
  modified_base (309)..(309): a, c, t, g, unknown or other
  misc_feature (309)..(309): n is a, c, g, or t
tcagatagagtactcacgaccggtgctcgatttagcacacgatagttgggtttggggaggaactgctcagttaggacccagacggaaccatggaagccccagctcagcttctcttcctcctgctactctggctcccagataccagcggagagattgtgttgacacagtctccagccaccctgtctttgtctccgggagaaagagccaccctctcctgcagggccagtcagagtgttaacaactacttggcctggttccaacagaaacctggccaggctcccaggctcctcatctatgatgcatccaacngggccactggcatcccagccaggttcagtggcagtgggtctgggacagacttcactctcaccatcagccgctagagcctgaggacttctgtccgtttattattgttcttgggcgtagctaactcggcctcccgtctacttttcggccgtagggaccgtaacgcgtaggagacgtcgacgtaacgaacgttgtggcgtgcacacttctcgttcttctac

SEQ ID NO: 277585 - DNA, 256 bp, Homo sapiens; identical to SEQ ID NO: 276990
  misc_feature: GYAE6OF02FL4LH.29.35.D02.1.454.CMB.1.raw
  modified_base (256)..(256): a, c, t, g, unknown or other
  misc_feature (256)..(256): n is a, c, g, or t

SEQ ID NO: 277586 - DNA, 504 bp, Homo sapiens
  misc_feature: GYAE6OF02IPKOS.29.35.D02.1.454.CMB.1.raw
tcagatagagtactcacgaccggtgctcgatttagcacacgatagttgggtttgggggaggaactgctcagttaggacccagacggaaccatggaagccccagctcagcttctcttcctcctgctactctggctcccagataccagcggagagattgtgttgacacagtctccagccaccctgtctttgtctccgggagaaagagccaccctctcctgcagggccagtcagagtgttaacaactacttggcctggttccaacagaaacctggccaggctcccaggctcctcatctatgatgcatccaacagggccactggcatcccagccaggttcagtggcagtggtctgggacagacttcactctcaccatcagccgcctagacgcctgaggattctgccgtttattattgtcttgggcgtagcactggcctcccgtctactttggccagggaccaagcgtggagatcgagacgaactgtggctgcaccatctgtcttctac

SEQ ID NO: 277587 - DNA, 256 bp, Homo sapiens; identical to SEQ ID NO: 276990
  misc_feature: GYAE6OF02I7Y2X.29.35.D02.1.454.CMB.1.raw
  modified_base (256)..(256): a, c, t, g, unknown or other
  misc_feature (256)..(256): n is a, c, g, or t

SEQ ID NO: 277588 - DNA, 509 bp, Homo sapiens
  misc_feature: GYAE6OF02FUDN4.29.35.D02.1.454.CMB.1.raw
tcagatagagtactcacgaccggtgctcgatttagcacacgatagttgggtttggggaggaactgctcagttaggacccagacggaaccatggaagccccagctcagcttctcttcctcctgctactctggctcccagataccagcggagagattgtgttgacacagtctccagccaccctgtctttgtctccgggagaaagagccaccctctcctgcagggccagtcagagtgttaacaactacttggcctggttccaacagaaacctggccaggctcccaggctcctcatctatgatgcatccaacagggccactggcatcccagccaggttcagtggcagtgggtctgggacagacttcactctcaccatcacgccgcctagagcctgaggattcgtgtccgttattattgtcttgggcgtagcaacgtggcctccgtctactttcggccgtagggaccaagcgtggagatcgagacgaactggtgctgcaccgatctgtctctac

SEQ ID NO: 277589 - DNA, 503 bp, Homo sapiens
  misc_feature: GYAE6OF02HVWT6.29.35.D02.1.454.CMB.1.raw
tcagatagagtactcacgaccggtgctcgatttagcacacgatagttgggtttgggaggaactgctcagttaggacccagacggaaccatggaagccccagctcagcttctcttcctcctgctactctggctcccagataccagcggagagattgtgttgacacagtctccagccaccctgtctttgtctccgggagaaagagccaccctctcctgcagggccagtcagagtgttaacaactacttggcctggttccaacagaaacctggccaggctcccaggctcctcatctatgatgcatccaacagggccactggcatcccagccaggttcagtggcagtgggtctgggacagacttcactctcaccatcagccgcctagagcctgaggattctgtccgtttattattgttcttgggtcgtagcaactgcctccgtctactttggccgagggaccaagctggagatcagacgaactgtgctgcaccatctgttcttctac

SEQ ID NO: 277590 - DNA, 575 bp, Homo sapiens
  misc_feature: GYAE6OF02F3ORF.29.35.D02.1.454.CMB.1.raw
tcagatagagtactcacgaccggtgctcgatttagcacacgatagttgggtttggggaggaactgctcagttaggacccagacggaaccatggaagccccagctcagcttctcttcctcctgctactctggctcccagataccagcggagagattgtgttgacacagtctccagccaccctgtctttgtctccgggagaaagagccaccctctcctgcagggccagtcagagtgttaacaactacttggcctggttccaacagaaacctggccaggctcccaggctcctcatctatgatgcatccaacagggccactggcatcccagccaggtcagtgcagtggtctgggacagacttcactctcacatcagccgctagagcctgaggattcgtcgtcgtttattattcgttacgttgggtcgtagtctaacgttcggtcccttcccgtctaccgttttcgggcccgtacgggggtaccaaacggtcgtacgggacgtagttacgacggtaacgtaacgttaggtcggtcgttacggacctaccgtacgttaccgttcgttccgttaccttaccg

SEQ ID NO: 277591 - DNA, 502 bp, Homo sapiens
  misc_feature: GYAE6OF02GJ7U1.29.35.D02.1.454.CMB.1.raw
tcagatagagtactcacgaccggtgctcgatttagcacacgatagttgggtttgggggaggaactgctcagttaggacccagacggaaccatggaagccccagctcagcttctcttcctcctgctactctggctcccagataccagcggagagattgtgttgacacagtctccagccaccctgtctttgtctccgggagaaagagccaccctctcctgcagggccagtcagagtgttaacaactacttggcctggttccaacagaaacctggccaggctcccaggctcctcatctatgatgcatccaacagggccactggcatcccagccaggttcagtggcagtgggtctgggacagacttcactctcaccatcagccgcctagagcctgaggattctgccgtttattattgtcttgggcgtagcaactggcctcccgtcactttggccagggaccaagctggagatcagacgaactgtggctgcaccatctgtcttctac

SEQ ID NO: 277592 - DNA, 504 bp, Homo sapiens
  misc_feature: GYAE6OF02FG9GM.29.35.D02.1.454.CMB.1.raw
  modified_base (387)..(387): a, c, t, g, unknown or other
  misc_feature (387)..(387): n is a, c, g, or t
tcagatagagtactcacgaccggtgctcgatttagcacacgatagttgggtttgggggaggaactgctcagttaggacccagacggaaccatggaagccccagctcagcttctcttcctcctgctactctggctcccagataccagcggagagattgtgttgacacagtctccagccaccctgtctttgtctccgggagaaagagccaccctctcctgcagggccagtcagagtgttaacaactacttggccctggttccaacagaaacctggccaggctcccaggctcctcatctatgatgcatccaacagggccactggcatcccagccaggttcagtggcagtgggtctgggacagacttcactctcaccatcagccgcctagngcctgaggattctgccgttattattgtcttgggcgtagcaacgtggcctccgtcactttggccaggggaccaagctggagatcagacgaactgtggctgcaccgatctgtcttctac

SEQ ID NO: 277593 - DNA, 551 bp, Homo sapiens
  misc_feature: GYAE6OF02JHXOM.29.35.D02.1.454.CMB.1.raw
  modified_base (201)..(201): a, c, t, g, unknown or other
  misc_feature (201)..(201): n is a, c, g, or t
  modified_base (264)..(264): a, c, t, g, unknown or other
  misc_feature (264)..(264): n is a, c, g, or t
tcagatagagtactcacgaccggtgctcgatttagcacacgataggttagggtttggggaggaactgctcagttacggacccagacggaaccatggaagccccagctcgagcttctcttcctcctgctactctggctcccagataccagcggagagattgtgttgacacagtctccagccaccctgtctttgctccggganaaagagccaccctctcctgcagggccagtcagagtgttaaacactacttggcctggttccaanagaaacctggccaggctcccaggctcctcatctatgatgcatccaacgagggccactggccatcccagccaggttcagtcggcaggtgggtctgggacagacttcactctcaccatcagccgctagacgctgaggtattcgtcgtccgtttatttagttcgttcgttgggtcgtagtactacgtcgccttccgtctacgttttcggccgtacgggaccagcgtaggacgtagtacgacggtacgtaacgtggtcgtcgtagccgactacttcgtcgttcttactacc

SEQ ID NO: 277594 - DNA, 510 bp, Homo sapiens
  misc_feature: GYAE6OF02IO8UD.29.35.D02.1.454.CMB.1.raw
tcagatagagtactcacgaccggtgctcgatttagcacacgatagttgggtttggggaggaactgctcagttaggacccagacggaaccatggaagccccagctcagcttctcttcctcctgctactctggctcccagataccagcggagagattgtgttgacacagtctccagccaccctgtctttgtctccgggagaaagagccaccctctcctgcagggccagtcagagtgttaacaactacttggcctggttccaacagaaacctggccaggctccccaggctcctcatctatgatgcatccaacagggccactggcatcccagccaggttcagtggcagtgggtctgggacagactcactctcaccatcacgccgcctagagcctgagatctgccgtttattattgttcttgggtcgtagcaactggcctcccgtcacttttcggccgtaggggaccaaggctggagatcgagcggaactgtggctgcaccatctgttcctctac

SEQ ID NO: 277595 - DNA, 258 bp, Homo sapiens
  misc_feature: GYAE6OF02GSKR9.29.35.D02.1.454.CMB.1.raw
  modified_base (256)..(258): a, c, t, g, unknown or other
  misc_feature (256)..(258): n is a, c, g, or t
tcagatagagtactcacgaccggtgctcgatttagcacacgatagttgggtttgggacagacttcactctcaccatcagccgcctagagcctgaggattctgccgtttattattgtcttgggcgtagcaactggcctcccgtcacttttggccaggggaccaagctggagatcagacgaactgtggctgcaccatctgtcttcatcttcccgccatctgaagtactctatctgagcgggctggcaaggcgcatagnnn

SEQ ID NO: 277596 - DNA, 533 bp, Homo sapiens
  misc_feature: GYAE6OF02HO0TW.29.35.D02.1.454.CMB.1.raw
  modified_base (309)..(309): a, c, t, g, unknown or other
  misc_feature (309)..(309): n is a, c, g, or t
tcagatagagtactcacgaccggtgctcgatttagcacacgatagttgggtttggggaggaactgctcagttaggacccagacggaaccatggaagccccagctcagcttctcttcctcctgctactctggctcccagataccagcggagagattgtgttgacacagtctccagccaccctgtctttgtctccgggagaaagagccaccctctcctgcagggccagtcagagtgttaacaactacttggcctggttccaacagaaacctggccaggctcccaggctcctcatctatgatgcatccaacngggccactggcatcccagccaggttcagtggcagtgggtctgggacagacttcactctcaccatcacgccgcctagacgcctggaggtattctgtccgtttattattgttcgttgggtcgtagctaacgtcggcccttcccgtctacgttttcggccgtacggggaccagcgtaggagtatcgaggacgaactggtcggtctgcaccatctcgttcttctaccg

SEQ ID NO: 277597 - DNA, 508 bp, Homo sapiens
  misc_feature: GYAE6OF02HI3GV.29.35.D02.1.454.CMB.1.raw
tcagatagagtactcacgaccggtgctcgatttagcacacgatagttgggtttgggggaggaactgctcagttaggacccagacggaaccatggaagccccagctcagcttctcttcctcctgctactctggctcccagataccagcggagagattgtgttgacacagtctccagccaccctgtctttgtctccgggagaaagagccaccctctcctgcagggccagtcagagtgttaacaactacttggcctggttccaacagaaacctggccaggctcccaggctcctcatctatgatgcatccaacagggccactggcatcccagccaggttcagtggcagtgggtctgggacagacttcactctcaccatcagccgctagagcctgaggattctgccgtttattattgttcttgggcgtagcaactggcctcccgtctactttggccgacgggaccaagcgtggagatcgagacgaacgtgtgcgtgcaccatctgtcttctac

SEQ ID NO: 277598 - DNA, 519 bp, Homo sapiens
  misc_feature: GYAE6OF02HGPE4.29.35.D02.1.454.CMB.1.raw
tcagatagagtactcacgaccggtgctcgatttagcacacgatagttgggtttgggggaggaactgctcagttaggacccagacggaaccatggaagccccagctcagcttctcttcctcctgctactctggctcccagataccagcggagagattgtgttgacacagtctccagccaccctgtctttgtctccgggagaaagagccaccctctcctgcagggccagtcagagtgttaacaactacttggcctggttccaacagaaacctggccaggctccaggctcctcatctatgatgcatccaacgagggccacgtggcactcccagccaggttcagtggcagtgggtctgggacagacttcactctcaccatcacgccgcctagacgcctgaggtattctgtccgtttattattgttcgttgggcgtagtcacgtcggcctcccgtctacgtttcggccgtacgggaccaagcgtggagatcgagacgaacgtgtcgctgcacatctgtctctac

SEQ ID NO: 277599 - DNA, 505 bp, Homo sapiens
  misc_feature: GYAE6OF02GJWEG.29.35.D02.1.454.CMB.1.raw
tcagatagagtactcacgaccggtgctcgatttagcacacgatagttgggtttgggggaggaactgctcagttaggacccagacggaaccatggaagccccagctcagcttctcttcctcctgctactctggctcccagataccagcggagagattgtgttgacacagtctccagccaccctgtctttgtctccgggagaaagagccaccctctcctgcagggccagtcagagtgttaacaactacttggcctggttccaacagaaacctggccaggctcccaggctcctcatctatgatgcatccaacagggccactggcatcccagccaggttcagtggcagtgggtctgggacagacttcactctcaccatcagccgcctagagcctgaggattctgtccgtttattattgtcttgggcgtagcaactggcctccgtctacttttggccaggggaccaagcgtggagatcagacgaactgtgctgcaccatctgtcttctac

SEQ ID NO: 277600 - DNA, 513 bp, Homo sapiens
  misc_feature: GYAE6OF02G23NU.29.35.D02.1.454.CMB.1.raw
  modified_base (510)..(510): a, c, t, g, unknown or other
  misc_feature (510)..(510): n is a, c, g, or t
tcagatagagtactcacgaccggtgctcgatttagcacacgatagttgggtttgggggaggaactgctcagttaggacccagacggaaccatggaagccccagctcagcttctcttcctcctgctactctggctcccagataccagcggagagattgtgttgacacagtctccagccaccctgtctttgtctccgggagaaagagccaccctctcctgcagggccagtcagagtgttaacaactacttggcctggttccaacagaaacctggccaggctcccaggctcctcatctatgatgcatccaacagggccactggcatcccagccaggttcagtgcagtggtctgggacagacttcactctcaccatcacgccgcctagacgcctgaggattctgtccgtttattattgtcttgggcgtagcaactcggcctcccgtctacgtttcggccgaggggtaccaaggctggagatcgagacgaacgtgtggctgcacatctcgtcttntac

SEQ ID NO: 277601 - DNA, 549 bp, Homo sapiens
  misc_feature: GYAE6OF02G4QWJ.29.35.D02.1.454.CMB.1.raw
  modified_base (199)..(199): a, c, t, g, unknown or other
  misc_feature (199)..(199): n is a, c, g, or t
tcagatagagtactcacgaccggtgctcgatttagcacacgatagttgggtttgggggaggaactgctcagttaggacccagacggaaccatggaagccccagctcagcttctcttcctcctgctactctggctcccagataccagcggagagattgtgttgacacagtctccagccaccctgtctttgtctccggganaaagagccaccctctcctgcagggccagtcagagtgttaacaactacttggcctggttccaacagaaacctggccaggctcccaggctcctcatctatgatgcatccaacagggccactggcactccagccaggttcaggtgcagtgggtctgggacagctcactctcactatacgacgccgacctagacgcctgaggtattcgtgtccgtttattagtttgtcgttggtcgtagctaacgtcgtcccttccgtctacgttttcggccgtacgggaaccgtagccgtagtacgagtcgaaggaaccgtaacgtggtcggcgtacgccaccgtatcgtgttccttctaccg

SEQ ID NO: 277602 - DNA, 499 bp, Homo sapiens
  misc_feature: GYAE6OF02GZ780.29.35.D02.1.454.CMB.1.raw
  modified_base (496)..(496): a, c, t, g, unknown or other
  misc_feature (496)..(496): n is a, c, g, or t
tcagatagagtactcacgaccggtgctcgatttagcacacgatagttgggtttggggaggaactgctcagttaggacccagacggaaccatggaagccccagctcagcttctcttcctcctgctactctggctcccagataccagcggagagattgtgttgacacagtctccagccaccctgtctttgtctccgggagaaagagccaccctctcctgcagggccagtcagagtgttaacaactacttggcctggttccaacagaaacctggccaggctcccaggctcctcatctatgatgcatccaacagggccactggcatcccagccaggttcagtggcagtgggtctgggacagacttcactctcaccatcagccgcctagagcctgaggattctgccgtttattattgtcttggcgtagcaactgcctcccgtctactttggccgagggaccagctggagatcagacgaactgtggctgcacatctgtcttntac

SEQ ID NO: 277603 - DNA, 572 bp, Homo sapiens
  misc_feature: GYAE6OF02HBOYB.29.35.D02.1.454.CMB.1.raw
  modified_base (199)..(199): a, c, t, g, unknown or other
  misc_feature (199)..(199): n is a, c, g, or t
  modified_base (204)..(204): a, c, t, g, unknown or other
  misc_feature (204)..(204): n is a, c, g, or t
  modified_base (212)..(212): a, c, t, g, unknown or other
  misc_feature (212)..(212): n is a, c, g, or t
  modified_base (263)..(263): a, c, t, g, unknown or other
  misc_feature (263)..(263): n is a, c, g, or t
tcagatagagtactcacgaccggtgctcgatttagcacacgataggttagggtttgggggaggaactgctcagttacggacccagacggaaccatggaagccccagctcagcttctcttcctcctgctactctggctcccagataccagcggagagattgtgttgacacagtctccagccacctgtctttgctcggganaaagngccacctntcctgcagggccagtcagagtgttaaacaactacttggccttggttccaanagaaacctggaccaggctccaggctcctcatctatgatgcatccaacagggccactggcatcccagccaggttcaggtgcaggtgggtctgggacaggacttcactctacaccactcacgccgctagacgccgtggagtacttacgtcgtccgttttatttagttgttcgtttgggtcgttagctaacgtcggccttcccgtctaccgttttggccgtacggggtaccaacgccgtaggagtactcgacggaacgtaacgttgggtcggtcgtcgacctacctattaccgttcgtttccgttactaccc

SEQ ID NO: 277604 - DNA, 522 bp, Homo sapiens
  misc_feature: GYAE6OF02F5NDG.29.35.D02.1.454.CMB.1.raw
tcagatagagtactcacgaccggtgctcgatttagcacacgatagttgggtttggggaggaactgctcagttaggacccagacggaaccatggaagccccagctcagcttctcttcctcctgctactctggctcccagataccagcggagagattgtgttgacacagtctccagccaccctgtctttgtctccgggagaaagagccaccctctcctgcagggccagtcagagtgttaacaactacttggcctggttccaacagaaacctggccaggctcccaggctcctcatctatgatgcatccaacagggccactggcatcccagccaggttcagtggcagtgggtctgggacagacttcactctcaccatcacgccgcctagacgcctggaggattctgtccgtttattattgttcgttgggtcgtagcaacgtcggcctcccgtctcgtttcggccgtacgggaccagcgtggagactcgagacgaacgtggtggctcgcaccactctcgtcttctac

SEQ ID NO: 277605 - DNA, 517 bp, Homo sapiens
  misc_feature: GYAE6OF02GVJBY.29.35.D02.1.454.CMB.1.raw
tcagatagagtactcacgaccggtgctcgatttagcacacgatagttgggtttgggggaggaactgctcagttaggacccagacggaaccatggaagccccagctcagcttctcttcctcctgctactctggctcccagataccagcggagagattgtgttgacacagtctccagccaccctgtctttgtctccgggagaaagagccaccctctcctgcagggccagtcagagtgttaacaactacttggcctggttccaacagaaacctggccaggctcccaggctcctcatctatgatgcatccaacagggccactggcatcccagccaggttcagtggcagtgggtctgggacagacttcactctcaccatcagccgcctagacgcctgaggattctgtccgtttattattgttcgttgggcgttagctaacgtcggcctcccgtctacgtttcggcctaggggaccaagcgtggagatcgagacgaacgtgtggctgcacatctgtcttctac

SEQ ID NO: 277606 - DNA, 516 bp, Homo sapiens
  misc_feature: GYAE6OF02F48A4.29.35.D02.1.454.CMB.1.raw
  modified_base (310)..(310): a, c, t, g, unknown or other
  misc_feature (310)..(310): n is a, c, g, or t
tcagatagagtactcacgaccggtgctcgatttagcacacgatagttgggtttgggggaggaactgctcagttaggacccagacggaaccatggaagccccagctcagcttctcttcctcctgctactctggctcccagataccagcggagagattgtgttgacacagtctccagccaccctgtctttgtctccgggagaaagagccaccctctcctgcagggccagtcagagtattaacaactacttggcctggttccaacagaaacctggccaggctcccaggctcctcatctatgatgcatccaacngggccactggcatcccagccaggttcagtggcagtgggtctgggacagacttcactctcaccatcagccgcctagacgcctgaggattctgtccgtttattattgtcgttgggcgtagcaacgtggcctccgtctacgtttggccgtaggggaccaagcgtggagtatcaggacgaacgtggtggctgcaccatctcgttctctac

SEQ ID NO: 277607 - DNA, 583 bp, Homo sapiens
  misc_feature: GYAE6OF02HTM01.29.35.D02.1.454.CMB.1.raw
  modified_base (199)..(199): a, c, t, g, unknown or other
  misc_feature (199)..(199): n is a, c, g, or t
  modified_base (204)..(204): a, c, t, g, unknown or other
  misc_feature (204)..(204): n is a, c, g, or t
  modified_base (310)..(310): a, c, t, g, unknown or other
  misc_feature (310)..(310): n is a, c, g, or t
  modified_base (350)..(350): a, c, t, g, unknown or other
  misc_feature (350)..(350): n is a, c, g, or t
tcagatagagtactcacgaccggtgctcgatttagcacacgatagttgggtttgggggaggaactgctcagttaggacccagacggaaccatggaagccccagctcagcttctcttcctcctgctactctggctcccagataccagcggagagattgtgttgacacagtctccagccaccctgtctttgtctccggganaaagngccacccgtctcctgcagggccagtcagagtgttaacaactcttggcctggttccaacagaaacctggaccaggctcccaggctcctcatctatgatgcatccaanagggccacgtggcatcccagccaggtcagtgcagtggtcngggacagacttcactctcacatcacgccgcctagacgccctgaggacttcgtgtccgtttattagtttgtcgttgggtccgtagtctaacgttcggtaccctcccgttacgtaccgttttcggacccgtaacggggtaccctaaggcgttagggacgtacgtacgacggtaaccggtaaccgttggtggtaccgtcggaccgaccgtaacgttcgtcgttccgtttactaccg

SEQ ID NO: 277608 - DNA, 515 bp, Homo sapiens
  misc_feature: GYAE6OF02GDSX8.29.35.D02.1.454.CMB.1.raw
tcagatagagtactcacgaccggtgctcgatttagcacacgatagttgggtttgggggaggaactgctcagttaggacccagacggaaccatggaagccccagctcagcttctcttcctcctgctactctggctcccagataccagcggagagattgtgttgacacagtctccagccaccctgtctttgtctccgggagaaagagccaccctctcctgcagggccagtcagagtgttaacaactacttggcctggttccaacagaaacctggccaggctcccaggctcctcatctatgatgcatccaacagggccactggcatcccagccaggttcagtggcagtgggtctgggacagacttcactctcaccatcagccgcctagacgcctgaggattctgtccgtttattattgtcttgggcgtagcaacgtcggcctcccgtctacgttttcggccgtaggggaccaagcgtggagatcgacgaacgaactggtgctgcacatctgtctctac

SEQ ID NO: 277609 - DNA, 563 bp, Homo sapiens
  misc_feature: GYAE6OF02JGTL2.29.35.D02.1.454.CMB.1.raw
  modified_base (204)..(204): a, c, t, g, unknown or other
  misc_feature (204)..(204): n is a, c, g, or t
  modified_base (262)..(262): a, c, t, g, unknown or other
  misc_feature (262)..(262): n is a, c, g, or t
  modified_base (284)..(284): a, c, t, g, unknown or other
  misc_feature (284)..(284): n is a, c, g, or t
tcagatagagtactcacgaccggtgctcgatttagcacacgatagttgggtttgggggaggaactgctcagttaggacccagacggaaccatggaagccccagctcagcttctcttcctcctgctactctggctcccagataccagcggagagattgtgttgacacagtctccagccaccctgtctttgtctccgggagaaagngccaccctctcctgcagggccaggtcagagtgttaacaactacttggcctggtccaanagaaacctgccagctccgaccnggctcctcatctatgatgcatccgaacaggccactggcactcccagccaggttcacgtaggcgagtgggactgggacagactcactctcaccatcacgcgactagacgcgtgacggattcgtagtcgtttattagttgtcgttcggtcgtagtcgtaacgttcggtaccgttaccgttcgtaccgtttcggtaccgaacgggtaccgaaggacgtacgtacgacgtacgaacggtacggtaacgtcgtacggacgtcgtacacctacgtctcgtacttc

SEQ ID NO: 277610 - DNA, 525 bp, Homo sapiens
  misc_feature: GYAE6OF02HOO5Z.29.35.D02.1.454.CMB.1.raw
tcagatagagtactcacgaccggtgctcgatttagcacacgatagttgggtttggggaggaactgctcagttaggacccagacggaaccatggaagccccagctcagcttctcttcctcctgctactctggctcccagataccagcggagagattgtgttgacacagtctccagccaccctgtctttgtctccgggagaaagagccaccctctcctgcagggccagtcagagtgttaacaactacttggcctggttccaacagaaacctggccaggctcccaggctcctcatctatgatgcatccaacagggccactggcatcccagccaggttcagtgcagtggtctgggacagacttcactctcaccatcagccgcctagacgctgagattctgtccgtttattattgttcgttggtcgtagctaacgtcggccctcccgtcgtaccgttttcggccgtacggggaccaacgcgtaggagtatcgacgacgaacgtgtggcgtgcaccatctcgttcttctac

SEQ ID NO: 277611 - DNA, 518 bp, Homo sapiens
  misc_feature: GYAE6OF02GED9H.29.35.D02.1.454.CMB.1.raw
tcagatagagtactcacgaccggtgctcgatttagcacacgatagttgggtttgggggaggaactgctcagttaggacccagacggaaccatggaagccccagctcagcttctcttcctcctgctactctggctcccagataccagcggagagattgtgttgacacagtctccagccaccctgtctttgtctccgggagaaagagccaccctctcctgcagggccagtcagagtgttaacaactacttggcctggttccaacagaaacctggccaggctcccaggctcctcatctatgatgcatccaacagggccactggcatcccagccaggttcagtggcagtgggtctgggacagacttcactctcaccatcagccgcctagacgcctgaggattctgtccgttattattgtcttgggcgtagctaactcggcctcccgtctacgtttggccgtaggggaccaagcgtaggagtagtcaggacgaacgtgtcggctgcaccatctcgtcttctac

SEQ ID NO: 277612 - DNA, 503 bp, Homo sapiens
  misc_feature: GYAE6OF02GLQX9.29.35.D02.1.454.CMB.1.raw
  modified_base (500)..(500): a, c, t, g, unknown or other
  misc_feature (500)..(500): n is a, c, g, or t
tcagatagagtactcacgaccggtgctcgatttagcacacgatagttgggtttgggggaggaactgctcagttaggacccagacggaaccatggaagccccagctcagcttctcttcctcctgctactctggctcccagataccagcggagagattgtgttgacacagtctccagccaccctgtctttgtctccgggagaaagagccaccctctcctgcagggccagtcagagtgttaacaactacttggcctggttccaacagaaacctggccaggctcccaggctcctcatctatgatgcatccaacagggccactggcatcccagccaggttcagtggcagtgggtctggggacagacttcactctcaccatcagccgcctagagcctgagattctgccgtttattattgtcttgggcgtagcaactggcctcccgtctactttggccaggggaccaagctggagatcagacgaactgtggctgcacatctgtcttntac

SEQ ID NO: 277613 - DNA, 538 bp, Homo sapiens
  misc_feature: GYAE6OF02HHTDT.29.35.D02.1.454.CMB.1.raw
tcagatagagtactcacgaccggtgctcgatttagcacacgatagttgggtttggggaggaactgctcagttaggacccagacggaaccatggaagccccagctcagcttctcttcctcctgctactctggctcccagataccagcggagagattgtgttgacacagtctccagccaccctgtctttgtctccgggagaaagagcccaccctctcctgcagggccagtcagagtgttaaacaactacttggcctggttccaacagaaacctggccaggctcccaggctcctcatctatgatgcatccaacagggccactggcatcccagccaggttcagtgcagtgggtctgggacagacttcactctcaccatcagccgcctagacgcctgagtattctgtccgtttattagttgttcgttggtcgtagtcaacgtcggtcctcccgtctacgtttcggccgtacgggaccgtaagcgtagggacgtagtacgacggaacgaacgtggtggctgacaccgattctgttccttctacc

SEQ ID NO: 277614 - DNA, 573 bp, Homo sapiens
  misc_feature: GYAE6OF02I9LFU.29.35.D02.1.454.CMB.1.raw
  modified_base (300)..(300): a, c, t, g, unknown or other
  misc_feature (300)..(300): n is a, c, g, or t
  modified_base (388)..(388): a, c, t, g, unknown or other
  misc_feature (388)..(388): n is a, c, g, or t
tcagatagagtactcacgaccggtgctcgatttagcacacgatagttgggtttgggggaggaactgctcagttaggacccagacggaaccatggaagccccagctcagcttctcttcctcctgctactctggctcccagataccagcggagagattgtgttgacacagtctccagccacctgtctttgtctccggggagaaagagcccaccctctcctgcagggccagtcagagtgttaaacaacttacttggccttggttcccaacagaaacctggaccaggcctcccaggcctccctnatctatgatgccatccaacgagggccacgtggcactcccagccaggttcagtggcagtgggctgggacagtacttcatctcactatcngccgcctagacgtcctgagtactttcgtgtccgttttattagtttgttcgtttcgggtcgtacgctaacgtcggtcctccgttcgtacgtttcggccgtacgggaccaagcgtaggagtacgtacgaggaacgtaacgtggtcggacgttacggcctaaccgtacttcgtacgttccttactacc

SEQ ID NO: 277615 - DNA, 502 bp, Homo sapiens
  misc_feature: GYAE6OF02GVEKR.29.35.D02.1.454.CMB.1.raw
  modified_base (203)..(203): a, c, t, g, unknown or other
  misc_feature (203)..(203): n is a, c, g, or t
  modified_base (499)..(499): a, c, t, g, unknown or other
  misc_feature (499)..(499): n is a, c, g, or t
tcagatagagtactcacgaccggtgctcgatttagcacacgatagttgggtttggggaggaactgctcagttaggacccagacggaaccatggaagccccagctcagcttctcttcctcctgctactctggctcccagataccagcggagagattgtgttgacacagtctccagccaccctgtctttgtctccgggagaaagngccaccctctcctgcagggccagtcagagtgttaacaactacttggcctggttccaacagaaacctggccaggctcccaggctcctcatctatgatgcatccaacagggccactggcatcccagccaggttcagtggcagtgggtctgggacagacttcactctcaccatcagccgcctagacgcctgaggattctgccgtttattattgtcttgggcgtagcaactggcctccgtcactttggccgagggaccaagctggagatcagacgaactgtggctgcaccatctgtcttntac

SEQ ID NO: 277616 - DNA, 513 bp, Homo sapiens
  misc_feature: GYAE6OF02FOZI5.29.35.D02.1.454.CMB.1.raw
tcagatagagtactcacgaccggtgctcgatttagcacacgatagttgggtttgggggaggaactgctcagttaggacccagacggaaccatggaagccccagctcagcttctcttcctcctgctactctggctcccagataccagcggagagattgtgttgacacagtctccagccaccctgtctttgtctccgggagaaagagccaccctctcctgcagggccagtcagagtgttaacaactacttggcctggttccaacagaaacctggccaggctcccaggctcctcatctatgatgcatccaacagggccactggcatcccagccaggttcagtggcagtgggtctgggacagacttcactctcaccatcagccgcctagacgcctgaggtattctcgtccgtttattattgttcttgggtcgtagctaactgcctccgtctacgtttcggccgtacgggaccaagcgtggagatcgagacgaactgtgctgcacgatctgtctctac

SEQ ID NO: 277617 - DNA, 544 bp, Homo sapiens
  misc_feature: GYAE6OF02HZAJ7.29.35.D02.1.454.CMB.1.raw
tcagatagagtactcacgaccggtgctcgatttagcacacgatagttgggtttggggaggaactgctcagttaggacccagacggaaccatggaagccccagctcagcttctcttcctcctgctactctggctcccagataccagcggagagattgtgttgacacagtctccagccaccctgtctttgtctccgggagaaagagccaccctctcctgcagggccagtcagagtgttaacaactacttggcctggttccaacagaaacctggccaggctcccaggctctcatctatgatgcatccaacagggccactggcatcccagccaggttcagtggcagtgggtctgggacaggacttcactctcaccatcagccgcctagcgcctgaggattctgtccgttttattatttgttcgttgggcgttagcaacgttcggcccttcccgtctaccgttttcggcccgaggggtcccaaagccgtgggagtatacgacggaacggtaactggtacggcgtgccaccgtatcgtgttccttctacg

SEQ ID NO: 277618 - DNA, 528 bp, Homo sapiens
  misc_feature: GYAE6OF02G606B.29.35.D02.1.454.CMB.1.raw
  modified_base (525)..(525): a, c, t, g, unknown or other
  misc_feature (525)..(525): n is a, c, g, or t
tcagatagagtactcacgaccggtgctcgatttagcacacgatagttgggtttggggaggaactgctcagttaggacccagacggaaccatggaagccccagctcagcttctcttcctcctgctactctggctcccagataccagcggagagattgtgttgacacagtctccagccaccctgtctttgtctccgggagaaagagccaccctctcctgcagggccagtcagagtgttaacaactacttggcctggttccaacagaaacctggccaggctcccaggctcctcatctatgatgcatccaacagggccactggcatcccagccaggttcagtggcagtggtctgggacagacttcactctcaccatcacgccgcctagacgcctgacggattcgtgtccgtttattattgttcttgggtcgtagctaacgtcggtcctcccgtctacgttttcggccgtacggggaccaagcgtggacgatcgacgacgtaactggtggtctgcaccgatctcgtcttntac

SEQ ID NO: 277619 - DNA, 584 bp, Homo sapiens
  misc_feature: GYAE6OF02GW3WQ.29.35.D02.1.454.CMB.1.raw
tcagatagagtactcacgaccggtgctcgatttagcacacgatagttgggtttgggggaggaactgctcagttaggacccagacggaaccatggaagccccagctcagcttctcttcctcctgctactctggctcccagataccagcggagagattgtgttgacacagtctccagccaccctgtctttgtctccgggagaaagagccaccctctcctgcagggccagtcagagtgttaacaactacttggcctggttccaacagaaacctggccaggctccaggctcctcatctatgatgcatccaacagggccacgtggcactcccacgccgaggttcaggtcggcgaggtgggtcgtggggacacggtacttcacctctcaccactcacgccgcctagacgcctggagtattctgtccgtttattattcgttcgtttgggtcgtagtctaacgtcggccctcccgtcttacgttttcggaccgtacggggacccaaggcgtagggagtacgtcgacggaaccgtaaacttcgggtcggtaccgtcggactacccgtattcccgtcgttccgttacttacccg

SEQ ID NO: 277620 - DNA, 504 bp, Homo sapiens
  misc_feature: GYAE6OF02GKGQH.29.35.D02.1.454.CMB.1.raw
  modified_base (373)..(373): a, c, t, g, unknown or other
  misc_feature (373)..(373): n is a, c, g, or t
  modified_base (501)..(501): a, c, t, g, unknown or other
  misc_feature (501)..(501): n is a, c, g, or t
tcagatagagtactcacgaccggtgctcgatttagcacacgatagttgggtttgggggaggaactgctcagttaggacccagacggaaccatggaagccccagctcagcttctcttcctcctgctactctggctcccagataccagcggagagattgtgttgacacagtctccagccaccctgtctttgtctccgggagaaagagccaccctctcctgcagggccagtcagagtgttaacaactacttggcctggttccaacagaaacctggccaggctcccaggctcctcatctatgatgcatccaacagggccactggcatcccagccaggttcagtggcagtgggtctgggacagacttcactctcaccntcagccgcctacgagcctgaggattctgccgtttattattgtcttgggcgtagcaactgcctccgtctactttggcctaggggaccagcgtggagatcagacgaactgtggctgcaccatctgtcttntac

SEQ ID NO: 277621 - DNA, 521 bp, Homo sapiens
  misc_feature: GYAE6OF02H0CEZ.29.35.D02.1.454.CMB.1.raw
  modified_base (513)..(513): a, c, t, g, unknown or other
  misc_feature (513)..(513): n is a, c, g, or t
tcagatagagtactcacgaccggtgctcgatttagcacacgatagttgggtttgggggaggaactgctcagttaggacccagacggaaccatggaagccccagctcagcttctcttcctcctgctactctggctcccagataccagcggagagattgtgttgacacagtctccagccaccctgtctttgtctccgggagaaagagccaccctctcctgcagggccagtcagagtgttaacaactacttggcctggttccaacagaaaacctggccaggctcccaggctcctcatctatgatgcatccaacagggccactggcatcccagccaggttcagtggcagtgggtctgggacaggacttcactcctcaccatcagccgcctagacgcctggaggattcgtgtccgttttattagttgttcgttgggtcgtagcaacgtcggcctccgtctacgtttcggccgagggccaagcgtaggagagtcagacgacgtgtgcgtgcacatcgtnttctctac

SEQ ID NO: 277622 - DNA, 506 bp, Homo sapiens
  misc_feature: GYAE6OF02HO15Z.29.35.D02.1.454.CMB.1.raw
tcagatagagtactcacgaccggtgctcgatttagcacacgatagttgggtttgggggaggaactgctcagttaggacccagacggaaccatggaagccccagctcagcttctcttcctcctgctactctggctcccagataccagcggagagattgtgttgacacagtctccagccaccctgtctttgtctccgggagaaagagccaccctctcctgcagggccagtcagagtgttaacaactacttggcctggttccaacagaaacctggccaggctcccaggctcctcatctatgatgcatccaacagggccactggcatcccagccaggttcagtggcagtgggtctgggacagacttcactctcaccatcagccgcctagagcctgaggattctgtccgtttattattgtcttgggtcgtagcaactggcctccgtctactttggcctaggggaccaagcgtggagatcagacgaactgtgctgcaccatctcgtctctac

SEQ ID NO: 277623 - DNA, 609 bp, Homo sapiens
  misc_feature: GYAE6OF02JVN7Z.29.35.D02.1.454.CMB.1.raw
  modified_base (357)..(357): a, c, t, g, unknown or other
  misc_feature (357)..(357): n is a, c, g, or t
tcagatagagtactcacgaccggtgctcgatttagcacacgatagttgggtttgggggaggaactgctcagttaggacccagacggaaccatggaagccccagctcagcttctcttcctcctgctactctggctcccagataccagcggagagattgtgttgacacagtctccagccaccctgtctttgtctccgggagaaagagccaccctctcctgcagggccagtcagagtgttaacaactacttggcctggttccaacagaaacctggccaggctcccaggctcctcatctatgatgcatccaacagggccatggcatccagccaggtcagtgcagtggctgggacagacttnactctcaccatcagccgcctagacgcctgaggacttcgtcgtaccgttttattactttcggttcgtttgggtcgttacgctaaaccgttgggtacccttcccggttacgtaaccgtttttcgggcccgtaacgggggtaccctaacggtccgtagggaacgtacgtaccgtaacggtaaccggtaaacgttcgggtacggtaccgttaggacccgtaaccgacgttaccgtcggttaccgttccgttaaccg

SEQ ID NO: 277624 - DNA, 586 bp, Homo sapiens
  misc_feature: GYAE6OF02JB9ZT.29.35.D02.1.454.CMB.1.raw
tcagatagagtactcacgaccggtgctcgatttagcacacgatagttgggtttggggaggaactgctcagttaggacccagacggaaccatggaagccccagctcagcttctcttcctcctgctactctggctcccagataccagcggagagattgtgttgacacagtctccagccaccctgtctttgtctccgggagaaagagccaccctctcctgcagggccagtcagagtgttaacaactacttggctggttccaacagaaacctggccaggctcccaggctcctcatctatgatgcatccaacacgggccactggcactcccagccaggttcagtggcagtgggtctggggacagacttcactctcaccatcacgcccgcctacgacgcctgacggtacttcgtcgtccgtttattagttagttcgttacgggtcgttagtacctaacgttcggcccttcccgttctaccgttttcggccgtacggggtaaccaacggtccgtacgggacgtacgtcgacggtaacggaacgttggtacggtctcggtacctaccgtacgttccgttcgttccttactaccg

SEQ ID NO: 277625 - DNA, 656 bp, Homo sapiens
  misc_feature: GYAE6OF02JTA5M.29.35.D02.1.454.CMB.1.raw
  modified_base (201)..(201): a, c, t, g, unknown or other
  misc_feature (201)..(201): n is a, c, g, or t
  modified_base (206)..(206): a, c, t, g, unknown or other
  misc_feature (206)..(206): n is a, c, g, or t
  modified_base (215)..(215): a, c, t, g, unknown or other
  misc_feature (215)..(215): n is a, c, g, or t
  modified_base (234)..(234): a, c, t, g, unknown or other
  misc_feature (234)..(234): n is a, c, g, or t
  modified_base (262)..(262): a, c, t, g, unknown or other
  misc_feature (262)..(262): n is a, c, g, or t
  modified_base (307)..(307): a, c, t, g, unknown or other
  misc_feature (307)..(307): n is a, c, g, or t
  modified_base (350)..(350): a, c, t, g, unknown or other
  misc_feature (350)..(350): n is a, c, g, or t
tcagatagagtactcacgaccggtgctcgatttagcacacgatagttgggtttgggggagggaacgtgctcagttaggacccagacggaaccatggaagccccagctcagcttctcttcctcctgctactctggctcccagataccagcggagagattgtgttgacacagtctccagccaccctgtctttgtctccggganaaagngccaccctntcctgcagggccagtcagngtgttaacactacttggctggttccaanagaacctggccaggctccaggctctcatctatgatgcatccaacncggccagtggcactcccagccaagttcagtggcaggtgggtcngggacacggtacttcactctaccgaccagtcccagcccgacgtacgacgtccgtaggacgtacgttcgttacgtacccgtttttaatacgtttcggtttccgtttacggggtaccgttaacggtaccgtaacgttccgggtacccgttccccggttaccgttaccgtttttccgggacccgtaacgggggtaaccctaacgggtccgttagggtacgtacgtaccgaacgggtaaccgtaacggttggtaccggtacgtaccggtaccgaaccgtaccgtttcgttccggttacctttaccgtacg

SEQ ID NO: 277626 - DNA, 510 bp, Homo sapiens
  misc_feature: GYAE6OF02HURMM.29.35.D02.1.454.CMB.1.raw
  modified_base (507)..(507): a, c, t, g, unknown or other
  misc_feature (507)..(507): n is a, c, g, or t
tcagatagagtactcacgaccggtgctcgatttagcacacgatagttgggtttgggggaggaactgctcagttaggacccagacggaaccatggaagccccagctcagcttctcttcctcctgctactctggctcccagataccagcggagagattgtgttgacacagtctccagccaccctgtctttgtctccgggagaaagagccaccctctcctgcagggccagtcagagtgttaacaactacttggcctggttccaacagaaacctggccaggctcccaggctcctcatctatgatgcatccaacagggccactggcatcccagccaggttcagtggcagtgggtctgggacagacttcactctcaccatcagccgcctagacgcctgaggattctgtccgtttattattgtcttgggtcgtagcaactggcctcccgtctacgtttggccaggggaccaagcgtggagatcacggacgaactgtggctgcacatctgttctntac

SEQ ID NO: 277627 - DNA, 538 bp, Homo sapiens
  misc_feature: GYAE6OF02I07RM.29.35.D02.1.454.CMB.1.raw
tcagatagagtactcacgaccggtgctcgatttagcacacgatagttgggtttggggaggaactgctcagttaggacccagacggaaccatggaagccccagctcagcttctcttcctcctgctactctggctcccagataccagcggagagattgtgttgacacagtctccagccaccctgtctttgtctccgggagaaagagccaccctctcctgcagggccagtcagagtgttaacaactacttggcctggttccaacagaaacctggccaggctcccaggctcctcatctatgatgcatccaacagggccactggcactcccagccaggttcagtcggcaggtgggtctgggacagacttcactctcaccatcagccgcctagagcctgacgattctcgtccgttttattagttgttcgttgggtcgttagctaacgtcggccctcccgtctacgtttcggccgtacgggacctaagcgtaggagtagtacgagacgaacgtggtcgtcgtgacctaccagtctgtcttctacg

SEQ ID NO: 277628 - DNA, 497 bp, Homo sapiens
  misc_feature: GYAE6OF02F21AG.29.35.D02.1.454.CMB.1.raw
  modified_base (494)..(494): a, c, t, g, unknown or other
  misc_feature (494)..(494): n is a, c, g, or t
tcagatagagtactcacgaccggtgctcgatttagcacacgatagttgggtttggggaggaactgctcagttaggacccagacggaaccatggaagccccagctcagcttctcttcctcctgctactctggctcccagataccagcggagagattgtgttgacacagtctccagccaccctgtctttgtctccgggagaaagagccaccctctcctgcagggccagtcagagtgttaacaactacttggcctggttccaacagaaacctggccaggctcccaggctcctcatctatgatgcatccaacagggccactggcatcccagccaggttcagtggcagtgggtctgggacagacttcactctcaccatcagccgcctagagcctgaggattctgccgtttattattgtcttgggcgtagcaactgcctccgtctactttggccaggggaccaaggctgagatcagcgaactgtgctgcacatctgtctntac

SEQ ID NO: 277629 - DNA, 532 bp, Homo sapiens
  misc_feature: GYAE6OF02HI4LH.29.35.D02.1.454.CMB.1.raw
  modified_base (203)..(203): a, c, t, g, unknown or other
  misc_feature (203)..(203): n is a, c, g, or t
  modified_base (261)..(261): a, c, t, g, unknown or other
  misc_feature (261)..(261): n is a, c, g, or t
  modified_base (363)..(363): a, c, t, g, unknown or other
  misc_feature (363)..(363): n is a, c, g, or t
tcagatagagtactcacgaccggtgctcgatttagcacacgatagttgggtttggggaggaactgctcagttaggacccagacggaaccatggaagccccagctcagcttctcttcctcctgctactctggctcccagataccagcggagagattgtgttgacacagtctccagccaccctgtctttgtctccgggagaaagngccaccctctcctgcagggccagtcagagtgttaacaactacttggcctggttccaanagaaacctggccaggctccaggctcctcatctatgatgcatccaacaggccactggcatcccagccaggtcagtgcagtgggtctgggacagacttcactcncacatcacgccgctagcgcctgaggattctgtccgtttattattgttcgttgggcgtagctaacgtcggcctccgtcctacgtttcggccgtacggggacctaggcgtggagacgtcgaggaacgaacgtggtcggtctgccaccgtatccgtacgttccttactaccg

SEQ ID NO: 277630 - DNA, 509 bp, Homo sapiens
  misc_feature: GYAE6OF02JHA36.29.35.D02.1.454.CMB.1.raw
  modified_base (380)..(380): a, c, t, g, unknown or other
  misc_feature (380)..(380): n is a, c, g, or t
  modified_base (506)..(506): a, c, t, g, unknown or other
  misc_feature (506)..(506): n is a, c, g, or t
tcagatagagtactcacgaccggtgctcgatttagcacacgatagttgggtttgggggaggaactgctcagttaggacccagacggaaccatggaagccccagctcagcttctcttcctcctgctactctggctcccagataccagcggagagattgtgttgacacagtctccagccaccctgtctttgtctccgggagaaagagccaccctctcctgcagggccagtcagagtgttaacaactacttggcctggttccaacagaaacctggccaggctcccaggctcctcatctatgatgcatccaacagggccactggcatcccagccaggttcagtggcagtgggtctgggacagacttcactctcaccatcagccncctagagccctgagattctgtccgtttattattgtcttgggcgtagcaacgtggcctcccgtctacgtttcggccgtacgggaccaagctggacgatcgagacgactggtgctgcacatctgtctntac

SEQ ID NO: 277631 - DNA, 273 bp, Homo sapiens
  misc_feature: GYAE6OF02IDVPB.29.35.D02.1.454.CMB.1.raw
  modified_base (259)..(273): a, c, t, g, unknown or other
  misc_feature (259)..(273): n is a, c, g, or t
tcagatagagtactcacgaccggtgctcgatttagcacacgatagttgggtttggggacagacttcactctcaccatcagccgcctagagcctgaggattctgccgtttattattgtcttgggcgtagcaactggcctcccgtcacttttggccaggggaccaagctggacgatcagacgaactgtggctgcaccatctgtcttcatcttcccgccatctgaagtactctaatctgagcgggctggcaaggcgcatagnnnnnnnnnnnnnnn

SEQ ID NO: 277632 - DNA, 855 bp, Homo sapiens
  misc_feature: GYAE6OF02IBOA4.29.35.D02.1.454.CMB.1.raw
  modified_base (192)..(192): a, c, t, g, unknown or other
  misc_feature (192)..(192): n is a, c, g, or t
  modified_base (206)..(206): a, c, t, g, unknown or other
  misc_feature (206)..(206): n is a, c, g, or t
tcagatagagtactcacgaccggtgctcgatttagcacacgatagttgggtttggggagaactgctcagttaggacccagacggaaccatggaagccccagctcagcttctcttcctcctgctactctggctccagataccagcggagagattgtgttgacacagtctcagccacctgtctttgctcggganaaagcgccacctcnctgcagggccagtcagagtattaaacaacttacgttggccttggttaccaaacagaaaacctggaccaggcctccaggctcctcatctaatgatgacactaccaaacgacgggtccaacgtcgggacactccccgaacgcccgtagggtttaccaagggttcggaccgtaaggggtttcgggggtacgttacgggggaaaccctaaggtaacccttttcaaacccttccgttaacccgaaaccctaactttacccgaaccggaccccggtacccgttaaacgggtaaccggtccccgttaaggggtaacgggttaacgttttccggttacggttacccgggttttttaatttttaacgttttacgggttttcggttttacggggggttaccggtttaacgggtacccgttaaaaccggttccggggttccccctttacccccgggtttacccgtttaacccggtttttttacccggggaccccgggtaaaccgggggggtaacccctaaaacgggtccggtttaacggggaacgtaccgttaaccggtaaacgggtaaacccggtaaacggttcggggtacgggtaccgttacgggtacccaaacccgttacgtttaccgtttacggtttccctttacgtttaaccccg

SEQ ID NO: 277633 - DNA, 536 bp, Homo sapiens
  misc_feature: GYAE6OF02H99H9.29.35.D02.1.454.CMB.1.raw
  modified_base (203)..(203): a, c, t, g, unknown or other
  misc_feature (203)..(203): n is a, c, g, or t
  modified_base (212)..(212): a, c, t, g, unknown or other
  misc_feature (212)..(212): n is a, c, g, or t
tcagatagagtactcacgaccggtgctcgatttagcacacgatagttgggtttgggggagaactgctcagttaggacccagacggaaccatggaagccccagctcagcttctcttcctcctgctactctggctcccagataccagcggagagattgtgttgacacagtctccagccaccctgtctttgtctccgggagaaagngccacctcncctgcagggccagtcagagtgttaaacaacttacttggcctggttccaacagaaacctggccaggctccaggctcctcatctatgatgcatccaacacgggccactggcatcccagccaggttcagtggcaggtcggctgggacagacttcactctcacctatccacgccgacctacgacgcctgaggtacttcgtcgtccgtttattagttgtttcgttggtcgtagcaacgtcgcctccgtctacgtttggcgacgggaccagcgtggagtacgtacacggaacgaacgtggtcggcgtgacaccattcgtcgtcttctacg

SEQ ID NO: 277634 - DNA, 524 bp, Homo sapiens
  misc_feature: GYAE6OF02IQGJW.29.35.D02.1.454.CMB.1.raw
  modified_base (507)..(507): a, c, t, g, unknown or other
  misc_feature (507)..(507): n is a, c, g, or t
  modified_base (516)..(516): a, c, t, g, unknown or other
  misc_feature (516)..(516): n is a, c, g, or t
tcagatagagtactcacgaccggtgctcgatttagcacacgatagttgggtttgggggaggaactgctcagttaggacccagacggaatcatggaagccccagctcagcttctcttcctcctgctactctggctcccagataccagcggagagattgtgttgacacagtctccagccaccctgtctttgtctccgggagaaagagcccaccctctcctgcagggccagtcagagtgttaacaactactggcctggttccaacagaaacctggccaggcctccaggcctctcatctatgatgcatccaacagggccactggccatcccagccaggttcagtgcagtgggtctgggacagacttcactctcaccatcacgcccgcctagacgcctgaggattcgtcgtccgttttatttacgtttgttcgttgggtcgtagctaacgtcggtcccttcccgtctacgttttcggccgtagggaccaagcgtgagagtcagacgacgtgngctcgcacntctgtctc

SEQ ID NO: 277635 - DNA, 618 bp, Homo sapiens
  misc_feature: GYAE6OF02HPVZJ.29.35.D02.1.454.CMB.1.raw
  modified_base (198)..(198): a, c, t, g, unknown or other
  misc_feature (198)..(198): n is a, c, g, or t
  modified_base (374)..(374): a, c, t, g, unknown or other
  misc_feature (374)..(374): n is a, c, g, or t
  modified_base (389)..(389): a, c, t, g, unknown or other
  misc_feature (389)..(389): n is a, c, g, or t
tcagatagagtactcacgaccggtgctcgatttagcacacgatagttgggtttgggggaggaactgctcagttaggacccagacggaaccatggaagccccagctcagcttctcttcctcctgctactctggctccagataccagcggagagattgtgttgacacagtctccagccaccctgtctttgtctccggganaaagagccaccctctcctgcagggccagtcagagtgttaaacaactacttggcctggttaccaacagaaacctggccaggcctcccaggctcctcatctatgatacatccaacacggccactggcatcccagccaggttcagtgcaggtgggtctgggacagacttcactctcacntcacgccgctagacnccgtgacgtattcgtcgtccgtttatttagtttgttcgtttcgggtacgttacgtacgtaacgtcggtacccgttcccgttaccgttaccggtttttacggacccggtaacggggtaccgtaaacggtcgtagggacgtacgtaccgaacggtaaccggtaacgtaggttacgggtaccgttacgtaccaccgtacgtccgttacggtttccttaccgtaccttccccg

SEQ ID NO: 277636 - DNA, 585 bp, Homo sapiens
  misc_feature: GYAE6OF02GSVK7.29.35.D02.1.454.CMB.1.raw
tcagatagagtactcacgaccggtgctcgatttagcacacgatagttgggtttggggaggaactgctcagttaggacccagacggaaccatggaagccccagctcagcttctcttcctcctgctactctggctcccagataccagcggagagattgtgttgacacagtctccagccaccctgtctttgtctccgggagaaagagccaccctctcctgcagggccagtcagagtgttaaacaactacttggcctggttccaacagaaacctggccaggctcccgggctcctcatctatgatgcatccaacgacgggccactggcactcccagccaggttcaggtcggcaggtgggtctgggacagtacttcactctcaccatcacgcccgcctagacgccgtgacggtattcgtcgtaccgttttattagtttgttcgttgggtcgtacgtactacgtcggtcccttcccgtcttaccgttttcgggccgtacggggtaccaacgcgtaggagtacgtacgacggaccgtaacgtcggtcggtacgtcgacctacctacgttccgttcgttcttaccgacttcccg

SEQ ID NO: 277637 - DNA, 703 bp, Homo sapiens
  misc_feature: GYAE6OF02GFNM6.29.35.D02.1.454.CMB.1.raw
tcagatagagtactcacgaccggtgctcgatttagcacacgatagttgggtttggggagtaactgctcaggttaggacccaagacggaaccatggaagccccaggctacagccttctcttcctcctcgctactcctggcctcccagataccacgcggagacgattgtgttgacgaccaggtcctccagccaccctgtcctttgtctcccgggacgaaagagccaccctcggtcccctggccagggccgagtccaagtacgtcgttaaacaacctaattttgggacccttaggtttcccaaacagtaaaacccgtcggaccgtaaggctaccccaagggtcctaccctcgaatcctaatcgaacttcgacgactcccgaaaccagggcccactggacactcccaggaccaggttacacggtcggcagggtcggtctacgggactacggtaccttcgaccttctccgacctatccacgcccgaccgtacgacgtcccgtcgacggtacttaccgtcggtacccgtttacgttagtttcggtacgtttgggtacgtagcctaaacgtcggtccgtacccgtcgttaccgttttcggaccgtaccggggtacctaacgcgtacggtacgtacgttaccgaggtaccggtaacggttcgggtacggtaccgtaggtaccgaccgtacttcgtcgttccgtacgtaccg

SEQ ID NO: 277638 - DNA, 522 bp, Homo sapiens
  misc_feature: GYAE6OF02JF5JS.29.35.D02.1.454.CMB.1.raw
  modified_base (364)..(364): a, c, t, g, unknown or other
  misc_feature (364)..(364): n is a, c, g, or t
tcagatagagtactcacgaccggtgctcgatttagcacacgatagttgggtttgggggaggaactgctcagttaggacccagacggaaccatggaagccccagctcagcttctcttcctcctgctactctggctcccagataccagcggagagattgtgttgacacagtctccagccaccctgtctttgtctccgggagaaagagccaccctctcctgcagggccagtcagagtgttaacactacttggcctggttccaacagaaacctggccaggctccaggctcctcatctatgatgcatccaacagggccacgtggcatcccagccaggttcagtgcagtggctgggacagacttcactcncaccatcacgccgctagacgcctggaggtattctcgtccgtttattattgttcgttcgggcgtagtcaacgtcggcctcccgtctcgtttcggccgtacgggaccacgtcgtggagatcgagtacgtaacgtgtggcgtgcaccatctcgtcttctac

SEQ ID NO: 277639 - DNA, 574 bp, Homo sapiens
  misc_feature: GYAE6OF02FMZCW.29.35.D02.1.454.CMB.1.raw
tcagatagagtactcacgaccggtgctcgatttagcacacgatagttgggtttggggaggaactgctcagttaggacccagacggaaccatggaagccccagctcagcttctcttcctcctgctactctggctcccagataccagcggagagattgtgttgacacagtctccagccaccctgtctttgtctccgggagaaagagccaccctctcctgcagggccagtcagagtgtacactacttggcctggttccaacagaaacctggccaggcctcccaggcctcctcatctatgatgcatcaacagggccactggcatcccagccaggttcagtggcagtgggtctgggacagacttcactctcaccatcacgccgcctagacgcctggaggatttctgtccgtttaattatttgtcgtttgggtccgtagctaaccgttcgggtcccttccccgttcctaccgttttcgggacccgtaacgggggaacccaacggtcgtcgggagtacgtaccgacggtaaccggtaacgtcggtaggtccgtgccacccacgttcctcggttcttcctac

SEQ ID NO: 277640 - DNA, 560 bp, Homo sapiens
  misc_feature: GYAE6OF02GRNUV.29.35.D02.1.454.CMB.1.raw
tcagatagagtactcacgaccggtgctcgatttagcacacgatagttgggtttggggaggaactgctcagttaggacccagacggaaccatggaagccccagctcagcttctcttcctcctgctactctggctcccagataccagcggagagattgtgttgacacagtctccagccaccctgtctttgtctccgggagaaagagccaccctctcctgcagggccagtcagagtgttaaacaactacttggcctggttccaacagaaacctggccaggctcccaggctcctcatctatgatgcatcccaaacgacgggccacgtcggacactccccagcccaggttcagtcggcaggtggtctgggacagacttcactctacacctatcgacgccgcctagacgctgaggtattcgtgtcgttattattgtcgttggtcgtagtctaacgtcggcctccgtccgtacgtttcggcgtacgggaccaaggctaggacgtacgtacgacggtacggaacgttcggtcggtcgtcgccaccgtacttccgttgttccttctacc

SEQ ID NO: 277641 - DNA, 549 bp, Homo sapiens
  misc_feature: GYAE6OF02H0XFF.29.35.D02.1.454.CMB.1.raw
  modified_base (308)..(308): a, c, t, g, unknown or other
  misc_feature (308)..(308): n is a, c, g, or t
  modified_base (356)..(356): a, c, t, g, unknown or other
  misc_feature (356)..(356): n is a, c, g, or t
tcagatagagtactcacgaccggtgctcgatttagcacacgatagttgggtttgggggaggaactgctcagttaggacccagacggaaccatggaagccccagctcagcttctcttcctcctgctactctggctccagataccagcggagagattgtgttgacacagtctcagccacctgtctttgtctccgggagaaagagccaccctctcctgcagggccagtcagagtgttaaacaactacttggcctggttccaacagaaacctggccaggctcccaggctcctcatctatgatgcatccaacngggccactggcactcccagccaggttcagtggcagtgggtctgggacngacttcactctcaccatcacgccgcctacgacgcctgaggtattcgtcgtccgttttattattgttcgttgggtcgtagcaacgtcgccttcccgttctacgttttcggccgtaggggaccagtcgtgggagagtacaggaacgaacgttggtggtctcggccaccgtacttcgttcgttccttacttacccg

SEQ ID NO: 277642 - DNA, 523 bp, Homo sapiens
  misc_feature: GYAE6OF02G6P80.29.35.D02.1.454.CMB.1.raw
tcagatagagtactcacgaccggtgctcgatttagcacacgatagttgggtttgggggaggaactgctcagttaggacccagacggaaccatggaagccccagctcagcttctcttcctcctgctactctggctcccagataccagcggagagattgtgttgacacagtctccagccaccctgtctttgtctccgggagaaagagccaccctctcctgcagggccagtcagagtgttaacaactacttggcctggttccaacagaaacctggccaggctcccaggctcctcatctatgatgcatccaacagggccactggcatcccagccaggttcagtggcagtgggtctgggacagacttcactctcaccatcacgccgcctagacgcctggaggattctgtccgtttattattgttcttgggtcgtagcaactcggtcctcccgtctacgttttcggccgtacggggaccaagcgtggagatcgagacgaactgtggctgcaccatcgtgttcttctacg

SEQ ID NO: 277643 - DNA, 650 bp, Homo sapiens
  misc_feature: GYAE6OF02J2R8L.29.35.D02.1.454.CMB.1.raw
  modified_base (205)..(205): a, c, t, g, unknown or other
  misc_feature (205)..(205): n is a, c, g, or t
  modified_base (290)..(290): a, c, t, g, unknown or other
  misc_feature (290)..(290): n is a, c, g, or t
  modified_base (626)..(626): a, c, t, g, unknown or other
  misc_feature (626)..(626): n is a, c, g, or t
tcagatagagtactcacgaccggtgctcgatttagcacacgatagttgggtttgggggaggaactgctcagttaggacccagacggaaccatggaagccccagctcagcttctcttcctcctgctactctggctcccagataccagcggagagattgtgttgacacagtctccagcccaccctgtctttgtctccgggagaaagngccaccctctcctgcagggccagtcagagtgttaacactacttggcctggttccaacagaaacctggccaggctccaggctcctnatctatcgatgcatccaacagggccacgtggcactcccgaagccgtaggttcaggtggctaggtgggtctgggactaggaccttcgactcctacaccgtatccgacgcccgtccgtaacgacgcccgttggaacggtacgtttcgtacggttacccgttttagtttacgtttcggtttcggtttacggggccgtttaacgccgtaaccgttcgggtcccctttacccggttacgtttaccgttttacgggcccgtaaggggtaccctaaacggtccgttaggtacgacgttacgacgggtaaccgtaagttcggtcggtcctcggacctaaccgtnttaccgtcgttcttaccgttaccg

SEQ ID NO: 277644 - DNA, 549 bp, Homo sapiens
  misc_feature: GYAE6OF02I964O.29.35.D02.1.454.CMB.1.raw
  modified_base (537)..(537): a, c, t, g, unknown or other
  misc_feature (537)..(537): n is a, c, g, or t
  modified_base (546)..(546): a, c, t, g, unknown or other
  misc_feature (546)..(546): n is a, c, g, or t
tcagatagagtactcacgaccggtgctcgatttagcacacgatagttgggtttgggggaggaactgctcagttaggacccagacggaaccatggaagccccagctcagcttctcttcctcctgctactctggctcccagataccagcggagagattgtgttgacacagtctccagccaccctgtctttgtctccgggagaaagagccaccctctcctgcagggccagtcagagtgttaacaactacttggcctggttccaacagaaacctggccaggctccccaggctcctcatctatgatgcatccaacacgggccactggcatcccagccaggttcagtggcagtgggtctgggacagacttcactctcacctatcacgccgcctagacgcctggacggtattcgtcgtccgttttatttagtttcgttcgttgggtcgtagtccgtaacgtcggcccttcccgtccgtacgttttcggccgtacggggaccaacggtcgtaggagactcgacgacgaactggtcgctgcacctntctgtcttntac

SEQ ID NO: 277645 - DNA, 509 bp, Homo sapiens
  misc_feature: GYAE6OF02GQKL3.29.35.D02.1.454.CMB.1.raw
  modified_base (262)..(262): a, c, t, g, unknown or other
  misc_feature (262)..(262): n is a, c, g, or t
tcagatagagtactcacgaccggtgctcgatttagcacacgatagttgggtttgggggaggaactgctcagttaggacccagacggaaccatggaagccccagctcagcttctcttcctcctgctactctggctcccagataccagcggagagattgtgttgacacagtctccagccaccctgtctttgtctccgggagaaagagccaccctctcctgcagggccagtcagagtgttaacaactacttggcctggttccaanagaaacctggccaggctcccaggctcctcatctatgatgcatccaacagggccactggcatcccagccaggttcagtggcagtgggtctgggacagacttcactctcaccatcagccgcctagagcctgaggattctgtccgtttattattgtcgttgggcgtagcaactggcctcccgtctacttttggccgaggggaccaagctggagatcagacgaactggtggctgcaccatctgtcttctac

SEQ ID NO: 277646 - DNA, 557 bp, Homo sapiens
  misc_feature: GYAE6OF02I0JUB.29.35.D02.1.454.CMB.1.raw
  modified_base (377)..(377): a, c, t, g, unknown or other
  misc_feature (377)..(377): n is a, c, g, or t
tcagatagagtactcacgaccggtgctcgatttagcacacgatagttgggtttgggggaggaactgctcagttaggacccagacggaaccatggaagccccagctcagcttctcttcctcctgctactctggctcccagataccagcggagagattgtgttgacacagtctccagccaccctgtctttgtctcgggagaaagagccaccctctcctgcagggccagtcagagtgttaacaactacttggcctggttccaacagaaacctggccaggcctcccaggcctcctcatctatgatgcatccaacgagggccactggcactcccagccaggttcagtggcaggtggtctgggacagtacttcactctcaccntcgacgccgcctagacgccgtagaggtattctgtccgtttattattgttcgttggtcgtagcctaacgtcggtcccttcccgttctaccgttttcgggaccgtacgggacctacggacgtaggacgagtcgacgacggtaacgtggtacggctcgcctacgtactcgtcgttcttctacc

SEQ ID NO: 277647 - DNA, 515 bp, Homo sapiens
  misc_feature: GYAE6OF02H73D0.29.35.D02.1.454.CMB.1.raw
  modified_base (501)..(501): a, c, t, g, unknown or other
  misc_feature (501)..(501): n is a, c, g, or t
tcagatagagtactcacgaccggtgctcgatttagcacacgatagttgggtttgggggaggaactgctcagttaggacccagacggaaccatggaagccccagctcagcttctcttcctcctgctactctggctcccagataccagcggagagattgtgttgacacagtctccagccaccctgtctttgtctccgggagaaagagccaccctctcctgcagggccagtcagagtgttaacaactacttggcctggttccaacagaaacctggccaggctcccaggctcctcatctatgatgcatccaacagggccactggcatcccagccaggttcagtggcagtgggtctgggacagacttcactctcaccatcagccgcctagacgcctgaggattctgtccgttttattattgttcttgggcgtagcaactggccttcccgtctacttttggcctaggggaccaagcgtggagatcagacgaactggtggctgcaccntctgttccttctac

SEQ ID NO: 277648 - DNA, 531 bp, Homo sapiens
  misc_feature: GYAE6OF02F5XBG.29.35.D02.1.454.CMB.1.raw
  modified_base (203)..(203): a, c, t, g, unknown or other
  misc_feature (203)..(203): n is a, c, g, or t
tcagatagagtactcacgaccggtgctcgatttagcacacgatagttgggtttggggaggaactgctcagttaggacccagacggaaccatggaagccccagctcagcttctcttcctcctgctactctggctcccagataccagcggagagattgtgttgacacagtctccagccaccctgtctttgtctccgggagaaagngccaccctctcctgcagggccagtcagagtgttaacaactacttggcctggttccaacagaaacctggccaggctcccaggctcctcatctatgatgcatccaacagggccactggcatcccagccaggttcagtggcagtgggtctgggacagcttcactctcaccatcagccgcctagagcctgaggtattctgtccgtttattagttcgtcgttgggtcgtagctaacgtcggtccctcccgtctacgttttcggccgtaggggacccaacggcgtgggacgtagtcgacgaacgtaactggtgtctgcaccatctgtcttctac

SEQ ID NO: 277649 - DNA, 518 bp, Homo sapiens
  misc_feature: GYAE6OF02FGLB7.29.35.D02.1.454.CMB.1.raw
tcagatagagtactcacgaccggtgctcgatttagcacacgatagttgggtttgggggaggaactgctcagttaggacccagacggaaccatggaagccccagctcagcttctcttcctcctgctactctggctcccagataccagcggagagattgtgttgacacagtctccagccaccctgtctttgtctccgggagaaagagccaccctctcctgcagggccagtcagagtgttaacaactacttggccctggttccaacagaaacctggccaggctcccaggctcctcatctatgatgcatccaacagggccactggcatcccagccaggttcagtgcagtgggtctgggacagacttcactctcaccatcagccgcctagagcctgaggattctgtccgtttatttattgtcttgggtcgtagcaactggccctccgtcctacgttttggccgtacgggaccaagcgtggagatcgagaacggaactggtggctgcaccatctcgtcttctac

SEQ ID NO: 277650 - DNA, 523 bp, Homo sapiens
  misc_feature: GYAE6OF02GAQ85.29.35.D02.1.454.CMB.1.raw
  modified_base (520)..(520): a, c, t, g, unknown or other
  misc_feature (520)..(520): n is a, c, g, or t
tcagatagagtactcacgaccggtgctcgatttagcacacgatagttgggtttggggaggaactgctcagttaggacccagacggaaccatggaagccccagctcagcttctcttcctcctgctactctggctcccagataccagcggagagattgtgttgacacagtctccagccaccctgtctttgtctccgggagaaagagccaccctctcctgcagggccagtcagagtgttaacaactacttggcctggttccaacagaaacctggccaggctcccaggctcctcatctatgatgcatccaacagggccactggcatcccagccaggttcagtgcagtgggtctgggacagcttcactctcaccatcagccgcctagacgcctgaggtattcgtcgtccgtttattattgttcgttgggtcgtagctaactcggcctcccgtctacgtttcggccgtacggggaccagcgtggagatcgaggacgtaactggtcggtctgcacctatctgttctntac

SEQ ID NO: 277651 - DNA, 535 bp, Homo sapiens
  misc_feature: GYAE6OF02HYUL1.29.35.D02.1.454.CMB.1.raw
  modified_base (310)..(310): a, c, t, g, unknown or other
  misc_feature (310)..(310): n is a, c, g, or t
  modified_base (378)..(378): a, c, t, g, unknown or other
  misc_feature (378)..(378): n is a, c, g, or t
  modified_base (511)..(511): a, c, t, g, unknown or other
  misc_feature (511)..(511): n is a, c, g, or t
  modified_base (532)..(532): a, c, t, g, unknown or other
  misc_feature (532)..(532): n is a, c, g, or t
tcagatagagtactcacgaccggtgctcgatttagcacacgatagttgggtttggggaggaactgctcagttaggacccagacggaaccatggaagccccagctcagcttctcttcctcctgctactctggctcccagataccagcggagagattgtgttgacacagtctccagccaccctgtctttgtctccgggagaaagagccaccctctcctgcagggccagtcagagtgttaaacaactacttggcctggttccaacagaaacctggccaggctcccaggctcctcatctatgatgcatccaacngggccacgtggcaatcccaagccaggttcagtggcaggtgggtctgggacagacttcacttctcaccntccgacgccgcctagacgtcccgtggaggtacttcgtcgtccgttttatttattgttcgttggtcgtagcaacgtcgccctccgtctacgtttcggccgtacgggaccgagcgtggagatcgagacgacgtgnggtctgcacactctcgtcttntac

SEQ ID NO: 277652 - DNA, 535 bp, Homo sapiens
  misc_feature: GYAE6OF02G8RPY.29.35.D02.1.454.CMB.1.raw
tcagatagagtactcacgaccggtgctcgatttagcacacgatagttgggtttgggggaggaactgctcagttaggacccagacggaaccatggaagccccagctcagcttctcttcctcctgctactctggctcccagataccagcggagagattgtgttgacacagtctccagccaccctgtctttgtctccgggagaaagagccaccctctcctgcagggccagtcagagtgttaacaactacttggcctggttccaacagaaacctggccaggctcccaggctcctcatctatgatgcatccaacagggccactggcatcccagccaggttcagtggcagtgggtctgggacagacttcactctcaccatcacgccgcctagacgcctgaggattctgtccgtttattattgttcgttgggcgttagctaacgtcggccctcccgtctacgttttcggacccgtaggggacctaagcgtggagtagtcgagacgaactcggtaggtcgtgacacctatctgttccttctac

SEQ ID NO: 277653 - DNA, 508 bp, Homo sapiens
  misc_feature: GYAE6OF02JGFC9.29.35.D02.1.454.CMB.1.raw
tcagatagagtactcacgaccggtgctcgatttagcacacgatagttgggtttgggggaggaactgctcagttaggacccagacggaaccatggaagccccagctcagcttctcttcctcctgctactctggctcccagataccagcggagagattgtgttgacacagtctccagccaccctgtctttgtctccgggagaaagagccaccctctcctgcagggccagtcagagtgttaacaactacttggcctggttccaacagaaacctggccaggctcccaggctcctcatctatgatgcatccaacagggccactggcatcccagccaggttcagtggcagtgggtctgggacagacttcactctcaccatcagccgctagagcctgaggattctgtccgtttattattgtcttgggcgtagcaactggcctcccgtctacgtttggccgaggggaccaagctggagatcgagacgaactggtggctgcaccatctgtcttctac

SEQ ID NO: 277654 - DNA, 510 bp, Homo sapiens
  misc_feature: GYAE6OF02HBQGE.29.35.D02.1.454.CMB.1.raw
tcagatagagtactcacgaccggtgctcgatttagcacacgatagttgggtttgggggaggaactgctcagttaggacccagacggaaccatggaagccccagctcagcttctcttcctcctgctactctggctcccagataccagcggagagattgtgttgacacagtctccagccaccctgtctttgtctccgggagaaagagccaccctctcctgcagggccagtcagagtgttaacaactacttggcctggttccaacagaaacctggccaggctcccaggctcctcatctatgatgcatccaacagggccactggcatcccagccaggttcagtggcagtgggtctgggacagacttcactctcaccatcagccgcctagacgcctgaggtattctgtccgtttattattgtcttgggcgtagcactggcctcccgtctactttggccacggggtaccaggtctggagagtcaggacgaactgtggctgcaccatctgtcttctc

SEQ ID NO: 277655 - DNA, 501 bp, Homo sapiens
  misc_feature: GYAE6OF02FVZ07.29.35.D02.1.454.CMB.1.raw
tcagatagagtactcacgaccggtgctcgatttagcacacgatagttgggtttgggggaggaactgctcagttaggacccagacggaaccatggaagccccagctcagcttctcttcctcctgctactctggctcccagataccagcggagagattgtgttgacacagtctccagccaccctgtctttgtctccgggagaaagagccaccctctcctgcagggccagtcagagtgttaacaactacttggcctggttccaacagaaacctggccaggctcccaggctcctcatctatgatgcatccaacagggccactggcatcccagccaggctcagtggcagtgggtctgggacagacttcactctcaccatcagccgcctagagcctgaggattctgccgtttattattgttcttgggcgtagcaactgcctccgtcactttggccagggaccaagctggagatcgagacgaacgtgtcgcgtgcaccatctgtcttc

SEQ ID NO: 277656 - DNA, 507 bp, Homo sapiens
  misc_feature: GYAE6OF02HTAE1.29.35.D02.1.454.CMB.1.raw
  modified_base (203)..(203): a, c, t, g, unknown or other
  misc_feature (203)..(203): n is a, c, g, or t
  modified_base (348)..(348): a, c, t, g, unknown or other
  misc_feature (348)..(348): n is a, c, g, or t
  modified_base (504)..(504): a, c, t, g, unknown or other
  misc_feature (504)..(504): n is a, c, g, or t
tcagatagagtactcacgaccggtgctcgatttagcacacgatagttgggtttgggggaggaactgctcagttaggacccagacggaaccatggaagccccagctcagcttctcttcctcctgctactctggctcccagataccagcggagagattgtgttgacacagtctccagccacctgtctttgtctccgggagaaagngccacctctcctgcagggccagtcagagtgttaacaactacttggccttggttccaacagaaacctggccaggctcccaggctcctcatctatgatgcatccaacagggccactggcatcccagccaggttcagtgcagtggtcngggacagacttcactctcaccatccagccgccgtagacgcctgaggattctgtccgtttattattgttcgttggtcgtagcaacgtgcctccgtctcgtttgcgtagggacagctgagcgtgacgtacgaacgtgtgcgtgcgacatctcgtcttntac

SEQ ID NO: 277657 - DNA, 515 bp, Homo sapiens
  misc_feature: GYAE6OF02FNYT0.29.35.D02.1.454.CMB.1.raw
tcagatagagtactcacgaccggtgctcgatttagcacacgatagttgggtttgggggaggaactgctcagttaggacccagacggaaccatggaagccccagctcagcttctcttcctcctgctactctggctcccagataccagcggagagattgtgttgacacagtctccagccaccctgtctttgtctccgggagaaagagccaccctctcctgcagggccagtcagagtgttaacaactacttggcctggttccaacagaaacctggccaggctcccaggctcctcatctatgatgcatccaacagggccactggcatcccagccaggttcagtggcagtgggtctgggacagacttcactctcaccatcagccgcctacgagcctgaggattctgtccgtttattattgtcgtttgggcgtagctaacgtcggcctcccgtctacgtttggccgtacgggaccagcgtggagatcgagacgaactgtggctgcaccatctgtcttctac

SEQ ID NO: 277658 - DNA, 513 bp, Homo sapiens
  misc_feature: GYAE6OF02H0AFL.29.35.D02.1.454.CMB.1.raw
  modified_base (510)..(510): a, c, t, g, unknown or other
  misc_feature (510)..(510): n is a, c, g, or t
tcagatagagtactcacgaccggtgctcgatttagcacacgatagttgggtttgggggaggaactgctcagttaggacccagacggaaccatggaagccccagctcagcttctcttcctcctgctactctggctcccagataccagcggagagattgtgttgacacagtctccagccaccctgtctttgtctccgggagaaagagccaccctctcctgcagggccagtcagagtgttaacaactacttggcctggttccaacagaaacctggccaggctcccaggctcctcatctatgatgcatccaacagggccactggcatcccagccaggttcagtggcagtgggtctgggacagacttcactctcaccatcagccgcctagagcctgaggattctgtccgtttattattgttcgttgggcgtagcaacgtggcctcccgtctacttttcggccgtacgggaccaagcgtggagatcgagacgaactgtggctgcaccatctgtctntac

SEQ ID NO: 277659 - DNA, 625 bp, Homo sapiens
  misc_feature: GYAE6OF02G1KC0.29.35.D02.1.454.CMB.1.raw
  modified_base (198)..(198): a, c, t, g, unknown or other
  misc_feature (198)..(198): n is a, c, g, or t
  modified_base (231)..(231): a, c, t, g, unknown or other
  misc_feature (231)..(231): n is a, c, g, or t
  modified_base (258)..(258): a, c, t, g, unknown or other
  misc_feature (258)..(258): n is a, c, g, or t
tcagatagagtactcacgaccggtgctcgatttagcacacgatagttgggtttgggggaggaacgtgctcagttaggacccagacggaaccatggaagcccagctcagcttctcttcctcctgctactctggctcccagataccagcggagagattgtgttgacacagtctccagccaccctgtctttgctccggganaaagcgccacctctcctgccagggccagtcagngtagtaacaatcttggcctggtccaanagaacctggccaggctccaggctcctcatctatgatcgcactaccaacgacgggcctaacgtggaccaactccccaaggccccgtaagggttccaaggttcggactagggttcggggtcgtagggggaacacggtacctttaccgaccttccgtccaaccgtaattcgacgcccgacctagacgccgtaggacggtacttcgtcgtaccgttttattacgtttgttcgttgggtacgtacgactacgtcggtcctcccgtcgttactttcggaccgtacgggtaaccaaggtccgtagggagtacgtacgtacggaacgtaagtcggtacggtacgtcgactaccgacgttcgtcgttcttcgtacc

SEQ ID NO: 277660 - DNA, 567 bp, Homo sapiens
  misc_feature: GYAE6OF02FFJ11.29.35.D02.1.454.CMB.1.raw
  modified_base (158)..(158): a, c, t, g, unknown or other
  misc_feature (158)..(158): n is a, c, g, or t
  modified_base (263)..(263): a, c, t, g, unknown or other
  misc_feature (263)..(263): n is a, c, g, or t
  modified_base (345)..(345): a, c, t, g, unknown or other
  misc_feature (345)..(345): n is a, c, g, or t
  modified_base (501)..(501): a, c, t, g, unknown or other
  misc_feature (501)..(501): n is a, c, g, or t
tcagatagagtactcacgaccggtgctcgatttagcacacgatagttgggtttgggggaggaactgctcagttaggacccagacggaaccatggaagccccagctcagcttctcttcctcctgctactctggctcccagataccagcggagagattgngttgacacagtctccagccaccctgtctttgtctccgggagaaagagccaccctctcctgcagggccagtcagagtgtaacaactacttggccttggttaccaanagaaacctggccaggctcccaggcctcctcatctatgatgcatccaacacgggccatggcatcccagccaggttcagtggcnggtgggtctgggacagtcttcactctcaccatcacgccgacgtagcgcctggacgtacttctcgtccgtttattagttgtcgttgggcgtagactaacgtcggtccctccgttcgtacgttttcggaccgtaggggaccaaggtcgtacggagtanacgtacggaaccgtaacgtcggtcggtcgtacgacctaccgtacgttccgttcgttccttctaccg

SEQ ID NO: 277661 - DNA, 507 bp, Homo sapiens
  misc_feature: GYAE6OF02F8HCG.29.35.D02.1.454.CMB.1.raw
tcagatagagtactcacgaccggtgctcgatttagcacacgatagttgggtttgggggaggaactgctcagttaggacccagacggaaccatggaagccccagctcagcttctcttcctcctgctactctggctcccagataccagcggagagattgtgttgacacagtctccagccaccctgtctttgtctccgggagaaagagccaccctctcctgcagggccagtcagagtgttaacaactacttggcctggttccaacagaaacctggccaggctcccaggctcctcatctatgatgcatccaacagggccactggcatcccagccaggttcagtggcagtgggtctgggacagacttcactctcaccatcagccgcctagagcctgaggattctgccgtttattattgtcttgggcgtagcaactggccttccgtctacttttggcctaggggaccaagctggagatcagacgaactggtggctgcaccatctgtcttctac

SEQ ID NO: 277662 - DNA, 531 bp, Homo sapiens
  misc_feature: GYAE6OF02GWKWM.29.35.D02.1.454.CMB.1.raw
  modified_base (204)..(204): a, c, t, g, unknown or other
  misc_feature (204)..(204): n is a, c, g, or t
tcagatagagtactcacgaccggtgctcgatttagcacacgatagttgggtttgggggaggaactgctcagttaggacccagacggaaccatggaagccccagctcagcttctcttcctcctgctactctggctcccagataccagcggagagattgtgttgacacagtctccagccaccctgtctttgtctccgggagaaagngccaccctctcctgcagggccagtcagagtgttaacaactacttggcctggttccaacagaaacctggccaggctcccaggctcctcatctatgatgcatccaacagggccactggcatcccagccaggttcagtgcaggtgggtctgggacagacttcactctcaccatcagccgcctagagcctgaggtattcgtgtccgtttattattgtcgttgggcgtagtctaacgtgcctccgtctacgtttcggccgtacgggaccacgcgtggagagtacgaggaacgaacgtggtggtccgtgaccacctactctcgttcttctacg

SEQ ID NO: 277663 - DNA, 511 bp, Homo sapiens
  misc_feature: GYAE6OF02GK4DR.29.35.D02.1.454.CMB.1.raw
  modified_base (497)..(497): a, c, t, g, unknown or other
  misc_feature (497)..(497): n is a, c, g, or t
tcagatagagtactcacgaccggtgctcgatttagcacacgatagttgggtttggggaggaactgctcagttaggacccagacggaaccatggaagccccagctcagcttctcttcctcctgctactctggctcccagataccagcggagagattgtgttgacacagtctccagccaccctgtctttgtctccgggagaaagagccaccctctcctgcagggccagtcagagtgttaacaactacttggcctggttccaacagaaacctggccaggctcccaggctcctcatctatgatgcatccaacagggccactggcatcccagccaggttcagtggcagtgggtctgggacagacttcactctcaccatcagccgcctagagcctgaggtattttcgccgtttattattgtcgttgggcgtagctaacgtcggcctccgtctacttttggccgtaggggaccaagctggagatcagacgaactgtgctgcacntctgtcttcattcc

SEQ ID NO: 277664 - DNA, 503 bp, Homo sapiens
  misc_feature: GYAE6OF02GJL6G.29.35.D02.1.454.CMB.1.raw
  modified_base (496)..(496): a, c, t, g, unknown or other
  misc_feature (496)..(496): n is a, c, g, or t
  modified_base (500)..(500): a, c, t, g, unknown or other
  misc_feature (500)..(500): n is a, c, g, or t
tcagatagagtactcacgaccggtgctcgatttagcacacgatagttgggtttgggggaggaactgctcagttaggacccagacggaaccatggaagccccagctcagcttctcttcctcctgctactctggctcccagataccagcggagagattgtgttgacacagtctccagccaccctgtctttgtctccgggagaaagagccaccctctcctgcagggccagtcagagtgttaacaactacttggcctggttccaacagaaacctggccaggctcccaggctcctcatctatgatgcatccaacagggccactggcatcccagccaggttcagtggcagtgggtctgggacagacttcactctcaccatcagccgcctagacgcctgaggattctgccgtttattattgtcttgggcgtagcaactgcctcccgtctacttttggccacgggaccaagctggagatcagacgaactgtggctgcacatctntctntac

SEQ ID NO: 277665 - DNA, 558 bp, Homo sapiens
  misc_feature: GYAE6OF02GCB13.29.35.D02.1.454.CMB.1.raw
  modified_base (349)..(349): a, c, t, g, unknown or other
  misc_feature (349)..(349): n is a, c, g, or t
tcagatagagtactcacgaccggtgctcgatttagcacacgatagttgggtttggggaggaactgctcagttaggacccagacggaaccatggaagccccagctcagcttctcttcctcctgctactctggctcccagataccagcggagagattgtgttgacacagtctccagccaccctgtctttgtctccgggagaaagagccaccctctcctgcagggccagtcagagtgttaacaactacttggcctggttccaacagaaacctggccaggctccaggctcctcatctatgatgcatccaacagggccactggcatcccagccaggttcagtggcagtgggtcngggacagacttcactctcaccatcacgccgcctagagcctggaggtacttcgtgtccgttttattattgtcgtttgggcgtagctaacgtcggccctcccgttctacgttttcggtcgtacggggaccaaggtctagggagtacgtacgaggtaaccgaacgttggtcgggaccttggcctaaccgtattccgtcgttaccttctaccg

SEQ ID NO: 277666 - DNA, 567 bp, Homo sapiens
  misc_feature: GYAE6OF02GE176.29.35.D02.1.454.CMB.1.raw
  modified_base (177)..(177): a, c, t, g, unknown or other
  misc_feature (177)..(177): n is a, c, g, or t
tcagatagagtactcacgaccggtgctcgatttagcacacgatagttgggtttgggggaggaactcgcctcacgttaggacccagacggaaccgactggaacggccccagcgtccaagctttcttcttcctccgtgcgtactcctggctacccagataccagcggagagagtttggnggttggaccacagtctccagccgaccctgtcctttagtctccgggacaaagcgccaccctctccctcgccacgggtccagtcagtagtgttaacacgtacttggcctaggtccaacagaaacctgccaggctcccaggctcctcatctatgatgcatccaacagggccacgtggcatcccagccaggttcagtgcagtgggtctgggacaggacttcgactctcaccatcacgccgcctacgacgcctgaggtacttcgtcgtccgtttattacttgttcgttgggcgtacgctaacgtcggcctcccgtcgtacttttcggccgagggtaccaagtcgtggagatcaggtacgaactcggtacggctgccactactctcgtcttgtacc

SEQ ID NO: 277667 - DNA, 510 bp, Homo sapiens
  misc_feature: GYAE6OF02GTNIQ.29.35.D02.1.454.CMB.1.raw
tcagatagagtactcacgaccggtgctcgatttagcacacgatagttgggtttgggggaggaactgctcagttaggacccagacggaaccatggaagccccagctcagcttctcttcctcctgctactctggctcccagataccagcggagagattgtgttgacacagtctccagccaccctgtctttgtctccgggagaaagagccaccctctcctgcagggccagtcagagtgttaacaactacttggcctggttccaacagaaacctggccaggctcccaggctcctcatctatgatgcatccaacagggccactggcatcccagccaggttcagtggcagtgggtctgggacagacttcactctcaccatcagccgcctagacgcctgaggattctgtccgtttattattgtcttgggcgtagcaactggcctccgtcacttttggccgtaggggaccaagcgtggagatcaggacgaacgtgtggctgcaccatctgtcttctac

SEQ ID NO: 277668 - DNA, 530 bp, Homo sapiens
  misc_feature: GYAE6OF02IRJYL.29.35.D02.1.454.CMB.1.raw
tcagatagagtactcacgaccggtgctcgatttagcacacgatagttgggtttggggaggaactgctcagttaggacccagacggaaccatggaagccccagctcagcttctcttcctcctgctactctggctcccagataccagcggagagattgtgttgacacagtctccagccaccctgtctttgtctccgggagaaagagccaccctctcctgcagggccagtcagagtgttaacaactacttggcctggttccaacagaaacctggccaggctcccaggctcctcatctatgatgcatccaacagggccactggcatcccagccaggttcagtggcagtgggtctgggacagacttcacgtctcaccatcagccgcctagacgcctgaggtacttcgtgtccgtttattattgtcgttgggtcgtagtcaactcggcccttcccgtctaccgttttcggccgtacggggaccgaagcgtggagtatcgacgacgaacgtggtgcgtgcaccatctcgtctctacg

SEQ ID NO: 277669 - DNA, 554 bp, Homo sapiens
  misc_feature: GYAE6OF02F1UQ8.29.35.D02.1.454.CMB.1.raw
  modified_base (262)..(262): a, c, t, g, unknown or other
  misc_feature (262)..(262): n is a, c, g, or t
tcagatagagtactcacgaccggtgctcgatttagcacacgatagttgggtttgggggaggaactgctcagttaggacccagacggaaccatggaagccccagctcagcttctcttcctcctgctactctggctcccagataccagcggagagattgtgttgacacagtctccagccaccctgtctttgtctccgggagaaagagccaccctctcctgcagggccagtcagagtgttaacaactacttggcctggttccaanagaaacctggccaggctcccaggctcctcatctatgatgcatccaacagggccatggcatcccagccaggttcagtggcaggtgggtctgggacagacttcactctcaccatcacgccgcctagacgccgtgaggattcgtgtccgtttattagtttcggttcttcgggtcgtacgtctacgtcggcccgttcccgttctaccgttttcggccgtaggggaccaaggtcgtggagtagtcgaaggacgtaacgtggtcggcgtcgacctacctattcctgttccttctaccg

SEQ ID NO: 277670 - DNA, 524 bp, Homo sapiens
  misc_feature: GYAE6OF02HYCLT.29.35.D02.1.454.CMB.1.raw
tcagatagagtactcacgaccggtgctcgatttagcacacgatagttgggtttgggggaggaactgctcagttaggacccagacggaaccatggaagccccagctcagcttctcttcctcctgctactctggctcccagataccagcggagagattgtgttgacacagtctccagccaccctgtctttgtctccgggagaaagagccaccctctcctgcagggccagtcagagtgttaacaactacttggcctggttccaacagaaacctggccaggctccaggctcctcatctatgatgcatccaacgagggccacgtggcactcccagccaggttcagtggcaggtgggtctgggacagacttcactctcaccatcacgccgcctagacgcctgagattctcgtccgtttattattgttcgttgggcgtagcaacgtcggcctccgtctacgtttcggccgacgggacagcgtggagatacgagaacgaacgtggtggcgtgcactatcgtcgttcttctac

SEQ ID NO: 277671 - DNA, 525 bp, Homo sapiens
  misc_feature: GYAE6OF02HROL4.29.35.D02.1.454.CMB.1.raw
tcagatagagtactcacgaccggtgctcgatttagcacacgatagttgggtttggggaggaactgctcagttaggacccagacggaaccatggaagccccagctcagcttctcttcctcctgctactctggctcccagataccagcggagagattgtgttgacacagtctccagccaccctgtctttgtctccggggagaaagagccaccctctcctgcagggccagtcagagtgttaacaactacttggcctggttccaacagaaacctggccaggctcccaggctcctcatctatgatgcatccaacagggccactggcactcccagccaggttcagtggcaggtgggtctgggacagtacttcactctcaccatcacgccgcctagacgcctggaggtattcgtcgtccgtttattattgttcgttgggtcgtagctaacgtggcctcccgtctacgtttgccgtacgggaccagcgtggagatcgagaacgactggtcgcgtgcaccatctcgttcttctc

SEQ ID NO: 277672 - DNA, 550 bp, Homo sapiens
  misc_feature: GYAE6OF02IRR9U.29.35.D02.1.454.CMB.1.raw
tcagatagagtactcacgaccggtgctcgatttagcacacgatagttgggtttgggggaggaactgctcagttaggacccagacggaaccatggaagccccagctcagcttctcttcctcctgctactctggctcccagataccagcggagagattgtgttgacacagtctccagccaccctgtctttgtctccgggagaaagagccaccctctcctgcagggccagtcagagtgttaacaactacttggcctggttccaacagaaacctggccaggctcccaggctcctcatctatgatgcatccaacagggccactggcatcccagccaggttcagtggcagtgggtctgggacagacttcactctcaccatcagccgcctagacgcctgaggtattctgtccgtttattattgtcgttgggtcgtagcaacgtcggccctcccgtctacgttttcggaccgtacggggaaccaacggtcgtaggagtactcgaacggacgtaaccgtggtacggcgtacggccacctacgtctcgttccttctaccg

SEQ ID NO: 277673 - DNA, 521 bp, Homo sapiens
  misc_feature: GYAE6OF02IFYT3.29.35.D02.1.454.CMB.1.raw
  modified_base (290)..(290): a, c, t, g, unknown or other
  misc_feature (290)..(290): n is a, c, g, or t
  modified_base (310)..(310): a, c, t, g, unknown or other
  misc_feature (310)..(310): n is a, c, g, or t
  modified_base (364)..(364): a, c, t, g, unknown or other
  misc_feature (364)..(364): n is a, c, g, or t
tcagatagagtactcacgaccggtgctcgatttagcacacgatagttgggtttgggggaggaactgctcagttaggacccagacggaaccatggaagccccagctcagcttctcttcctcctgctactctggctcccagataccagcggagagattgtgttgacacagtctccagccaccctgtctttgtctccgggagaaagagccaccctctcctgcagggccagtcagagtgttaacaactacttggcctggttccaaacagaaacctggccaggctccaggctccncatctatgatgcatccaacngggccactggcatcccagccaggttcagtggcaggtgggtctgggacagacttnactctcaccatcagccgctagacgcctgagacttctcgtcgtttattattgtcgttggtcgtagctaacgtggaccttccgtctacgttttcggaccgtacgggaccgaaagccgtaggagatacgagaacgactggtgctgcacatctgtctctac

SEQ ID NO: 277674 - DNA, 502 bp, Homo sapiens
  misc_feature: GYAE6OF02FTKCH.29.35.D02.1.454.CMB.1.raw
  modified_base (499)..(499): a, c, t, g, unknown or other
  misc_feature (499)..(499): n is a, c, g, or t
tcagatagagtactcacgaccggtgctcgatttagcacacgatagttgggtttggggaggaactgctcagttaggacccagacggaaccatggaagccccagctcagcttctcttcctcctgctactctggctcccagataccagcggagagattgtgttgacacagtctccagccaccctgtctttgtctccgggagaaagagccaccctctcctgcagggccagtcagagtgttaacaactacttggcctggttccaacagaaacctggccaggctcccaggctcctcatctatgatgcatccaacagggccactggcatcccagccaggttcagtggcagtgggtctgggacagacttcactctcaccatcagccgcctagagcctgaggattctgccgtttattattgtcttgggcgtagcactgcctccgtcacttttggccgtaggggaccaagctggagatcagacgaactgtggctgcaccatctgtcttntac

SEQ ID NO: 277675 - DNA, 504 bp, Homo sapiens
  misc_feature: GYAE6OF02FI3GV.29.35.D02.1.454.CMB.1.raw
  modified_base (501)..(501): a, c, t, g, unknown or other
  misc_feature (501)..(501): n is a, c, g, or t
tcagatagagtactcacgaccggtgctcgatttagcacacgatagttgggtttgggggaggaactgctcagttaggacccagacggaaccatggaagccccagctcagcttctcttcctcctgctactctggctcccagataccagcggagagattgtgttgacacagtctccagccaccctgtctttgtctccgggagaaagagccaccctctcctgcagggccagtcagagtgttaacaactacttggcctggttccaacagaaacctggccaggctcccaggctcctcatctatgatgcatccaacagggccactggcatcccagccaggttcagtggcagtgggtctgggacagacttcactctcaccatcagccgcctagacgcctgaggattctgccgtttattattgtcttgggcgtagcaactgcctccgtcacttttggcctaggggaccaagctggagatcgagacgactgtcggctgcaccatctgtctntac

SEQ ID NO: 277676 - DNA, 530 bp, Homo sapiens
  misc_feature: GYAE6OF02GPJ91.29.35.D02.1.454.CMB.1.raw
tcagatagagtactcacgaccggtgctcgatttagcacacgatagttgggtttgggggaggaactgctcagttaggacccagacggaaccatggaagccccagctcagcttctcttcctcctgctactctggctcccagataccagcggagagattgtgttgacacagtctccagccaccctgtctttgtctccgggagaaagagccaccctctcctgcagggccagtcagagtgttaacaactacttggcctggttccaacagaaacctggccaggctcccaggctcctcatctatgatgcatccaacagggccactggcatcccagccaggttcagtggcagtgggtctgggacagacttcactctcaccatcacgccgcctagacgcctgaggattcgtgtccgtttattattgttcgttgggtcgtagctaacgtcggcctcccgtctacgttttcggccgtacggggacctacgcgtggagacgtcgacgacgaactggtcggcgtgcaccatctcgtcttctac

SEQ ID NO: 277677 - DNA, 580 bp, Homo sapiens
  misc_feature: GYAE6OF02JDKXZ.29.35.D02.1.454.CMB.1.raw
tcagatagagtactcacgaccggtgctcgatttagcacacgatagttgggtttgggggaggaactgctcagttaggacccagacggaaccatggaagccccagctcagcttctcttcctcctgctactctggctcccagataccagcggagagattgtgttgacacagtctccagccaccctgtctttgtctccgggagaaagagccaccctctcctgcagggccagtcagagtgttaacaactacttggcctggttccaacagaaacctggccaggctccaggctcctcatctatgatgcatccaacgagggccactggcactcccagccaggttcagtgcagtgggctgggacagacttcactcacaccatccgacgccgcctaagcgtcccgtggacggtaacttcgtcggtaccgttttattacgtttgttacgtttgggacggttacgactaacgtcggtacccgttcccgtaccgtacttttcggaccgtacgggaccgtaagtccgtaggacgtagtacgaggaccgtaagtcggtaggccgtgacgacctacttcgtacgttcttactaccg

SEQ ID NO: 277678 - DNA, 528 bp, Homo sapiens
  misc_feature: GYAE6OF02HQL0I.29.35.D02.1.454.CMB.1.raw
  modified_base (204)..(204): a, c, t, g, unknown or other
  misc_feature (204)..(204): n is a, c, g, or t
  modified_base (309)..(309): a, c, t, g, unknown or other
  misc_feature (309)..(309): n is a, c, g, or t
tcagatagagtactcacgaccggtgctcgatttagcacacgatagttgggtttgggggaggaactgctcagttaggacccagacggaaccatggaagccccagctcagcttctcttcctcctgctactctggctcccagataccagcggagagattgtgttgacacagtctccagccaccctgtctttgtctccgggagaaagngccaccctctcctgcagggccagtcagagtgttaaacactacttggcctggttccaacagaaacctggccaggctcccaggctcctcatctatgatgcatccaanagggccactggcatcccagccaggttcagtgcagtgggtctgggacagacttcactctcaccatcagccgcctagagcctgaggattctgtccgtttattattgttcgttgggtcgtagctaacgtcggccttcccgtctaccgttttcggccgtacggggaccaacgcgtggagtatcgaggaacgaacgtggtggcgtgctaccatctgtctctacg

SEQ ID NO: 277679 - DNA, 506 bp, Homo sapiens
  misc_feature: GYAE6OF02FTQHA.29.35.D02.1.454.CMB.1.raw
  modified_base (503)..(503): a, c, t, g, unknown or other
  misc_feature (503)..(503): n is a, c, g, or t
tcagatagagtactcacgaccggtgctcgatttagcacacgatagttgggtttgggggaggaactgctcagttaggacccagacggaaccatggaagccccagctcagcttctcttcctcctgctactctggctcccagataccagcggagagattgtgttgacacagtctccagccaccctgtctttgtctccgggagaaagagccaccctctcctgcagggccagtcagagtgttaacaactacttggcctggttccaacagaaacctggccaggctcccaggctcctcatctatgatgcatccaacagggccacgtggcatcccagccaggttcagtggcagtgggtctgggacagacttcactctcaccatcagccgctagacgcctgaggattctgtccgtttattattgtcgttggcgtagcaactggtcctccgtctactttcggccgtacgggaccagctgagatcagacgacgtgtgctgcactatctgtcttntac

SEQ ID NO: 277680 - DNA, 525 bp, Homo sapiens
  misc_feature: GYAE6OF02GHWHP.29.35.D02.1.454.CMB.1.raw
  modified_base (515)..(515): a, c, t, g, unknown or other
  misc_feature (515)..(515): n is a, c, g, or t
tcagatagagtactcacgaccggtgctcgatttagcacacgatagttgggtttggggaggaactgctcagttaggacccagacggaaccatggaagccccagctcagcttctcttcctcctgctactctggctcccagataccagcggagagattgtgttgacacagtctccagccaccctgtctttgtctccgggagaaagagccaccctctcctgcagggccagtcagagtgttaacaactacttggcctggttccaacagaaacctggccaggctcccaggctcctcatctatgatgcatccaacgcgggccacgtggcactcccagccaggttcaggtggcaggtgggtctgggacagacttcactctcacatcacgccgactagacgcctggagtacttcgtcgtccgtttattattgttcgttgggcgtagctacgtcggtcccttccgtcttacgtttcggaccgtagggaccaggtcgtggatatacgagacgactgcgctgcactntctgtctctc

SEQ ID NO: 277681 - DNA, 641 bp, Homo sapiens
  misc_feature: GYAE6OF02J0LIO.29.35.D02.1.454.CMB.1.raw
  modified_base (201)..(201): a, c, t, g, unknown or other
  misc_feature (201)..(201): n is a, c, g, or t
  modified_base (206)..(206): a, c, t, g, unknown or other
  misc_feature (206)..(206): n is a, c, g, or t
  modified_base (265)..(265): a, c, t, g, unknown or other
  misc_feature (265)..(265): n is a, c, g, or t
  modified_base (316)..(316): a, c, t, g, unknown or other
  misc_feature (316)..(316): n is a, c, g, or t
tcagatagagtactcacgaccggtgctcgatttagcacacgatagttgggtttgggggagggaacgtgctcagttaggacccagacggaaccatggaagccccagctcagcttctcttcctcctgctactctggctcccagataccagcggagagattgtgttgacacagtctccagccaccctgtctttgtctccggganaaagngccacctctcctgcagggccagtcagagtgttaacaacttacttggcctggttcccaanagaaacctggccaggctcccaggcctcctcatctatcgatgcatccaacgngggccactggcatcccagccagttccagtgcagtgggtctgggacagactcactctcacatcgacgccgctagacgtccgtgtacggtactttcgtcgtaccgtttattacgttcgttaccgttagggtccgttaagtccgtaaaccggttcgggtccctttaccccggttacgttaccgttttcgggacccgtaacgggggtaaccctaaacgggttccgtagggaacgtactaccggtaacggtaacggtaccgttgggtaccggtaccgtaggtaccctaccggtaacctttccggttacgtttacccgtaccgttaacccg

SEQ ID NO: 277682 - DNA, 542 bp, Homo sapiens
  misc_feature: GYAE6OF02FU39E.29.35.D02.1.454.CMB.1.raw
tcagatagagtactcacgaccggtgctcgatttagcacacgatagttgggtttggggaggaactgctcagttaggacccagacggaaccatggaagccccagctcagcttctcttcctcctgctactctggctcccagataccagcggagagattgtgttgacacagtctccagccaccctgtctttgtctccgggagaaagagccaccctctcctgcagggccagtcagagtgttaacaactacttggcctggttccaacagaaacctggccaggctcccaggctcctcatctatgatgcatccaacagggccactggcatcccagccaggttcagtggcagtggtctgggacaggacttcactctcaccatcagccgctagacgcctgaggtattctgtccgtttattattgtcgttgggcgtagcaacgtgcctccgtctactttcggcctaggggaccaaggcgttaggagatcgaaggtaccggaacgttggtacggccttggaccctacctaagttccgtacgttccttctaaccg

SEQ ID NO: 277683 - DNA, 601 bp, Homo sapiens
  misc_feature: GYAE6OF02IG0YF.29.35.D02.1.454.CMB.1.raw
  modified_base (264)..(264): a, c, t, g, unknown or other
  misc_feature (264)..(264): n is a, c, g, or t
  modified_base (310)..(310): a, c, t, g, unknown or other
  misc_feature (310)..(310): n is a, c, g, or t
  modified_base (368)..(368): a, c, t, g, unknown or other
  misc_feature (368)..(368): n is a, c, g, or t
  modified_base (385)..(385): a, c, t, g, unknown or other
  misc_feature (385)..(385): n is a, c, g, or t
  modified_base (508)..(508): a, c, t, g, unknown or other
  misc_feature (508)..(508): n is a, c, g, or t
tcagatagagtactcacgaccggtgctcgatttagcacacgatagttgggtttgggggaggaactgctcagttaggacccagacggaaccatggaagccccagctcagcttctcttcctcctgctactctggctcccagataccagcggagagattgtgttgacacagtctccagccaccctgtctttgtctccgggagaaagagccaccctctcctgccagggccagtcagagtgttaacaacttacttggcctggttccaangaaacctggccaggctccaggctcctcatctatgatgcatccaacngggccactggcatcccagccaggttcagtgcagtgggtctgggacagacttcgactcncaccatcagccgctagngcctgagtatctgtccgtttattacgttgttcgttgggtcgttagtcaacgttggtcccttacccgtctaccgtttttcggccgtacggggaccaaggcctggacgactcgagacgtaactgngtaaccccgggtttacggtaacccggttaaccccggttaaccggtttacccggtttaaccggtttacccggtttaacccggtttaaccccggg

SEQ ID NO: 277684 - DNA, 561 bp, Homo sapiens
  misc_feature: GYAE6OF02F7NVE.29.35.D02.1.454.CMB.1.raw
tcagatagagtactcacgaccggtgctcgatttagcacacgatagttgggttttggggggaggaactgctcagttaggacccagacggaaccatggaagccccagctcagcttctcttcctcctgctactctggctccagataccagcggagagattgtgttgacacagtctccagccaccctgtctttgtctccgggagaaagagccaccctctcctgcagggccagtcagagtgttaacaactacttggcctggttccaacagaaacctggccaggctcccaggcctcctcatctatgatgcatccaacaggccactggcactcccagccgaggttcagtggctagtcgggtctgggacaggtacttcactctcaccatcgacgccgactacgacgccgtgacggacttcgtcgtccgtttatttagttgttcgttgggtcgtagctacgtcggtcctcccgtcgtacgtttcggccgtacgggtaccaagtcgtggagtagtcgaaggaacgaacgttcggtacggtctcgacaccgtacttcgtcgtccttctaccg

SEQ ID NO: 277685 - DNA, 532 bp, Homo sapiens
  misc_feature: GYAE6OF02HCWXK.29.35.D02.1.454.CMB.1.raw
tcagatagagtactcacgaccggtgctcgatttagcacacgatagttgggtttggggaggaactgctcagttaggacccagacggaaccatggaagccccagctcagcttctcttcctcctgctactctggctcccagataccagcggagagattgtgttgacacagtctccagccaccctgtctttgtctccgggagaaagagccaccctctcctgcagggccagtcagagtgttaacaactacttggcctggttccaacagaaacctggccaggctcccaggctcctcatctatgatgcatccaacgagggccactggcactcccagccaggtcagtcgcagtggtctgggacagacttcactctacaccatcacgccgacctagacgcctgaggtattcgtgtccgtttattattgttcgttgggcgtagctacgtcgccttcccgtctacgttttcggccgtacgggtaccaagcgtaggagagtacgaggaacgtaactggtcggactgcaccgatctcgtctctac

SEQ ID NO: 277686 - DNA, 567 bp, Homo sapiens
  misc_feature: GYAE6OF02H8G36.29.35.D02.1.454.CMB.1.raw
  modified_base (369)..(369): a, c, t, g, unknown or other
  misc_feature (369)..(369): n is a, c, g, or t
tcagatagagtactcacgaccggtgctcgatttagcacacgatagttgggtttgggggaggaactgctcagttaggacccagacggaaccatggaagccccagctcagcttctcttcctcctgctactctggctcccagataccagcggagagattgtgttgacacagtctccagccaccctgtctttgtctccgggagaaagagccaccctctcctgcagggccagtcagagtgttaacaactacttggcctggttccaacagaaacctggccaggctcccaggctcctcatctatgatgcatccaacagggccactggcactcccagccaggttcagtggcagtgggtctgggacagacttcactcncaccatcacgccgcctagacgccgtgaggtattctgtccgttttattagttgttcgttgggtcgtacgctaaccgtcggtcccttcccgttcctaccgttttcgggacccgtaggggtaacccaaggtcgtagggagacgtcgaacggtacgtaacgtggtcggtctagccacctacgttcgtcgttccttcgtaccg

SEQ ID NO: 277687 - DNA, 536 bp, Homo sapiens
  misc_feature: GYAE6OF02H18PT.29.35.D02.1.454.CMB.1.raw
  modified_base (202)..(202): a, c, t, g, unknown or other
  misc_feature (202)..(202): n is a, c, g, or t
  modified_base (533)..(533): a, c, t, g, unknown or other
  misc_feature (533)..(533): n is a, c, g, or t
tcagatagagtactcacgaccggtgctcgatttagcacacgatagttgggtttgggggaggaactgctcagttaggacccagacggaaccatggaagccccagctcagcttctcttcctcctgctactctggctccagataccagcggagagattgtgttgacacagtctccagccacctgtctttgtctccgggagaaagngccacctctcctgcagggccagtcagagtgttaacaactacttggcctggttccaacagaaacctggccaggctccaggctcctcatctatgatgcatccaacagggccactggcatcccagccaggttcagtggcaggtgggtctgggacaggacttcactctcaccatcgacgccgcctagacgcctgagtattctgtccgttttattattgttcgttgggcgttagctaacgtcggtcccttcccgtctaccgttttcggccgtacggggtaccaggtcgtgggacgtagtcgaggacgactggtggtcgtgcacgatcgtgttcttntac

SEQ ID NO: 277688 - DNA, 556 bp, Homo sapiens
  misc_feature: GYAE6OF02FYY0I.29.35.D02.1.454.CMB.1.raw
tcagatagagtactcacgaccggtgctcgatttagcacacgatagttgggtttgggggaggaactgctcagttaggacccagacggaaccatggaagccccagctcagcttctcttcctcctgctactctggctcccagataccagcggagagattgtgttgacacagtctccagccaccctgtctttgtctccgggagaaagagccaccctctcctgcagggccagtcagagtgttaacaactacttggcctggttccaacagaaacctggccaggctccaggctcctcatctatgatgcatccaacagggccactggcatcccagccagttcagtggcaggtgggtctgggacaggtactcactctcaccatcacgccgactacgacgccgtgagtattcgtcgtccgtttaattagtttgttcgtttgggcgttagtctaacgtcgtcccgtcccgttcgtacgttttcggaccgtacggggtaccaagtcgtggacgagtcgaacggcgaacgtggtcggtcgtgccaccgtacttcgtcgttccttatacc

SEQ ID NO: 277689 - DNA, 507 bp, Homo sapiens
  misc_feature: GYAE6OF02IGM4A.29.35.D02.1.454.CMB.1.raw
  modified_base (203)..(203): a, c, t, g, unknown or other
  misc_feature (203)..(203): n is a, c, g, or t
  modified_base (261)..(261): a, c, t, g, unknown or other
  misc_feature (261)..(261): n is a, c, g, or t
tcagatagagtactcacgaccggtgctcgatttagcacacgatagttgggtttggggaggaactgctcagttaggacccagacggaaccatggaagccccagctcagcttctcttcctcctgctactctggctcccagataccagcggagagattgtgttgacacagtctccagccaccctgtctttgtctccgggagaaagngccaccctctcctgcagggccagtcagagtgttaacaactacttggcctggttccaanagaaacctggccaggctccccaggctcctcatctatgatgcatccaacagggccactggcatcccagccaggttcagtggcagtgggtctgggacaggacttcactctcaccatcagccgcctagacgcctgaggatttctgccgtttattattgtcttgggcgtagcaactggccttcccgtctacgtttcgccaggggaccagcgtggagatcagacgactgtggctgcacatctgtcttctac

SEQ ID NO: 277690 - DNA, 577 bp, Homo sapiens
  misc_feature: GYAE6OF02I6TNS.29.35.D02.1.454.CMB.1.raw
  modified_base (198)..(198): a, c, t, g, unknown or other
  misc_feature (198)..(198): n is a, c, g, or t
  modified_base (260)..(260): a, c, t, g, unknown or other
  misc_feature (260)..(260): n is a, c, g, or t
tcagatagagtactcacgaccggtgctcgatttagcacacgatagttgggtttgggggaggaactgctcagttaggacccagacggaaccatggaagccccagctcagcttctcttcctcctgctactctggctcccagataccagcggagagattgtgttgacacagtctccagccacctgtctttgtctccggganaaagcgccaccctctcctgcagggccagtcagagtgttaacaactcttggcctggttccaanagaaacctggccaggctcccaggctcctcatctatgatgcatccaacgacggccactggccactcccagccaggttcagtggcaggtgggtctgggacagacttcgactctcaccgatcgacgccgacctagacgccgtggaggtacttacgtgtaccggttttattagttgttcgttggtcgtagcgtaacgtcggtccttcccgtcgtaccgtttcggaccgtacggggtaccagcgttacgggagtacgtacgacgtaacgtaacgttggtcggtccttcgaccgtacctagttctacggttccttacgtaccg

SEQ ID NO: 277691 - DNA, 593 bp, Homo sapiens
  misc_feature: GYAE6OF02J1DFO.29.35.D02.1.454.CMB.1.raw
  modified_base (341)..(341): a, c, t, g, unknown or other
  misc_feature (341)..(341): n is a, c, g, or t
tcagatagagtactcacgaccggtgctcgatttagcacacgatagttgggtttgggggaggaactgctcagttaggacccagacggaaccatggaagccccagctcagcttctcttcctcctgctactctggctcccagataccagcggagagattgtgttgacacagtctccagccaccctgtctttgtctccgggagaaagagccaccctctcctgcagggccagtcagagtgttaacaactacttggcctggttccaacagaaacctggccaggctcccaggctcctcatctatgatgcatccaacgaggccactggcatcccagccctaggttcagnggcaggtgggtctagggacagtacttcactctacaccatcgacgccgcctagacgcgtgaggtacttctgtccgttttattagtttcgttcgttcgggtcgtacgtactaaccgttcggtcccttcccgttcgtacgttttcggaccgtacggggtacccaaggtcgtagggacgtacgtacgaacggaaccggtaacgttcggtacggaccgttcgaccgtacccgtattcccgtcgttcttaccttaccg

SEQ ID NO: 277692 - DNA, 484 bp, Homo sapiens
  misc_feature: GYAE6OF02IBQI4.29.35.D02.1.454.CMB.1.raw
  modified_base (215)..(215): a, c, t, g, unknown or other
  misc_feature (215)..(215): n is a, c, g, or t
  modified_base (256)..(256): a, c, t, g, unknown or other
  misc_feature (256)..(256): n is a, c, g, or t
  modified_base (305)..(305): a, c, t, g, unknown or other
  misc_feature (305)..(305): n is a, c, g, or t
  modified_base (341)..(341): a, c, t, g, unknown or other
  misc_feature (341)..(341): n is a, c, g, or t
  modified_base (347)..(347): a, c, t, g, unknown or other
  misc_feature (347)..(347): n is a, c, g, or t
  modified_base (359)..(359): a, c, t, g, unknown or other
  misc_feature (359)..(359): n is a, c, g, or t
  modified_base (376)..(376): a, c, t, g, unknown or other
  misc_feature (376)..(376): n is a, c, g, or t
  modified_base (381)..(381): a, c, t, g, unknown or other
  misc_feature (381)..(381): n is a, c, g, or t
  modified_base (385)..(385): a, c, t, g, unknown or other
  misc_feature (385)..(385): n is a, c, g, or t
  modified_base (392)..(392): a, c, t, g, unknown or other
  misc_feature (392)..(392): n is a, c, g, or t
  modified_base (441)..(441): a, c, t, g, unknown or other
  misc_feature (441)..(441): n is a, c, g, or t
  modified_base (446)..(446): a, c, t, g, unknown or other
  misc_feature (446)..(446): n is a, c, g, or t
  modified_base (463)..(463): a, c, t, g, unknown or other
  misc_feature (463)..(463): n is a, c, g, or t
  modified_base (472)..(472): a, c, t, g, unknown or other
  misc_feature (472)..(472): n is a, c, g, or t
  modified_base (474)..(474): a, c, t, g, unknown or other
  misc_feature (474)..(474): n is a, c, g, or t
  modified_base (476)..(476): a, c, t, g, unknown or other
  misc_feature (476)..(476): n is a, c, g, or t
tcagatagagtactcacgaccggtgctcgatttagcacacgatagttgggtttgggggaggaactggctcagttaggacccagacggaaccatggaagccccagctcagcttctcttcctcctgctactctggctcccagataccagcggagagattgtgttgacacagtctccagccaccctgtctttcgctccgggagtaaagcgccaccctntcctgcagggccagtcagagtgtaacactatggctgtccangaactgcagctccaggctctcatcatgatgcatcccaaagcggcctacnggctatcccgagcctaggttcagtggcaggtcggtngggacngacttcacttcncaccgatcagcctcagngctgngatntgctttnattgcttggctagcatggcctccgctattttcggacaggggccaaaggngtganagtcaggaactacgtgngcagcactntntntctactcg

SEQ ID NO: 277693 - DNA, 536 bp, Homo sapiens
  misc_feature: GYAE6OF02F0627.29.35.D02.1.454.CMB.1.raw
  modified_base (199)..(199): a, c, t, g, unknown or other
  misc_feature (199)..(199): n is a, c, g, or t
  modified_base (204)..(204): a, c, t, g, unknown or other
  misc_feature (204)..(204): n is a, c, g, or t
tcagatagagtactcacgaccggtgctcgatttagcacacgatagttgggtttgggggaggaactgctcagttaggacccagacggaaccatggaagccccagctcagcttctcttcctcctgctactctggctcccagataccagcggagagattgtgttgacacagtctccagccaccctgtctttgtctccggganaaagngccaccctctcctgcagggccagtcagagtgttaacaactacttggcctggttccaacagaaacctggccaggctacccaggctcctcatctatcgatgcatccaacacgggccactggcatcccagccaggttcagtggcagtgggtctgggacagtacttcactctcacatcacgccgctagacgctgaggtattcgtgtccgtttattattcgtcgttgggcgtagcaacgtcggcctccgtctacgttttcggccgtacgggaccaaggtcgtggagtatacgacggaacgaacgttggtggctgccacctatctcgttccttactac

SEQ ID NO: 277694 - DNA, 592 bp, Homo sapiens
  misc_feature: GYAE6OF02GX81X.29.35.D02.1.454.CMB.1.raw
  modified_base (290)..(290): a, c, t, g, unknown or other
  misc_feature (290)..(290): n is a, c, g, or t
tcagatagagtactcacgaccggtgctcgatttagcacacgatagttgggtttgggggaggaactgctcagttaggacccagacggaaccatggaagccccagctcagcttctcttcctcctgctactctggctcccagataccagcggagagattgtgttgacacagtctccagccaccctgtctttgtctccgggagaaagagccaccctctcctgcagggccagtcagagtgttaacaactacttggcctggttccaacagaaacctggccaggctcccaggctccncatctatgatgcatccaacgacgggccacgtggcactcccagccaggttcagtggcaggtgggtctgggacagtacttcactctcaccatcagccgctagacgcctgaggtattcgtcgtaccgttttattagtttcgtcgttcgggtcgttacgctaacgtcggtcccttcccggtcttaccgttttcggacccgtaaggggtacccaaggtccgtagggaacgtactacgaacggtaaccgtaaacgttgggtacggtacgtcggacctaccgtattccgtacggtttccttccttaccg

SEQ ID NO: 277695 - DNA, 677 bp, Homo sapiens
  misc_feature: GYAE6OF02JSFFX.29.35.D02.1.454.CMB.1.raw
  modified_base (201)..(201): a, c, t, g, unknown or other
  misc_feature (201)..(201): n is a, c, g, or t
tcagatagagtactcacgaccggtgctcgatttagcacacgatagttgggtttgggggaggaacgtgctcagttaggaccagacggaaccatggaagcccagctcagcttctcttctcctgctactctggctcccagataccagcggagagattgtgttgacacagtctccagccacctgtctttgtctccgggagaaagngccaccctctcctgcagggccagtcagagtgttaacactacttggcctggttccaacagaactgccagctccaggctctcatctatgatgcactccaacacgggccactcggaccagtcccagccgaggttccaaggttcggcaaggttcggggtctacgggggtaacacggaactttcgaacttcgttaccaaccctattaccgacgcccgacgtacgaacgtccgtacgacggtaacgttcgtacggtacccgttttaagtttaacgtttcggtttccggtttaggggtaccggttaaggtaccgtaaaccggttcggtcccggttacccgttccgtaccgtttttccgggacccggtacggggtaacccgtaacggtaccgtggtaacggtagtaccgtaaggaccggtaacgttgggtacggtaccgtagtacccggtaccgtaaccgttctaccggttcgttaccttaacg

SEQ ID NO: 277696 - DNA, 525 bp, Homo sapiens
  misc_feature: GYAE6OF02GPOZ5.29.35.D02.1.454.CMB.1.raw
  modified_base (522)..(522): a, c, t, g, unknown or other
  misc_feature (522)..(522): n is a, c, g, or t
tcagatagagtactcacgaccggtgctcgatttagcacacgatagttgggtttggggaggaactgctcagttaggacccagacggaaccatggaagccccagctcagcttctcttcctcctgctactctggctcccagataccagcggagagattgtgttgacacagtctccagccaccctgtctttgtctccgggagaaagagccaccctctcctgcagggccagtcagagtgttaacaactacttggcctggttccaacagaaacctggccaggctcccaggctcctcatctatgatgcatccaacagggccactggcatcccagccaggttcagtgcagtgggtctgggacagacttcactctcaccatcacgccgcctagacgcctgaggattctgtccgttttattattgtcgttgggcgttagctaacgtcggtccctcccgttctacgttttcgggccgtacggggaccaacggcgtggagatcgagacgaactggtgctgcaccatctgttctntac

SEQ ID NO: 277697 - DNA, 523 bp, Homo sapiens
  misc_feature: GYAE6OF02GHGLO.29.35.D02.1.454.CMB.1.raw
  modified_base (373)..(373): a, c, t, g, unknown or other
  misc_feature (373)..(373): n is a, c, g, or t
tcagatagagtactcacgaccggtgctcgatttagcacacgatagttgggtttggggaggaactgctcagttaggacccagacggaaccatggaagccccagctcagcttctcttcctcctgctactctggctcccagataccagcggagagattgtgttgacacagtctccagccaccctgtctttgtctccgggagaaagagccaccctctcctgcagggccagtcagagtgttaacaactacttggcctggttccaacagaaacctggccaggctcccaggctcctcatctatgatgcatccaacgagggccacgtggcatcccagccaggttcagtgcagtgggtctgggacagacttcactctcaccntcacgccgctagagcctgaggattcgtgtccgtttattattcgtcgttgggtcgtagctaacgtcgtcctccgtctacgtttcggccgagggtaccagcgtggagatcgaggacgaacgtgtcggcgtcgcacgtactctcgttctctac

SEQ ID NO: 277698 - DNA, 539 bp, Homo sapiens
  misc_feature: GYAE6OF02IDFXM.29.35.D02.1.454.CMB.1.raw
tcagatagagtactcacgaccggtgctcgatttagcacacgatagttgggtttggggaggaactgctcagttaggacccagacggaaccatggaagccccagctcagcttctcttcctcctgctactctggctcccagataccagcggagagattgtgttgacacagtctccagccaccctgtctttgtctccgggagaaagagccaccctctcctgcagggccagtcagagtgttaaacaactacttggcctggttccaacagaaacctggccaggctccaggctcctcatctatgatgcatccaacagggccactggcatcccagccaggttcagtgcagtgggtctgggacagacttcactctcaccatcgagccgcctagacgcctgaggtattcgtgtccgtttattattgttcgttgggtcgtagcaacgtcggtcccgttccgtctacgttttcggccgtacggggaccaaggcgtaggagatacgacggaacgaactggtcggtcgtgcaccattctcgttccttctaccg

SEQ ID NO: 277699 - DNA, 640 bp, Homo sapiens
  misc_feature: GYAE6OF02JAFMG.29.35.D02.1.454.CMB.1.raw
tcagatagagtactcacgaccggtgctcgatttagcacacgatagttgggtttgggggaggaactgctcagttaggacccagacggaaccatggaagccccagctcagcttctcttcctcctgctactctggctcccagataccagcggagagattgtgttgacacagtctccagccaccctgtctttgtctccgggagaaagagccaccctctcctgcagggccagtcagagtgttaacaactacttggcctggttccaacagaaacctggccaggctcccaggctcctcatctatgatgcatccaacagggccactggcactcccagccaggttccagtcggcaggtgggtctgggacaggacttcactctcacatcacgccgcctagacgcctgaggtatttcgtgtacccgttttatttagtttcggtttcgtttggggtccgttacgtaccgtaaccgttcggtccccgttcccggttccgttaccgtttttccggggaccccgtaacgggggtaaccctaaacggtcggttacgggaacggtacgttaccgaacggtaaccggtaacgttcgggttaccgggccttacggacccgtaaccgtacgttccgttacggtttccgttaccttacccg

SEQ ID NO: 277700 - DNA, 536 bp, Homo sapiens
  misc_feature: GYAE6OF02H5A1E.29.35.D02.1.454.CMB.1.raw
  modified_base (523)..(523): a, c, t, g, unknown or other
  misc_feature (523)..(523): n is a, c, g, or t
tcagatagagtactcacgaccggtgctcgatttagcacacgatagttgggtttgggggaggaactgctcagttaggacccagacggaaccatggaagccccagctcagcttctcttcctcctgctactctggctccagataccagcggagagattgtgttgacacagtctccagccaccctgtctttgtctccgggagaaagagccaccctctcctgcagggccagtcagagtgttaacaactacttggcctggttccaacagaaacctggccaggctcccaggctcctcatctatgatgcatccaacagggccactggcatcccagccaggttcagtggcagtgggtctgggcagacttcactctcaccatcacgccgcctagagcctggaggtattcgtcgtccgttttattatttcgttcgttgggtcgttaggcaacgtcggtccctcccgttctaccgttttcggccgtacggggacctaaggcgtggagtagtcgagacgaactggtgtcgtgcacntctgtccttctac

SEQ ID NO: 277701 - DNA, 986 bp, Homo sapiens
  misc_feature: GYAE6OF02F30ZG.29.35.D02.1.454.CMB.1.raw
tcagatagagtactcacgaccggtgctcgatttagcacacgatagttggggtttggggacggaactgctcgaggttaggacccagaccggaaccatgggaacgccccacgcgtcagcttctcttccgtcctggcctactctgggctcccgagtactaccacgcggacgagacttgtgttgacacagtcgtccagccacctgtctttggtctccgggagaaggcgccgaccctctcctcgccgaggggccagtcgaagtacgtagttaaacgaacttacgttcgggacccttgggttacccaaacggtacggtaaaacccgttcggacccgtaacgggaccttacccccgaagggtcccttaccccgttaccgtaacgttccgttaacgttcgaaacttcggtactaccttaccccgaaacggaaccggggtacccctaaccggttacggggacctaaccgttcccccgtaacgggttacccccgttaaggggtttaaccgaacgggtttacggggtaccgttaacgggggtttcgggggttaccggtaccgggggtaacccggtacggttaaccggtttacccaaccgggtttacccttaacccgtaaacccgtacgttacccggaccgggtacccggtaacccggttaacgggaccgttacccgttaagggtaacgggttacgttttacggttacggtttaccggttttaagttttaccggtttacggttaccggttttacggggtaccggttacgggtaccggttaaccggttaccggggtaccccgttacccgggttacccgttaacgggtttttccgggacccgggttaaccgggggtaaccctaaaccgggttccgttaacgggtaaccggtaccgttaccggaaccgggtaaccggtaaccggttacgggttaccgggtccgtttacccggacccttacccgttaaccgttacccgttacgttaccgttccgttaacccg

SEQ ID NO: 277702 - DNA, 553 bp, Homo sapiens
  misc_feature: GYAE6OF02IE6A5.29.35.D02.1.454.CMB.1.raw
  modified_base (261)..(261): a, c, t, g, unknown or other
  misc_feature (261)..(261): n is a, c, g, or t
  modified_base (397)..(397): a, c, t, g, unknown or other
  misc_feature (397)..(397): n is a, c, g, or t
  modified_base (502)..(502): a, c, t, g, unknown or other
  misc_feature (502)..(502): n is a, c, g, or t
tcagatagagtactcacgaccggtgctcgatttagcacacgatagttgggtttggggaggaactgctcagttaggacccagacggacatggaagccccagctcagcttctcttcctcctgctactctggctcccagataccagcggagagattgtgttgacacagtctccagccaccctgtctttgtctccgggagaaagagccaccctctcctgcagggccagtcagagtgttaaacaactacttggcctggttaccaanagaaacctggccaggctcccgggctcctcatctatgatgcatccaacagggccactggcatcccagccaggttcagtggcaggtgggtctgggacagacttcactctcaccgatcagcccgctagacgcctgaggnttcgtgtccgttttattagttgttcgtttgggcgttagctaacgtcggtcccttcccgttactcggttttcgggcccgtacggggtaccaaggcgttgggacgtntacaggaccgaattcggtaggctgccactcttactcgtcttcgacttcccg

SEQ ID NO: 277703 - DNA, 605 bp, Homo sapiens
  misc_feature: GYAE6OF02HLA59.29.35.D02.1.454.CMB.1.raw
  modified_base (196)..(196): a, c, t, g, unknown or other
  misc_feature (196)..(196): n is a, c, g, or t
  modified_base (202)..(202): a, c, t, g, unknown or other
  misc_feature (202)..(202): n is a, c, g, or t
  modified_base (229)..(229): a, c, t, g, unknown or other
  misc_feature (229)..(229): n is a, c, g, or t
  modified_base (253)..(253): a, c, t, g, unknown or other
  misc_feature (253)..(253): n is a, c, g, or t
  modified_base (260)..(260): a, c, t, g, unknown or other
  misc_feature (260)..(260): n is a, c, g, or t
  modified_base (344)..(344): a, c, t, g, unknown or other
  misc_feature (344)..(344): n is a, c, g, or t
  modified_base (393)..(393): a, c, t, g, unknown or other
  misc_feature (393)..(393): n is a, c, g, or t
tcagatagagtactcacgaccggtgctcgatttagcacacgatagttgggtttgggggaggaacgtgctcagttaggaccagacggaacatggaagcccagctcagcttctcttcctcctgctactctggcctcccagataccagcggagagattgtgttgacacagtctccagccaccctgtctttgctcggganaaaagngccacctctcctgcagggccagtcagntgttaaacatctggctggttcaanagaaccngcagctccagctctcatctatcatgtcactacaaacgaggccaacgtggcaactcccagccaggttcagtcggcagtgggtcgngggacagtacgttcactctacacgatacgacgccgtacctagacgtccngtaggtacttacgtcgtaccgttttattaagttcgtttctaggggtccgtagtaccgaacttcgggtaccccttcccgtacgttacgttttccgggaccgtaacggggacgtaaacggcgttacggaagtagtcccgtaagggaacccgtaacgttggtacggggtaccacggtaccaaccgtagtttacccgtgtttaccctagttacccg

SEQ ID NO: 277704 - DNA, 520 bp, Homo sapiens
  misc_feature: GYAE6OF02FJSPV.29.35.D02.1.454.CMB.1.raw
tcagatagagtactcacgaccggtgctcgatttagcacacgatagttgggtttggggaggaactgctcagttaggacccagacggaaccatggaagccccagctcagcttctcttcctcctgctactctggctcccagataccagcggagagattgtgttgacacagtctccagccaccctgtctttgtctccgggagaaagagccaccctctcctgcagggccagtcagagtgttaacaactacttggcctggttccaacagaaacctggccaggctcccaggctcctcatctatgatgcatccaacagggccactggcatcccagccaggttcagtggcaggtgggtctgggacagacttcactctcaccatcagccgctagacgcctgaggattctgtccgtttattattgtcgttgggcgtagcaactggtccctcccgtctacgttttcggccgtacggggaccaaggctggagagtcaggacgaacgtgtggctgcacctatctcgtcttctac

SEQ ID NO: 277705 - DNA, 595 bp, Homo sapiens
  misc_feature: GYAE6OF02IYPCP.29.35.D02.1.454.CMB.1.raw
  modified_base (265)..(265): a, c, t, g, unknown or other
  misc_feature (265)..(265): n is a, c, g, or t
  modified_base (312)..(312): a, c, t, g, unknown or other
  misc_feature (312)..(312): n is a, c, g, or t
tcagatagagtactcacgaccggtgctcgatttagcacacgatagttggggtttggggggaggaactgctcagttaggacccagacggaaccatggaagcccccagctcagcttctcttcctcctgctactctggctcccagataccaggcggagagattggtgttgacacagttctccagccaccctgtctttgtctccgggagaaagagccaccctctccgtgcagggccagtcgagagtgtaacactactggcctggtccanagaacctgccaggctcccagctcctcatctatgatgcatccgaacgngggccacgtggccactcccgagaccaggttcaggtcggcaggtgggtctggggacagacttcactctacgacctataccagcccgacctaggacgccctggacggtactttcgtagtcccgttttatttacgttgttcgttaggcgtagtcacgtcggcccttccggtctacgtttggaccgaggggtaaccagtcgtcggagtacgtacgaacggacggtaaacgttcggtacggtctcggaccgtacccgtagttaccgtcggtttacctttccgtaaccg

SEQ ID NO: 277706 - DNA, 603 bp, Homo sapiens
  misc_feature: GYAE6OF02JV35W.29.35.D02.1.454.CMB.1.raw
  modified_base (197)..(197): a, c, t, g, unknown or other
  misc_feature (197)..(197): n is a, c, g, or t
  modified_base (288)..(288): a, c, t, g, unknown or other
  misc_feature (288)..(288): n is a, c, g, or t
  modified_base (308)..(308): a, c, t, g, unknown or other
  misc_feature (308)..(308): n is a, c, g, or t
tcagatagagtactcacgaccggtgctcgatttagcacacgatagttgggtttgggggaggaactgctcagttaggacccagacggaaccatggaagccccagctcagcttctcttcctcctgctactctggctccagataccagcggagagattgtgttgacacagtctccagccacctgtctttgtctccggganaaagagccaccctctcctgcagggccagtcagagtgttaacactacttggctggttaccaacagaaacctggccaggcctccaggcctccncatcatgatgcactccaacngggcccacgtggccactacccgagccctaggttcaggtcgcaggttgggtcgtgggactacggacctttcgaccgtctacacctatccgacgcccgcctacgacgtccgtaggacggtagttcgtcgtccgtttattacgttgttcgttgggtcgttacgtacgtaacgtccgtaccgtccgttcgtacgtttacggtccgtacggggtaacctacggacgtggacgtacgtacgacggtaacggtaacgtcggtacggcgtacgaccacgtacgttcgtcgttcttaccgtacg

SEQ ID NO: 277707 - DNA, 518 bp, Homo sapiens
  misc_feature: GYAE6OF02H05EY.29.35.D02.1.454.CMB.1.raw
  modified_base (373)..(373): a, c, t, g, unknown or other
  misc_feature (373)..(373): n is a, c, g, or t
  modified_base (515)..(515): a, c, t, g, unknown or other
  misc_feature (515)..(515): n is a, c, g, or t
tcagatagagtactcacgaccggtgctcgatttagcacacgatagttgggtttgggggaggaactgctcagttaggacccagacggaaccatggaagccccagctcagcttctcttcctcctgctactctggctcccagataccagcggagagattgtgttgacacagtctccagccaccctgtctttgtctccgggagaaagagccaccctctcctgcagggccagtcagagtgttaaacaactacttggcctggttccaacagaaacctggccaggctcccaggctcctcatctatgatgcatccaacagggccactggcactcccagccaggttcagtgcagtgggtctgggacagacttcactctcacntcagccgctagacgctgaggattctcgtaccgtttattattgttcgttgggtcgtagcaacgtcgcctcccgtctacgttttcggccgtacggggaccaagcgtggagtagtcgagacgaactggtgctgcacatctgtctntac

SEQ ID NO: 277708 - DNA, 1059 bp, Homo sapiens
  misc_feature: GYAE6OF02H8NKD.29.35.D02.1.454.CMB.1.raw
tcagatagagtactcacgaccggtgctcgatttagcacacgatagttgggtttggggaggaactgctcagttaggacccagacggaaccatggaagccccagctcagcttctcttcctcctgctactctggctcccagataccagcggagagattggtgttgacacgagtctccagcccaccttgttctttgtccgtccgggaagaaagcgcccaccctctcctgcgacgggacctagtcgaggtagttacgttaaaccaacttacgttcggtccgttcggttaacccaaacgaaccggtaaaaccgttcgggacccgtaacgggtacccccttaccccggaacgggtccccttaccccgtacctaactttccttaaggtacggtaacgttcggaccctaaccttaaacccccgaaaacggggaccgggggtaccccctaacgggttcgggaccctaacccgttacccccgaacggaccccggtttaacggggtttaccaacggggttcggacgggttaacggggtttcgggggttacccggttaagggggaaaccctaacggtttacccgttttaccaacccgttttaccctaacccgtaaacccttaacgttacccgaacccgggtacccccggtaacccggttaaccgggtaacccgggttacccggttaacgggtaacgggttttaaccgttttaccggtttacccgggtttttacccggttttttaaaacgtttttaccgggttttttacgggttttccggggtttaccggggtttaccgggtttaaccgggtaacccggttaaacccgggtttccccgggttacccccggtttacccccggttaccgtttttacccgggttttttacccggggtaacccgggttaaccgggggttaaacccgtaaacggttaccgggtttaacggggtaacgttaccggttaaccggaacgggttaaacccggttaaaccggttcggggttaccggttccggttaccgtaccccgaaccgttaaccgttccgtttccggttttacccgttacctttaaccccg

SEQ ID NO: 277709 - DNA, 651 bp, Homo sapiens
  misc_feature: GYAE6OF02IWYEI.29.35.D02.1.454.CMB.1.raw
  modified_base (216)..(216): a, c, t, g, unknown or other
  misc_feature (216)..(216): n is a, c, g, or t
tcagatagagtactcacgaccggtgctcgatttagcacacgatagtgggtttgggggaggaactgctcacgttagggcccagacggaaccatggaagccccagctcaggccttctcttcctcctgcgtactctggctcccagataccagccggagagattagtgttgacacagtctccagcccacccttgttcctttgtccttccggggagaaagngcccaccctctccgtgcagggccagtcagagtgtaacactacgttggcctggttccaacagaaacctggccaggcctcccagggtctccctcactctaatggaactcgacactcccaacgaggggccctaactcgggccacttcccaaggacccagggtttccagttcggacgagggttcggggtcgtggggacaggtacttcgacgtctacgacctactcacgtccgaccctaagacgcctggacggtacttcgtcgtcccgtttattagttcgttcgttcgggtcgttacgtacctaacgtcggtcccttcccgtactacgttttcggccgtacggggtacctaggtccgtacgggagacgtacgaagggtaaccggtaacgttggtacggacgtcgaccgtacctagttccgtacggttaccttacttaccg

SEQ ID NO: 277710 - DNA, 516 bp, Homo sapiens
  misc_feature: GYAE6OF02I1O69.29.35.D02.1.454.CMB.1.raw
  modified_base (499)..(499): a, c, t, g, unknown or other
  misc_feature (499)..(499): n is a, c, g, or t
  modified_base (504)..(504): a, c, t, g, unknown or other
  misc_feature (504)..(504): n is a, c, g, or t
tcagatagagtactcacgaccggtgctcgatttagcacacgatagttgggtttggggaggaactgctcagttaggacccagacggaaccatggaagccccagctcagcttctcttcctcctgctactctggctcccagataccagcggagagattgtgttgacacagtctccagcccaccctgtctttgtctccgggagaaagagcccaccctctcctgcagggccagtcagagtgttaacaactacttggcctggttccaacagaaacctggccaggctcccaggctcctcatctatgatgcatccaacagggccactggcactcccagccaggttcagtggcagtgggtctgggacagacttcactctcaccatcagccgcctagacgcctgaggtattctgtccgttattattgtcttgggcgtagctactcggccttcccgtctacgtttcggccgacgggaccaacgcgtgggagatcgagacgaactggtgcngcacntctgttctctac

SEQ ID NO: 277711 - DNA, 540 bp, Homo sapiens
  misc_feature: GYAE6OF02JC2SH.29.35.D02.1.454.CMB.1.raw
tcagatagagtactcacgaccggtgctcgatttagcacacgatagttgggtttgggggaggaactgctcagttaggacccagacggaaccatggaagccccagctcagcttctcttcctcctgctactctggctcccagataccagcggagagattgtgttgacacagtctccagccaccctgtctttgtctccgggagaaagagccactctctcctgcagggccagtcagagtgttaacaactacttggcctggttccaacagaaacctggccaggcctccaggctcctcatctatgatgcatccaacagggccactggcactcccagccaggttcagtggcaggtgggtctgggacagacttcactctcaccatcacgccgcctagacgcctggagtattcgtcgtccgtttattagtttgttcgttgggtcgtagctacgtcggtcccttcccgtcgtacgtttcggccgtacgggaccaagtctgggagtacgtcgaacggacgaacgtggtcgcgtcgcgacctatctgtcttcg

SEQ ID NO: 277712 - DNA, 536 bp, Homo sapiens
  misc_feature: GYAE6OF02HJ0RY.29.35.D02.1.454.CMB.1.raw
  modified_base (198)..(198): a, c, t, g, unknown or other
  misc_feature (198)..(198): n is a, c, g, or t
  modified_base (310)..(310): a, c, t, g, unknown or other
  misc_feature (310)..(310): n is a, c, g, or t
  modified_base (397)..(397): a, c, t, g, unknown or other
  misc_feature (397)..(397): n is a, c, g, or t
  modified_base (532)..(532): a, c, t, g, unknown or other
  misc_feature (532)..(532): n is a, c, g, or t
tcagatagagtactcacgaccggtgctcgatttagcacacgatagttgggtttgggggaggaactgctcagttaggacccagacggaaccatggaagccccagctcagcttctcttcctcctgctactctggctcccagataccagcggagagattgtgttgacacagtctccagccaccctgtctttgctccggganaaagagcccaccctctcctgcagggccagtcagagtgttaaacaactacttggcctggttccaacagaaacctggccaggctccaggctcctcatctatgatgcatccaacngggccactggcatcccagccaggttcagtcggcagtgggtctaggggacagacttcactcgtcaccatcagccgctagagcctgagnttcgtcgtccgtttattagttcgttcgttgggcgtagctaacgtcggccttacccgtctacgttttcggccgtaggggaacctagcgtaggacgtatcgaggaacgtacgtggtgcgtgctaccattcgtgtctntacc

SEQ ID NO: 277713 - DNA, 689 bp, Homo sapiens
  misc_feature: GYAE6OF02IO6DF.29.35.D02.1.454.CMB.1.raw
  modified_base (195)..(195): a, c, t, g, unknown or other
  misc_feature (195)..(195): n is a, c, g, or t
  modified_base (200)..(200): a, c, t, g, unknown or other
  misc_feature (200)..(200): n is a, c, g, or t
  modified_base (681)..(681): a, c, t, g, unknown or other
  misc_feature (681)..(681): n is a, c, g, or t
tcagatagagtactcacgaccggtgctcgatttagcacacgatagttgggtttgggggaggaacgtgctcagttaggaccagacggaaccatggaagcccagctcagcttctcttcctcctgctactctggctcccagataccagcggagagattgtgttgacacagtctcagccacctgtctttgctccggganaaagngccacctctcctgcagggccagtcaagagttgttaaaccacttacgttggccttggttaccaaacagaaaccgtggccaggcctcccgaggctcctcagtctatcgatcgcatccaaagcgggaccactcggaccactcccgagcccgtaaggttccaaggtcggactaggggttcgggttacgtcggggtaacgagttaccgtttaccaacgtttcccaccgaaccctaagttcccgaccggacccgtaccgttaacggaaccgtccccggttaggaacggttacgtttaccgttacgttaccgtttttaactttaacgtttcggtttacgtttcgggtaccgttacgtacgtaaccgttcggtccctcccgttcgtacgtttcggaccgtacgggaccgtaacgtcgttaggacgtacgtacgacgtaaacgtcgtaggtacggcgttacgaccgtacgtcgttacgtcgttaccgttnttaacccg

SEQ ID NO: 277714 - DNA, 303 bp, Homo sapiens
  misc_feature: GYAE6OF02GWQ9Z.29.35.D02.1.454.CMB.1.raw
  modified_base (265)..(303): a, c, t, g, unknown or other
  misc_feature (265)..(303): n is a, c, g, or t
tcagatagagtactcacgaccggtgctcgatttagcacacgatagttgggtttggggactagacttcactctcaccatcagccgcctagagcctgaggattctgccgtttattattgtcttgggcgtagcaactggccctcccgtcacttttggccaggggaccaagctggagatcgagacgaactgtggctgcaccgatctgtcttcatccttcccgccatctgaagtactctagtctgagcgggtctgggcaaggcgcatagnnnnnnnnnnnnnnnnnnnnnnnnnnnnnnnnnnnnnnn

SEQ ID NO: 277715 - DNA, 566 bp, Homo sapiens
  misc_feature: GYAE6OF02H58CF.29.35.D02.1.454.CMB.1.raw
  modified_base (309)..(309): a, c, t, g, unknown or other
  misc_feature (309)..(309): n is a, c, g, or t
  modified_base (369)..(369): a, c, t, g, unknown or other
  misc_feature (369)..(369): n is a, c, g, or t
tcagatagagtactcacgaccggtgctcgatttagcacacgatagttgggtttggggaggaactgctcagttaggacccagacggaacatggaagccccagctcagcttctcttcctcctgctactctggctcccagataccagcggagagattgtgttgacacagtctccagccaccctgtctttgtctccgggagaaagagccaccctctcctgcagggccagtcagagtgttaacaactacttggcctggttccaacagaaaacctggccaggctcccaggctcctcatctatgatgcatccaacngggccactggcatcccagccaggttcaggtggcaggtgggtctgggacagacttcactcnccaccatcacgccgcctagacgcctggaggtattcgtcgtcgttttatttacgttcggttcgttgggtcgttagactaacgtcggtcccttcccgttcctacgtttcggaccgtacggggaccaaggcgtaggagtacgtcgaggacgtaacgtggtacggtctacgtcaccgtagttccgtcgttccttatacccg

SEQ ID NO: 277716 - DNA, 627 bp, Homo sapiens
  misc_feature: GYAE6OF02H283J.29.35.D02.1.454.CMB.1.raw
tcagatagagtactcacgaccggtgctcgatttagcacacgatagttgggtttgggggaggaactgctcagttaggacccagacggaaccatggaagccccagctcagcttctcttcctcctgctactctggctcccagataccagcggagagattgtgttgacacagtctccagccaccctgtctttgtctccgggagaaagagccaccctctcctgcagggccagtcagagtgttaacactacttggcctggttccaacagaaacctggccaggctcccaggctcctcatctatgatgcatccaacagggccactggcatcccagccaggttcagtgcagtggtctgggacagacttcactctctaccatcacgccgcctagacgcctgaggtattacgtgtccgttttattagtttcgttacgtttgggtccgttagccgtaaacgttcgggtacccgttccccggttacgttacgtttttacgggcccgtaacgggggtaccctaaaaggtccgttaggggaacgtacgttaccgtacgggtaaccggaaaccgttcgggtaacggtccgtacggaccctaacccgaacgtttccgttacggtttccctttaccgttaacccg

SEQ ID NO: 277717 - DNA, 521 bp, Homo sapiens
  misc_feature: GYAE6OF02FWVP0.29.35.D02.1.454.CMB.1.raw
tcagatagagtactcacgaccggtgctcgatttagcacacgatagttgggtttgggggaggaactgctcagttaggacccagacggaaccatggaagccccagctcagcttctcttcctcctgctactctggctcccagataccagcggagagattgtgttgacacagtctccagccaccctgtctttgtctccgggagaaagagccaccctctcctgcagggccagtcagagtgttaacaactacttggcctggttccaacagaaacctggccaggctcccaggctcctcatctatgatgcatccaacagggccactggcatcccagccaggttcagtggcagtgggtctgggacaggcttcactctcaccatcagccgcctagagcctgaggattctgtccgtttattattgtcttgggtcgtagcaacgttcggcctcccgttctacttttcggccgtagggaccaagcgtggagactcgagacgaactggtggcgtgcaccacttctcgtcttctac

SEQ ID NO: 277718 - DNA, 527 bp, Homo sapiens
  misc_feature: GYAE6OF02GVVYR.29.35.D02.1.454.CMB.1.raw
tcagatagagtactcacgaccggtgctcgatttagcacacgatagttgggtttggggaggaactgctcagttaggacccagacggaaccatggaagccccagctcagcttctcttcctcctgctactctggctcccagataccagcggagagattgtgttgacacagtctccagccaccctgtctttgtctccgggagaaagagccaccctctcctgcagggccagtcagagtgttaacaactacttggcctggttccaacagaaacctggccaggctcccaggctcctcatctatgatgcatccaacagggccactggcatcccagccaggttcagtggcaggtgggtctgggacagacttcactctcacctatcacgccgcctagacgcctggaggtattcgtcgtccgttttattattgttcgttgggtcgtagctaacgtcggcccttcccgtctacgtttcggccgtaggggaccaggctggagagtcaggacgaactgtggtctgcacatctgtcttctac

SEQ ID NO: 277719 - DNA, 514 bp, Homo sapiens
  misc_feature: GYAE6OF02ITBLI.29.35.D02.1.454.CMB.1.raw
tcagatagagtactcacgaccggtgctcgatttagcacacgatagttgggtttgggggaggaactgctcagttaggacccagacggaaccatggaagccccagctcagcttctcttcctcctgctactctggctcccagataccagcggagagattgtgttgacacagtctccagccaccctgtctttgtctccgggagaaagagccaccctctcctgcagggccagtcagagtgttaacaactacttggcctggttccaacagaaacctggccaggctcccaggctcctcatctatgatgcatccaaacagggccactggcatcccagccaggttcagtggcagtgggtctgggacagacttcactctcaccatcagccgctagagcctgaggtattctgtccgtttattattgttcgttgggcgtagcaacgtggccctccgtctacgtttcggccgtagggaccaagcgtggagatcgagaacgactggtgcgtgcacatctgtctctacg

SEQ ID NO: 277720 - DNA, 561 bp, Homo sapiens
  misc_feature: GYAE6OF02FXS60.29.35.D02.1.454.CMB.1.raw
tcagatagagtactcacgaccggtgctcgatttagcacacgatagttgggtttgggggaggaactgctcagttaggacccagacggaaccatggaagccccagctcagcttctcttcctcctgctactctggctcccagataccagcggagagattgtgttgacacagtctccagccaccctgtctttgtctccgggagaaagagccaccctctcctgcagggccagtcagagtgttaacaactacttggcctggttccaacagaaacctggccaggctcccaggcctcctcatctatgatgcatccaacagggccactggcatcccagccaggttcagtggcaggtgggtctgggacagacttcactctcaccatcagccgcctagacgcctgaggattcgtgtccgtttattagttgtcgtttgggtcgtagcgtaacgtcggcccttccgtcctacgttttcggaccgtacggggacctaacggcgtagggacgtactcgaaggaacggtaacttggtcgggtcttcggcaccgtatccgttcgttccttactacccg

SEQ ID NO: 277721 - DNA, 616 bp, Homo sapiens
  misc_feature: GYAE6OF02GRHLU.29.35.D02.1.454.CMB.1.raw
  modified_base (211)..(211): a, c, t, g, unknown or other
  misc_feature (211)..(211): n is a, c, g, or t
  modified_base (297)..(297): a, c, t, g, unknown or other
  misc_feature (297)..(297): n is a, c, g, or t
  modified_base (323)..(323): a, c, t, g, unknown or other
  misc_feature (323)..(323): n is a, c, g, or t
  modified_base (433)..(433): a, c, t, g, unknown or other
  misc_feature (433)..(433): n is a, c, g, or t
tcagatagagtactcacgaccggtgctcgatttagcacacgatagttggggtttagggggaggaactgctcagttaggacccagacggaaccatggaagccccagctcagcttctcttacctcctgctactctggctcccgagtagtaccaggcggagaggtattgtgttgactacagtctccagccacctgtcttgctccgggagaaagngccaccgtctcctgccagggccaggtcagagtgttaacacttacttggcctggttaccaacagaaacctggccaggcctcccgggntccctcatctatgatgcatccaacgnggccacgtggcactcccgagccgaggttcaagtggacaggtgggtctggggacaggaacttcacttctccaacatcacgcccgtcctaaggacgcctagacggactttcncgtccgttttattacttgttcgttagggacgttagctaacgttcggtcccttcccgtacttacgttttcggaccgtacgggggaaccaagcggttacggagtacgtcaacgggtacgtaaacgtgggtacggtccgttgccgtaaccgagtttcccgtagtttcccttacgacgtttaccccg

SEQ ID NO: 277722 - DNA, 513 bp, Homo sapiens
  misc_feature: GYAE6OF02H1IPG.29.35.D02.1.454.CMB.1.raw
tcagatagagtactcacgaccggtgctcgatttagcacacgatagttgggtttggggaggaactgctcagttaggacccagacggaaccatggaagccccagctcagcttctcttcctcctgctactctggctcccagataccagcggagagattgtgttgacacagtctccagccaccctgtctttgtctccgggagaaagagccaccctctcctgcagggccagtcagagtgttaacaactacttggcctggttccaacagaaacctggccaggctcccaggctcctcatctatgatgcatccaacagggccactggcatcccagccaggttcagtggcagtgggtctgggacagacttcactctcaccatcagccgcctagacgcctgaggattctgtccgtttattacttgttcgttggtcgtagcacgtcgcctccgtctactttcggccgtagggaccgaagcgtggagagtcagacgtaactggtgcgtgcacatctgtcttctac

SEQ ID NO: 277723 - DNA, 640 bp, Homo sapiens
  misc_feature: GYAE6OF02GIIFK.29.35.D02.1.454.CMB.1.raw
  modified_base (205)..(205): a, c, t, g, unknown or other
  misc_feature (205)..(205): n is a, c, g, or t
  modified_base (312)..(312): a, c, t, g, unknown or other
  misc_feature (312)..(312): n is a, c, g, or t
tcagatagagtactcacgaccggtgctcgatttagcacacgatagttgggtttgggggaggaactgctcagttaggacccagacggaaccatggaagccccagctcagcttctcttcctcctgctactctggctcccagataccagcggagagattgtgttgacacagtctccagccaccctgtctttgtcctccgggagaaagngccaccctctcctgcagggccagtcagagtgttaacaacttacttggcctggttccaacagaaacctggccaggctcccaggctcctcatctatgatgcatccaacngggccactggcactcccagccaggttcagtggctaggtgggtctgggacaggtaccttcgacttcgtccacctatcacgccgacctagacgccctgacggtattccgtggtacccgtttattagtttcgttcgttcgggtacgttacggctaaccgttcggtcccttcccggttaccgttaccgttttccggacccgtaacggggtacccgaaaggtccggttaggacgtacgttacgaaccggtaacggtaaccgttgggttaccggtcgttaccggacccgtaaccctaacgtttccggttacggtttacctttacccgtaacccg

SEQ ID NO: 277724 - DNA, 631 bp, Homo sapiens
  misc_feature: GYAE6OF02H741F.29.35.D02.1.454.CMB.1.raw
  modified_base (203)..(203): a, c, t, g, unknown or other
  misc_feature (203)..(203): n is a, c, g, or t
  modified_base (265)..(265): a, c, t, g, unknown or other
  misc_feature (265)..(265): n is a, c, g, or t
  modified_base (359)..(359): a, c, t, g, unknown or other
  misc_feature (359)..(359): n is a, c, g, or t
tcagatagagtactcacgaccggtgctcgatttagcacacgatagttgggtttggggaggaactgctcagttaggacccagacggaaccatggaagccccagctcagcttctcttctcctgctactctggctcccagataccagcggagagattgtgttgacacagtctccagccaccctgtctttgctaccgggagaaaagngccaccctctcctgccagggccagtcagagtagttaacaacttacttcggctggttccaaanagaaacctggccaggctccgaggctcctcactctatgatgcatccaacgacggtccactggcaactcccagcctagttcaggtgcaggtcggtngggacagacttcactcacaccatcacgccgctagacgctgaggtattctgtccgtttattagttcgttcgttcggggtacgtaggtcctaaacgttcgggcccgtttcccggttacccttacggtttttacgggacccggtaggggtaaccccgtaagtccggttagggaacgtacgttacggtaacggtaaccggtaaaccgtttgggtacggtccggttacgaccgtaaccgtaacgttccgtttagggtttacccttacggttaacccg

SEQ ID NO: 277725 - DNA, 528 bp, Homo sapiens
  misc_feature: GYAE6OF02G27YM.29.35.D02.1.454.CMB.1.raw
  modified_base (203)..(203): a, c, t, g, unknown or other
  misc_feature (203)..(203): n is a, c, g, or t
tcagatagagtactcacgaccggtgctcgatttagcacacgatagttgggtttggggaggaactgctcagttaggacccagacggaaccatggaagccccagctcagcttctcttcctcctgctactctggctcccagataccagcggagagattgtgttgacacagtctccagccaccctgtctttgtctccgggagaaagnggccaccctctcctggcagggccagtcagagtgttaacaactacttggcctggttccaacagaaacctggccaggctccaggctcctcatctatgatgcatccaacagggccactggcatcccagccaggttcagtggcagtgggtctgggacagacttcactctcaccatcacgccgctagacgcctgagtattcgtgtccgtttattattgtcgttgggtcgtagctaacgtcggcctcccgtctacgttttcggccgtagggaccaaggcgtggagagtcgagaacggaactggtggctgcaccgatctcgttcctctaccg

SEQ ID NO: 277726 - DNA, 606 bp, Homo sapiens
  misc_feature: GYAE6OF02G1QNE.29.35.D02.1.454.CMB.1.raw
  modified_base (314)..(314): a, c, t, g, unknown or other
  misc_feature (314)..(314): n is a, c, g, or t
tcagatagagtactcacgaccggtgctcgatttagcacacgatagttgggtttgggggaggaactgctcagttaggacccagacggaaccatggaagccccagctcagcttctcttcctcctgctactctggctcccagataccagcggagagattgtgttgacacagtctccagccaccctgtctttgtctccgggagaaagagcccaccctctcctgcagggccagtcagagtgttaacaactacttggcctggttccaacagaaacctggccaggctcccaggcctcctcatctatgatgcataccaacgngggccacgtggcactcccagcctaggttcaggtggcaggtgggtcgtgggacagacttcactctacaccatcgacgccgctacgcgccgtaggaggtacttcgtcggttaccgttttattacgtttcggttcgtttcgggtcgttacgtacctaacgttcggtcccgttcccgttccttaccgttttcgggaccgtacggggtaacctaacggtccgtaggacgtacgtacgacggtaacgaacgttcggtcggcgtcggacctaccgtacttcgtcgttccttacgtaccg

SEQ ID NO: 277727 - DNA, 591 bp, Homo sapiens
  misc_feature: GYAE6OF02IGUNL.29.35.D02.1.454.CMB.1.raw
tcagatagagtactcacgaccggtgctcgatttagcacacgatagttgggtttgggggaactgctcagttaggacccagacggaaccatggaagccccagctcagcttctcttcctcctgctactctggctcccagataccagcggagagattgtgttgacacagtctccagccaccctgtctttgtctccgggagaaagagccaccctctcctgcagggccagtcagagtgttaaacaactacttggcctggttccaacagaaacctggccaggctcccaggctcctcatctatgatgcatccaacacgggccactggcatcccagccaggttcagtggcagtgggtctgggacagacttcactctcaccatcacgccgcctagacgcctagagggatttctcgtccgttttattatttgttcgtttgggcgttagctaacgtcggtcccttcccgttacttaccgttttcgggcccgtagggggaccctaaaggcttagggagtactcgaaggtaccgaaacgttggtacgggccgttacggccctacccgtacgttacccgttggttacctttcctaactttcccccg

SEQ ID NO: 277728 - DNA, 738 bp, Homo sapiens
  misc_feature: GYAE6OF02IP9CV.29.35.D02.1.454.CMB.1.raw
tcagatagagtactcacgaccggtgctcgattttagcacacgatagttggggtttggggaggaactagctcgagtttaggacccagaccggaaccattggaagtccccagcttcagcctttcgtctttcctcctggcctaccgtcgtgcttcccgagataccacgcggagacgattcgtcgttgacacgagtcctccgagccacccgtgtacctttgcctaccgggagaaaacgacgcccaaccctctaccgtagtcgtaggcccaggtcacgaagttagttaaaccaacttacgttggcccttggttaccccaaagacgaaaaccgtacggaccgacggtccctacccccgaaggtccttccctactaacgtcgtaactacgtacgtccggactaccggtacccaacgaccgggacctacgtgggaccactcccgacggccgtaggttaccaggttcgtacgacgttcggtccgtacggactacgaacctttacgactccgtacacctataccgacgtccgacgtacgacgttactaggtagtactcgttacgtacgttttattacgtttcgttccgttcggtccgttacgtacgtaacggtcgtacccgtaccgttacgttacgtttcggaccgtaacgggtaaccgagtccgtaggacgtacgtacgacggtaacgtaacgttggtacgtactacggtccctaaccgtcgttaccgttacgttacttactacccg

SEQ ID NO: 277729 - DNA, 525 bp, Homo sapiens
  misc_feature: GYAE6OF02HT8GB.29.35.D02.1.454.CMB.1.raw
  modified_base (522)..(522): a, c, t, g, unknown or other
  misc_feature (522)..(522): n is a, c, g, or t
tcagatagagtactcacgaccggtgctcgatttagcacacgatagttgggtttggggaggaactgctcagttaggacccagacggaaccatggaagccccagctcagcttctcttcctcctgctactctggctcccagataccagcggagagattgtgttgacacagtctccagccaccctgtctttgtctccgggagaaagagccaccctctcctgcagggccagtcagagtgttaacaactacttggcctggttccaacagaaacctggccaggctccccaggctcctcatctatgatgcatccaacagggccactggcatcccagccaggttcagtggcagtggtctgggacagacttcactctcacctatccagccgcctagacgcctgaggattctgtccgtttattattgttcgttgggtcgtagctaacgtggcctcccgtctacgttttcggccgtacgggtaccaagcgtggagatcgacggacgaacgtggtcgtcgtgcaccatctgtctntac

SEQ ID NO: 277730 - DNA, 518 bp, Homo sapiens
  misc_feature: GYAE6OF02IJYVC.29.35.D02.1.454.CMB.1.raw
  modified_base (200)..(200): a, c, t, g, unknown or other
  misc_feature (200)..(200): n is a, c, g, or t
  modified_base (263)..(263): a, c, t, g, unknown or other
  misc_feature (263)..(263): n is a, c, g, or t
  modified_base (509)..(509): a, c, t, g, unknown or other
  misc_feature (509)..(509): n is a, c, g, or t
  modified_base (515)..(515): a, c, t, g, unknown or other
  misc_feature (515)..(515): n is a, c, g, or t
tcagatagagtactcacgaccggtgctcgatttagcacacgatagttggggtttgggggaggaactgctcagttaggacccagacggaaccatggaagccccagctcagcttctcttcctcctgctactctggctcccagataccagcggagagattgtgttgacacagtctccagccaccctgtctttgtctccggganaaagagccaccctctcctgcagggccagtcagagtgttaacaactacttggcctggttccaanagaaacctggccaggctcccaggctcctcatctatgatgcatccaacagggccactggcatccagccaggttcagtggcagtgggtctgggacagacttcactctcaccatcacgccgcctagacgcctgaggattctgtccgtttattattgttcttgggcgtagcaacgtcggaccttcccgtctcgtttggcccgtaggggaccaaggctggagtatcgagacgaactggtggctgcacatcncgtctntac

SEQ ID NO: 277731 - DNA, 583 bp, Homo sapiens
  misc_feature: GYAE6OF02GP7Q0.29.35.D02.1.454.CMB.1.raw
  modified_base (198)..(198): a, c, t, g, unknown or other
  misc_feature (198)..(198): n is a, c, g, or t
  modified_base (203)..(203): a, c, t, g, unknown or other
  misc_feature (203)..(203): n is a, c, g, or t
  modified_base (366)..(366): a, c, t, g, unknown or other
  misc_feature (366)..(366): n is a, c, g, or t
tcagatagagtactcacgaccggtgctcgatttagcacacgatagttagggttggggaggaactgctcagttacggacccagacggaaccatggaagccccagctcgagcttctcttcctcctgctactctggctcccagataccagcggagagattgtgttgacacagtctccagccacctgtctttgctccggganaaagngcccaccctctcctgcagggcctagtcagagtgttaaacaactacgttggcctggttccaaacagaaaacctggccaggctcccaggcctcctcatctatcgatgcatccaacgacgggccactggcactcccagccagttcagtggcagtgggtctgggacngacttcactcgtcaccatcgacgccgaccgtacgacgcctagacggtacttacgtcgtaccgttttattagtttggttccgttgggtacgtacgtactaacgtcggcccttcccgttctaccgttttcggccgttaagggaacccaagcgtaggacgtagtacgaggaaccgtaacgtggtacgtcgtgccactacttcgtagttccttacgttacc

SEQ ID NO: 277732 - DNA, 715 bp, Homo sapiens
  misc_feature: GYAE6OF02GE7GT.29.35.D02.1.454.CMB.1.raw
  modified_base (233)..(233): a, c, t, g, unknown or other
  misc_feature (233)..(233): n is a, c, g, or t
tcagatagagtactcacgaccggtgctcgatttagcacacgatagttgggtttgggggaggaactgctcagttaggacccagacggaaccatggaagccccagctcagcttctcttcctcctgctactctggctcccagataccagcggagagattgtgttgacacagtctccagccaccctgtctttgtctccgggagaaagagccaccctctcctgcagggccagtcaggngtactaacactacgtcgcgttcgtaccaagaacgtaaccgtcgacgacggtcctaccgagcccttccactacttactagtgtatcgactactaccaacggcggacctacgtcggacctacctacccgacgaccgttaggttcaggttcggacgtaggggttcggtacggtacgggaactacggtaccttacaaccgttcctaaccgaacctactaccgaccgcccgtacgtaacggaccgtccgtaggagttacgtttcgtcggtttaccgttttaatttagtttcgttcggtttcgggtacgttacgaccttaacggtccggtccccttaccggttacttttaccggtttccgggacccgggttaaacgggtaacccgtacggtacggtacgggtaagtaccgtacggaaccggtaaaccggtacgttcgggtcggtaccgtccgaccttaccgtactttcgttcgtttcctacttacccg

SEQ ID NO: 277733 - DNA, 578 bp, Homo sapiens
  misc_feature: GYAE6OF02F1LS6.29.35.D02.1.454.CMB.1.raw
  modified_base (361)..(361): a, c, t, g, unknown or other
  misc_feature (361)..(361): n is a, c, g, or t
tcagatagagtactcacgaccggtgctcgatttagcacacgatagttgggtttgggggaggaactgctcagttaggacccagacggaaccatggaagccccagctcagcttctcttcctcctgctactctggctcccagataccagcggagagattgtgttgacacagtctccagccaccctgtctttgtctccgggagaaagagccaccctctcctgcagggccagtcagagtgttaacaactacttggcccttggttccaacagaaacctggccaggctcccaggctcctcatctatgatggcatccaacacgggccacgtggcatcccagccaggttcagtggcagtggtctgggacngacttcactctcacatcgagcccgacctagacgtcctggaggtacttcgtcgtccgtttatttagttgttcgttgggcgtagtctaacgtcggtccctcccggttcttaccgttttacgggccgtaacggggtaccacggtactgggagtacgttacgacggaacgtaacgtggtcggtcgttacggcctaccgtagttcgtacgttccttactacg

SEQ ID NO: 277734 - DNA, 547 bp, Homo sapiens
  misc_feature: GYAE6OF02G5RAX.29.35.D02.1.454.CMB.1.raw
  modified_base (499)..(499): a, c, t, g, unknown or other
  misc_feature (499)..(499): n is a, c, g, or t
tcagatagagtactcacgaccggtgctcgatttagcacacgatagttgggtttggggaggaactgctcagttaggacccagacggaaccatggaagccccagctcagcttctcttcctcctgctactctggctcccagataccagcggagagattgtgttgacacagtctccagccaccctgtctttgtctccgggagaaagagccaccctctcctgcagggccagtcagagtgttaacaactacttggcctggttccaacagaaacctggccaggctcccaggctcctcatctatgatgcatccaacgagggccacgtggcactcccgagccctaggttcaggtggcaggtgggtcgtgggacagtacttcacgtctaccaccatccgacgcccgacctacgacgccgtggacggtattcgtcgtccgtttattattgtcgttggcgtagctacgtcgccgtccgtctacgtttcggcgtacgggacctacgcgtganagtcgagtacgaactggtgcgtcgacactacgtctcgttcttctaccg

SEQ ID NO: 277735 - DNA, 513 bp, Homo sapiens
  misc_feature: GYAE6OF02FO5K1.29.35.D02.1.454.CMB.1.raw
  modified_base (510)..(510): a, c, t, g, unknown or other
  misc_feature (510)..(510): n is a, c, g, or t
tcagatagagtactcacgaccggtgctcgatttagcacacgatagttgggtttgggggaggaactgctcagttaggacccagacggaaccatggaagccccagctcagcttctcttcctcctgctactctggctcccagataccagcggagagattgtgttgacacagtctccagccaccctgtctttgtctccgggagaaagagccaccctctcctgcagggccagtcagagtgttaacaactacttggcctggttccaacagaaacctggccaggctcccaggctcctcatctatgatgcatccaacagggccactggcatcccagccaggttcagtggcagtgggtctgggacagacttcactctcaccatcagccgcctacgagcctgaggattctgccgtttattattgtcttgggtcgtagcaacgtggcctcccgtctacttttcggccgtagggaccaagcgtggagatcgagacgaactgtggctgcaccatctcgtcttntac

SEQ ID NO: 277736 - DNA, 598 bp, Homo sapiens
  misc_feature: GYAE6OF02IA9NA.29.35.D02.1.454.CMB.1.raw
  modified_base (367)..(367): a, c, t, g, unknown or other
  misc_feature (367)..(367): n is a, c, g, or t
tcagatagagtactcacgaccggtgctcgatttagcacacgatagttgggtttgggggaggaactgctcagttaggacccagacggaaccatggaagccccagctcagcttctcttcctcctgctactctggctcccagataccagcggagagattgtgttgacacagtctccagccaccctgtctttgtctccgggagaaagagcccaccctctcctgcagggccagtcagagtgttaaacaactacttggcctggttccaaacagaaacctggccaggcctccaggctcctcatctatgatgcatcccaacgagggccacgtggacactccccagcctaggttcagtggcagtgggtctgggacngacttcactctcacatcgacgccgacctagacgcctgagtattctgtccgttttattattgttcgttgggtcgtagactaacgtcggtcccttcccgtcttacgttttcggaccgtacgggggtaaccaaggtccgtagggacgtacgttccgaaggtaaccgtaaacgttcggtacgggtcttcggaccaacccgtagttcccgtttcggtttaccctttacttaacccg

SEQ ID NO: 277737 - DNA, 543 bp, Homo sapiens
  misc_feature: GYAE6OF02G8TKC.29.35.D02.1.454.CMB.1.raw
tcagatagagtactcacgaccggtgctcgatttagcacacgatagttgggtttgggggaggaactgctcagttaggacccagacggaaccatggaagccccagctcagcttctcttcctcctgctactctggctcccagataccagcggagagattgtgttgacacagtctccagccaccctgtctttgtctccgggagaaagagccaccctctcctgcagggccagtcagagtgttaacaactacttggcctggttccaacagaaacctggccaggctccaggctcctcatctatgatgcatccaacagggccactggcatcccagccaggttcagtggcagtgggtctgggacagacttcactctcaccatcacgccgcctagacgcctggaggattctgtccgtttattatttgttcgttgggtcgttagctaacgtcggtccctcccgttctacgttttcggaccgtacggggacctacggcgtcgggtagagtcgacggaacgaacgtggtggctgccacactcgtcgttcttctacc

SEQ ID NO: 277738 - DNA, 569 bp, Homo sapiens
  misc_feature: GYAE6OF02JYTTH.29.35.D02.1.454.CMB.1.raw
tcagatagagtactcacgaccggtgctcgatttagcacacgatagttgggtttgggggaggaactgctcagttaggacccagacggaaccatggaagccccagctcagcttctcttcctcctgctactctggctcccagataccagcggagagattgtgttgacacagtctccagccaccctgtctttgtctccgggagaaagagccaccctctcctgcagggccagtcagagtgttaacactacttggcctggttccaacagaaacctggccaggctccgaggcctcctcatctatgatgcatccaacgacgggccactggccactcccagcctaggttcagtggcaggtgggtctggggacaggtacttcactctaccacactcacgccgccgtagacgtcctggagtacttcgttacggtccgtttattacgttgttcgttcgggtacgtacgtactaacgttcggtccctccgttcgtacgtttcggccgtacggggtacctaaggcgtggagtactacgacgacgtacgtcggtacggtctcgacgactagtctcgtctctacg

SEQ ID NO: 277739 - DNA, 605 bp, Homo sapiens
  misc_feature: GYAE6OF02JZ42X.29.35.D02.1.454.CMB.1.raw
  modified_base (205)..(205): a, c, t, g, unknown or other
  misc_feature (205)..(205): n is a, c, g, or t
  modified_base (315)..(315): a, c, t, g, unknown or other
  misc_feature (315)..(315): n is a, c, g, or t
  modified_base (383)..(383): a, c, t, g, unknown or other
  misc_feature (383)..(383): n is a, c, g, or t
tcagatagagtactcacgaccggtgctcgatttagcacacgatagttgggtttgggggaggaactgctcagttaggacccagacggaaccatggaagccccagctcagcttctcttcctcctgctactctggctcccagataccagcggagagattgtgttgacacagtctccagcccaccctgtctttgtctccgggagaaagngccaccctctcctgcagggccagtcagagtgttaacaactacttggcctggttaccaacagaaacctggccaggcctcccaggcctcctcatctatgatgcatccaacgngggtccacgtggacatcccagccaggttcagtggcaggtgggtctgggacagtacttcgactctcacnctcgacgccgcctagacgtccgtggacgtacttcgtcgtacgtttactttagttcgttcgttgggtcgtacgcgtaacgttcggtcccttcccggtccttacgttttcggcccgtaacggggtaccgtaacggtcgtagggtacgtagtacgtacgggtaacgtaaccggttggtacggtcgtacgacctaaccggtacttcgtcggttccttacgttaccg

SEQ ID NO: 277740 - DNA, 521 bp, Homo sapiens
  misc_feature: GYAE6OF02GLOZZ.29.35.D02.1.454.CMB.1.raw
  modified_base (483)..(483): a, c, t, g, unknown or other
  misc_feature (483)..(483): n is a, c, g, or t
  modified_base (508)..(508): a, c, t, g, unknown or other
  misc_feature (508)..(508): n is a, c, g, or t
  modified_base (513)..(513): a, c, t, g, unknown or other
  misc_feature (513)..(513): n is a, c, g, or t
tcagatagagtactcacgaccggtgctcgatttagcacacgatagttgggtttggggaggaactgctcagttaggacccagacggaaccatggaagccccagctcagcttctcttcctcctgctactctggctcccagataccagcggagagattgtgttgacacagtctccagccaccctgtctttgtctccgggagaaagagccaccctctcctgcagggccagtcagagtgttaacaactacttggcctggttccaacagaaacctggccaggctcccaggctcctcatctatgatgcatccaacagggccactggcactcccagccaggttcagtggcaggtgggtctgggacagacttcactctcaccatcagccgcctagacgccgtgaggtacttcgtgtccgtttattattgttcgttgggtcgtagctaacgtcgcctccgtctacgtttcggcctaggggaccagcgtggagntacgagacgaactggtcgctgcacntcgtntcttctac

SEQ ID NO: 277741 - DNA, 522 bp, Homo sapiens
  misc_feature: GYAE6OF02GKEGU.29.35.D02.1.454.CMB.1.raw
  modified_base (499)..(499): a, c, t, g, unknown or other
  misc_feature (499)..(499): n is a, c, g, or t
tcagatagagtactcacgaccggtgctcgatttagcacacgatagttgggtttggggaggaactgctcagttaggacccagacggaaccatggaagccccagctcagcttctcttcctcctgctactctggctcccagataccagcggagagattgtgttgacacagtctccagccaccctgtctttgtctccgggagaaagagccaccctctcctgcagggccagtcagagtgttaacaactacttggcctggttccaacagaaacctggccaggctcccaggctccctcatctatgatgcatccaacagggccactggcatcccagccaggttcagtgcagtgggtctgggacagacttcactctcaccatcacgccgcctagacgcctggaggtattctgtccgtttattagtttgtcgtttgggcgttagcgtaacgtcggtccctccgtctacgttttcggccgtagggaccagcgtgagatcgagacgactgnggcgtgcactatctgttctctac

SEQ ID NO: 277742 - DNA, 648 bp, Homo sapiens
  misc_feature: GYAE6OF02IRQR8.29.35.D02.1.454.CMB.1.raw
tcagatagagtactcacgaccggtgctcgatttagcacacgatagttgggtttgggggaggaactgctcagttaggacccagacggaaccatggaagccccagctcagcttctcttcctcctgctactctggctcccagataccagcggagagattgtgttgacacagtctccagccaccctgtctttgtctccgggagaaagagccaccctctcctgcagggccagtcagagtgttaacaactacttggcctggttccaacagaaacctggccaggctccaggctcctcatctatgatgcatccaacagggccactggcatcccagccaggttcagtggcaggtgggtctggggacagtacttcgacttctcaccatccacgcccgacctacggacgccctggacggtacgtttcgttcggtaccgttttattaacgtttcggttcgtttggggtacgttaggtaccaaccgttcgggtcccttaccccggttaccgttaaccgtttttcgggacccggtaacgggggtaacccaaaggtccgttaggggaacgtacgttacgaacgggtaaacgtaaccggtcgggttacggtaccgttacggccctaaccgttacgttaccgtttcggttaccttacgttacccg

SEQ ID NO: 277743 - DNA, 255 bp, Homo sapiens
  misc_feature: GYAE6OF02G93P0.29.35.D02.1.454.CMB.1.raw
  modified_base (255)..(255): a, c, t, g, unknown or other
  misc_feature (255)..(255): n is a, c, g, or t
tcagatagagtactcacgaccggtgctcgatttagcacacgatagttgggtttgggacagacttcactctcaccatcagccgcctagagcctgaggattctgccgtttattattgtcttgggcgtagcaactggcctcccgtcacttttggccaggggaccaagctggagatcagacgaactgtggctgcaccatctgtcttcatcttcccgcatctgaagtactctatctgagcgggctggcaaggcgcatagn

SEQ ID NO: 277744 - DNA, 517 bp, Homo sapiens
  misc_feature: GYAE6OF02JJOM1.29.35.D02.1.454.CMB.1.raw
  modified_base (502)..(502): a, c, t, g, unknown or other
  misc_feature (502)..(502): n is a, c, g, or t
  modified_base (513)..(513): a, c, t, g, unknown or other
  misc_feature (513)..(513): n is a, c, g, or t
tcagatagagtactcacgaccggtgctcgatttagcacacgatagttgggtttgggggaggaactgctcagttaggacccagacggaaccatggaagccccagctcagcttctcttcctcctgctactctggctcccagataccagcggagagattgtgttgacacagtctccagccaccctgtctttgtctccgggagaaagagccaccctctcctgcagggccagtcagagtgttaacaactacttggcctggttccaacagaaacctggccaggctcccaggctcctcatctatgatgcatccaacagggccactggcatcccagccaggttcagtggcagtgggtctgggacagacttcactctcaccatcagccgctagacgcctgagtattcgtcgtccgtttattattgtcgttgggtcgtagtcaacgtcgcctccgtctacgtttcggccgtagggaccagcgtgacgtatacgagacgactgtcgctgcacnctctcgtcttntacg

SEQ ID NO: 277745 - DNA, 670 bp, Homo sapiens
  misc_feature: GYAE6OF02IMRWX.29.35.D02.1.454.CMB.1.raw
tcagatagagtactcacgaccggtgctcgatttagcacacgatagttgggtttgggggaggaactgctcagttaggacccagacggaaccatggaagccccagctcagcttctcttcctcctgctactctggcctccagactaccaggcggagagtattggttgttgacacagttcctccagcccacccttgttcttttgtccgtccgggaagaaagcgccctaccctctcctgcgacgggccagtcagtagttagttaaaccaacttcgtcggccttcggttaccaaacaacgaaacctcggccaggcctcccgaggcctcctcatctattgatcgctactacccaaacgtcgggacctacggtggaccacctcccgagccgtaggttccaggtcggcgtaggttcgggtcgtagggacagtaccttcaccttctaccacctactcgacgcccgtacctacgacgtccgtaggtaggtacttccgtacggtttaccgtttttagtttagtttcgtttcgttcggggtacgttacgtaccgtaacgttcggtcccttcccgttcttacgttttcggaccggtacgggaccgacgtcgtaggactagtacgacggaacgtaacgttggtcggtcgtacgacctacctacttcgttcgttccttcgttaccc

SEQ ID NO: 277746 - DNA, 596 bp, Homo sapiens
  misc_feature: GYAE6OF02G5SB8.29.35.D02.1.454.CMB.1.raw
  modified_base (261)..(261): a, c, t, g, unknown or other
  misc_feature (261)..(261): n is a, c, g, or t
tcagatagagtactcacgaccggtgctcgatttagcacacgatagttgggtttggggaggaactgctcagttaggacccagacggaaccatggaagccccagctcagcttctcttcctcctgctactctggctcccagataccagcggagagattgtgttgacacagtctccagccaccctgtctttgtctccgggagaaagagccaccctctcctgcagggccagtcagagtgttaacaactacttggcctggttccaanagaaacctggccaggctcccaggctcctcatctatgatgcatccaacagggccactggccatcccagccaggttcaggtcggctaggtggtctgggacaggcttacactctcacctatcacgccgcctagacgcctggacggtattcgttcgtccgttttaattagtttcgttcgtttgggtcgttacgtcctaacgttcggtcccgttccccggttacttaccgttttcgggacccgtacgggggtaaccctaacggtccgtagggagtacgtacgtaacggaacgtaacgtcggtcggacgttcgaccgaccctactcgtcgttcttctaccg

SEQ ID NO: 277747 - DNA, 591 bp, Homo sapiens
  misc_feature: GYAE6OF02ILVSP.29.35.D02.1.454.CMB.1.raw
  modified_base (203)..(203): a, c, t, g, unknown or other
  misc_feature (203)..(203): n is a, c, g, or t
  modified_base (260)..(260): a, c, t, g, unknown or other
  misc_feature (260)..(260): n is a, c, g, or t
tcagatagagtactcacgaccggtgctcgatttagcacacgatagttgggtttgggggaggaactgctcagttaggacccagacggaaccatggaagccccagctcagcttctcttcctcctgctactctggctcccagataccagcggagagattgtgttgacacagtctccagccacctgtctttgtctccgggagaaagngccaccctctcctgcaggccagtcagagtgttaacaactacttggcctggttccaanagaaacctggccaggctcccaggctcctcatctatgatgcatccaacagggccacgtggcatcccagccaggttcagtggcaggtgggtcgtgggacagtacttcactctcaccatcagccgcctagacgcctggaggtattcgtgtacccgttttattacgtttgttcgttgggtacgttagtacctaacgttcggtcccgttcccgttcgttaccgttttcgggacccgtaaggggtacccaaaggtccgttagggacgtacgtacgaacggaacgaaccgttggtacgggtctacggaccaccgtattccgttcgttccttactaccg

SEQ ID NO: 277748 - DNA, 903 bp, Homo sapiens
  misc_feature: GYAE6OF02JTAY7.29.35.D02.1.454.CMB.1.raw
  modified_base (206)..(206): a, c, t, g, unknown or other
  misc_feature (206)..(206): n is a, c, g, or t
tcagatagagtactcacgaccggtgctcgatttagcacacgatagttagggtttgggggacggaactgctcagttaggacccagacggaaccatggaagccccagctcagcttctcttcctcctgctactctggctcccagataccagcggagacgattgtcgttgacacagtctcagccacctgtctttgctaccgggagaaagngccctacctctcctgcgagggccagtccaggtagtagttaaaccaacttacgttcgggccctttgggtttacccaaacgtacgtaaaaccgttcgggacctaaggggtcctaccccgaacggggtcccttaccggtaccattacctaagttgaacttggacctaacttcccaaaaccggtaggggacccctaaacgttcggggacctaacgttccccgaaacggtaccccggtaacggggtttacctaaggggttacggtccccggtaaggggtttaacgggggttccgttacgggggaacctaacgggtaacccttttacgaacccttttcccgacaaccctaacgttaccaaccgggaccccgtaccgttaacggaccgtaccgttaacgggaaggttaaccgtttcgtacgggttaccgttttaacttacggtttaccggtttaacggttcgggtaccggttaacgtaaccgtaaaccggttcggttacccccgtttaccggttacccgttttaccgttttacggggtacccggtaaacggggggtaccctaaacgggtccgtttaacggggtaacgtacggttaccgtaacgggtaaacccgttaaccgggtttaggtaccggggtttaccgtaccggtaccgttaccggtaacgttttcccggttaacgttcccgtttacccgtaacccggg

SEQ ID NO: 277749 - DNA, 506 bp, Homo sapiens
  misc_feature: GYAE6OF02HOZPX.29.35.D02.1.454.CMB.1.raw
  modified_base (262)..(262): a, c, t, g, unknown or other
  misc_feature (262)..(262): n is a, c, g, or t
  modified_base (308)..(308): a, c, t, g, unknown or other
  misc_feature (308)..(308): n is a, c, g, or t
tcagatagagtactcacgaccggtgctcgatttagcacacgatagttgggtttggggaggaactgctcagttaggacccagacggaaccatggaagccccagctcagcttctcttcctcctgctactctggctcccagataccagcggagagattgtgttgacacagtctccagccaccctgtctttgtctccgggagaaagagccaccctctcctgcagggccagtcagagtgttaacaactacttggcctggttccaacngaaacctggccaggctccaggctcctcatctatgatgcatccaacnggccactggcatcccagccaggttcagtggcagtgggtctgggacagacttcactctcacatcagccgcctagacgctgagatctgtccgtttattattgtcttgggcgtagcactgcctccgtctactttggccgtacggggaccaagcgtggagatcgagacgtaactgtaggctagcaccatcctgttcttctac

SEQ ID NO: 277750 - DNA, 528 bp, Homo sapiens
  misc_feature: GYAE6OF02H36I1.29.35.D02.1.454.CMB.1.raw
  modified_base (213)..(213): a, c, t, g, unknown or other
  misc_feature (213)..(213): n is a, c, g, or t
  modified_base (525)..(525): a, c, t, g, unknown or other
  misc_feature (525)..(525): n is a, c, g, or t
tcagatagagtactcacgaccggtgctcgatttagcacacgatagttggggtttgggggaggaactgctcagttaggacccagacggaaccatggaagccccagctcagcttctcttcctcctgctactctggctcccagataccagcggagagattgtgttgacacagtctccagccacctgtctttgtctccgggagaaagagccaccctntcctgcagggccagtcagagtgttaacaactactggcctggttaccaacagaaacctggccaggctcccaggcctctcatctaatgatgcatccaaacagggccactggcatcccagccaggttcagtgcagtggtctgggacagacttcactctcaccatcacgccgcctagacgcctgaggtacttcgtgtaccgttttattattgttcgttgggtcgtagctaacgtcggccttcccgtactactttcggccgtacgggaccaagcgtgagatcagacgactgtcggtactgcacctatcgtgttcttntac

SEQ ID NO: 277751 - DNA, 577 bp, Homo sapiens
  misc_feature: GYAE6OF02HJ0RJ.29.35.D02.1.454.CMB.1.raw
  modified_base (310)..(310): a, c, t, g, unknown or other
  misc_feature (310)..(310): n is a, c, g, or t
tcagatagagtactcacgaccggtgctcgatttagcacacgatagttgggtttggggaggaactgctcagttaggacccagacggaaccatggaagccccagctcagcttctcttcctcctgctactctggctcccagataccagcggagagattgtgttgacacagtctccagccaccctgtctttgtctccgggagaaagagccaccctctcctgcagggccagtcagagtgttaacaactacttggcctggttccaacagaaacctggccaggcctcccaggctcctcatctatgatgcatccaacngggccactggcatcccagccaggttcagtggcagtgggtctgggacagacttcactctcaccatcagccgctagacgcctgagtattcgtgtaccgtttattacttgttcgttgggtcgtagactaacgttcggcccttcccgttactaccgttttcggacccgtacggggtaacctaacggcgtagggaagtactacgaacggtaaccggtaacttgggtacgtccgttacgacctaccgacgttccgttcgttccttacgtaccg

SEQ ID NO: 277752 - DNA, 550 bp, Homo sapiens
  misc_feature: GYAE6OF02H4IZ1.29.35.D02.1.454.CMB.1.raw
  modified_base (203)..(203): a, c, t, g, unknown or other
  misc_feature (203)..(203): n is a, c, g, or t
  modified_base (212)..(212): a, c, t, g, unknown or other
  misc_feature (212)..(212): n is a, c, g, or t
  modified_base (311)..(311): a, c, t, g, unknown or other
  misc_feature (311)..(311): n is a, c, g, or t
  modified_base (384)..(384): a, c, t, g, unknown or other
  misc_feature (384)..(384): n is a, c, g, or t
  modified_base (402)..(402): a, c, t, g, unknown or other
  misc_feature (402)..(402): n is a, c, g, or t
  modified_base (412)..(412): a, c, t, g, unknown or other
  misc_feature (412)..(412): n is a, c, g, or t
tcagatagagtactcacgaccggtgctcgatttagcacacgatagttgggtttggggaggaactgctcagttaggacccagacggaaccatggaagccccagctcagcttctcttcctcctgctactctggctcccagataccagcggagagattgtgttgacacagtctccagccaccctgtctttgtctccgggagaaagngccaccctntcctgcagggccagtcagagtgttaacaactacttggcctggttccaacagaaacctggccaggctcccaggcctcctcatctatgatgcatccaacgngggccacgtcggccactcccgagccgaggttcagtggccaggtgggtctgggacaggacttcactctacaccntccgacgccgacctacgngccgtgagtnttctcgtccgttttatttagttgttcgttgggacgttgcaacgtcggccttccgtctcgtttggccgacgggaccagtcgtggagactcgacggacgtaacgtggtcggactcgccacctatctacgttcttctaccg

SEQ ID NO: 277753 - DNA, 531 bp, Homo sapiens
  misc_feature: GYAE6OF02FZG5A.29.35.D02.1.454.CMB.1.raw
tcagatagagtactcacgaccggtgctcgatttagcacacgatagttgggtttgagggaggaactgctcagttaggacccagacggaaccatggaagccccagctcagcttctcttcctcctgctactctggctcccagataccagcggagagattgtgttgacacagtctccagccaccctgtctttgtctccgggagaaagagccaccctctcctgcagggccagtcagagtgttaacaactacttggcctggttccaacagaaacctggccaggctcccaggctcctcatctatgatgcatccaacagggccactggcatcccagccaggttcagtgcagtggtctgggacagacttcactctcaccatcagccgctagagcctgacggtattcgtcgtccgttttattagtttgttcgttcgggtcgtagctaacgtcggacctcccgtactacgtttcggccgtacgggaccaacgtctagggacgtagtcgagacgtaacgtgtgcgtgcaccatcgtgtcttcg

SEQ ID NO: 277754 - DNA, 555 bp, Homo sapiens
  misc_feature: GYAE6OF02H9LAB.29.35.D02.1.454.CMB.1.raw
  modified_base (198)..(198): a, c, t, g, unknown or other
  misc_feature (198)..(198): n is a, c, g, or t
  modified_base (203)..(203): a, c, t, g, unknown or other
  misc_feature (203)..(203): n is a, c, g, or t
  modified_base (308)..(308): a, c, t, g, unknown or other
  misc_feature (308)..(308): n is a, c, g, or t
  modified_base (550)..(550): a, c, t, g, unknown or other
  misc_feature (550)..(550): n is a, c, g, or t
tcagatagagtactcacgaccggtgctcgatttagcacacgatagttgggtttggggaggaactgctcagttaggacccagacggaaccatggaagccccagctcagcttctcttcctcctgctactctggctcccagataccagcggagagattgtgttgacacagtctccagccaccctgtcttttgctccggganaaagngccacctctcctgcagggccagtcagagtgttaacaactacttggcctggttccaacagaaacctggccaggctcccaggctcctcatctatgatgcatccaacngggccactggcatcccagccaggttcagtggcagtgggtctgggacagacttcactctcaccatcagccgcctagacgcctgaggtattcgtgtccgttttatttattgttcgttgggtcgttagctaacgtcggcccgttcccgttctacgttttcgggcccgaaggggtacccaaggtcgtagggagtacgtcaacggacgtaaacgtggtacggtctcggcacctattcctgttccttntaccg

SEQ ID NO: 277755 - DNA, 579 bp, Homo sapiens
  misc_feature: GYAE6OF02G4OLL.29.35.D02.1.454.CMB.1.raw
  modified_base (292)..(292): a, c, t, g, unknown or other
  misc_feature (292)..(292): n is a, c, g, or t
  modified_base (374)..(374): a, c, t, g, unknown or other
  misc_feature (374)..(374): n is a, c, g, or t
tcagatagagtactcacgaccggtgctcgatttagcacacgatagttgggtttggggaggaactgctcagttaggacccagacggaaccatggaagccccagctcagcttctcttcctcctgctactctggctcccagataccagcggagagattgtgttgacacagtctccagccaccctgtctttgtctccgggagaaagagcccaccctctcctgcagggccagtcagagtgttaacaactacttggcctggttccaacagaaacctggccaggcctcccaggctcctnatctatgatgcatccaacgacgggccactggcactcccagccaaggttcaggtggcagtgggtctgggacagacttcactcncacctatcgacgccgcctagacgtcctaggagtacttcgtcgttccgtttattattgtcgttgggtcgtacgactaacgtcggtccttcccgttctaccgtttcggaccgtaacggggacctaaggccgtaggacgtactacgacggtaaccgtaacgtcggtacggtcgtcgacctaccgtacttcgtcgttcgttacctaccg

SEQ ID NO: 277756 - DNA, 659 bp, Homo sapiens
  misc_feature: GYAE6OF02HKI0W.29.35.D02.1.454.CMB.1.raw
  modified_base (203)..(203): a, c, t, g, unknown or other
  misc_feature (203)..(203): n is a, c, g, or t
  modified_base (369)..(369): a, c, t, g, unknown or other
  misc_feature (369)..(369): n is a, c, g, or t
tcagatagagtactcacgaccggtgctcgatttagcacacgatagttgggtttgggggaggaactgctcagttaggacccagacggaaccatggaagccccagctcagcttctcttcctcctgctactctggctcccagataccagcggagagattgtgttgacacagtctccagccaccctgtctttgctccgggagaaagngccaccctctcctgcagggccagtcagagtgttaaacaactacttggcctggttaccaacagaaacctggccaggctccaggctctcatctatgatgcatccaacagggccactggcactcccagccaggttcagtggcagtgggctgggacagtacttcacgtcncacatcgacgccgctagacgtccctagaggtactttcgtggtacccgttttattacgtttcggttccgttaggggtaccgttaagaccgtaaccgttcgggcccctttacccggttacgttaccgtttttccggggacccgtaacgggggtaacccctaaaggtcccggttaggggtaacgtaccgttacgaacggggtaaaccggtaaccgtttgggtaccggggtacccttacggacccgtaacccgtaagttttcccgtacgggttttacccttaccgttaaccccg

SEQ ID NO: 277757 - DNA, 551 bp, Homo sapiens
  misc_feature: GYAE6OF02FPQFW.29.35.D02.1.454.CMB.1.raw
  modified_base (373)..(373): a, c, t, g, unknown or other
  misc_feature (373)..(373): n is a, c, g, or t
tcagatagagtactcacgaccggtgctcgatttagcacacgatagttgggtttggggaggaactgctcagttaggacccagacggaaccatggaagccccagctcagcttctcttcctcctgctactctggctcccagataccagcggagagattgtgttgacacagtctccagccaccctgtctttgtctccgggagaaagagccaccctctcctgcagggccagtcagagtgttaacaactacttggcctggttccaacagaaacctggccaggctcccaggctcctcatctatgatgcatccaacagggccactggcatcccagccaggttcagtggcaggtgggtctgggacagacttcactctcaccntcacgccgcctagacgccgtgaggtattcttcgtccgttttatttatttgttcgtttgggtcgttacgtactaacgtcggtcccgttcccgttcgtaccgtttttcggcccgtacggggtaccaacggcgtggagatcgagacgaacgtggtcggctgacaccgatctcgtcttctac

SEQ ID NO: 277758 - DNA, 530 bp, Homo sapiens
  misc_feature: GYAE6OF02JB2F8.29.35.D02.1.454.CMB.1.raw
  modified_base (368)..(368): a, c, t, g, unknown or other
  misc_feature (368)..(368): n is a, c, g, or t
  modified_base (372)..(372): a, c, t, g, unknown or other
  misc_feature (372)..(372): n is a, c, g, or t
  modified_base (377)..(377): a, c, t, g, unknown or other
  misc_feature (377)..(377): n is a, c, g, or t
  modified_base (380)..(380): a, c, t, g, unknown or other
  misc_feature (380)..(380): n is a, c, g, or t
  modified_base (526)..(526): a, c, t, g, unknown or other
  misc_feature (526)..(526): n is a, c, g, or t
tcagatagagtactcacgaccggtgctcgatttagcacacgatagttgggtttggggaggaactgctcagttaggacccagacggaaccatggaagccccagctcagcttctcttcctcctgctactctggctcccagataccagcggagagattgtgttgacacagtctccagccaccctgtctttgtctccggggagaaagagcccaccctctcctgcagggccagtcagagtgttaacaactacttggcctggttccaacagaacctggccaggcctcccaggctcctcatctatgatgcatccaacgacgggccactggcactcccagccaggttcaggtgcaggtgggtctgggacagcttcnctcncaccntcncgccgactagacgccgtgacgtattctcgtctttattattgttcgtgggtctagctactcggcctccgtctacgtttcggccgacgggaccagcgtaggacgatcgagtacggtaactggtcgtctcgacactctcgtgttccttntacg

SEQ ID NO: 277759 - DNA, 527 bp, Homo sapiens
  misc_feature: GYAE6OF02FHTC0.29.35.D02.1.454.CMB.1.raw
  modified_base (492)..(492): a, c, t, g, unknown or other
  misc_feature (492)..(492): n is a, c, g, or t
tcagatagagtactcacgaccggtgctcgatttagcacacgatagttgggtttggggaggaactgctcagttaggacccagacggaaccatggaagccccagctcagcttctcttcctcctgctactctggctcccagataccagcggagagattgtgttgacacagtctccagccaccctgtctttgtctccgggagaaagagccaccctctcctgcagggccagtcagagtgttaacaactacttggcctggttccaacagaaacctggccaggctcccaggctcctcatctatgatgcatccaacagggccactggcatccccagccaggttcagtggcagtgggtctgggacagacttcactctcaccatcagccgcctagcgcctggaggtattctgtccgtttatttagttgtctttgggtcgtagtctacgtcggccctcccgttcgtacgttttcggccgtacggggaccaaggctgggagtancgagacgaactggtggctgcacatctgtcttctac

SEQ ID NO: 277760 - DNA, 527 bp, Homo sapiens
  misc_feature: GYAE6OF02G0MEZ.29.35.D02.1.454.CMB.1.raw
  modified_base (519)..(519): a, c, t, g, unknown or other
  misc_feature (519)..(519): n is a, c, g, or t
tcagatagagtactcacgaccggtgctcgatttagcacacgatagttgggtttgggggaggaactgctcagttaggacccagacggaaccatggaagccccagctcagcttctcttcctcctgctactctggctcccagataccagcggagagattgtgttgacacagtctccagccaccctgtctttgtctccgggagaaagagccaccctctcctgcagggccagtcagagtgttaacaactacttggcctggttccaacagaaacctggccaggctccaggctcctcatctatgatgcataccaacagggccactggcatcccagccaggttcagtggcaggtggtctgggacagacttcactctcacatcagccgctagacgcctgaggattctgtccgtttagttattcgttcttgggcttagctaacgtcgcccgttccgtctacgtttcggccgacggggaccagacgtggagatcgagaccgtaacgtggtcgcgtgccgtactactcgtntcttctac

SEQ ID NO: 277761 - DNA, 534 bp, Homo sapiens
  misc_feature: GYAE6OF02HV4LU.29.35.D02.1.454.CMB.1.raw
  modified_base (259)..(259): a, c, t, g, unknown or other
  misc_feature (259)..(259): n is a, c, g, or t
  modified_base (306)..(306): a, c, t, g, unknown or other
  misc_feature (306)..(306): n is a, c, g, or t
  modified_base (366)..(366): a, c, t, g, unknown or other
  misc_feature (366)..(366): n is a, c, g, or t
  modified_base (371)..(371): a, c, t, g, unknown or other
  misc_feature (371)..(371): n is a, c, g, or t
tcagatagagtactcacgaccggtgctcgatttagcacacgatagttgggtttggggaggaactgctcagttaggacccagacggaaccatggaagccccagctcagcttctcttcctcctgctactctggctcccagataccagcggagagattgtgttgacacagtctccagccaccctgtctttgtctccgggagaaagagccaccctctcctgcagggccagtcagagtgttaacactacttggctggttccaanagaaacctggccaggctccaggctcctcatctatgatgcatccaacngggccactggcactcccagccaggttcagtcggcagtgggtctgggacagacttcactcncaccntcacgccgcctacgcgcctagagtacttcgtgtcgttttattactttgttcgttgggtcgtagctacgtcggcccttccgtctacgtttcggccgtacgggaccagcgtggagtagtacgaggacgtaacgtggtggtcgtcgcaccattctcgtcttctacc

SEQ ID NO: 277762 - DNA, 515 bp, Homo sapiens
  misc_feature: GYAE6OF02JCK0L.29.35.D02.1.454.CMB.1.raw
tcagatagagtactcacgaccggtgctcgatttagcacacgatagttgggtttgggggaggaactgctcagttaggacccagacggaaccatggaagccccagctcagcttctcttcctcctgctactctggctcccagataccagcggagagattgtgttgacacagtctccagccaccctgtctttgtctccggggagaaagagccaccctctcctgcagggccagtcagagtgttaacaactacttggcctggttccaacagaaacctggccaggctcccaggctcctcatctatgatgcatccaacagggccactggcactcccagccaggttcagtggcagtgggtctgggacagacttcactctcaccatcacgccgcctagacgcctgagtattctcgtccgtttattattgtcgttgggtcgtagctactcggcctcccgtctacgtttggccgagggaccaagcgtggagatcgagacgaactggtggctgcacatctgtctctac

SEQ ID NO: 277763 - DNA, 528 bp, Homo sapiens
  misc_feature: GYAE6OF02GTR1A.29.35.D02.1.454.CMB.1.raw
  modified_base (310)..(310): a, c, t, g, unknown or other
  misc_feature (310)..(310): n is a, c, g, or t
  modified_base (488)..(488): a, c, t, g, unknown or other
  misc_feature (488)..(488): n is a, c, g, or t
  modified_base (525)..(525): a, c, t, g, unknown or other
  misc_feature (525)..(525): n is a, c, g, or t
tcagatagagtactcacgaccggtgctcgatttagcacacgatagttgggtttgggggaggaactgctcagttaggacccagacggaaccatggaagccccagctcagcttctcttcctcctgctactctggctcccagataccagcggagagattgtgttgacacagtctccagccaccctgtctttgtctccgggagaaagagccaccctctcctgcagggccagtcagagtgttaacaactacttggcctggttccaacagaaacctggccaggcctccaggctcctcatctatgatgcatccaacncgggccacgtggcactcccagccaggttcaggtggcaggtgggtcgtgggacagtacttcgactctcaccatcgacgccgctacgacgctggaggtattcgtgtccgtttattagttgttcgttgggcgtagcaacgtcgcctcccgtctcgtttcggccgtagggaccagcgtgagngtcgagacgaatggtggctcgcacctctctcgtcttntcc

SEQ ID NO: 277764 - DNA, 627 bp, Homo sapiens
  misc_feature: GYAE6OF02I908M.29.35.D02.1.454.CMB.1.raw
  modified_base (204)..(204): a, c, t, g, unknown or other
  misc_feature (204)..(204): n is a, c, g, or t
  modified_base (213)..(213): a, c, t, g, unknown or other
  misc_feature (213)..(213): n is a, c, g, or t
  modified_base (255)..(255): a, c, t, g, unknown or other
  misc_feature (255)..(255): n is a, c, g, or t
  modified_base (257)..(257): a, c, t, g, unknown or other
  misc_feature (257)..(257): n is a, c, g, or t
  modified_base (261)..(261): a, c, t, g, unknown or other
  misc_feature (261)..(261): n is a, c, g, or t
  modified_base (275)..(275): a, c, t, g, unknown or other
  misc_feature (275)..(275): n is a, c, g, or t
tcagatagagtactcacgaccggtgctcgatttagcacacgatagttgggtttggggaggaactgctcagttaggacccagacggaaccatggaagccccagctcagcttctcttcctcctgctactctggctcccagataccagcggagagattgtgttgacacagtctccagccaccctgtctttgtctccggggagaaagngccaccctntcctgcagggccagtcagagtgtaacactattggctgtccananaacngcagctccagctcncatctatgatgcatccaacgagggccacgtggcactccagccaggttcagtggcagtgggtctggggacagtacttcactctaccacctactcacgcccgtaccgtacggacgtccgtaggaggtactttccgtcggtaccgtttttaatttacgtttcggttcgtttacggggtcgttaacgtcctaaacggttcggtccccgttccccggttacttaaccggtttttcggacccggtaaccggggtaaccgaaacggtcgtagggaacgtacgtacggaacggaacggttaaccgtaggttggtccgtacggtcctaccgttaacgttcttacgttaccgttcttacccg

SEQ ID NO: 277765 - DNA, 711 bp, Homo sapiens
  misc_feature: GYAE6OF02IQN1E.29.35.D02.1.454.CMB.1.raw
  modified_base (204)..(204): a, c, t, g, unknown or other
  misc_feature (204)..(204): n is a, c, g, or t
  modified_base (213)..(213): a, c, t, g, unknown or other
  misc_feature (213)..(213): n is a, c, g, or t
  modified_base (260)..(260): a, c, t, g, unknown or other
  misc_feature (260)..(260): n is a, c, g, or t
  modified_base (357)..(357): a, c, t, g, unknown or other
  misc_feature (357)..(357): n is a, c, g, or t
tcagatagagtactcacgaccggtgctcgatttagcacacgatagttgggtttgggggaggaactgctcagttaggacccagacggaaccatggaagccccagctcagcttctcttcctcctgctactctggctcccagataccagcggagagattgtgttgacacagtctccagccaccctgtcctttgctccgggagaaagngccaccctntcctgcagggccagtcagagtgtaacactacttggcctggttccaanagaaacctgaccaggctcccaggctctcatctatgatgcatccaacagggccacgtggacacgtcccagccaggttccagtcggacacggtcgggtntcggggacaggacttcaacgtccacgtaccatcgacgccgtcctacgacgtccgtggtacgactttcgtcggtacgttttacgttacgtttgttaccgtttggggacccggttacggtaccgtaaaccgttccgggtacccgttccccggttacccggttacccgtttttacggggaccccggttaaccgggggttaacccgtaacggtaccggttaccgggttaaggtaccgttaacggtacggtaaacccgggttaacgttaccgggtttaccggggaccggtttaccggtaacccgttaacccggtacggtttacccgttaccgggttttaccctttaccgtttaacccgg

SEQ ID NO: 277766 - DNA, 558 bp, Homo sapiens
  misc_feature: GYAE6OF02HO4CC.29.35.D02.1.454.CMB.1.raw
  modified_base (203)..(203): a, c, t, g, unknown or other
  misc_feature (203)..(203): n is a, c, g, or t
  modified_base (260)..(260): a, c, t, g, unknown or other
  misc_feature (260)..(260): n is a, c, g, or t
tcagatagagtactcacgaccggtgctcgatttagcacacgatagttgggtttggggaggaactgctcagttaggacccagacggaaccatggaagccccagctcagcttctcttcctcctgctactctggctcccagataccagcggagagattgtgttgacacagtctccagccaccctgtctttgtctccgggagaaagngccacctctcctgcagggccagtcagagtgttaacaactacttggcctggttccaanagaaacctggccaggctccaggctcctcatctatgatgcatccaacagggccactggcatcccagccaggttcagtgcagtgggtctgggacagacttcactctcaccatcacgccgcctacgacgccgtgaggattcgtcgtaccgtttattacgtttgttcttgggtcgtagctaacgtcggtacctcccgttcgtaccgttttcggccgtacggggaccgaacgacgtcggagtactcgtacggaacgtaacgtgtcggtcgtacgcctaccgtactccgtcgttccttctaccg

SEQ ID NO: 277767 - DNA, 534 bp, Homo sapiens
  misc_feature: GYAE6OF02FXTY0.29.35.D02.1.454.CMB.1.raw
tcagatagagtactcacgaccggtgctcgatttagcacacgatagttgggtttgggggaggaactgctcagttaggacccagacggaaccatggaagccccagctcagcttctcttcctcctgctactctggctcccagataccagcggagagattgtgttgacacagtctccagccaccctgtctttgtctccgggagaaagagccaccctctcctgcagggccagtcagagtgttaacactacttggcctggttccaacagaaacctggccaggctcccaggctcctcatctatgatgcatccaacagggccactggcatcccagccaggttcagtggcagtgggtctgggacagtacttcactctcaccatcacgccgcctagagcctgaggtacttctgtccgtttattattgtcgttgggcgttagctaacgtcgtcctcccgtctacgtttggccgaggggaccaggcgtaggagtatcgagtacgaaccgtgtcggctgaccaccgtactcgtcgttccttctaccg

SEQ ID NO: 277768 - DNA, 520 bp, Homo sapiens
  misc_feature: GYAE6OF02FZVHI.29.35.D02.1.454.CMB.1.raw
tcagatagagtactcacgaccggtgctcgatttagcacacgatagttgggtttggggaggaactgctcagttaggacccagacggaaccatggaagccccagctcagcttctcttcctcctgctactctggctcccagataccagcggagagattgtgttgacacagtctccagccaccctgtctttgtctccgggagaaagagccaccctctcctgcagggccagtcagagtgttaacaactacttggcctggttccaacagaaacctggccaggctcccaggctcctcatctatgatgcatccaacagggccactggcatcccagccaggttcagtggcagtgggtctgggacagacttcgactctcaccatcagccgctacgagcctgaggacttcgtgtccgtttattattgtcgtttgggtcgtagcaacctggccctccgttctacgttttggccgtacgggaccaaggctggagctcgaggacgaacgtgtgcgtgcacactctcgtctctac

SEQ ID NO: 277769 - DNA, 552 bp, Homo sapiens
  misc_feature: GYAE6OF02GDG33.29.35.D02.1.454.CMB.1.raw
tcagatagagtactcacgaccggtgctcgatttagcacacgatagttgggtttgggggaggaactgctcagttaggacccagacggaaccatggaagccccagctcagcttctcttcctcctgctactctggctcccagataccagcggagagattgtgttgacacagtctccagccaccctgtctttgtctccgggagaaagagccaccctctcctgcagggccagtcagagtgttaacaactacttggcctggttccaacagaaacctggccaggctcccaggctcctcatctatgatgcatccaacagggccactggcatcccagccaggttcagtggcaggtgggtctgggacagacttcactctcaccatcacgccgacctagacgccgtgaggtattcgtcgtccgtttattagtttgttcgttgggtcgtagctaacgtcggtccttcccgtctacgttttcggccgtagggaccgaacgacgtgagacgtacgacgaacggtaacgtacggtggtcgtcgcgacctactctcgttcttctaccg

SEQ ID NO: 277770 - DNA, 568 bp, Homo sapiens
  misc_feature: GYAE6OF02HF3Q2.29.35.D02.1.454.CMB.1.raw
  modified_base (311)..(311): a, c, t, g, unknown or other
  misc_feature (311)..(311): n is a, c, g, or t
tcagatagagtactcacgaccggtgctcgatttagcacacgatagttgggtttgggggaggaactgctcagttaggacccagacggaaccatggaagccccagctcagcttctcttcctcctgctactctggctcccagataccagcggagagattgtgttgacacagtctccagccaccctgtctttgtctccgggagaaagagccaccctctcctgcagggccagtcagagtgttaacaactacttggcctggttccaacagaaacctggccagggctcccaggctcctcatctatgatgcatccaacngggccactggcatcccagccaggttcagtggcagtgggtctgggacagacttcactctcaccatcagccgcctagacgcctggacggattcgtcgtccgtttaattagtttgtcgtttcggggcgtacgtcaacgtcggccttccccgttcgtaacgttttcgggccgaacgggggaaccaacgcgttaggagtactacgacggaacggaacctggtcggcgtagaccaccgtagttcctacggttccttactaccg

SEQ ID NO: 277771 - DNA, 601 bp, Homo sapiens
  misc_feature: GYAE6OF02I1431.29.35.D02.1.454.CMB.1.raw
  modified_base (320)..(320): a, c, t, g, unknown or other
  misc_feature (320)..(320): n is a, c, g, or t
  modified_base (396)..(396): a, c, t, g, unknown or other
  misc_feature (396)..(396): n is a, c, g, or t
  modified_base (413)..(413): a, c, t, g, unknown or other
  misc_feature (413)..(413): n is a, c, g, or t
tcagatagagtactcacgaccggtgctcgatttagcacacgatagttgggtttgggggaggaactgctcagttaggaccagacggaaccatggaagccccagctcagcttctcttcctcctgctactctggctcccagataccagcggagagattgtgttgacacagtctccagccaccctgtctttgtctccgggagaaagagccaccctctcctgcagggccagtcagagtcgttaaacaactacttggcctggttccaacagaaacctggaccaggcctacccgaggcctcctcattctatgatgccataccaacgngggccacgtcggaccactcccgagccctagggttcagtggcgtagtgggtctgggacaggtactcgactcgtcacntcgacgccgactagacnccgtagaggtattcgtcgtccgtttatttattgttcgttgggtcgtcgtacgtaacgtcggccgttacccgtcgtacgttttcgggccgggtaacggggtaaccaaggtcgtacgggacgtacgtacacggtaacgtaacgtcgggttacggtacgtacgtacaccgtactcgtcgttcttactaccg

SEQ ID NO: 277772 - DNA, 667 bp, Homo sapiens
  misc_feature: GYAE6OF02JY3W0.29.35.D02.1.454.CMB.1.raw
  modified_base (198)..(198): a, c, t, g, unknown or other
  misc_feature (198)..(198): n is a, c, g, or t
  modified_base (203)..(203): a, c, t, g, unknown or other
  misc_feature (203)..(203): n is a, c, g, or t
tcagatagagtactcacgaccggtgctcgatttagcacacgatagttgggtttgggggaggaactgctcagttaggacccagacggaaccatggaagccccagctcagcttctcttcctcctgctactctggctcccagataccagcggagagattgtgttgacacagtctccagccacctgtctttgtctccggganaaagngccacctctcctgcagggccagtcagagtgttaacaactacttggcctggttccaacagaaacctgccaggcctcccaggcctcctcatctatgaagtgcactccaacgacgggtccaacgtggccaatccccgagcccaggttccaggtcggacgaggttgggtctggggacaggtacttcaccttcgccaaccatcacgaccgccgtacgacgaccgtcgaggtaactttcgtacggttaccgttttaacgtttacgtttcggtttccgtttcgggtccggttaacggtacctaaaccggttcggtacccgttcccggttacgttacccgttttcggtcccggtaaggggtaccctaacggtccgttagggacgtacgttaccgaacggtaccggtaacgttcggtacggtcgttacggccgtaaccgtacgttaccgttcgtttacgttaccgttaacccg

SEQ ID NO: 277773 - DNA, 563 bp, Homo sapiens
  misc_feature: GYAE6OF02H642A.29.35.D02.1.454.CMB.1.raw
  modified_base (260)..(260): a, c, t, g, unknown or other
  misc_feature (260)..(260): n is a, c, g, or t
  modified_base (558)..(558): a, c, t, g, unknown or other
  misc_feature (558)..(558): n is a, c, g, or t
tcagatagagtactcacgaccggtgctcgatttagcacacgatagttgggtttgggggaggaactgctcagttaggacccagacggaaccatggaagccccagctcagcttctcttcctcctgctactctggctcccagataccagcggagagattgtgttgacacagtctccagccacctgtctttgctccgggagaaagagcccacctctcctgcagggccagtcagagtgttaaacaactattggcctggttccaanagaaacctggccaggctccaggctcctcatctatgatgcactccaacgagggccacgtggcactcccagccaggttcagtggcagtgggtctgggacagtacttcgactctcaccatcacgccgcctacgacgccgtgaggtattcgtcgtaccgttttatttagttcgtttcgttgggtcgtacgtcgaacctcggtcctcccgtcgtaccgttttcggtccgtacggggaaccgaacgtcgtaggacgagtacgtaaggacgaaacgtggtggtcgtgcacctactctgttccttntaccg

SEQ ID NO: 277774 - DNA, 705 bp, Homo sapiens
  misc_feature: GYAE6OF02GN4TG.29.35.D02.1.454.CMB.1.raw
  modified_base (214)..(214): a, c, t, g, unknown or other
  misc_feature (214)..(214): n is a, c, g, or t
tcagatagagtactcacgaccggtgctcgatttagcacacgatagttggggtttgggggaggaactgctcagttaggacccagacggaaccatggaagccccagctcagcttctcttccgtcctgctactctggctcccagataccagcggagagattgtgttgacacagtctccagccaccctgtctttgtctccgggagaagagccaccctntcctgcagggccagtcagagtagttaacaactacgttggccttgggttaccaaactagaaaaccttcggaccaggcctacccgaggcctccctacactcctaagtgaactcggactatacccgaaacgacgggcccaacgtcggaccaacttccccgaaggtcccgaagggtttaccacgggtggacgtagggttggggtaccgtagggggaactacgggtaaccttcgtaacttcctaccgtaaccctaattccgaacggcccgtaccgtaagacgccgttaggaggtacttcgtacggtaccgtttatttagttcggtttacgttggggtacttaagtacctaaccgttcgggtacccttcccgttcttaccgttttcgggacccgtagggggaaccctaaggtccgtagggacgtacggtcgaacggaacggtaaccgtggtaggtcgtacgaccgtaccgtagttccgttacggttcttccgtaccg

SEQ ID NO: 277775 - DNA, 619 bp, Homo sapiens
  misc_feature: GYAE6OF02JVEMV.29.35.D02.1.454.CMB.1.raw
tcagatagagtactcacgaccggtgctcgatttagcacacgatagttgggtttgggggaggaactgctcagttaggacccagacggaaccatggaagccccagctcagcttctcttcctcctgctactctggctcccagataccagcggagagattgtgttgacacagtctccagccaccctgtctttgtctccgggagaaagagccaccctctcctgcagggccagtcagagtgttaacaactacttggcctggttccaacagaaacctggccaggctccaggctcctcatctatgatgcatccaacagggccacgtggcatcccagcccaggttccagtcggctaggtcgggtctggggacaggtacttcactctcgaccatcacgccgcctagacgcctgaggtattcgtcgtccgttttattacgttgttcgttcgggtcgttacgtacgtaacgttcggtacccttcccgttactaccgttttcgggacccggtacggggtaccctaacggtcgttaacgggacggtacttacggacggtaaccggtaacgttcggtcgggtaccgtcggtaccctaccgtaacgttccggttacgttccgtttaccttacccg

SEQ ID NO: 277776 - DNA, 575 bp, Homo sapiens
  misc_feature: GYAE6OF02JXLLV.29.35.D02.1.454.CMB.1.raw
  modified_base (152)..(152): a, c, t, g, unknown or other
  misc_feature (152)..(152): n is a, c, g, or t
  modified_base (197)..(197): a, c, t, g, unknown or other
  misc_feature (197)..(197): n is a, c, g, or t
  modified_base (201)..(201): a, c, t, g, unknown or other
  misc_feature (201)..(201): n is a, c, g, or t
  modified_base (259)..(259): a, c, t, g, unknown or other
  misc_feature (259)..(259): n is a, c, g, or t
  modified_base (293)..(293): a, c, t, g, unknown or other
  misc_feature (293)..(293): n is a, c, g, or t
  modified_base (305)..(305): a, c, t, g, unknown or other
  misc_feature (305)..(305): n is a, c, g, or t
  modified_base (367)..(367): a, c, t, g, unknown or other
  misc_feature (367)..(367): n is a, c, g, or t
  modified_base (370)..(370): a, c, t, g, unknown or other
  misc_feature (370)..(370): n is a, c, g, or t
  modified_base (374)..(374): a, c, t, g, unknown or other
  misc_feature (374)..(374): n is a, c, g, or t
  modified_base (382)..(382): a, c, t, g, unknown or other
  misc_feature (382)..(382): n is a, c, g, or t
  modified_base (516)..(516): a, c, t, g, unknown or other
  misc_feature (516)..(516): n is a, c, g, or t
tcagatagagtactcacgaccggtgctcgatttagcacacgatagttgggtttgggggaggaactgctcagttaggacccagacggaaccatggaagccccagctcagcttctcttcctcctgctactctggctcccagatacccagcgganagattgtgttgacacagtctccagccaccctgtcttgctcggganaagngccacctctcctgcagggccagtcagagtgttaacaactcttggaccttggttccaanagaacctggccaggctccaggctcctcagtctangatgcatccaancgggccactggcatcccagccagttcaggtgcaggtgggctgggactgacttcactctcacntcngccnccgtagcnccgtgaggtacttcgtgtaccgttttagttacgtttcggttcttaggggtccgtaacggtctaaaccgtcgggtcccttcccgtaccttaacgttttccggaccgtacgggggaacccaggtccgtagggacgntcgacggtacgtaactggtacggcgttaggccacgtacgttcgtcgttcgttacctacg

SEQ ID NO: 277777 - DNA, 615 bp, Homo sapiens
  misc_feature: GYAE6OF02JAXT3.29.35.D02.1.454.CMB.1.raw
tcagatagagtactcacgaccggtgctcgatttagcacacgatagttgggtttgggggaggaactgctcagttaggacccagacggaaccatggaagccccagctcagcttctcttcctcctgctactctggctcccagataccagcggagagattgtgttgacacagtctccagccacctgtctttgtctccggagaagagccacctctcctgcgaggaccgacgtacgagtagtagttaactaactacgtacgtcgtacgttacgaacgaacgaaccgtacggaccgacggacgtcccacggactcctcatctatagatacgcactacaacacggaccgactacggacactaccacgaccgacggttacgacgtaggcgacgtaggtcgtacggacgagactacactactacacactacacgacgccgtacgacgactacgacggacgttactcgtacgttacttacgttcgttacgttcggtcgtacgtacgtacgtacggtaccgtaccgtcgtacgttacggtacgacggtacgacgacgtacgagacgtacgaacgacgtgaacgtacgtacggacgtacggtacgtaccgtacgttacgttacgtacg

SEQ ID NO: 277778 - DNA, 616 bp, Homo sapiens
  misc_feature: GYAE6OF02G458V.29.35.D02.1.454.CMB.1.raw
tcagatagagtactcacgaccggtgctcgatttagcacacgatagttgggtttgggggaggaactgctcagttaggacccagacggaaccatggaagccccagctcagcttctcttcctcctgctactctggctcccagataccagcggagagattgtgttgacacagtctccagccaccctgtctttgtctccgggagaaagagccaccctctcctgcagggccagtcagagtgttaacaactacttggcctggttccaacagaaacctggccaggctccaggctcctcatctatgatgcatccaacgagggccacgtcggcactcccagccaggttcaggtggcaggtgggtcgtggggacaggtacttcactctacaccatcacgcccgcctagacgcctggacggtattcgtcgttccgttttatttagttcgtttcgttcgggtcgttacgacgtaacgtcgggtcccttcccggttcttaccgttttcgggaccgtacgggggaaccctaacggtcgtacgggacgtagtaccgaacggtaaccggtaacgttcgggtacggtccgttacggaccctaacccgtacgttccgttcgttaccttcctaccg

SEQ ID NO: 277779 - DNA, 545 bp, Homo sapiens
  misc_feature: GYAE6OF02FLWAZ.29.35.D02.1.454.CMB.1.raw
  modified_base (203)..(203): a, c, t, g, unknown or other
  misc_feature (203)..(203): n is a, c, g, or t
  modified_base (374)..(374): a, c, t, g, unknown or other
  misc_feature (374)..(374): n is a, c, g, or t
  modified_base (386)..(386): a, c, t, g, unknown or other
  misc_feature (386)..(386): n is a, c, g, or t
tcagatagagtactcacgaccggtgctcgatttagcacacgatagttgggtttggggaggaactgctcagttaggacccagacggaaccatggaagccccagctcagcttctcttcctcctgctactctggctcccagataccagcggagagattgtgttgacacagtctccagccaccctgtctttgtctccgggagaaagngccaccctctcctgcagggccagtcagagtgttaacaactacttggcctggttccaacagaaacctggccaggctcccaggctcctcatctatgatgcatccaacagggccactggcatcccagcccaggttccagtcggcaggtgggtcgtgggacaggtacttcactcncaccatcagccnctagacgcctgaggtacttctcgtccgtttatttattcgttcgttgggtcgtagtcaacgttcgcccgtcccgttctacgttttcggccgacggggacctaaggcgtggagtatacgagacgaacgtggtcggctgccacgtactctcgtccttctacc

SEQ ID NO: 277780 - DNA, 540 bp, Homo sapiens
  misc_feature: GYAE6OF02G8URL.29.35.D02.1.454.CMB.1.raw
  modified_base (199)..(199): a, c, t, g, unknown or other
  misc_feature (199)..(199): n is a, c, g, or t
  modified_base (261)..(261): a, c, t, g, unknown or other
  misc_feature (261)..(261): n is a, c, g, or t
  modified_base (384)..(384): a, c, t, g, unknown or other
  misc_feature (384)..(384): n is a, c, g, or t
  modified_base (428)..(428): a, c, t, g, unknown or other
  misc_feature (428)..(428): n is a, c, g, or t
  modified_base (499)..(499): a, c, t, g, unknown or other
  misc_feature (499)..(499): n is a, c, g, or t
  modified_base (526)..(526): a, c, t, g, unknown or other
  misc_feature (526)..(526): n is a, c, g, or t
tcagatagagtactcacgaccggtgctcgatttagcacacgatagttgggtttgggggaggaactgctcagttaggacccagacggaaccatggaagccccagctcagcttctcttcctcctgctactctggctcccagataccagcggagagattgtgttgacacagtctccagccaccctgtctttgtctccggganaaagcgcccaccctctcctgcagggccagtcagagtgttaaacactcttggcctggtccaanagaaacctgccaggctccagctcctcatctatgatgcataccaacgcgggccacgtcggacactcccagcccgtaggttccagtggcaggtcgggtcgtgggacagacttcactctacgactntcgacgccgtcctagcgtcgtagacggtattcgtgtaccgtttnttacgttgttcgttggcgtagcctacgtcgtccctccgtctacgtttcggaccgagggaccagcgtggagntcgagtacgactggcggtctagctacntctagttctactcg

SEQ ID NO: 277781 - DNA, 530 bp, Homo sapiens
  misc_feature: GYAE6OF02HQ38P.29.35.D02.1.454.CMB.1.raw
  modified_base (392)..(392): a, c, t, g, unknown or other
  misc_feature (392)..(392): n is a, c, g, or t
tcagatagagtactcacgaccggtgctcgatttagcacacgatagttgggtttgggggaggaactgctcagttaggacccagacggaaccatggaagccccagctcagcttctcttcctcctgctactctggctccagataccagcggagagattgtgttgacacagtctccagccaccctgtctttgtctccgggagaaagagccaccctctcctgcagggccagtcagagtgttaacaactacttggcctggttccaacagaaacctggaccaggcctccaggctcctcatctatgatgcactaccaacgcgggccacgtcggcactcccagcctaggttcaggtggctaggtcgggtctgggacagtacttcactctcaccatcacgcnctagcgctgagtatctcgtcctttattacttgttcgttggtcgtagctacgtcggtcctccgtctacgtttcggccgtagggaccgagcgtagagactcgagacgacgtggcgtctcgacaccgatcgtgttctctac

SEQ ID NO: 277782 - DNA, 553 bp, Homo sapiens
  misc_feature: GYAE6OF02FTYJX.29.35.D02.1.454.CMB.1.raw
  modified_base (371)..(371): a, c, t, g, unknown or other
  misc_feature (371)..(371): n is a, c, g, or t
tcagatagagtactcacgaccggtgctcgatttagcacacgatagttgggtttgggggaggaactgctcagttaggacccagacggaaccatggaagccccagctcagcttctcttcctcctgctactctggctcccagataccagcggagagattgtgttgacacagtctccagccaccctgtctttgtctccgggagaaagagccaccctctcctgcagggccagtcagagtgtaacactacttggcctggttccaacagaaacctggccaggctcccaggctcctcatctatgatgcatccaacagggccactggcatcccagccaggttcagtggcaggtgggtctgggacagcttcactctcaccntcacgccgcctagacgcctggacggtatttcgtcgtaccgtttatttacgtttgttcgttcgggcgttagtcctaacgtcggtccctcccgttctaccgttttcggccgtacggggtaaccaggcgtaggacgactacgacgacgtaacgtcggtggcgtgacacctactctcgtcttctac

SEQ ID NO: 277783 - DNA, 718 bp, Homo sapiens
  misc_feature: GYAE6OF02I16LN.29.35.D02.1.454.CMB.1.raw
tcagatagagtactcacgaccggtgctcgatttagcacacgataggtttgggggttgggggaaggaactgctctagttacggaccagacggaaccatggaagccccagctcagcttctcttcctcctgctactctggctcccagataccagcggagagtattgtagttgacacagtctccagccaccctgtcttgtcgtccggagaagggagccaccctcctcctcgcgacggccagtccaagtagtacgttaaccaacttacgttcggccttacggttacccgtaacgaccgtaaaccgttccggaccgaggacctaaccccgaggtcccgtcccgtacgacttacctagtcgtactcgtaccttacgtacccaacgacgggcccaaccgtcgggacctacgtccgacgtcccgaggttacaaggttcggacgtagggtcgggtcgtagggtacgacgtacttcgtacctctaccgaccacgttccgacgtcccgtacctaacggacgtaccgtaggacggtacttcgttcggtaccgtttatttaacgtttcgttcgttacgggtacgtacgtacctacgtacgttaccgtcccgttcgttaccgtttcggacccgtacggggtaccaacggtacgtacggtagtacgtacgaacggtaacgtacgtaggtacggtccgtcgaccgtacctagttccttacggtccttactacccg

SEQ ID NO: 277784 - DNA, 607 bp, Homo sapiens
  misc_feature: GYAE6OF02JIPKN.29.35.D02.1.454.CMB.1.raw
  modified_base (373)..(373): a, c, t, g, unknown or other
  misc_feature (373)..(373): n is a, c, g, or t
tcagatagagtactcacgaccggtgctcgatttagcacacgatagttgggtttgggggaggaactgctcagttaggacccagacggaaccatggaagccccagctcagcttctcttcctcctgctactctggctcccagataccagcggagagattgtgttgacacagtctccagccaccctgtctttgtctccgggagaaagagccaccctctcctgcagggccagtcagagtgttaacaactacttggcctggttccaacagaaacctggccaggctcccaggctcctcatctatcgatgcatccaacacggggccactggccatcccagccaggttcagtggcagtgggtctgggacaggacttcactcncaccatcagccgcctagacgccctggacggtatttctacggtccgttttaatttagtttacgttcgtttgggcgttacgtacgaaccgttcgggacccttccccggttacttaccgttttacgggcccggtaacggggtacccgtaaggtccgtagggagtacgtcgacgtaaccggtaacgtcggtacgggtctacgtccgacctacgtccgttcgttaccttccttaacccg

SEQ ID NO: 277785 - DNA, 586 bp, Homo sapiens
  misc_feature: GYAE6OF02HSJZN.29.35.D02.1.454.CMB.1.raw
  modified_base (204)..(204): a, c, t, g, unknown or other
  misc_feature (204)..(204): n is a, c, g, or t
tcagatagagtactcacgaccggtgctcgatttagcacacgatagttgggtttgggggaggaactgctcagttaggacccagacggaaccatggaagccccagctcagcttctcttcctcctgctactctggctcccagataccagcggagagattgtgttgacacagtctccagccaccctgtctttgtctccgggagaaagngcccaccctctcctgcagggccagtcagagtgttaacaactacttggcctggttccaacagaaacctggccaggctcccaggctcctcatctatgatgcatccaacgagggccacgtggcactcccagccaggttcagtcggcagtgggtctgggacagacttcactctcaccatcagccgcctagacgcctggaggtattctggtccgttttattagttgttcgttgggtcgttagcctaacgttcggcccgttcccgttcctacgttttcgggcccgtacggggtaacccgaacggcgtagggtaacgagttacgaacggaacggtaaccgtggtacggtacgtggacgacctaacttccgttcgttcctttacttaccg

SEQ ID NO: 277786 - DNA, 550 bp, Homo sapiens
  misc_feature: GYAE6OF02HVI0H.29.35.D02.1.454.CMB.1.raw
  modified_base (264)..(264): a, c, t, g, unknown or other
  misc_feature (264)..(264): n is a, c, g, or t
tcagatagagtactcacgaccggtgctcgatttagcacacgatagttgggtttgggggaggaactgctcagttaggacccagacggaaccatggaagccccagctcagcttctcttcctcctgctactctggctcccagataccagcggagagattgtgttgacacagtctccagccaccctgtctttgtctccgggagaaagagcccaccctctcctgcagggccagtcagagtgttaacaactacttggcctggttaccaanagaaacctggccaggctcccaggctcctcatctatgatgcatccaacagggccacgtggcactcccagccaggttcagtgcagtgggtctgggacaggacttcactctcaccatcacgccgcctagacgccgtaggaggtattctcgtaccgttttattacgttgttcgttgggtcgttagctaacgtcggccctcccgtctacgtttcggccgtacggggaccaacgcgtaggacgtactcgagaacgaacgtggtggcgtgacacctatctcgttcttctaccg

SEQ ID NO: 277787 - DNA, 541 bp, Homo sapiens
  misc_feature: GYAE6OF02HRBQH.29.35.D02.1.454.CMB.1.raw
  modified_base (203)..(203): a, c, t, g, unknown or other
  misc_feature (203)..(203): n is a, c, g, or t
  modified_base (261)..(261): a, c, t, g, unknown or other
  misc_feature (261)..(261): n is a, c, g, or t
tcagatagagtactcacgaccggtgctcgatttagcacacgatagttgggtttggggaggaactgctcagttaggacccagacggaaccatggaagccccagctcagcttctcttcctcctgctactctggctcccagataccagcggagagattgtgttgacacagtctccagccaccctgtctttgtctccgggagaaagngccaccctctcctgcagggccagtcagagtgttaacaactacttggcctggttccaanagaaacctggccaggctcccaggctcctcatctatgatgcatccaacgagggccacgtggcactcccagccaggttcaggtcggcagtgggtctgggacagacttcactctcaccatcagccgcctagacgcctgaggtattctgtaccgtttattagttgttcgttgggtcgtagctaacgtcggtcctcccgttctacgttttcggccgtacggggaccgtaacgctggagagtacgacgacgacgtggtcgtcgtcgcacctatcgtgttcttctac

SEQ ID NO: 277788 - DNA, 554 bp, Homo sapiens
  misc_feature: GYAE6OF02IQI96.29.35.D02.1.454.CMB.1.raw
  modified_base (203)..(203): a, c, t, g, unknown or other
  misc_feature (203)..(203): n is a, c, g, or t
tcagatagagtactcacgaccggtgctcgatttagcacacgatagttgggtttggggaggaactgctcagttaggacccagacggaaccatggaagccccagctcagcttctcttcctcctgctactctggctcccagataccagcggagagattgtgttgacacagtctccagccaccctgtctttgtctccgggagaaagngccaccctctcctgcagggccagtcagagtgttaacaactacttggcctggttccaacagaaacctggccaggctcccaggctcctcatctatgatgcatccaacgagggccacgtggcactcccagccaggttcagtggcaggtgggtctgggacagtacttcactctcaccatcagccgcctagacgcgtggaggtattcgtgtccgtttattagttgttcgttgggtcgttagcctaacgtcggtcctcccgtctacgttttcggaccgtacggggaccaaggtcgtggacgtacgtacgacggacgtaacgtggtcggctgacctaccgtacttcgtcttcttctac

SEQ ID NO: 277789 - DNA, 642 bp, Homo sapiens
  misc_feature: GYAE6OF02JLT27.29.35.D02.1.454.CMB.1.raw
  modified_base (199)..(199): a, c, t, g, unknown or other
  misc_feature (199)..(199): n is a, c, g, or t
tcagatagagtactcacgaccggtgctcgatttagcacacgatagttgggtttgggggaggaactgctcagttaggacccagacggaaccatggaagccccagctcagcttctcttcctcctgctactctggctcccagataccagcggagagattgtgttgacacagtctccagccaccctgtctttgtctccggganaaagagcccaccctctcctgccagggccagtcagagtgttaacaactacttggcctggttccaacagaaacctggccaggcctcccaggcctcctcatctatgatgcatccaacgacgggccacgtggaccactcccagcccaggttcaggtgcgacggtgggtctgggactagacgttcaactctcacctatcgacgccgacctagacgcctggagtactcgtcgtaccgtttattacgttcgttacgttcgggtaccgttagaccgtaaccggttcgggtacccgttaccccgttaccgttaccggttttcgggacccgggtaacggggtaaccctaacggtccgttagggaaccgtacgttaccgaaggtaacccgtaagttcggtacgggtacctacggacctacgtaccgttccgtaggtttacccttaccgttaccg

SEQ ID NO: 277790 - DNA, 513 bp, Homo sapiens
  misc_feature: GYAE6OF02FJFYX.29.35.D02.1.454.CMB.1.raw
  modified_base (501)..(501): a, c, t, g, unknown or other
  misc_feature (501)..(501): n is a, c, g, or t
tcagatagagtactcacgaccggtgctcgatttagcacacgatagttgggtttgggggaggaactgctcagttaggacccagacggaaccatggaagccccagctcagcttctcttcctcctgctactctggctcccagataccagcggagagattgtgttgacacagtctccagccaccctgtctttgtctccgggagaaagagccaccctctcctgcagggccagtcagagtgttaacaactacttggcctggttccaacagaaacctggccaggctcccaggctcctcatctatgatgcatccaacacgggccactcggcactcccagccaggttcagtggcaggtgggtcgtgggacagacttcactctcaccatcacgccgcctagcgccgtgaggtattctcgtcgtttattattgtcgttggcgtagcacgtgcctccgtctactttggcgagggaccagcgtgagagtcgacgaacgacgtgtggctcgcacntctgtctctacg

SEQ ID NO: 277791 - DNA, 626 bp, Homo sapiens
  misc_feature: GYAE6OF02I6GZ3.29.35.D02.1.454.CMB.1.raw
  modified_base (202)..(202): a, c, t, g, unknown or other
  misc_feature (202)..(202): n is a, c, g, or t
  modified_base (211)..(211): a, c, t, g, unknown or other
  misc_feature (211)..(211): n is a, c, g, or t
  modified_base (363)..(363): a, c, t, g, unknown or other
  misc_feature (363)..(363): n is a, c, g, or t
tcagatagagtactcacgaccggtgctcgatttagcacacgatagttgggtttgggggaggaactgctcagttaggacccagacggaaccatggaagccccagctcagcttctcttcctcctgctactctggctcccagataccagcggagagattgtgttgacacagtctccagccacctgtctttgctccgggagaaagngccaccctntcctgcagggccagtcagagtgttaaacacgttacttggcctggttccaacgagaaacctggaccgaggcctacccaggctcatcatcgtatgatgcataccaagacggccacgtgcatcccgagccaggttcagtcggctaggtgggtcgngggacaggtaccttcgacgtacctcgaccatcgacgccgtacctacggacgcgtaggacgtacttcgtggttacccgtttagtttacgtttggttcgttcgggtcgtaacggccgttaacgtccggtaccccgttaccgtccgttaccggtttcggaccgtaacgggaaccgtaggtaccgtagggtagtaccgtacgaacggtacgtaacggtcggtcggtaccgtacgtacccgacgttacttacgttcgttaccgttccg

SEQ ID NO: 277792 - DNA, 559 bp, Homo sapiens
  misc_feature: GYAE6OF02IDA42.29.35.D02.1.454.CMB.1.raw
  modified_base (199)..(199): a, c, t, g, unknown or other
  misc_feature (199)..(199): n is a, c, g, or t
  modified_base (213)..(213): a, c, t, g, unknown or other
  misc_feature (213)..(213): n is a, c, g, or t
tcagatagagtactcacgaccggtgctcgatttagcacacgatagttgggtttgggggaggaactgatcagttaggacccagacggaaccatggaagccccagctcagcttctcttcctcctgctactctggctcccagataccagcggagagattgtgttgacacagtctccagccaccctgtctttgtctccggganaaagagccaccctntcctgcagggccagtcagagtgttaacactacttggcctggttccaacagaaacctggccaggcctccaggcctcctcatctatgatgcatccaacgagggccaacgtggaccactcccagccctaggttcaggtcggcaggtgggtctgggacaggtactcactctacaccatccagccgaccgtaacgacgcctaggacgtacgttcgtcgtaccgtttatttattgttcgttgggtcgtagtacgtactcggtcttcccgtctacgttttcgccgtacgggacacgcgtcgtagatacgagaacgtacgtaggtggtctcggctaccatctcgtcttctaccg

SEQ ID NO: 277793 - DNA, 670 bp, Homo sapiens
  misc_feature: GYAE6OF02JJRPA.29.35.D02.1.454.CMB.1.raw
tcagatagagtactcacgaccggtgctcgatttagcacacgatagttgggtttgggggaggaactgctcagttaggacccagacggaaccatggaagccccagctcagcttctcttcctcctgctactctggctcccagataccagcggagagattgtgttgacacagtctccagccaccctgtctttgtctccgggagaaagagccaccctctcctgcagggccagtcagagtgttaacactacttggcctggttccaacagaaacctggccaggctcccaggctcctcatctatgatgcatccaacagggccactggcatcccagccaggttcagtcggcaggtgggtctggggacaggtacctttcgaccttcgtaccaacccgtattaccgacggtcccgacccttaaggacggtcccgtagggacggtactttccgtcggtacccgtttttaagttttaacgttcggtttccgtttggggccgttaacgtccgtaaaccgttcgggtccccttaccccggttaccgttaccgtttttcgggacccgtaacgggggtaaccctaaacggccgttacgggaagtacgttaccgaacgggtaaccggtaacgttgggtcggtaccgtcggacccgtaaccgtcgttacgttcggttccttacgtaccg

SEQ ID NO: 277794 - DNA, 664 bp, Homo sapiens
  misc_feature: GYAE6OF02GPATT.29.35.D02.1.454.CMB.1.raw
tcagatagagtactcacgaccggtgctcgatttagcacacgatagttgggtttgggggaggaactgctcagttaggacccagacggaaccatggaagccccagctcagcttctcttcctcctgctactctggctcccagataccagcggagagattgtgttgacacagtctccagccaccctgtctttgtctccgggagaaagagccaccctctcctgcagggccagtcagagtgttaacaactacttggcctggttaccaacaagaaacctggccaggctcccaggctcctcatctatgatgacactccaaacgagggccacgtggccatccccagcctaggttcaggtcggcaggtgggtctggggacagtaccttcactctacaccataccacgccgacctacgacgccgtaggtaggtacttcgttcggtacccgttttaagtttacgtttcggttcgtttcggggtaccggttacgtacctaaccgttccgggtccccgttaccccggttaccgtttaccgtttttccgggacccggtaacgggggtaacccgtaaacggtccgttagggacgtacgtaccgaacgggtaaccggtaaccgtacggtcggtaccgttacggcctaaccgtacgttaccgtcgttaccgttacttacccg

SEQ ID NO: 277795 - DNA, 521 bp, Homo sapiens
  misc_feature: GYAE6OF02GG6NC.29.35.D02.1.454.CMB.1.raw
tcagatagagtactcacgaccggtgctcgatttagcacacgatagttgggtttgggggaggaactgctcagttaggacccagacggaaccatggaagccccagctcagcttctcttcctcctgctactctggctcccagataccagcggagagattgtgttgacacagtctccagccaccctgtctttgtctccgggagaaagagccaccctctcctgcagggccagtcagagtgttaacaactacttggcctggttccaacagaaacctggccaggctcccaggctcctcatctatgatgcatccaacagggccactggcatcccagccaggttcagtggcagtgggtctggggacagacttcactctcaccatcagccgcctacgagcctgaggattctcgtccgtttatttattgtctttgggcgtagctaacgtggcctcccgtctacttttcggccgaggggaccaaggcgtaggcgatcaggacgaactggtaggctgcaccatctgtcttctac

SEQ ID NO: 277796 - DNA, 563 bp, Homo sapiens
  misc_feature: GYAE6OF02IRQPN.29.35.D02.1.454.CMB.1.raw
  modified_base (368)..(368): a, c, t, g, unknown or other
  misc_feature (368)..(368): n is a, c, g, or t
tcagatagagtactcacgaccggtgctcgatttagcacacgatagttgggtttgggggaggaactgctcagttaggacccagacggaaccatggaagccccagctcagcttctcttcctcctgctactctggctcccagataccagcggagagattgtgttgacacagtctccagccaccctgtctttgtctccgggagaaagagccaccctctcctgcagggccagtcagagtgttaacaactacttggcctggttccaacagaaacctggccaggctcccaggctcctcatctatgatgcatccaacagggccactggcatcccagccaggttcaggtgcagtgggtctgggacagacttcactcncaccatcagcccgcctagacgccgtgacggtattctcgtccgttttattacgtttgttcgttggcgtagcaacgtggccctccgtctacgtttcggccgtacggggtaccaaggcgtagggacgtacgtacgacggaacgtaaccgttggtacggcgtcggccacctacgttaccgtcgtttccgttacttaccg

SEQ ID NO: 277797 - DNA, 566 bp, Homo sapiens
  misc_feature: GYAE6OF02H8E8X.29.35.D02.1.454.CMB.1.raw
  modified_base (414)..(414): a, c, t, g, unknown or other
  misc_feature (414)..(414): n is a, c, g, or t
tcagatagagtactcacgaccggtgctcgatttagcacacgatagttgggtttggggaggaactgctcagttaggacccagacggaaccatggaagccccagctcagcttctcttcctcctgctactctggctcccagataccagcggagagattgtgttgacacagtctccagccaccctgtctttgtctccgggagaaagcgccacctctcctgcagggccagtcagagtgtaacaacttacttggcctggttccaacagaaacctggccaggctcccgaggctcctcatctatgatgctactccaacgacgggccacgtggacctactcccgagccctaggttcaggtcggacgtaggtcggtcgtgggacagtacttcactcacacatcacgccactagacgtcagagtnttcgtcgtacgttttattagttcggttcgttgggcttagctaaccgtcggtccctccgttctacgtttcggaccgtacgggtaccagtcgtagagacgtcgaacgcgtaacgtggtacgtctcgaccacgtcttacgtcttacctctacccg

SEQ ID NO: 277798 - DNA, 586 bp, Homo sapiens
  misc_feature: GYAE6OF02GSM68.29.35.D02.1.454.CMB.1.raw
  modified_base (312)..(312): a, c, t, g, unknown or other
  misc_feature (312)..(312): n is a, c, g, or t
tcagatagagtactcacgaccggtgctcgatttagcacacgatagttgggtttggggaggaactgctcagttaggacccagacggaaccatggaagccccagctcagcttctcttcctcctgctactctggctcccagataccagcggagagattgtgttgacacagtctccagccaccctgtctttgtctccgggagaaagagccaccctctcctgcgagggccagtcagagtagttaacaactacttggcctggttccaacagaaacctggccaggctcccaggctcctcatctatgatgcataccaacncgggccacgtggccacgtcccacgtccgaggttccaggtcggactaggtgggtcgtgggacagtaccttcgactctacacctatcacgccgctagacgccgtcgaggtacttcgtcgtccgttttattagttcgttcgttgggtaccgtagtccgtaacgtcggtccttcccgttacgttacgtttcggccgtacggggtaccagtcgtaggacgtacgtacgacggaacgtacgtcggtggcgtgaccacgtagttctacgttcttactaccg

SEQ ID NO: 277799 - DNA, 257 bp, Homo sapiens
  misc_feature: GYAE6OF02GBVDL.29.35.D02.1.454.CMB.1.raw
  modified_base (255)..(257): a, c, t, g, unknown or other
  misc_feature (255)..(257): n is a, c, g, or t
tcagatagagtactcacgaccggtgctcgatttagcacacgatagttgggtttgggacagacttcactctcaccatcagccgcctagagcctgaggattctgccgtttattattgtcttgggcgtagcaactggcctcccgtcacttttggccaggggaccaagctggagatcagacgaactgtggctgcaccatctgtcttcatcttcccgcatctgaagtactctatctgagcgggctggcaaggcgcatagnnn

SEQ ID NO: 277800 - DNA, 720 bp, Homo sapiens
  misc_feature: GYAE6OF02HRG88.29.35.D02.1.454.CMB.1.raw
tcagatagagtactcacgaccggtgctcgatttagcacacgatagttgggtttggggaggaactgctcagttaggacccagacggaaccatggaaagccccagctcagcttctcttcctcctcgctactctgctccacgataccacgcggagagattgtgttgacacagtcttccacgccaccctcgtctttcgtctccgggagaaagaagccaccctctcctcgcaggccacgtcagagtgttaacaactacttcggcctcggttccaacaagaaaccgtgccgagctcccacggctcctcatctatgatgcactaccaacgacggccgacctaggcactcccgacgaccgtacggttcgagtaggcgtaggtgggtcgtgggtacgacgtacgttaccacgtaccttaccaccaaatccgaacggaccccgacccgttaacgaaccggccgtttacggaagggttaacttcggttcgttaacccgttttttaagtttaagtttcgtttcgtttacggggtccgggttaacgacccgtaaaccgtcgggttccccgttcccgtttaccgttaaccgtttttcggggtacccggaacgggggttaaacccgtaaacggcgttacgggaacgtaacgttccgaacggtaaacggtacccgttaggggttccgccggttcgtacccgaccgtaatttaccggttcttcccttacgttacccg

SEQ ID NO: 277801 - DNA, 539 bp, Homo sapiens
  misc_feature: GYAE6OF02JGYGV.29.35.D02.1.454.CMB.1.raw
tcagatagagtactcacgaccggtgctcgatttagcacacgatagttgggtttgggggaggaactgctcagttaggacccagacggaaccatggaagccccagctcagcttctcttcctcctgctactctggctcccagataccagcggagagattgtgttgacacagtctccagccaacctgtctttgtctccgggagaaagagccaccctctcctgcagggccagtcagagtgttaacaactacttggcctggttccaacagaaacctggccaggctcccaggctcctcatctatgatgcatccaacgagggccacgtggcactcccagccaggttcagtcgcagtgggtctgggacagacttcacgtctcaccatcacgccgtacctagacgccgtgacggtattctcgtaccgtttattagttgttcgttgggtcgtagccaacgtcggcctcccgttctacgtttcggaccgtacgggaccagcgtaggagatcgagtacgaactggtgcgtgcactactcgtcgtccttctcc

SEQ ID NO: 277802 - DNA, 572 bp, Homo sapiens
  misc_feature: GYAE6OF02G8WUA.29.35.D02.1.454.CMB.1.raw
tcagatagagtactcacgaccggtgctcgatttagcacacgatagttgggtttgggggaggaactgctcagttaggacccagacggaaccatggaagccccagctcagcttctcttcctcctgctactctggctcccagataccagcggagagattgtgttgacacagtctccagcccaccctgtctttgtctccgggagaaagagccaccctctcctgcagggccagtcagagtgttaacaactacttggcctggttccaacagaaacctggccaggctccaggctcctcatctatgatgcatccaacgacgggccactggccactcccagccgaggttccaggtcggcgaggtgggtctgggacagtacttcactctacaccatccacgccgccgtacgacgccgtaggaggtacttcgttcgttaccgtttatttagttcgttcgtttcgggtacgtagtctaacgtcggtcccgtcccgtctacgttttcggaccgtacggggaccgagcgtggagtactacgagacgtaacgtggtcgacgtcggacacatctcgttccttctaccg

SEQ ID NO: 277803 - DNA, 569 bp, Homo sapiens
  misc_feature: GYAE6OF02HO68M.29.35.D02.1.454.CMB.1.raw
  modified_base (199)..(199): a, c, t, g, unknown or other
  misc_feature (199)..(199): n is a, c, g, or t
  modified_base (204)..(204): a, c, t, g, unknown or other
  misc_feature (204)..(204): n is a, c, g, or t
  modified_base (379)..(379): a, c, t, g, unknown or other
  misc_feature (379)..(379): n is a, c, g, or t
tcagatagagtactcacgaccggtgctcgatttagcacacgatagttgggtttgggggaggaactgctcagttaggacccagacggaaccatggaagccccagctcagcttctcttcctcctgctactctggctcccagataccagcggagagattgtgttgacacagtctccagccaccctgtctttgtctccggganaaagngccaccctctcctgcagggccagtcagagtgttaaacaactacttggcctggttaccaacagaaaacctggaccaggctcccaggcctcctcatctatgatgcatccaacagggccacgtggcatcccagccaggttcagtggcagtgggtctgggacagacttcactctcaccntcacgccgcctagacgtcctaggacggtatttcgtgttaccgttttattagtttcggttcgttagggtcgtagtaccaacgtcggccttcccgtcgttacgtttcggccgtacgggaccagcgtagggagtacgtacgacgaacgtacgtggtcggacgtcgacctaccgacttcgtgttcctacgtacc

SEQ ID NO: 277804 - DNA, 680 bp, Homo sapiens
  misc_feature: GYAE6OF02IVXTJ.29.35.D02.1.454.CMB.1.raw
tcagatagagtactcacgaccggtgctcgatttagcacacgatagttgggtttggggaggaactgctcagttaggacccagacggaaccatggaagccccagctcagcttctcttcctcctgctactctggctcccagatacccagcggagagattgtgttgacacagtctcagccaccctgtctttgtctccgggagaaagcgccaccctctcctgcagggccagtcagagtgttaaccaactcttggccttggttaccaaacagaaacctggaccaggcctccgaggcctaccctcgactctatgactcgactactcccaacgacgggccacgtcggcactaccccgagtacccgaagggtttccaacgggtggccgtaagggttcggggtaccgttcgggggaactacggtaccgtttaccgaacgttccctacgtaacccgagttacccgacggtcccgtaccgtacgaccgccgtagaggtacttcgtcggtacccgttttattacgttggttcgttacgggtccgttagtccgtaacggttccggtacccgttcccggtacttaaccgttttcggaccgtaaccggggtactaaacgtccggtagacgtacgtacgacggtacgtaacgttggtacggtcgtcggacctaccgattccggtattcctcttaccg

SEQ ID NO: 277805 - DNA, 826 bp, Homo sapiens
  misc_feature: GYAE6OF02JPR3T.29.35.D02.1.454.CMB.1.raw
  modified_base (202)..(202): a, c, t, g, unknown or other
  misc_feature (202)..(202): n is a, c, g, or t
tcagatagagtactcacgaccggtgctcgatttagcacacgatagttgggtttgggggaggaactgctcagttaggacccagacggaaccatggaagccccagctcagcttctcttcctcctgctactctggctccagataccagcggagagattgtgttgacacagtctccagccacctgtctttgtcgtcgggagaaagngcccaccctctcctgcgagggccagtcagagtagttaaaccaacttacgttgggcccttgggttaccccaaaacgtaacggtaaaacccgttcgggacccaagggtcccttaccccgaaggggtccccttaccctacctaacttaccttaagtacggtaacgtcggtacctaaaccttacccgaaaaccggaacggggtccccaaccggttcgggaccctaaccgttacccccgaacggtacccccggttaagggtttaccgaagggtttaccgggacccgtaaggggtttcgggggttacccggttaagggggaaaccctaacgggttaacccttttaccgaacccttttcccgtaaccgtaacccctaagttacccgaaccggaccccgtacccgtaacggacgtacccgtaggtacggtaacgtttccgttcgttaccgttttacttacgtttcggtttcgttcgggtacgtacgtacgtaacgtcggtcccgtccgttacgttaccgtttcggaccgtacgggtaccgtacgtacgtaggacgtacgtacgacggtaaccgtaacgttggtacgtcgtacgtactaaccggtactacgtttcgttaccgttaccgtaccg

SEQ ID NO: 277806 - DNA, 583 bp, Homo sapiens
  misc_feature: GYAE6OF02HLC1D.29.35.D02.1.454.CMB.1.raw
  modified_base (402)..(402): a, c, t, g, unknown or other
  misc_feature (402)..(402): n is a, c, g, or t
  modified_base (535)..(535): a, c, t, g, unknown or other
  misc_feature (535)..(535): n is a, c, g, or t
tcagatagagtactcacgaccggtgctcgatttagcacacgatagttgggtttggggaggaactgctcagttaggacccagacggaaccatggaagccccagctcagcttctcttcctcctgctactctggctcccagataccagcggagagattgtgttgacacagtctccagccaccctgtctttgtctccgggagaaagagccaccctctcctgcagggccagtcagagtgttaacaacttacttgggcctggttaccaaacagaaacctggccaggcctcccgaggcctcctcatctaatgatgcactccaacgcgggccacgtggcactccccagccctaagggttccaggtcggcgtaggtcgggtcctggggaactacggtaaccttcaccttcnctaaccgatcgacgccgaccgtagacgtcctgacggtattcgtgtaccgtttattactttcgttcgttgggtcgtacgtctaacgtcgtccgttccgtctcgtttcgccgtacgggacgaacgcgtagacganacgtagacgtacgtggtcgacgtgaccacagttcgtcgttcttctacg

SEQ ID NO: 277807 - DNA, 256 bp, Homo sapiens; identical to SEQ ID NO: 276990
  misc_feature: GYAE6OF02F3I9B.29.35.D02.1.454.CMB.1.raw
  modified_base (256)..(256): a, c, t, g, unknown or other
  misc_feature (256)..(256): n is a, c, g, or t

SEQ ID NO: 277808 - DNA, 514 bp, Homo sapiens
  misc_feature: GYAE6OF02GOQJD.29.35.D02.1.454.CMB.1.raw
  modified_base (310)..(310): a, c, t, g, unknown or other
  misc_feature (310)..(310): n is a, c, g, or t
tcagatagagtactcacgaccggtgctcgatttagcacacgatagttgggtttgggggaggaactgctcagttaggacccagacggaaccatggaagccccagctcagcttctcttcctcctgctactctggctcccagataccagcggagagattgtgttgacacagtctccagccaccctgtctttgtctccgggagaaagagccaccctctcctgcagggccagtcagagtgttaacaactacttggcctggttccaacagaaacctggccaggctcccaggctcctcatctatgatgcatccaacngggccactggcatcccagccaggttcagtggcagtgggtctgggacagacttcactctcaccatcagccgcctagagcctgaggattctgtccgtttattattgtcttgggcgtagcaactggcctcccgtctacgttttggccgtacggggaccaagcgtggagatcagacgaactggtggctgcaccatctcgttcttctac

SEQ ID NO: 277809 - DNA, 555 bp, Homo sapiens
  misc_feature: GYAE6OF02F86GE.29.35.D02.1.454.CMB.1.raw
  modified_base (310)..(310): a, c, t, g, unknown or other
  misc_feature (310)..(310): n is a, c, g, or t
  modified_base (397)..(397): a, c, t, g, unknown or other
  misc_feature (397)..(397): n is a, c, g, or t
tcagatagagtactcacgaccggtgctcgatttagcacacgatagttgggtttgggggaggaactgctcagttaggacccagacggaaccatggaagccccagctcagcttctcttcctcctgctactctggctcccagataccagcggagagattgtgttgacacagtctccagccaccctgtctttgtctccgggagaaagagccaccctctcctgcagggccagtcagagtgttaacaactacttggcctggttccaacagaaacctggccaggctcccaggctcctcatctatgatgcatccaacngggccactggcatcccagccaggttcagtgcagtgggtctgggacagacttcactctcaccatcacgccgcctagacgcctgaggtnttcgtgtccgtttattattgtcgttgggcgtagctaacgtcggcctcccgtctacgttttcggccgtacggggaccaacggtcgtaggagacgtacgaggaacggtaacttcggtcggtcgtcggacctaccgtacgttcgtcgttccttacttaccg

SEQ ID NO: 277810 - DNA, 533 bp, Homo sapiens
  misc_feature: GYAE6OF02GR1HE.29.35.D02.1.454.CMB.1.raw
tcagatagagtactcacgaccggtgctcgatttagcacacgatagttgggtttggggaggaactgctcagttaggacccagacggaaccatggaagccccagctcagcttctcttcctcctgctactctggctcccagataccagcggagagattgtgttgacacagtctccagccaccctgtctttgtctccgggagaaagagccaccctctcctgcagggccagtcagagtgttaacaactactggcctggttccaacagaaacctggccaggctcccaggcctcctcatctatgatgcatccaacagggccacgtggcactcccagccaggttcagtcggcagtgggtctgggacagacttcactctcacctatcacgccgctagacgcctggaggtattcgtcgtccgtttattatttgttcgttgggtcgtacgcacgtcggcctcccgttctacgtttcggccgtagggaccagcgtggagagtcgagacgaacgtggtcgcgtgccactatcgtcgttctctaccg

SEQ ID NO: 277811 - DNA, 645 bp, Homo sapiens
  misc_feature: GYAE6OF02HI6BV.29.35.D02.1.454.CMB.1.raw
tcagatagagtactcacgaccggtgctcgatttagcacacgatagttgggtttgggggaggaactgctcagttaggacccagacggaaccatggaagccccagctcagcttctcttcctcctgctactctggctcccagataccagcggagagattgtgttgacacagtctccagccaccctgtctttgtctccgggagaaagagccaccctctcctgcagggccagtcagagtgttaacaactacttggccttggttccaaacagaaacctggccaagggcctcccgaggcctcctcactctatgatgcactaccaacgagggccacgtggccactcccagcctaggttcaggtcggcaggtgggtcgtagggacagtacttcgaccttctaccacccatccgacgcccgacctaggacgtcctggtacgtaacgtttcgttcgttaccgttttatttacgtttcggttcgttcgggtcgttacgtacctaaccggttcggtccccgttcccgttaccgttaccgttttacgggacccgtaacggggtaacccgtaacggtccgttagggacgtacgtacgaacggtaaccgtaacgtcggtcggcgttacgcctaccgtacgttccgttcttccttatacccg

SEQ ID NO: 277812 - DNA, 770 bp, Homo sapiens
  misc_feature: GYAE6OF02GN9AU.29.35.D02.1.454.CMB.1.raw
  modified_base (714)..(714): a, c, t, g, unknown or other
  misc_feature (714)..(714): n is a, c, g, or t
tcagatagagtactcacgaccggtgctcgatttagcacacgatagttgggtttggggaggaactgctcagttaggacccagacggaaccatggaagccccagctcagcttctcttcctcctgctactctggctcccagataccagcggagagattgtgttgacacagtctccagccaccctgtctttgtctccgggagaagagccacctctcctgcagggccagtcagagtgttaaacaacttacttggcctggttaccaacagaaacctggccagggcctcccgaggctccctcatcctatgatgcgtatccaacgacgggccacgttacggccaacgtccccaaggcccgtaggtttccgacggttcggccgtagggtttcggggtccgttaggggggaacccacggttaaccgttcctaaccttccctcccgtaaccctacttacccgaacggccccgtacccgttaaggaccggtccttacggggtaaacgtcgtttaccgttacggttacccggtttttagtttaacgtttcgggttttcgtttacgggggtcgtttaacggaccgttaaccggttccgggttccccgttaccccggtttgtttaacccggtttttcgggaccccgggttaacgggggttaaacccacgggttcggttaccgggacgttacgtacgtaacggtaaccgggaaaccgttgggttaccggntttacccgggacgttaacccgtacttcccggttaggtttacccttcggttaacccc

SEQ ID NO: 277813 - DNA, 527 bp, Homo sapiens
  misc_feature: GYAE6OF02FKJP2.29.35.D02.1.454.CMB.1.raw
tcagatagagtactcacgaccggtgctcgatttagcacacgatagttgggtttgggggaggaactgctcagttaggacccagacggaaccatggaagccccagctcagcttctcttcctcctgctactctggctcccagataccagcggagagattgtgttgacacagtctccagccaccctgtctttgtctccgggagaaagagccaccctctcctgcagggccagtcagagtgttaacaactacttggcctggttccaacagaaacctggccaggctcccaggctcctcatctatgatgcatccaacagggccactggcatcccagccaggttcagtggcagtgggtctggggacagacttcactcctcaaccatcagccgcctagacgcctgagattctgtccgtttattattgtcttgggtcgtagcaacgtcgcctcccgtctacgttttggccgaggggaccaagtcgtggagacgtcagacgaactggtggccgtgcacctacgtctgttccttctaccg

SEQ ID NO: 277814 - DNA, 550 bp, Homo sapiens
  misc_feature: GYAE6OF02HBQED.29.35.D02.1.454.CMB.1.raw
tcagatagagtactcacgaccggtgctcgatttagcacacgatagttgggtttgggggaggaactgctcagttaggacccagacggaaccatggaagccccagctcagcttctcttcctcctgctactctggctcccagataccagcggagagattgtgttgacacagtctccagccaccctgtctttgtctccgggagaaagagccaccctctcctgcagggccagtcagagtgttaacaactacttggcctggttccaacagaacctggccaggctccaggctcctcatctatgatgcataccaacgcgggccacgtggccactcccagcctaggttcaggtcggcaggtgggtcgtgggacacgtacttcgactctcaccatccgacgcccgaccgtacgacgccgtgaggtacttcgtcgttaccgtttatttagttcgttcgttggcgtagtctacgtcgtcctccgtctacgtttcggccgtacgggacgacgcgtggagagtcgacgtacgtacgtggtggcgtgacactctctcgtcttctc

SEQ ID NO: 277815 - DNA, 554 bp, Homo sapiens
  misc_feature: GYAE6OF02HZ27R.29.35.D02.1.454.CMB.1.raw
  modified_base (397)..(397): a, c, t, g, unknown or other
  misc_feature (397)..(397): n is a, c, g, or t
  modified_base (538)..(538): a, c, t, g, unknown or other
  misc_feature (538)..(538): n is a, c, g, or t
tcagatagagtactcacgaccggtgctcgatttagcacacgatagttgggtttgggggaggaactgctcagttaggacccagacggaaccatggaagccccagctcagcttctcttcctcctgctactctggctcccagataccagcggagagattgtgttgacacagtctccagccaccctgtctttgtctccgggagaaagagccaccctctcctgcagggccagtcagagtgttaaacaactacttggcctggttccaacagaaacctggccaggctccaggctctcatctatgatgcatccaacagggccactggcatcccagccaggttcagtggcagtgggtctgggacagacttcactctcaccatcacgccgcctagacgcctgaggtnttcgtgtccgttttattactttggttcgttgggcgttagctacgtcggtcccttccccgttctacgttttcggccgtaggggtacccgaaggccgtagggacgacttcgacggaacgtaacgtgtacggtcgtgccaccgnttctgtccttcgtacc

SEQ ID NO: 277816 - DNA, 604 bp, Homo sapiens
  misc_feature: GYAE6OF02GE25V.29.35.D02.1.454.CMB.1.raw
tcagatagagtactcacgaccggtgctcgatttagcacacgatagttgggtttgggggaggaactgctcagttaggacccagacggaaccatggaagccccagctcagcttctcttcctcctgctactctggctcccagataccagcggagagattgtgttgacacagtctccagccaccctgtctttgtctccgggagaaagagccaccctctcctgcagggccagtcagagtgttaacactacttggcctggttccaacagaaacctggccaggctcccaggctctcatctatgatgcatccaacagggccacgtggcactcccagccaggttcagtcgcaggtggtctgggacagacttcactctacaccatcacgccgactagacgccgtgtacggacttcgtacggtccgtttaattagttcgtccgtttgggccgttagtcctaacgttcgtcccgttcccgtcgtacgttttcgggacccgtaggggaaccctaaggtccgtagggacgtagtaccgtaacggtaaccgtaacgttggttaccggtcttaccggacctaacccgttagttccgttacggttcctttaccgtaacccg

SEQ ID NO: 277817 - DNA, 755 bp, Homo sapiens
  misc_feature: GYAE6OF02GCUSZ.29.35.D02.1.454.CMB.1.raw
  modified_base (218)..(218): a, c, t, g, unknown or other
  misc_feature (218)..(218): n is a, c, g, or t
tcagatagagtactcacgaccggtgctcgatttagcacacgatagttgggtttggggaggaactgctcagttaggacccagacggaaccatggaagccccagctcagcttctcttcctcctgctactctggctcccagataccagcggagagattgtgttgacacagtctccacgccacccttgtctttgtcgtccgggagaaacgacgcctaccctntcctgcacgggccagtcagtagtacgttaaacaacttacgttcggccttagggtttacccaaacgacgaaaaccttcgggaccctaacgggtcctaccccgaagggcccttccccgttcctacttccttatcgtacttacggtcaacttccaaaccgacgggccaacgtcgggacctactccccacgtccgtaggttacaggttcgacgaggttcggggtcgtcggggactacggtacttacgaccttccttacaccctactccgacgcccgtacctaagcgtccgtaggtacggtatttcgtacgttaccgttttacttgttttacgttcggtttacgggtcgttacgacgtaaccgttcggttacccgttcccggtttcctttacccggttttcgggtacccggtaacgggggtaaccctaacgggtccggttaacgggaagttacgtaacggtacggtaaacggtaaccgttaggggttaccggtacgttcggaccttacctacggttacctttcgttaccgtttcttacccgg

SEQ ID NO: 277818 - DNA, 536 bp, Homo sapiens
  misc_feature: GYAE6OF02IXHMV.29.35.D02.1.454.CMB.1.raw
tcagatagagtactcacgaccggtgctcgatttagcacacgatagttgggtttgggggaggaactgctcagttaggacccagacggaaccatggaagccccagctcagcttctcttcctcctgctactctggctcccagataccagcggagagattgtgttgacacagtctccagccaccctgtctttgtctccgggagaaagagccaccctctcctgcagggccagtcagagtgttaacaactacttggcctggttccaacagaaacctggccaggctcccaggctccctcatctatgatgcatccaacagggccactggcatcccagccaggttcagtggcagtgggtctgggacagacttcatctcaccatcagccgcctagacgcctgaggtattctgtccgtttattagtttgttcgtttgggcgttagccaactcgggccttcccgtctaccgttttcggccgacggggtaccaagcgtgggacgagtcgaaggacgtaacgtggtggcgtgcaccatctgttcctctac

SEQ ID NO: 277819 - DNA, 554 bp, Homo sapiens
  misc_feature: GYAE6OF02GT63R.29.35.D02.1.454.CMB.1.raw
  modified_base (203)..(203): a, c, t, g, unknown or other
  misc_feature (203)..(203): n is a, c, g, or t
  modified_base (261)..(261): a, c, t, g, unknown or other
  misc_feature (261)..(261): n is a, c, g, or t
  modified_base (381)..(381): a, c, t, g, unknown or other
  misc_feature (381)..(381): n is a, c, g, or t
tcagatagagtactcacgaccggtgctcgatttagcacacgatagttgggtttggggaggaactgctcagttaggacccagacggaaccatggaagccccagctcagcttctcttcctcctgctactctggctcccagataccagcggagagattgtgttgacacagtctccagccaccctgtctttgtctccgggagaaagngccaccctctcctgcagggccagtcagagtgttaacaactacttggcctggttccaanagaaacctggccaggctcccaggcctcctcatctatgatgcatccaagacgggccacgtggcactcccagccaggttcagtcggcaggtggtcgtgggacagtacttcactctccacctntcacgccgacctagacgccgtgaggtattcgtcgtccgttttattatttcgttcgttgggtcgtagctaacgtcgcccttccgtcctacgtttcggccgtacgggaccagcgtggagactcgacgaacgtaacgtggtcggctcggaccaccgtatcgtcgttccgtctaccg

SEQ ID NO: 277820 - DNA, 630 bp, Homo sapiens
  misc_feature: GYAE6OF02HSNT3.29.35.D02.1.454.CMB.1.raw
  modified_base (207)..(207): a, c, t, g, unknown or other
  misc_feature (207)..(207): n is a, c, g, or t
  modified_base (212)..(212): a, c, t, g, unknown or other
  misc_feature (212)..(212): n is a, c, g, or t
  modified_base (279)..(279): a, c, t, g, unknown or other
  misc_feature (279)..(279): n is a, c, g, or t
tcagatagagtactcacgaccggtgctcgatttagcacacgatagttggggtttggggggaggaactgctctagttaggacccagacggtaaaccatggaacgccccagctcagcttctcttcctcctgctactcgtggctcccagatacccaggcggagagattgtgttgacacagtctccagccaccctgtcttgtctccggganaaagngcccaccctctcctgcacgggccaggtcagtagtagttaaacaactacgttggccttggttaccaanagtaaacctggccaggcctcccgagctcctcatctatgatcgcatccgaacgacgggccacgtggacactcccagcctaggttcagtggactaggtcgggtacgtgggacagtacttcactctccaccatccgacggcccgccgtaggacgtccgtaggaggtacgttcgtcgtaccgtttattattcgttcgttgggtcgtagactaaccgtcggtcccttccgtcgtaccgtttcggccgtacggggtaccgtaagcgtaggacgtacgtacgtaacggaacgtaaccgttcggtacggtccgtacggtaccaccgttaccgttccgtttccgttccttaccgtacccg

SEQ ID NO: 277821 - DNA, 787 bp, Homo sapiens
  misc_feature: GYAE6OF02IWJRF.29.35.D02.1.454.CMB.1.raw
  modified_base (213)..(213): a, c, t, g, unknown or other
  misc_feature (213)..(213): n is a, c, g, or t
tcagatagagtactcacgaccggtgctcgatttagcacacgatagttgggtttgggggaggaactgctcagttaggacccagacggaaccatggaagcccagctcagcttctcttcctcctgctactctggctccagataccagcggtagagattgtgttgacacagtctcagccacctgtctttgcgtccgggagaaagcgccacctctccngcgagggccagtcaagtacgttagttaaaccaacttcgttcggccttcgggttacccaaaacgtaacgtaaaacccgtggacccgaagggtcccttaccccgaagggtccccttcctacctaagtccgttaaactcggtaacttcggacctaacttaaccccgaaagcggggtacccacggttcggacctaaccgttccccgaggtcccgtaacgggtttccgaagggtcggaccgttaaggggttcgggtacgttacgggggaacctaacggtcctttaccgaaccgttcgtaaccccgaaccgtactaccgtaccggacccgtacgtaagacgtccgtaaggacggtacttcgtacgtaccgtttattagttcgttacgttggaccgtacgtacgtaaccggttcggtacccgttcccgttacgttaaccggttttccgggaacccgggtaaacggggtaccctaaaggtaccgggttaaggaacggtacgtaccggaaacggtaccggtaacggttcggtaacggtcgtaacggtcctaccggtacttcggtcgttaccttacgtacccgg

SEQ ID NO: 277822 - DNA, 759 bp, Homo sapiens
  misc_feature: GYAE6OF02F6O1F.29.35.D02.1.454.CMB.1.raw
tcagatagagtactcacgaccggtgctcgatttagcacacgatagttgggtttgggggaggaactgctcagttaggacccagacggaaccatggaagccccagctcagcttctcttcctcctgctactctggctcccagataccacggacggaaagtaggtactttggacgttacgaacgtacctaccgtacgtccccaagttccctacccgttgttccttttcgtccttcccgggaagggaaacgacgaccgacccctacctcctcgacgtacgggcccaagggtcccaaggtacgtaggttaaacgtaacttacgtacggaccttacggtttccgaacctagggtaaaccttcggaacctaacggacgtcccctagggcctaccggtcccgattcctactcgtactgcgtactaccgaacctacgggaccaacgtacggggccaacgtcccgacgaccgtaccggtacaccggtcggtacagggttcgggtcggtaggggttacgacgtacgtcgacttccgtacctacctactaccaagtccgacgtacgacgcctacgaacgttacgtacgtacgttaccgttattagttcgttacgttacggtacgttacgaccgtacggtcgtaccgtaccgtacgtacgtttaccggccgtacgggtaacctacgggacgtacgggacgtacgtacggaaggtaccgtaacgtacggtacgtcgttacgctacgtacctacgtacgttccttacgttacccg

SEQ ID NO: 277823 - DNA, 730 bp, Homo sapiens
  misc_feature: GYAE6OF02H1H81.29.35.D02.1.454.CMB.1.raw
  modified_base (262)..(262): a, c, t, g, unknown or other
  misc_feature (262)..(262): n is a, c, g, or t
  modified_base (363)..(363): a, c, t, g, unknown or other
  misc_feature (363)..(363): n is a, c, g, or t
  modified_base (383)..(383): a, c, t, g, unknown or other
  misc_feature (383)..(383): n is a, c, g, or t
tcagatagagtactcacgaccggtgctcgatttagcacacgatagttgggtttgggggaggaactgctcagttaggacccagacggaaccatggaagccccagctcagcttctcttcctcctgctactctggctccagataccagcggagagattgtgttgacacagtctccagccacctgtctttgtctccgggagaaagagccaccctctcctgcagggccagtcagagtgttaaacaactacttggccttggttccaanagaaacctggccaggctcccaggctcctcatctatgatgcatccaacgaggccacgtggccactcccgagcccgtaggttcaggtggcgaggtcgggtcgngggacacgtacttcacttcnccacctatcgacgcccgacctaaggacgtccgtaggaacggttacttccgttacggtttacccggtttttattttaacggtttcggttttcccggttaggggttacccggttaaacggtaccgttaaaccggttccggggttaccccctttcccccgggttaccgttttaccgggtttttcccggggaacccgggtaaccgggggtaacccgtaaacgggtccggttaaggggtaacggttacgtaacccggtaacgggtaaccggtaaccggttgggtaaccgggtcgttaccggtacccgttacccgtacgtttcccgttacgtttcccgttaccgttaaccccg

SEQ ID NO: 277824 - DNA, 684 bp, Homo sapiens
  misc_feature: GYAE6OF02FFT1D.29.35.D02.1.454.CMB.1.raw
tcagatagagtactcacgaccggtgctcgatttagcacacgatagttgggtttgggggaggaactgctcagttaggacccagacggaaccatggaagccccagctcagcttctcttcctcctgctactctggctcccagataccagcggagagattgtgttgacacagtctccagccaccctgtctttgtctccgggagaaagagccaccctctcctgcacgggccagtcagagtgttaacactacttggcctggttaccaacacgaaacctggccagggctcccaggcctcctcatctatgatgcatccaacacgggctacgtggcactcccagcctaggttcaggtcggcgaggtgggtcgttggggacaggtaccttacaccttctaccgacctactccgacgtcccgaccgtaagcgaccgtaggtaggtactttcgtacgtaccgttttagtttacgtttcgtcgtttacggggtcgtacgtacctaaccgttcggtaccctcccggttacgttaccgtttttacgggaacccgtacgggggaaccctaaacgggtcgttacgggaagtacgtacggtaacggtaaaccggtaaccgttacgggttaccgggtaccgtttaccggacccgtaacccgttacgtttaccgtttccggttacccttttaccgttaaccccg

SEQ ID NO: 277825 - DNA, 589 bp, Homo sapiens
  misc_feature: GYAE6OF02JBIK4.29.35.D02.1.454.CMB.1.raw
tcagatagagtactcacgaccggtgctcgatttagcacacgatagttgggtttggggaggaactgctcagttaggacccagacggaaccatggaagccccagctcagcttctcttcctcctgctactctggctcccagataccagcggagagattgtgttgacacagtctccagccaccctgtctttgtctccgggagaaagagccaccctctcctgcagggccagtcagagtgttaacaactacttggcctggtccaacagaaacctggccaggctcccaggctcctcatctatgatgcatccaacgagggccactggacactcccagccaggttcagtggcaggtgggtctgggacagacttcacttctcacatcacgccgactacgacgcctggaggtacttcgtcgtccgttttattacgtttcgttcgttcgggtcgttacgccgtaacgtcggtcccttcccgttcgtaccgttttcgggaccgtacggggacctaacggtcgtcgggtacgagtacgacggtaaccggacgttaggtcggtacgtacgccgtacctacgttacgtcgttaccgttcttaccg

SEQ ID NO: 277826 - DNA, 637 bp, Homo sapiens
  misc_feature: GYAE6OF02JB4W9.29.35.D02.1.454.CMB.1.raw
  modified_base (153)..(153): a, c, t, g, unknown or other
  misc_feature (153)..(153): n is a, c, g, or t
  modified_base (157)..(157): a, c, t, g, unknown or other
  misc_feature (157)..(157): n is a, c, g, or t
  modified_base (167)..(167): a, c, t, g, unknown or other
  misc_feature (167)..(167): n is a, c, g, or t
  modified_base (201)..(201): a, c, t, g, unknown or other
  misc_feature (201)..(201): n is a, c, g, or t
  modified_base (206)..(206): a, c, t, g, unknown or other
  misc_feature (206)..(206): n is a, c, g, or t
  modified_base (214)..(214): a, c, t, g, unknown or other
  misc_feature (214)..(214): n is a, c, g, or t
  modified_base (232)..(232): a, c, t, g, unknown or other
  misc_feature (232)..(232): n is a, c, g, or t
  modified_base (296)..(296): a, c, t, g, unknown or other
  misc_feature (296)..(296): n is a, c, g, or t
  modified_base (344)..(344): a, c, t, g, unknown or other
  misc_feature (344)..(344): n is a, c, g, or t
  modified_base (357)..(357): a, c, t, g, unknown or other
  misc_feature (357)..(357): n is a, c, g, or t
  modified_base (386)..(386): a, c, t, g, unknown or other
  misc_feature (386)..(386): n is a, c, g, or t
tcagatagagtactcacgaccggtgctcgatttagcacacgataggttgggtttgggggaggaacgtgctcagttaggacccagacggaaccatggaagccccagctcagcttctcttcctcctgctactctggctccagataccagccgganagtnttgtgtgacncagtctccagccacctgtctttgtctccgggganaagcnccaccctnacctgcaggccagtcagntagttaacactacttggaccttggttaccaacaggaacctgccaggcctcccgaggcgtccctnaatctagtggatgtacatccaacgacggccaaccgtggcactcccganccgagttccaggngtcaggtggtctagggactaggtaccttnacctctacccgactaatcgacgtcccgaccgttacgacgtccgtacgaggtaacgtttccgtagtaccgttttaactttaagtttcgttccgttgggtaccgttagtacgtaacgtcggtaccctcccggttccttacgttttcggaccgtaccgggttacctaacgtccgtaggtacgtactacgtaacggtaaccgtaacgtacgggtagtccgtaggtccaaccgtactacgtgttcccgttataccc

SEQ ID NO: 277827 - DNA, 552 bp, Homo sapiens
  misc_feature: GYAE6OF02IRX1I.29.35.D02.1.454.CMB.1.raw
  modified_base (203)..(203): a, c, t, g, unknown or other
  misc_feature (203)..(203): n is a, c, g, or t
tcagatagagtactcacgaccggtgctcgatttagcacacgatagttgggtttggggaggaactgctcagttaggacccagacggaaccatggaagccccagctcagcttctcttcctcctgctactctggctcccagataccagcggagagattgtgttgacacagtctccagccaccctgtctttgtctccgggagaaagngccaccctctcctgcagggccagtcagagtgttaacaactacttggcctggtccaacagaaacctggccaggcctcccaggctccctcatctatgatgcatccaacgacgggccaacgtggcactcccagccaggttcagtggcagtgggtctgggacagtacttcactctcaccatcacgccgcctaagacgcctgaggtattcgtgtccgtttatttacttgttcgttcggggtcgttagcgtaacgtcggtcccgttcccgttcgtaccgttttcggccgtacggggacctaacggcgtggagatcgagacgaactggtcgcgtgcacctatctgttccttctacc

SEQ ID NO: 277828 - DNA, 584 bp, Homo sapiens
  misc_feature: GYAE6OF02F1ABJ.29.35.D02.1.454.CMB.1.raw
  modified_base (199)..(199): a, c, t, g, unknown or other
  misc_feature (199)..(199): n is a, c, g, or t
tcagatagagtactcacgaccggtgctcgatttagcacacgatagttgggtttgggggaggaactgctcagttaggacccagacggaaccatggaagccccagctcagcttctcttcctcctgctactctggctcccagataccagcggagagattgtgttgacacagtctccagccaccctgtctttgtctccggganaaagagccaccctctcctgcagggccagtcagagtgttaacaactacttggcctggttccaacagaaacctggccaggctcccaggctcctcatctatgatgcatccaacgagggccactcggcaactccccagcccaggttccaggtggcaggtgggtctggggacaggacttcactctcaccatccacgccgcctagacgccgtaggacggattcgtcgtccgtttatttacttgttcgttgggtcgtagtccgtaacgttcggtccctcccgttctacgttttcggccgtacggggacctaacggtcgtagggtacgtactacgaggtaacgtaacgtacggtcggtacgtcgacaccgtacttccgtcgttccttctaccg

SEQ ID NO: 277829 - DNA, 685 bp, Homo sapiens
  misc_feature: GYAE6OF02HS5K9.29.35.D02.1.454.CMB.1.raw
  modified_base (157)..(157): a, c, t, g, unknown or other
  misc_feature (157)..(157): n is a, c, g, or t
  modified_base (173)..(173): a, c, t, g, unknown or other
  misc_feature (173)..(173): n is a, c, g, or t
  modified_base (206)..(206): a, c, t, g, unknown or other
  misc_feature (206)..(206): n is a, c, g, or t
  modified_base (211)..(211): a, c, t, g, unknown or other
  misc_feature (211)..(211): n is a, c, g, or t
  modified_base (301)..(301): a, c, t, g, unknown or other
  misc_feature (301)..(301): n is a, c, g, or t
  modified_base (415)..(415): a, c, t, g, unknown or other
  misc_feature (415)..(415): n is a, c, g, or t
tcagatagagtactcacgaccggtgctcgatttagcacacgataggtttggggtttgggggaggaacgtgctcaggttaggacccagacggaaccatggaagccccagctcagcttctcttcctcctgctactctggcctcccagataccagcgganagattgtgttgacacngtctccagccaccctgtcctttgtctccggganaaagngcccaccctctccgtgcagggccagtcagagtgttaaacaactcttggcctggttccaacagaaacctggccaggcctcccaggctccanatcatgatgctactaccaacgtcgggccacgtggaccacttccccgagtccccgtaagggttccaaggtcggcctagggtcggggtctagggggaccagtctcctacttcaccnccaatccaaccgccgtacctaggacgtaccgtagggacgtagtttccgtcggttacccgtttttaattggtttcgtttcgggtttcggggtacgttacgtacgtaaccgttcgggccccttttacccggtaccgttaaccgtttttccggggaaccggaacggggttaaacccgtaggtaccgttaggggactagtaccgtaacggtaaccggaagttcggtacggacttccggaactcccggtattaccgtccgtttccgttatacccc

SEQ ID NO: 277830 - DNA, 634 bp, Homo sapiens
  misc_feature: GYAE6OF02GXMAC.29.35.D02.1.454.CMB.1.raw
tcagatagagtactcacgaccggtgctcgatttagcacacgatagttgggtttgggggaggaactgctcagttaggacccagacggaaccatggaagccccagctcagcttctcttcctcctgctactctggctcccagataccagcggagagattgtgttgacacagtctccagccaccctgtctttgtctccgggagaaagacgccaccctctcctgcagggccagtcagagtgttaacaactactggcctggttccaaacagaaaacctggaccaggcctcccgaggcctcctcatctatgatgcatccaacgagggccactggcactcccgacgcctacggttcaggtcggagtaggtgggtcgtgggacaggtaccttcactctacacctatcgacgcccgcctaagacgctaggagtcttcgtgtccgtttaattacgtttgttcgttgggtcgtagtacctaacgttcggtcccctcccgttaccgttaccgtttttcggggacccggtaacggggtaacccgaacggtaccgtacgggtagacgttaccggaacggaaccgtaaacggttggttaccgggtacgtcgaccctaaccgtacgttcctacgtttccgttataaccccg

SEQ ID NO: 277831 - DNA, 652 bp, Homo sapiens
  misc_feature: GYAE6OF02H5AKR.29.35.D02.1.454.CMB.1.raw
  modified_base (203)..(203): a, c, t, g, unknown or other
  misc_feature (203)..(203): n is a, c, g, or t
tcagatagagtactcacgaccggtgctcgatttagcacacgatagttgggtttggggaggaactgctcagttaggacccagacggaaccatggaagccccagctcagcttctcttcctcctgctactctggctcccagataccagcggagagattgtgttgacacagtctccagccaccctgtctttgtctccgggagaaagngccaccctctcctgcagggccagtcagagtgttaaacaacttacttggcctggttccaacagaaacctggacctaggcctcccgaggcctcctcattctatgatgcatccaacaggccacgtggcactcccagcccgtaggttcagttggctaggttggggtctggggacagtaccttcaccttcgtccaccactccgacgccgacctagacgtaccgtggacggtacgtttcgtacgttaccgttttaagtttaacgtttcgtttcgtttagggtccggttacgtaccgtaacgttaccggtcccgttaccccgttacgttaccgttttacgggaccgtaacggggtaaccgtaaacggtacgtacggtacgtacgtacgtaggtaacgtaacggttcggtacgggtaccgtcgtaccaccgtaacgttccttcgttcttcctaaccg

SEQ ID NO: 277832 - DNA, 520 bp, Homo sapiens
  misc_feature: GYAE6OF02HM4ID.29.35.D02.1.454.CMB.1.raw
  modified_base (308)..(308): a, c, t, g, unknown or other
  misc_feature (308)..(308): n is a, c, g, or t
tcagatagagtactcacgaccggtgctcgatttagcacacgatagttgggtttgggggaggaactgctcagttaggacccagacggaaccatggaagccccagctcagcttctcttcctcctgctactctggctcccagataccagcggagagattgtgttgacacagtctccagccaccctgtctttgtctccgggagaaagagccaccctctcctgcagggccagtcagagtgttaacaactacttggcctggttccaacagaaacctggccaggctccaggctcctcatctatgatgcatccaangggccacgtggcatcccagccagttcagtggcagtgggtctgggacagacttcactctcaccatcagccgcctagacgcctgaggtattctcgtccgtttattattgtcttgggcgtagcacgtcgcctccgtctacgtttggccgtagggaccaagcgtaggacgagtcgaggaacgtaacgtgtcggcgtgacacatctcgttctctacg

SEQ ID NO: 277833 - DNA, 705 bp, Homo sapiens
  misc_feature: GYAE6OF02HZ5CN.29.35.D02.1.454.CMB.1.raw
  modified_base (196)..(196): a, c, t, g, unknown or other
  misc_feature (196)..(196): n is a, c, g, or t
  modified_base (210)..(210): a, c, t, g, unknown or other
  misc_feature (210)..(210): n is a, c, g, or t
  modified_base (254)..(254): a, c, t, g, unknown or other
  misc_feature (254)..(254): n is a, c, g, or t
tcagatagagtactcacgaccggtgctcgatttagcacacgatagttgggtttggggaggaactgctcagttaggacccagacggaaccatggaagccccagctcagcttctcttcctcctgctactctgtctcccagataccagcggagagattgtgttgacacagtctccagccaccctgtctttgctcggganaaagcgccacctcncctgcagggccagtcagagtgtaaacactcttggctggtcaacngaaacctgccaggctccaggctctcatctatgactgcactaccaacgacgggccaactcgggactaactccccgaagccctaagggttcctaacggttacggcgaaggttcgggggtactcggggaactaaggaacctttcgaaacttccgttacccaacccagttcccgaacgcccgacccgttaaggaccggtccctacggtagggtaactttccgttcgttaaccggtttttactttaaaggtttccgttacgtttgggggaccgttacgggtacttaaacggtcgggttaccccgttaccccgttccgttaaccgtttttccgggacccgttaacgggggaaccccgtaaaggttaccgtacgggtagaccgtacggtaacggaacgtaaaccgtggtacggtcgtacggtcgacctacgttaccgtcgttacccttagttaacccg

SEQ ID NO: 277834 - DNA, 538 bp, Homo sapiens
  misc_feature: GYAE6OF02GS255.29.35.D02.1.454.CMB.1.raw
  modified_base (374)..(374): a, c, t, g, unknown or other
  misc_feature (374)..(374): n is a, c, g, or t
tcagatagagtactcacgaccggtgctcgatttagcacacgatagttgggtttgggggaggaactgctcagttaggacccagacggaaccatggaagccccagctcagcttctcttcctcctgctactctggctcccagataccagcggagagattgtgttgacacagtctccagccaccctgtctttgtctccgggagaaagagccaccctctcctgcagggccagtcagagtgttaacaactacttggcctggttccaacagaaacctggccaggctcccaggctcctcatctatgatgcatccaacagggccacgtggcatcccagccaggttcagtgcaggtgggtctgggacagacttcactctcaccntcacgccgcctagacgccgtgacgtattcgtgtccgttttattattgtcttgggtcgtagctaacgtcgcctccgttcgtactttcggccgtaacggggaccaagcgtaggacgtatcgacggtacgactggtggtctgacctacagtctcgttacttctaccg

SEQ ID NO: 277835 - DNA, 692 bp, Homo sapiens
  misc_feature: GYAE6OF02FLG9X.29.35.D02.1.454.CMB.1.raw
  modified_base (191)..(191): a, c, t, g, unknown or other
  misc_feature (191)..(191): n is a, c, g, or t
  modified_base (197)..(197): a, c, t, g, unknown or other
  misc_feature (197)..(197): n is a, c, g, or t
  modified_base (444)..(444): a, c, t, g, unknown or other
  misc_feature (444)..(444): n is a, c, g, or t
tcagatagagtactcacgaccggtgctcgatttagcacacgatagttgggtttgggaggaactgctcagttaggacccagacggaaccatggaagccccagctcagcttctctctcctgctactctggctcccagataccagcggagagattgtgttgacacagtctccagccacctgtcttgctcggganaaacgngccacctctccgtgcgacgggtccagtacgagtaggtacttaaccacttacgttcgggtacctggttaccaacgacgtaaccgtggccacggcctaccaggtcctcctacatcctatggacttcggctaacgtaccgaacgacggggtacctacgtcggtcaacgtccccgagtccgtggttacggagtcgggacctagggtacgggttcctagggacccttaagtcctcacccgtcaccaccctancgtaccgcccgtcgtacggtacgtccgtagtacgttactttcgtacggttcgttaactttagtttacgttcgttacggacgttacgccgttaaccggtcgttcccgttacccgtacgtaccgtttcggaccgggtaacgggtaacctacggacgttacgggtcgaccgttaggacggtaacggtaccgttacggtcggttaaccgccggtacaccgtacgttccgtacggttaccttccgttaacccg

SEQ ID NO: 277836 - DNA, 613 bp, Homo sapiens
  misc_feature: GYAE6OF02F85GX.29.35.D02.1.454.CMB.1.raw
tcagatagagtactcacgaccggtgctcgatttagcacacgatagttgggtttgggggaggaactgctcagttaggacccagacggaaccatggaagccccagctcagcttctcttcctcctgctactctggctcccagataccagcggagagattgtgttgacacagtctccagccaccctgtctttgtctccgggagaaagagccaccctctcctgcagggccagtcagagtgttaaacaactacttggccttggttccaacagaaacctggccaggcctcccaggcctcctcatctatgatgcatccaacgagggaccacgtcggcactcccacgccaggttcaggtcggcaggtggtcgtgggacagtactcactctacaccagtcacgccgcctacgacgccgtgaggtacttcgtcgtcgtttaactttagtttagttcgtttgggtcgttagtctaacgttcggtcccttcccgtcgttacgttttcgggaccgtaacggggaccgtaacggacgtagggacgtacgtacgtacggtaaccgtaacgttcgggtacggtcgtacggaccgtacccgtagttacctacggttcccttacgttacccg

SEQ ID NO: 277837 - DNA, 738 bp, Homo sapiens
  misc_feature: GYAE6OF02HX1GE.29.35.D02.1.454.CMB.1.raw
  modified_base (194)..(194): a, c, t, g, unknown or other
  misc_feature (194)..(194): n is a, c, g, or t
  modified_base (199)..(199): a, c, t, g, unknown or other
  misc_feature (199)..(199): n is a, c, g, or t
  modified_base (206)..(206): a, c, t, g, unknown or other
  misc_feature (206)..(206): n is a, c, g, or t
  modified_base (256)..(256): a, c, t, g, unknown or other
  misc_feature (256)..(256): n is a, c, g, or t
tcagatagagtactcacgaccggtgctcgatttagcacacgatagttgggtttgggggaactgctcagttaggacccagacggaaccatggaagccccagctcagcttctcttcctcctgctactctggctcccagataccagcggagagattgtgttgacacagtctccagccacctgtctttgctccggganaaagnccacctntcctgcagggccagtcagagtgtaaacaactacttggcctggttccaaanagaaacctggaccaggcctccgaggcctcctcatcatagactgcactacccgaaagacgggcccacgtcggcctaacgtcccccaaggtacccctagggtttaccaaggttcggacctaggttcggtcggttacgtagggggaacacggtaacctttcaaccttcctacaaccctataccgaccgccgacccttaggaccgtccgtaggacggtactttacgtacggttaccggtttttaattaacgtttcggtttcggtttaggggtccggttaacggtaccgtaaaccgttcgggttacccccgtttacccggttaccgttaccggtttttaccgggacccgggttaaaccgggggtaacccgtaaacggtccggttaagggtacgttacgtaccgtaacggaaaccggttaacgttcgggtaacgggtccttaggacccgtaaccgtacgttacctttcggttaccgttcgttaacccg

SEQ ID NO: 277838 - DNA, 742 bp, Homo sapiens
  misc_feature: GYAE6OF02HAY6I.29.35.D02.1.454.CMB.1.raw
  modified_base (200)..(200): a, c, t, g, unknown or other
  misc_feature (200)..(200): n is a, c, g, or t
  modified_base (206)..(206): a, c, t, g, unknown or other
  misc_feature (206)..(206): n is a, c, g, or t
tcagatagagtactcacgaccggtgctcgatttagcacacgatagttgggtttgggggaggaactgctcagttaggacccagacggaaccatggaagccccagctcagcttctcttcctcctgctactctggctcccagataccagcggtagagattgtgttgacacagtctccagccaccctgtctttgtctccggganaaaggngccaccctctcctgcgagggccagtcagagtgttaaccaacttacttggccttggttccaaacgacgaaacctggaccaggcctccccgaggcctccgtcacttcgtactgatcggacactacccgaaacgacgggcctacgtggacctacttccccagcctaggttcaggtcggcgtaggttcgggtcgtggggaactaggtacctttcgaaccgttcctaccgaacccgtacttaccgaccgacccgtacccgttacggaccgtcccgtaggtaacggtaactttccgtacgttacccgttttaatttaagtttcggtttccggtttacggggtaccgttaaggtaccctaaccgtttccgggtaccccgttcccggttaccgttaaccggtttttcgggacccggtaacggggtaaccctaaacggtaccgtagggaacggtacgtaccggaacggtaaccggtaacggtcggttaccggtacgtccggaccgtaccgttaccgtccgttacggttcccgttacgttaccccg

SEQ ID NO: 277839 - DNA, 560 bp, Homo sapiens
  misc_feature: GYAE6OF02JDRGT.29.35.D02.1.454.CMB.1.raw
  modified_base (196)..(196): a, c, t, g, unknown or other
  misc_feature (196)..(196): n is a, c, g, or t
  modified_base (201)..(201): a, c, t, g, unknown or other
  misc_feature (201)..(201): n is a, c, g, or t
  modified_base (368)..(368): a, c, t, g, unknown or other
  misc_feature (368)..(368): n is a, c, g, or t
  modified_base (412)..(412): a, c, t, g, unknown or other
  misc_feature (412)..(412): n is a, c, g, or t
tcagatagagtactcacgaccggtgctcgatttagcacacgatagttgggtttgggggaggaactgctcagttaggacccagacggaaccatggaagccccagctcagcttctcttcctcctgctactctggctcccagataccagcggagagattgtgttgacacagtctcagccacctgtctttgctccggganaaagngccacctctcctgcaggccagtcagagtgttaacacttacttggcctggttaccaacgagaaacctggccaggctccaggctcctcatctatgatgcatccaacgcgggccaactggcactccagccaggttcagtgcagtgggtctgggacagctcactctcaccntcgacgccgactagacgcctgacgtattcgtgtccgtttagttnttcgttcgtggtcgtgactacgtcggccgttccgtcgtacgtttcgccgtagggaccgtagcgtacggactacgtcgaacggtacgtaacgttggtcggtaccgtaggccgtaacccgtagttaccgtcgttaccgtttacgtacccg

SEQ ID NO: 277840 - DNA, 638 bp, Homo sapiens
  misc_feature: GYAE6OF02HN589.29.35.D02.1.454.CMB.1.raw
  modified_base (264)..(264): a, c, t, g, unknown or other
  misc_feature (264)..(264): n is a, c, g, or t
tcagatagagtactcacgaccggtgctcgatttagcacacgatagttgggtttgggggaggaactgctcagttaggacccagacggaaccatggaagccccagctcagcttctcttcctcctgctactctggctcccagataccagcggagagattgtgttgacacagtctccagccaccctgtctttgtctccgggagaaagagccaccctctcctgcagggccagtcagagtgttaaacaactacttggcctggttaccaanagaaacctggccaggcctcccaggctcctcatctatgatgcatccaacgagggccacgtggcactcccagcctaggttcaggtggcagtgggtctgggacagtacttcactctacaccatcgacgccgccgtagacgccgtagacggtattcgtcggtccgttttattacgtttcggttcgttcggggtcgttaacgacgttaaccgttcggtacccttcccggttcgtaccgtttttcgggacccgtaacgggggtaaccctaaggtccgttagggaacgtacgtaccgaaggtaaccggtaaccgttgggtacggccgttaggaccctaacccgtaacgtttaccgttcggtttaccttacccgttaacccg

SEQ ID NO: 277841 - DNA, 696 bp, Homo sapiens
  misc_feature: GYAE6OF02HSKL1.29.35.D02.1.454.CMB.1.raw
  modified_base (314)..(314): a, c, t, g, unknown or other
  misc_feature (314)..(314): n is a, c, g, or t
tcagatagagtactcacgaccggtgctcgatttagcacacgatagttgggtttggggaggaactgctcagttaggacccagacggaaccatggaagccccagctcagcttctcttcctcctgctactctggctcccagataccagcggagagattgtgttgacacagtctccagcccaccctgttctttgtctcgggagaaagcgcccaccctctcctgccgagggcctagtcagtagtacgttaaacaacttacgttcggccttggttaccaacacgaaacctggccaggcctccccaggcctcctcatctangatcgcctagtaccaaacggcgggtaccagttcggcctacgtccccgaggaccctagggtttcagggtcggcagggttgggtaccgtaggggactaaggtaccttcaccttcctacaaccctagttcccaaccggcccgtaccgtacggaaccgtccgtaggacgttaactttcgtacggttccttttaagttagtttggtttccgttacggggttaccgttacgtactaaccggttccggtacccgttccccggttacgttccgttttacgggccggtaacggggtaacccgtaggttccgtacggtagtacgtacgaacggtacggtaacgttggtcggtacgtcgacgacctagttccgttacgtttccttattacccg

SEQ ID NO: 277842 - DNA, 549 bp, Homo sapiens
  misc_feature: GYAE6OF02HWFQX.29.35.D02.1.454.CMB.1.raw
  modified_base (205)..(205): a, c, t, g, unknown or other
  misc_feature (205)..(205): n is a, c, g, or t
  modified_base (264)..(264): a, c, t, g, unknown or other
  misc_feature (264)..(264): n is a, c, g, or t
  modified_base (338)..(338): a, c, t, g, unknown or other
  misc_feature (338)..(338): n is a, c, g, or t
tcagatagagtactcacgaccggtgctcgatttagcacacgatagttgggtttgggggaggaactgctcagttaggacccagacggaaccatggaagccccagctcagcttctcttcctcctgctactctggctcccagataccagcggagagattgtgttgacacagtctccagccaccctgtctttgtctccgggagaaaagngccaccctctcctgcagggccagtcagagtgttaacaactacttggcctggttccaacngaaacctggccaggctcccaggctcctcatctatgatgcatccaacagggccactggcatcccagccaggttcngtggcagtgggtctgggacagacttcactctcaccatcagccgcctagacgcctggaggattctgtccgttttattatttgttcgttgggtcgtagctaacgttcggcccgttcccgtctacgttttcggccgtaggggacccgaagccgtggtagagtcaggacgaaacgtggtacggtctcgccacctagttctcgttccttctaaccg

SEQ ID NO: 277843 - DNA, 757 bp, Homo sapiens
  misc_feature: GYAE6OF02H8ZNA.29.35.D02.1.454.CMB.1.raw
  modified_base (204)..(204): a, c, t, g, unknown or other
  misc_feature (204)..(204): n is a, c, g, or t
tcagatagagtactcacgaccggtgctcgatttagcacacgataggttgggtttgggggaggaactgctcagttaggacccagacggaaccatggaagccccagctcagcttctcttcctcctgctactctggctccagataccagcggagagattgtgttgacacagtctccagcccacctgtctttgtcgtcgggagaaagngcccaccctctcctgcgagggccagtcagagtgttaaacacttcttggcctggttaccaacagaaacctggaccgaggcctacccgaggcctcctcatctaatgacttgctacgtaccaaccgagggcccacggttcgacctaccgtcccgacgaccgtacgggttccgaggttcggccgtagggtcggggttcgtaggggtaaccgacgtaccgttcacgttcctaccaccgtactccgaacgcccgaccgtaaggaccgtaccgtacggtacggtacgtttcgtagttacccggtttttaatttaacgttcggtttacggttcgggtaccggtttacggtaccgtaaacgtttccgggtacccgtttacccccggtttaccgtttaccggtttttcccggggtaacccgggtaaccgggggtaacccgtaacggtccggttaggggaccgtacggtaaccgtaaccgggaacgtaaccggttgggtcgggtaccgttcggtaacccgtacccgttacgttccgtttacggtttaccctttacgttaccccg

SEQ ID NO: 277844 - DNA, 860 bp, Homo sapiens
  misc_feature: GYAE6OF02J27OP.29.35.D02.1.454.CMB.1.raw
tcagatagagtactcacgaccggtgctcgatttagcacacgatagttgggtttggggaggaactgctcagttaggacccagacggaaccatggaagccccagctcagcttctcttcctcctgctactctggcctcccagataccagcggagtagtattcgtgttagaccacgtagtcctccagccctacccttgttccgtttgccgtccgggaagaacgtccgccctaccctctccgtgaccgacgggcctagtcagtacgttacgtaaccacgttccgtcgggcccttaggttaacccaagaaccgtaaccgttcggaccgtacggtccctccgacggtcctacccgtactacttactataccggtactcgacctacctaccgaacggtacggtccctacggtccgaccgtacccgtaccccgtacggtaccgtacggttacgtacggtccggtacggttacgggtccggtacgtaccgggtacgtaaccgttacccgtaccgtacccttacccgacctaccgtaccgtaccgacccggtacccgtaaccgtacggtacccgttaccgtaacggttacggttaccgtttaccgttaccggtttaccggttttacgtttacggtttaccggttaccggtttaacgggacccgttacgttaacccggttacccgggttcccgttaccccggttacccggtttaccgttttaccgggttacccgggtaaccggtaaccgggggttaacctaaccgggtcgttacgaacgttaccaaccggttggtaaacccggtcggttaccggtacgtaccgtacccgtaccggtaccgttcgttacctcggtttacctacccggttaccc

SEQ ID NO: 277845 - DNA, 588 bp, Homo sapiens
  misc_feature: GYAE6OF02HOUYM.29.35.D02.1.454.CMB.1.raw
  modified_base (203)..(203): a, c, t, g, unknown or other
  misc_feature (203)..(203): n is a, c, g, or t
tcagatagagtactcacgaccggtgctcgatttagcacacgatagttgggtttgggggaggaactgctcagttaggacccagacggaaccatggaagccccagctcagcttctcttcctcctgctactctggctcccagataccagcggagagattgtgttgacacagtctccagccaccctgtctttgtctcgggagaaagngcccaccctctcctgcagggccagtcagagtgttaaacaactacttggcctggttccaacagaaacctggaccaggcctccaggcctcctcatctatgatgcactaccaacgacgggccacgtggaccactcccgacgccgtaggttcaggtcggcgtagggttggggtctggggaactacggacctttcacttcctacgaccctatccacgcccgtaccgtacgacgtccgtaggacggtatttcgtcgttaccgttttatttgttgttcgttgggtcgtagctacgtcggtcccttccgtctcgtttcggccgtacgggaccagcgtaggagtatcgagacgtacgtcggtcgctgaccactagttccgtcgttcttcgtccg

SEQ ID NO: 277846 - DNA, 679 bp, Homo sapiens
  misc_feature: GYAE6OF02G6E75.29.35.D02.1.454.CMB.1.raw
  modified_base (197)..(197): a, c, t, g, unknown or other
  misc_feature (197)..(197): n is a, c, g, or t
tcagatagagtactcacgaccggtgctcgatttagcacacgatagttgggtttgggggaggaactgctcagttaggacccagacggaaccatggaagccccagctcagcttctcttcctcctgctactctggctcccagataccagcggagagattgtgttgacacagtctccagccacctgtctttgctccggganaaagacgcccaccctctcctgcagggccagtcagagtagttaacaactacttggcctggttaccaacagaaacctggccaggcctcccaggcctcctcatctatgatgcatccaacgacgggccacgtggaccactcccagcctaggttcaggtggcgaggttcgggtcgtaggggacacggtacttccaacgttcctacaccatccgacgcccgtacctaggacgccgtggaacggtactttccgttacgttccgttttaatttacgttcggtttccgttggggtaccgttacgtaccgtaaccgttccggtccccgttaccccggttactttaccgttttccggggacccggttaacgggggtaaccctaaacggtccggttacgggaacgtacgttacgaacggtaaccggtaaccggttgggtaccggtacgttccggacctaaccgtacgtccgtttacgttccttacgttaccccg

SEQ ID NO: 277847 - DNA, 599 bp, Homo sapiens
  misc_feature: GYAE6OF02GTNZ3.29.35.D02.1.454.CMB.1.raw
  modified_base (203)..(203): a, c, t, g, unknown or other
  misc_feature (203)..(203): n is a, c, g, or t
tcagatagagtactcacgaccggtgctcgatttagcacacgatagttgggtttgggggaggaactgctcagttaggacccagacggaaccatggaagccccagctcagcttctcttcctcctgctactctggctcccagataccagcggagagattgtgttgacacagtctccagccaccctgtctttgctccgggagaaagngccaccctctcctgcagggccagtcagagtgttaacaactacttggcctggttccaacagaaacctggccaggctccaggctcctcatctatgatgcatccaacagggccactggcatcccagcctaggttcagtcggcagtggtcgtgggacagtacttacactctcacactcacgccgctacgacgccgtagaggtattctcgtaccgttttatttagttcgttcgtttcgggtcgtacgactaaccgttcggtcccgtcccgttacgtacgttttcggaccgtacggggtaccctaaacggtccgtagggacgtacgtaccgtacggaaccgtaaccgtggtacggtaccgttacgacgtaccctaagttccgttacgttccgttctaacccg

SEQ ID NO: 277848 - DNA, 734 bp, Homo sapiens
  misc_feature: GYAE6OF02IAN00.29.35.D02.1.454.CMB.1.raw
tcagatagagtactcacgaccggtgctcgatttagcacacgatagttgggtttgggggaggaactgctcagttaggacccagacggaaccatggaagccccagctcagcttctcttcctcctgctactctggcctcccagataccagcggagagattgtgttgacacagtctccagcccacctgtctttgtctccgggagaaagacgcccaccctctcctgcagggccagtcagagttagttaaaccaaccttacgttcggccttaggttacccaaacacgaaacctggcccaggcctcccgagcctctcactctatgatgactactaccaacgacgggccacgtcggacctactcccacgccctagggttaccaggtcggacgtacgggtcgggtcgtagggactagtaacttcactcgtacacccgatccgacgcccgaccgtacggacgtaccgtacgagttacgttccgttacggttaccgtttttacgtttacgtttcggtttacggtttacgggggtaccgttaacggaccgtaaaccggttcccgggttcccccgtttaccccggtttacccgtttaccgggtttttacccgggacccggtaaccgggggtaaacccgtaacgggtaccggttaagggtaaccggtacgtaccggaacggtaaaccggtaaccgttggtccggttactccggacctacctaacgtttctacgtttcctcttaacccg

SEQ ID NO: 277849 - DNA, 561 bp, Homo sapiens
  misc_feature: GYAE6OF02HAO0C.29.35.D02.1.454.CMB.1.raw
  modified_base (198)..(198): a, c, t, g, unknown or other
  misc_feature (198)..(198): n is a, c, g, or t
  modified_base (307)..(307): a, c, t, g, unknown or other
  misc_feature (307)..(307): n is a, c, g, or t
  modified_base (344)..(344): a, c, t, g, unknown or other
  misc_feature (344)..(344): n is a, c, g, or t
tcagatagagtactcacgaccggtgctcgatttagcacacgatagttgggtttggggaggaactgctcagttaggacccagacggaaccatggaagccccagctcagcttctcttcctcctgctactctggctcccagataccagcggagagattgtgttgacacagtctccagccaccctgtctttgtctccggganaaagagccaccctctcctgcagggccagtcagagtgttaacactacttggcctggttccaacagaaacctggccaggctccaggctcctcatctatgatgcatccaacnggccatggcatccagccaggttcagtgcagtgggtcngggacagacttcgactctcaccatcgagccgctacgagcctgagattctcgtcgtttacgttattagtcgttggcgttagactaactggccctccgttcgtaccttttcggaccgtacgggtaacccaagtccgtaggacgtacgtacacggtaaccggtaacgtaggtcggtaccgtgtaccgaacctaacgttccgtcggttaccttacgtaccg

SEQ ID NO: 277850 - DNA, 949 bp, Homo sapiens
  misc_feature: GYAE6OF02GBFTI.29.35.D02.1.454.CMB.1.raw
  modified_base (229)..(229): a, c, t, g, unknown or other
  misc_feature (229)..(229): n is a, c, g, or t
tcagatagagtactcacgaccggtgctcgatttagcacacgatagttgggtttggggggaaggaacgtagctcgacggttaccggaccgagtacggaaccgagtggaaggccccagcgtcgacgcgttctcttcctccgtgacgtactctcggcctaccagataccaggcggaggagtagttgtaggttcgacacgtagtctccagccacctgtctttgtcgtcggganaagcgccacctctctgcgacgggccagtcagagtagttaaacaacgttacgttggcccttagggttacccaaacgaacggtaaaacccttgggacccaacgggccttcccccggaaggccttccccgttcgtaacttaccttaagttacggaattcggacctaacgttaccccgaaaaccgacgggggacccctaacgttcggggacctaaacccgttccccgaaacggtccccgtaacggggtttacaacggggttcggaccgtacggggtttcggggtaccgttacgggggaaaccctaggtaacccgtttccgtaaacccttccgttaacccgaacccgtaacttaccgaaccgggaccccgtaacccgtttaaacggaaccggttccccgtaaggggtaaccggttaacgttttcccggttaacgggtttaacccgttttttaaagtttcggttttacggttacccgggttttagggggaccgtttaaaccgggtaccgttaacggttccccggttacccgtttaccccgggttaccttttaaaccgggttttcccgggaccggtaaaccgggggtaaccctaaacgggtccgttaagggaaccgtacgtaaccgaaaccgggtaacgtaacgggttacggacccgggttacttacccgggaacccttacccgttaacgtttcccggtttcggtttacccttacccgttaaccccg

SEQ ID NO: 277851 - DNA, 256 bp, Homo sapiens; identical to SEQ ID NO: 277388
  misc_feature: GYAE6OF02HG7RH.29.35.D02.1.454.CMB.1.raw
  modified_base (254)..(256): a, c, t, g, unknown or other
  misc_feature (254)..(256): n is a, c, g, or t

SEQ ID NO: 277852 - DNA, 552 bp, Homo sapiens
  misc_feature: GYAE6OF02GVSH1.29.35.D02.1.454.CMB.1.raw
tcagatagagtactcacgaccggtgctcgatttagcacacgatagttgggtttggggaggaactgctcagttaggacccagacggaaccatggaagccccagctcagcttctcttcctcctgctactctggctcccagataccagcggagagattgtgttgacacagtctccagccaccctgtctttgtctccgggagaaagagccaccctctcctgcagggccagtcagagtgttaacaactacttggcctggttccaacagaaacctggccaggctcccaggctcctcatctatgatgcatccaacagggccactggcactcccagccaggttcagtggcaggtgggtctgggacagtacttcactctacaccatcacgccgccgtagacgccgtagaggtagttctgtccgtttatttagtttgtcgtttgggcgttagactaacgtcggtcccttcccgttctacgttttcggaccgtacggggaccaacggcgtaggagtactcgaggacgtaacgtggtggtctgacacctatcgtcgtcttctac

SEQ ID NO: 277853 - DNA, 595 bp, Homo sapiens
  misc_feature: GYAE6OF02I7P8F.29.35.D02.1.454.CMB.1.raw
  modified_base (203)..(203): a, c, t, g, unknown or other
  misc_feature (203)..(203): n is a, c, g, or t
tcagatagagtactcacgaccggtgctcgatttagcacacgatagttgggtttgggggaggaactgctcagttaggacccagacggaaccatggaagccccagctcagcttctcttcctcctgctactctggctcccagataccagcggagagattgtgttgacacagtctccagccaccctgtctttgtctccgggagaagngccaccctctcctgcaggccagtcagagtgtaacaactactggcctggtccaacagaacctgccaggctcccaggctcctcactctatgatgcatccaacgacgggccacgtggccactcccgacgccgaggttcaggtcggcgtaggtcgggtctgggacaggtacttcactctaccaccatccagcccgcctagacgctggagtacttctcgttaccgtttattagttcgttcgttcgggtacgttacgacgtaacgtcgtccgttccccgtcgttaccgtttcgggcccgtaacgggacctaacggtcgtacggtagtactacgaacggacgtaacgtcggtggtaccgtcgaccgtaccgtacgttacgttcgttaccttccttaccg

SEQ ID NO: 277854 - DNA, 560 bp, Homo sapiens
  misc_feature: GYAE6OF02FPE50.29.35.D02.1.454.CMB.1.raw
tcagatagagtactcacgaccggtgctcgatttagcacacgatagttgggtttgggggaggaactgctcagttaggacccagacggaaccatggaagccccagctcagcttctcttcctcctgctactctggctcccagataccagcggagagattgtgttgacacagtctccagccaccctgtctttgtctccgggagaaagagccaccctctcctgcagggccagtcagagtgttaacaactacttggcctggttccaacagaaacctggccaggctcccaggctcctcatctatgatgcatccaacagggccactggcatcccagccaggttcagtggcaggtgggtctgggacagtactcactctcaccatcacgccgctagacgctgaggtacttcgtgtccgtttattatttgtcgttgggcgtagctaacgttcggtccctcccggttctaccgttttcgggccgtacggggtacccaaggtcgtagggacgactacgaggtaaccgaacgtggtcggtcgtacggctaccgtattccgtgttccttctaccg

SEQ ID NO: 277855 - DNA, 628 bp, Homo sapiens
  misc_feature: GYAE6OF02FGWVM.29.35.D02.1.454.CMB.1.raw
  modified_base (303)..(303): a, c, t, g, unknown or other
  misc_feature (303)..(303): n is a, c, g, or t
tcagatagagtactcacgaccggtgctcgatttagcacacgatagttgggtttggggaggaactgctcagttaggacccagacggaaccatggaagccccagctcagcttctcttcctcctgctactctggctcccagataccagcggagagattgtgttgacacagtctccagccaccctgtctttgtctccgggagaaagcgccaccctctcctgcagggccagtcagagtgttaacacttacttgggccctggttccaaacacgaaacctggtcacggctcccaggcctcctcatcctancgatgcatccaacgcggccacgtcggccactccccgagcccgtaggttccaggtcggctacgggtgggtaccgtaggggaacctacggtaccttacaacctttccacccaccaactccgaccgcccgtaccgtagacgtccgtaggacggtacttcgtcgttccgtttattagttcgtcgttcggcgttacgctaacgtcgtaccctccgtactacgtttcggaccgacggggtaccacggcgtaggacgtacgtacgaggtaaccgaacggtcggtacggcctacggcctaaccgtacgttcctcggttaccttacttaccccg

SEQ ID NO: 277856 - DNA, 531 bp, Homo sapiens
  misc_feature: GYAE6OF02HSDSY.29.35.D02.1.454.CMB.1.raw
  modified_base (381)..(381): a, c, t, g, unknown or other
  misc_feature (381)..(381): n is a, c, g, or t
tcagatagagtactcacgaccggtgctcgatttagcacacgatagttgggtttgggggaggaactgctcagttaggacccagacggaaccatggaagccccagctcagcttctcttcctcctgctactctggctcccagataccagcggagagattgtgttgacacagtctccagccaccctgtctttgtctccgggagaaagagccaccctctcctgcagggccagtcagagtgttaacaactacttggcctggttccaacagaaacctggccaggctccaggctcctcatctatgatgcatccaacagggccactggcactcccagccaggttcagtggcaggtggtctgggacagacttcactctcaccatcacgccncctagacgcctggagattctgtccgtttattattgttcttggcgtagcaactcggaccttcccgtctaccgttttggcctaggggaccaagctggagatacgaggacgtaactggtaggccgtgccaccattccgtacgttcttctaccg

SEQ ID NO: 277857 - DNA, 762 bp, Homo sapiens
  misc_feature: GYAE6OF02G8YKH.29.35.D02.1.454.CMB.1.raw
  modified_base (198)..(198): a, c, t, g, unknown or other
  misc_feature (198)..(198): n is a, c, g, or t
tcagatagagtactcacgaccggtgctcgatttagcacacgatagttgggtttggggaggaactgctcagttaggacccagacggaaccatggaagccccagctcagcttctcttcctcctgctactctggctcccagataccagcggagagattgtgttgacacagtctccagccaccctgtctttgtctccggganaaagcgccaccctctcctgcagggccagtcagagtagttaaacaacttacttggccttggttacccaaacaacgaaacctggaccaaggcctcccaggcctccctacatcctaatcgaagtcgctaactacccaaacgacggggaccctaaccgtcgggacctaaccgtccccgaaggacccctaagggtttccaagggttacggacgtaaggggttcggggttacgtacggggtaacctaaggtacctttaccgaacctttcctaccgaaccctagttaccgaccgcccgtaccgtaacgaccggtaccgtaggaacggttactttcgttaggttacccgttttaactttagtttcggtttcgtttacgggtaccgttaacgtaccgtaacggttccggtacccgttacccggttacgttaccggtttttcggacccggtaacggggtaaccgtaacggtaccgttagggacgtacgtaccgtaacgggtaaccggtaacggttcgggtacggtaccgtacgtacctaccgtacgttccgttacgtttaccttacgttaaccg

SEQ ID NO: 277858 - DNA, 809 bp, Homo sapiens
  misc_feature: GYAE6OF02IVCRW.29.35.D02.1.454.CMB.1.raw
tcagatagagtactcacgaccggtgctcgatttagcacacgatagttgggtttgggggaggaactgctcagttaggacccagacggaaccatggaagccccagctcagcttctcttcctcctgctactctggcctccagataccagcggagagattgtgttgacacagtctccagcccacctgtctttgtctccgggagaaagcgccaccctctccgtgcgacgggccagtcagtagtagttaaaccaacttacgttcggccttggttacccaaagaacgtaaacccgtgggacccacgggtccctaccccgagggtcccttccctacacttcctaagttgacttcgacctaactacccgaaacggacgggacccctacggtcggacctaaccgtccccgaacggtacccgtaacgggtttccaagggttcgggacgtaaggggtttcggggttccgtacggggaactacggttaacctttccgaacctttcccgtaaccgaaccctagttacccgaccggtccccgtaccgttaacggaccggtaccgttaggtaacggttactttccgttaccggtttaccgttttaattttacggtttacggtttccgggtttacggggtaccgttacggtaccgtaaccggttccggtcccccgtttcccgttaccgtttaccggttttccgggaccggtacggggtaacccgtaaggtccgtacgggacgtacgtacgtaacggtaaccggtaacgttcggtcggtacgtacgaccgtaccgttacgttccgtttacgttccttacgttacccg

SEQ ID NO: 277859 - DNA, 525 bp, Homo sapiens
  misc_feature: GYAE6OF02JCNUO.29.35.D02.1.454.CMB.1.raw
  modified_base (198)..(198): a, c, t, g, unknown or other
  misc_feature (198)..(198): n is a, c, g, or t
  modified_base (203)..(203): a, c, t, g, unknown or other
  misc_feature (203)..(203): n is a, c, g, or t
  modified_base (252)..(252): a, c, t, g, unknown or other
  misc_feature (252)..(252): n is a, c, g, or t
  modified_base (268)..(268): a, c, t, g, unknown or other
  misc_feature (268)..(268): n is a, c, g, or t
  modified_base (271)..(271): a, c, t, g, unknown or other
  misc_feature (271)..(271): n is a, c, g, or t
tcagatagagtactcacgaccggtgctcgatttagcacacgatagttgggtttggggaggaactgctcagttaggacccagacggaaccagtggaagccccagctcagcttctcttcctcctgctactctggctcccagataccagcggagagattgtgttgacacagtctccagccacctgtctttgtctccggganaaagngccaccctctcctgcaggccagtcagagtgtaacactctggcctgtcanagaacctgcagctccngcnctcatcactgatgcatccaacgaggccacgtggacactcccagcctaggttcagtcgcagtggtctgggacagtacttcgactctcaccatcacgccgactagacgcctagacgtatcgtcgttcgtttattagttgtcgttggtacgtacgacgtacgtcggcctccgttcgtacgtttcggccgtagggaccacgtcgcggacgacgtacacggtaacacgtgcgtcgcgcgactactcgtcgtcttctacg

SEQ ID NO: 277860 - DNA, 851 bp, Homo sapiens
  misc_feature: GYAE6OF02F40UM.29.35.D02.1.454.CMB.1.raw
  modified_base (209)..(209): a, c, t, g, unknown or other
  misc_feature (209)..(209): n is a, c, g, or t
tcagatagagtactcacgaccggtgctcgatttagcacacgatagttgggtttgggggaggaactgtctctagttaggacccagacggaacctatggaagccccagctcgagcttctcttacctcctgctacgtctggctcccagataccgagcggagagattgtgttgacacagtctccagccacctgtctttgctccgggagaaagngccacctctcctgcagggccagtcgagacgtacgttaaacaactacgttggcctggttaccaactagtaaacctggccgaaggcctcccgaggactcccgtcgactcctatggaactcggcctactaccgaacgacgggtacctacgtcggtacacgtccccgacggtcccgtaaggttccgacgggttcggacgtagggttcgggttaccggttacgggggaactaacgggtaccgtttaccgtaaccgtttacccttaccgtaaacccgtacgtttaaccggaaccgtaaccccggtaacccgttaaacgggaccggtacccgtttaacggggaacggttaacgttttaccggttacggtttacccgggttttttaagttttaaacgttttacgggtttccggtttacgggggtaccgtttaaacggtaccgtaaaccggttccgggttacccccgtttacccggttacccgtttaccggtttttaccggggaccccggttaaacgggggtacccgaaaacgggtcggttacggggtaacgtacgttaccgaacgggtaaccggttaacggtacgggttccggtacgttaccggaccgttaccgtacgttaccgttcggtttacctttaccgttaccccg

SEQ ID NO: 277861 - DNA, 544 bp, Homo sapiens
  misc_feature: GYAE6OF02FNDLA.29.35.D02.1.454.CMB.1.raw
tcagatagagtactcacgaccggtgctcgatttagcacacgatagttgggtttgggggaggaactgctcagttaggacccagacggaaccatggaagccccagctcagcttctcttcctcctgctactctggctcccagataccagcggagagattgtgttgacacagtctccagccaccctgtctttgtctccgggagaaagagccaccctctcctgcagggccagtcagagtgttaacaactacttggcctggttccaacagaaacctggccaggctcccaggctcctcatctatgatgcatccaacagggccactggcatcccagccaggttcagtggcagtgggtctgggacagacttcactctcaccatcagccgctagagcctgagtattctgtccgttattattgtcgttgggtcgtagctaacgtcggtcctccgttctacgttttcggccgtacggggaccaacggcgtaggagtagtacgaggtaacgtaacgttggtcggtcgtacgcaccgtactcgtcgttccttctaccg

SEQ ID NO: 277862 - DNA, 695 bp, Homo sapiens
  misc_feature: GYAE6OF02HEQG9.29.35.D02.1.454.CMB.1.raw
  modified_base (199)..(199): a, c, t, g, unknown or other
  misc_feature (199)..(199): n is a, c, g, or t
  modified_base (207)..(207): a, c, t, g, unknown or other
  misc_feature (207)..(207): n is a, c, g, or t
  modified_base (228)..(228): a, c, t, g, unknown or other
  misc_feature (228)..(228): n is a, c, g, or t
  modified_base (254)..(254): a, c, t, g, unknown or other
  misc_feature (254)..(254): n is a, c, g, or t
tcagatagagtactcacgaccggtgctcgatttagcacacgatagttgggtttgggggaggaactgctcagttaggacccagacggaaccatggaagccccagctcagcttctcttcctcctgctactctggctccagataccagcggagagattgtgttgacacagtctccagccacctgtctttgctcggagaaagngccacctntcctgcaggccagtcagagtnttaacaactcttggacctggtacaanagaacctgaccaggctccgaggctcctacatactatcgatcgacactaccaacgacgggccacgtggccaatccccgaacggcccgtaaggtttccaaggttcggacgtacggttggggtctagggggtaactacggtaacctttccgaaccttctaccaacctactcgaccgaccgtaccgtaagacgtccgtagaaggttacttcgtagtacccggtttttaatttcgttttacggtcgtttacggggtaccgttaacggtaccgtaaccggttcggtccccgtttaaccccggttcgtttaaaccggttttccgggacccggtaaggggtaacccgtaaaggtccgttagggtaactacgttacggaacggtaacggttaacgtcgggttaacgcgttacgacgaacccttagtccgtttcgttaccttcgttacccg

SEQ ID NO: 277863 - DNA, 618 bp, Homo sapiens
  misc_feature: GYAE6OF02JAGXW.29.35.D02.1.454.CMB.1.raw
tcagatagagtactcacgaccggtgctcgatttagcacacgatagttgggtttgggggaggaactgctcagttaggacccagacggaaccatggaagccccagctcagcttctcttcctcctgctactctggctcccagataccagcggagagattgtgttgacacagtctccagccaccctgtctttgtctccgggagaaagagcccaccctctcctgcagggccagtcagagtgttaacaacttacttggcctggttccaacagaaacctggccacggctcccaggcctcctcatctatgatgcactaccaacgacggggccacgtcggacactccccaggtcccgtaggttccaaggtcggactagggttggggtccgtggggacgacgtacttcacctctccacctatcgacgcccgcctagacgtccgtaggaggtactcgtcgttaccgttttatttacgtttgttcgttcgggtcgttacgtcctaacgtcggtcccttcccgtcgttaccgtttggccgtaacggggtaccacggtacgtggagacgtcgaacggacgtaagtcggtcggtcgtacgacccaaccgtcgttcgtcgttaccttctacccg

SEQ ID NO: 277864 - DNA, 261 bp, Homo sapiens
  misc_feature: GYAE6OF02HK1I4.29.35.D02.1.454.CMB.1.raw
  modified_base (259)..(261): a, c, t, g, unknown or other
  misc_feature (259)..(261): n is a, c, g, or t
tcagatagagtactcacgaccggtgctcgatttagcacacgatagttgggtttgggacagacttcactctcaccatcagccgcctagagcctgaggattctgccgtttattattgtcttgggcgtagcaactggcctcccgtcacttttggccaggggaccaagctggagatcagacgaactgtggctgcaccatctgtcttcatccttcccgccatctgaacgtactctatctgagcgggctggcaaggcgacatagnnn

SEQ ID NO: 277865 - DNA, 531 bp, Homo sapiens
  misc_feature: GYAE6OF02HGZ5Q.29.35.D02.1.454.CMB.1.raw
  modified_base (262)..(262): a, c, t, g, unknown or other
  misc_feature (262)..(262): n is a, c, g, or t
  modified_base (378)..(378): a, c, t, g, unknown or other
  misc_feature (378)..(378): n is a, c, g, or t
  modified_base (466)..(466): a, c, t, g, unknown or other
  misc_feature (466)..(466): n is a, c, g, or t
  modified_base (520)..(520): a, c, t, g, unknown or other
  misc_feature (520)..(520): n is a, c, g, or t
  modified_base (524)..(524): a, c, t, g, unknown or other
  misc_feature (524)..(524): n is a, c, g, or t
  modified_base (528)..(528): a, c, t, g, unknown or other
  misc_feature (528)..(528): n is a, c, g, or t
tcagatagagtactcacgaccggtgctcgatttagcacacgatagttgggtttgggggaggaactgctcagttaggacccagacggaaccatggaagccccagctcagcttctcttcctcctgctactctggctcccagataccagcggagagattgtgttgacacagtctccagccaccctgtctttgtctccgggagaaagagccaccctctcctgcagggccagtcagagtgttaacaactacttggcctggttccaanagaaacctggccaggctcccaggctcctcatctatgatgcatccaacgagggcccacgtggccactccccagccctaggttcagtggcaggtgggtctgggacagacttcacttcncacatcacgcccgctagacgcctgacgtattcgtgtccgttttattagttcgttcgttgggcgtagctaacgtcggtccttccccgtntaccgtttcggccgaggggtaccagcgtgacgatcgagacgatggtgctgcacntctntctntcc

SEQ ID NO: 277866 - DNA, 686 bp, Homo sapiens
  misc_feature: GYAE6OF02F6EV1.29.35.D02.1.454.CMB.1.raw
  modified_base (214)..(214): a, c, t, g, unknown or other
  misc_feature (214)..(214): n is a, c, g, or t
  modified_base (223)..(223): a, c, t, g, unknown or other
  misc_feature (223)..(223): n is a, c, g, or t
tcagatagagtactcacgaccggtgctcgatttagcacacgatagttgggtttggggagggaactcgctccaggttaggacccaaggacggaacctatggaagccccagctcagcttctcttcctcctgctactctggctccaggataccagcggtaggtagtattgtgttcgaacactagtctcagtccacctgtcttgtctcgggagaaagnggccacctntccgtggcagggaccagtcagagtgttaacaactcttggcctggtaccaacacgaaacctggtccaggtcctacccgagggtcctcccgtacgactccgtaagtcggattggctacgtccaacgagggccctaagtcggacctacgtcccgaagtccgagggtttcacggtcggactacgggttcgggtccgtaggggacctaggtacttccggacttactccgaccactcgacgccgacctacgacgacctaggacgtcttacgtcgttaccgttatttacgttggttcgttggggtacttacggtaccaacgttcggtacccgtccgttaccgtaccgttttacggaccgtaacgggtacctaagtccggtaggacgtacgttaacgaacggtaaccgtaacgtcggttacggcggttacgacccgtacgtacttccgttacgttccgttacgttacccgg

SEQ ID NO: 277867 - DNA, 629 bp, Homo sapiens
  misc_feature: GYAE6OF02JSLUZ.29.35.D02.1.454.CMB.1.raw
  modified_base (197)..(197): a, c, t, g, unknown or other
  misc_feature (197)..(197): n is a, c, g, or t
  modified_base (202)..(202): a, c, t, g, unknown or other
  misc_feature (202)..(202): n is a, c, g, or t
  modified_base (211)..(211): a, c, t, g, unknown or other
  misc_feature (211)..(211): n is a, c, g, or t
  modified_base (260)..(260): a, c, t, g, unknown or other
  misc_feature (260)..(260): n is a, c, g, or t
  modified_base (327)..(327): a, c, t, g, unknown or other
  misc_feature (327)..(327): n is a, c, g, or t
  modified_base (453)..(453): a, c, t, g, unknown or other
  misc_feature (453)..(453): n is a, c, g, or t
tcagatagagtactcacgaccggtgctcgatttagcacacgatagttgggtttgggggaggaactgctcagttaggacccagacggaaccatggaagccccagctcagcttctcttcctcctgctactctggctcccagataccagcggagagattgtgttgacacagtctccagccacctgtctttgctccggganaaagngccaccctntcctgcagggccagtcagagtgtaacaactacttggccttggtaccaanagaaacctggcaggctaccaggcctctcatctatgactgctactccaacgacggccacgtcgctacnccctagcctaggttcaggtcgcgagggttcggtcgtagggacctaggtaccttcaacgtccttacaccctagtccacgcccgtactagacgtaccgtgagtacttcgtcgttaccgttttaagttnttcggttccgttagggtaccttagccgtaacgtccggtacccgttacccggttaccttacggtttaccgggaccgaccgggtaacctaacggcgttacgggacacgtacgagggtaccgtaagttcggtcggtactacggacctacgtaacttccgtaggtttccctattacccgg

SEQ ID NO: 277868 - DNA, 624 bp, Homo sapiens
  misc_feature: GYAE6OF02HW00H.29.35.D02.1.454.CMB.1.raw
tcagatagagtactcacgaccggtgctcgatttagcacacgatagttggggtttgggggaggaactgctcagttaggacccagacggaaccatggaagccccagctcagcttctcttcctcctgctactctggctcccagataccagcggagagattgtgttgacacagtctccagccaccctgtctttgtctccgggagaaagagccaccctctcctgcagggccagtccccccagagtgttaacaactacttggcctgttccaacagaaacctggccaggctcccaggctcctcatctatgatgcatccaacgacgggccacgtggcatcccacgccaggttcagtcggcgagtgggtcgtgggacagacttcactctcaccatcacgccgctagacgccgtgaggtacttctggtccgttttattacgttgttccgtttaggggcgttaagcctaaacgttcgggcccttcccgttacgttacgttttcgggaccgtacgggggacctaaacggcgttagggaacgattaccgaaggtaaccggtaacgtttcgggtacgggtaccttacgggaccctaacccgtaagttcccgtttacggttttcccttacttaaccccg

SEQ ID NO: 277869 - DNA, 725 bp, Homo sapiens
  misc_feature: GYAE6OF02GPLOV.29.35.D02.1.454.CMB.1.raw
  modified_base (204)..(204): a, c, t, g, unknown or other
  misc_feature (204)..(204): n is a, c, g, or t
tcagatagagtactcacgaccggtgctcgatttagcacacgatagttgggtttgggggaggaactgctcagttaggacccagacggaaccatggaagccccagctcagcttctcttcctcctgctactctggctcccagataccagcggagagattgtgttgacacagtctccagccaccctgtctttgtctccgggagaaagngccaccctctcctgcagggccagtcagagtgttaacaactacgttggcctggttccaacagaacctgcaggctccaggctcctcatctatgatcgcataccaacgacgggtcccacgtgggcctacgtcccaacgccgtacggttcaggtcggcgtagggtcgggtcgtacggggaacaggtaccgttacaccgttctaccgaacctacttaccgaccggcccgtacccgtacggtaaccgtcccgtacggtaacggtaacttttccgtacggttacccggttttaagtttaacgttttcggtttaccggtttgggtacccggttaacgtaccgtaaaccggttccgggttccccgtttaccccggttacccgtttaaccggtttttcccgggtacccggtaaccgggggtaaacccgtacggtaccgtacgggtaacgtacgtacgaaccggaacggtaaccgtcgggtacggtaccgtacgtaccgtaccgtacttccgttacgttccttaccgtaccg

SEQ ID NO: 277870 - DNA, 686 bp, Homo sapiens
  misc_feature: GYAE6OF02G1NTI.29.35.D02.1.454.CMB.1.raw
tcagatagagtactcacgaccggtgctcgatttagcacacgatagttgggtttgggggaggaactgctcagttaggacccagacggaaccatggaagccccagctcagcttctcttcctcctgctactctggctcccagataccagcggagagattgtgttgacacagtctccagcccaccctgtctttgtctccgggagaaagagcccaccctctcctgcagggccagtcagagtgtaaacactacttggcctggttccaacagaaacctggaccaggctcccaggctcctcatcatgatgcactaccaacgagggccacgtggcactcccagccagttcagtggcaggtgggtctgggacagtacttcacgttctcaccatccgacgcccgactacgacgtcctaggacggtactttccgtaggttacccgtttttaatttagtttccggtttacgtttacgggggtaccgttaaggtaccgtaaccggttccgggtcccccgtttacccggttacccgtttaacggtttttccgggaccccgggttaaaccgggggtaacccgtaaacgtccgggtaacggtaacggtacgtacggtaaccggaaccggtaaaccgttggggtaccggttaccgttacggaacccctaccggtacttaccgttcgtttaccttacgttacccg

SEQ ID NO: 277871 - DNA, 604 bp, Homo sapiens
  misc_feature: GYAE6OF02H8X4L.29.35.D02.1.454.CMB.1.raw
  modified_base (194)..(194): a, c, t, g, unknown or other
  misc_feature (194)..(194): n is a, c, g, or t
  modified_base (199)..(199): a, c, t, g, unknown or other
  misc_feature (199)..(199): n is a, c, g, or t
  modified_base (351)..(351): a, c, t, g, unknown or other
  misc_feature (351)..(351): n is a, c, g, or t
  modified_base (585)..(585): a, c, t, g, unknown or other
  misc_feature (585)..(585): n is a, c, g, or t
tcagatagagtactcacgaccggtgctcgatttagcacacgatagttgggtttgggggagaactgctcagttaggacccagacggaaccatggaagccccagctcagcttctcttctcctgctactctggctccagataccagcggagagattgtgttgacacagtctccagccaccctgtctttgctcggganaaagngccacctctctgcagggccagtcagagtagttaacaactcttggccttggttaccaacagaaacctggccaggctccaggctctcatctatgatgcatccaacgacgggccaacgtggacactcccagccaggttcaggtggcgagtcgggntgggacagacttcactctcactatccgacgccgtacctacggacgtccgtaggagtacttcgtacggttaccgttttaatttagtttcggtttcgtttcggggtacgttacgtcgtaaccgttcgggtaccccgttcccggttcctaccgttttccgggaccgtacggggaacccaggtcgtagggtacgagtacgaacggaccgtaacgtggtacggtaccgtgaccaccgtnttccgtgttccttctaccg

SEQ ID NO: 277872 - DNA, 256 bp, Homo sapiens; identical to SEQ ID NO: 276990
  misc_feature: GYAE6OF02GUEJ9.29.35.D02.1.454.CMB.1.raw
  modified_base (256)..(256): a, c, t, g, unknown or other
  misc_feature (256)..(256): n is a, c, g, or t

SEQ ID NO: 277873 - DNA, 584 bp, Homo sapiens
  misc_feature: GYAE6OF02ICZPQ.29.35.D02.1.454.CMB.1.raw
  modified_base (383)..(383): a, c, t, g, unknown or other
  misc_feature (383)..(383): n is a, c, g, or t
  modified_base (390)..(390): a, c, t, g, unknown or other
  misc_feature (390)..(390): n is a, c, g, or t
tcagatagagtactcacgaccggtgctcgatttagcacacgatagttgggtttgggggaggaactgctcagttaggacccagacggaaccatggaagccccagctcagcttctcttcctcctgctactctggctccagataccagcggagagattgtgttgacacagtctccagccaccctgtctttgtctccgggagaaagagccaccctctcctgcagggccagtcagagtgttaaacaactacttggcctggttccaacagaaacctggaccaggcctcccaggctcctcatctactgatgctactccaacgagggccacgtcggcactcccagccaggttccgagtcggctaggtgggtcgtggacagctcatctcacntcacgcnctagacgctgagtacttctcgtcgtttattagttcgttcgttggtcgtgtacacgtcggtcctccgtctacgtttcggaccgtacgggacctaacggcgtaggacgtacgtacgaacggtaacggtaacgttcgggtcgggttaccgtcggtaccgaccgtaccgttaccgttcggtttccttaccttacccgg

SEQ ID NO: 277874 - DNA, 576 bp, Homo sapiens
  misc_feature: GYAE6OF02GALAY.29.35.D02.1.454.CMB.1.raw
tcagatagagtactcacgaccggtgctcgatttagcacacgatagttgggtttgggggaggaactgctcagttaggacccagacggaaccatggaagccccagctcagcttctcttcctcctgctactctggctcccagataccagcggagagattgtgttgacacagtctccagccaccctgtctttgtctccgggagaaagagccaccctctcctgcagggccagtcagagtgttaacaactacttggcctggttccaacagaaacctggccaggctcccaggctcctcatctatgatgcatccaacagggccatcgacactcccagccagttcaggtgacgagtgggtcgtgggacagacttcaacttctacacctatccacgcccgctacgacgcccgtggacgtacttcgttcgtccgttttaatttagtttcgttcgttacgggtcgtacgtcgtaacgttcggtcccttcccgtcttacgttttcggccggtacgggtaacctacggcgtgggacgtatacgagaacgacgtggtcgtcgtcgactactatccgttgttccttcttacc

SEQ ID NO: 277875 - DNA, 869 bp, Homo sapiens
  misc_feature: GYAE6OF02HYHRN.29.35.D02.1.454.CMB.1.raw
tcagatagagtactcacgaccggtgctcgatttagcacacgatagttgggtttgggggaggaactgctcagttaggacccagacggaaccatggaagccccagctcagcttctcttcctcctgctactctggctccagataccagcggagagattgtgttgacacagtctccagccacctgtctttgctccgggagaaagacgccacctctcctgcagggccagtcagagttagttaaaccaacttacgttgggccttacgggttaccaaaacgaagtaaaacccgttgggacccgaagggccttaccccgaagggccttacccttacaacttccttaatcggaattcgcctaacttacccgaaacgacgggcccctaacgtcgggaccaaccttccccgaacggtccctaagggtttaccaacggttcggacgtacggggttcggggtcgttacgggggaacctaaggtaccttcgaaccttccgttaccacccgtaagtcccgaccggaccgtaccctaacgggtaaccgtcccgtaggtacgggttaactttccggttacggttaacccggttttttaatttaacggttttcgggtttaccgttttacggggggtaaccgttaacgggtaacctaaacccgggtttccgggtacccccgtttaccccgggttacccgttttacccgggttttttaccggggaaccccggttaaacggggggtaacccctaaagggtacccggtttacgggggaaactacggttacccggtaacggtaaacccggtaaacggtttcgggacgggttaccgtacggaccccgtaaccgttaccgtttccggttacgtttacccgtttcgttaacccgg

SEQ ID NO: 277876 - DNA, 634 bp, Homo sapiens
  misc_feature: GYAE6OF02FWK3N.29.35.D02.1.454.CMB.1.raw
  modified_base (217)..(217): a, c, t, g, unknown or other
  misc_feature (217)..(217): n is a, c, g, or t
tcagatagagtactcacgaccggtgctcgatttagcacacgatagttgggtttgggggaggaactgctcagttaggacccagacggaaccatggaagccccagctcagcttctcttcctcctgctactctggctcccagataccagcggagagattgtgttgacacagtctccagcccaccctgttctttgtcctccggggagaaagcgccaccctntcctgcagggccagtcagagtgttaacaactcttggcccttggttaccaacagaaacctggccaggctcccaggcctcctcattctatgatgcatcccaagacgggccacgtggcactccccagcccaggttcaggtgcgaggtgggtctggggacagtacttcacgttcctacacctactccacgcccgaccgtagacgaccgtaggtacggtacttcgttacggtccgttttaatttattggttcgttgggtccgtagtactaaccgtcggtcccgttacccggttcttaccgtttttaccgggcccggtaacggggaacccgaacggtcgtacggagtactacgaacggtaccgtaacgtcggtacggtccgttacgacctaccgtacgttccgttacggttccttacctaccg

SEQ ID NO: 277877 - DNA, 709 bp, Homo sapiens
  misc_feature: GYAE6OF02IDL4Q.29.35.D02.1.454.CMB.1.raw
  modified_base (202)..(202): a, c, t, g, unknown or other
  misc_feature (202)..(202): n is a, c, g, or t
  modified_base (212)..(212): a, c, t, g, unknown or other
  misc_feature (212)..(212): n is a, c, g, or t
tcagatagagtactcacgaccggtgctcgatttagcacacgatagttgggtttgggggagaactgctcagttaggacccagacggaaccatggaagccccagctcagcttctcttcctcctgctactctggctcccagataccagcggagagattgtgttgacacagtctccagccaccctgtctttgctccgggagaaagngccaccctcncctgcagggccagtcagtagtgttaaacaactcttggcctggttccaacagaaacctggccaggcctccaggcctcctcatctatgatgcactccaacgacgggccacgtggaccactcccaagcctagggttccaaggtcggacagggttcgggtcgtagggacagtaccttcgacttacctacgaacccattccgaacgcccggtaccgtaacggacgtacccgtacggacggttacttccgttacggttaccgtttttaagtttaacgtttcggtttcggtttacggggtaccggtttaacgaccgtaaccgttcgggtacccgttaccccggtttccgttacccggtttttcgggcccggtaacgggggtaacccgtaaacggtccgttaggggacgtacgttaccggaacggtaacggtaaccggtcggtacgggtacctacggtacctaacccggtaaccgttccgtttacggttaccgtttccgtaaccg

SEQ ID NO: 277878 - DNA, 627 bp, Homo sapiens
  misc_feature: GYAE6OF02F06YK.29.35.D02.1.454.CMB.1.raw
tcagatagagtactcacgaccggtgctcgatttagcacacgatagttgggtttgggggaggaactgctcagttaggacccagacggaaccatggaagccccagctcagcttctcttcctcctgctactctggctcccagataccagcggagagattgtgttgacacagtctccagcccaccctgtctttgtctccggggagaaagcgccaccctctcctgcagggccagtcagagtgttaaacaactacttggcctggttccaacagaaacctggccaggctcccgaggctcctcatctatgatgcactccaaacgacgggccacgtggccaactcccgagcctaggttccaggtcggcaggtcgggtctggggacagtactcactctccacctatcacgccgctacgcgcctggaggtacttcgtcgtaccgttttatttacgtttgttcggtttcgggtcgtacgtacctaacgttcggtacccgttcccgttaccgttacgtttttcgggaccgtaacgggggtaccctaaggtaccgtacgggaagtacgtacgacggtaaccggtaaccgttggtacggtccgtagacctaccgtaaccttcgttacgttccttccttaccg

SEQ ID NO: 277879 - DNA, 536 bp, Homo sapiens
  misc_feature: GYAE6OF02FMCP9.29.35.D02.1.454.CMB.1.raw
tcagatagagtactcacgaccggtgctcgatttagcacacgatagttgggtttggggaggaactgctcagttaggacccagacggaaccatggaagccccagctcagcttctcttcctcctgctactctggctcccagataccagcggagagattgtgttgacacagtctccagccaccctgtctttgtctccgggagaaagagccaccctctcctgcagggccagtcagagtgttaacaactacttggcctggttccaacagaaacctggccaggctcccaggctcctcatctatgatgcatccaacagggccactggcatcccagccaggttcagtggcagtgggtctgggacaggacttcactctcaccatcacgccgcctacgagccgtggaggtattcgtcgtccgtttatttagtttgtcgttgggtcgtagtcacgtcggccctcccgttctacgttttcggccgtacgggaccaagtcgtggagatcaggaacgaacgtggtggtctgcactacgtctgttcttctac

SEQ ID NO: 277880 - DNA, 646 bp, Homo sapiens
  misc_feature: GYAE6OF02GWB8X.29.35.D02.1.454.CMB.1.raw
  modified_base (262)..(262): a, c, t, g, unknown or other
  misc_feature (262)..(262): n is a, c, g, or t
  modified_base (369)..(369): a, c, t, g, unknown or other
  misc_feature (369)..(369): n is a, c, g, or t
tcagatagagtactcacgaccggtgctcgatttagcacacgatagttgggtttgggggaggaactgctcagttaggacccagcggaaccatggaagccccagctcagcttctcttcctcctgctactctggctcccagataccagcggagagattgtgttgacacagtctccagccaccctgtctttgtctccgggagaaagagccaccctctcctgcagggccagtcagagtgttaacaactacttggcctggttaccaanacgaaacctggccaggctccgaggcctctcatctaatgatgcataccaacgcgggaccacgtggccacgtcccagccgtagggttcaggtcggcagggtcgggtcgngggaacagtacttcacttctaccaacatcgacggcccgacctaagacggccgtaggtacggtactttcgtacggtttacctttttagttacgtttggttaccgtttcggggtcgttacgtaccgtaacgttcgggtacccgttccccgtttacgttacgtttcgggacccgtaacgggggaaaccctaggtaccgtaggggactacgtcgaacgggtaacccgtaacggttcggaggtccgtagaccgtacctacgttccttacgttcttacgtccc

SEQ ID NO: 277881 - DNA, 687 bp, Homo sapiens
  misc_feature: GYAE6OF02IR5LT.29.35.D02.1.454.CMB.1.raw
  modified_base (197)..(197): a, c, t, g, unknown or other
  misc_feature (197)..(197): n is a, c, g, or t
  modified_base (258)..(258): a, c, t, g, unknown or other
  misc_feature (258)..(258): n is a, c, g, or t
tcagatagagtactcacgaccggtgctcgatttagcacacgatagttgggtttgggggaggaactgctcagttaggacccagacggaaccatggaagccccagctcagcttctcttcctcctgctactctggctcccagataccagcggagagattgtgttgacacagtctccagccacctgtctttgctccggganaaagcgccacctctcctgcagggccagtcagagtgttaaacactcttggccttggtccaanagaaacctgccagctccagctctcatctatgatgcactccaacgacgggccacgtggacctacgtccccgagaccctaagggtttccaggtacggctacgggttcgggtccttaggggacaacggtactttaccgaaccttctccaacccgtaattcccgaacgcccgaccttacggacgtacccgtaggtaacgggtactttcgtacggttaccgttttatttagttcggtttcgttagggtaccgtacgtaccgtaacgtcggtacccgttcccgttaccgtaaccggtttttccggacccggtaacggggtaacccgtaaaggtccggttacgggaacgtacgtacgtaacggaacggtaaccgttggtaccggtacgtaccggtaccgtaccctagttaccgtttacgttccgttacttacccgg

SEQ ID NO: 277882 - DNA, 750 bp, Homo sapiens
  misc_feature: GYAE6OF02F0R3H.29.35.D02.1.454.CMB.1.raw
  modified_base (200)..(200): a, c, t, g, unknown or other
  misc_feature (200)..(200): n is a, c, g, or t
tcagatagagtactcacgaccggtgctcgatttagcacacgatagttgggtttggggaggaactgctcagttaggacccagacggaaccatggaagccccagctcagcttctcttcctcctgctactctggctcccagataccagcggagagattgtgttgacacagtctccagccaccctgtctttgctcgggagaagngccacctctcctgcagggccagtcagagtagttaacaacttacttgggcccttgggttaccaaacgacgaaacccgtggaccagggtcctcccgaggcctcctcaatcctatgatggactataccgaacgacgggcctacgtggaccaactccccgagtcccgtaggttccaagggtcggtaccgaggttcggggttcgtagggggaactacggtaccttcaccttccgtaccacctactaccgacgtacccgaccgtaagacgtccgtaggtacggtactttccggtcgttacccgttttagtttacgttacggttcgtttcgggtaccggttaacgtacctaacggtccgggttacccgtaccccggtttccgtttaacccggtttttccgggacccgggttaacggggggtaaccctaaacgggtacgttacggggaacgtacgtaccggtaacggtaaccggttaacggttacggggttccggtacgttaccggacccgtaacccgtacgttacccgtttacggttacccgtttcgtttaacccgg

SEQ ID NO: 277883 - DNA, 637 bp, Homo sapiens
  misc_feature: GYAE6OF02FZE8U.29.35.D02.1.454.CMB.1.raw
  modified_base (198)..(198): a, c, t, g, unknown or other
  misc_feature (198)..(198): n is a, c, g, or t
  modified_base (203)..(203): a, c, t, g, unknown or other
  misc_feature (203)..(203): n is a, c, g, or t
tcagatagagtactcacgaccggtgctcgatttagcacacgatagttgggtttggggaggaactgctcagttaggacccagacggaaccatggaagccccagctcagcttctcttcctcctgctactctggctcccagataccagcggagagattgtgttgacacagtctccagccaccctgtctttgtctccggganaaagngccaccctctcctgcagggccagtcagagtgttaacaactacttggcctggttccaacagaaacctggccaggctcccaggctcctcatctatgatgcatccaacgacgggccacgtggccacgtccccgagccctaggttccaggtcggcaggtgggtctgggacaggtaccttcacttcctcaacctagtccgacgcccgtactacgacgccgtggagtacgttcttcggtaccgttttattacgtttcggtcgtttgggtcgtacgtactaaccgttcggtcccttcccggttcgttaccgttttcgggacccggtacgggtaacctaggtccgtagggtacgtacgtacgaacggtaacgtaacgttcgggtacggtccgttacggaccctaccgtacgttccgttacggtttacctttaccgttacccg

SEQ ID NO: 277884 - DNA, 612 bp, Homo sapiens
  misc_feature: GYAE6OF02GSZAK.29.35.D02.1.454.CMB.1.raw
  modified_base (200)..(200): a, c, t, g, unknown or other
  misc_feature (200)..(200): n is a, c, g, or t
  modified_base (264)..(264): a, c, t, g, unknown or other
  misc_feature (264)..(264): n is a, c, g, or t
  modified_base (398)..(398): a, c, t, g, unknown or other
  misc_feature (398)..(398): n is a, c, g, or t
tcagatagagtactcacgaccggtgctcgatttagcacacgatagttgggtttgggggaggaactgctcagttaggacccagacggaaccatggaagccccagctcagcttctcttcctcctgctactctggctcccagataccagcggagagattggtgttgacacagtctccagccaccctgtctttgtctccggganaaagagccaccctctcctgcacgggccagtcagagtgttaacactacttggcctggttaccaanacgaaacctggccaggcctccaggctcctcatctatcgattgcatccaacgcgggccagtcggacactcccagccgaggttccagtggctaggtcgggtcgtgggactaggtaccttcaccgttctaccgaccnctacgacgcccgaccgtagacgcgtaggagtacttcgtcgttacgtttattagttcgttcgtttcgggcgtacgtctacgttcggtcccttaccggttcctacgttttccggaccggtaacgggtaccgaacggtcgtaggacggtactacggaagaccggtaacgtcggtacgccgttagaccgtacctggttacctggtttccctattcccg

SEQ ID NO: 277885 - DNA, 564 bp, Homo sapiens
  misc_feature: GYAE6OF02FWRAK.29.35.D02.1.454.CMB.1.raw
  modified_base (549)..(549): a, c, t, g, unknown or other
  misc_feature (549)..(549): n is a, c, g, or t
tcagatagagtactcacgaccggtgctcgatttagcacacgatagttgggtttgggggaggaactgctcagttaggacccagacggaaccatggaagccccagctcagcttctcttcctcctgctactctggctcccagataccagcggagagattgtgttgacacagtctccagccaccctgtctttgtctccgggagaaagagccaccctctcctgcagggccagtcagagtgttaacaactacttggcctggtccaacagaaacctggccaggctccagctcctcatctatgatgcatccaacacggggccacgtggcactccccagccaggttcagtggctaggtcgggtctggggacaggtaccttcgactctccaacctactcacgcccgctaacgagcctggaggactttcgtcgtaccgttttatttagttgttcgtttgggctagctaaccgttcggtccctcccggtcttacgttttcgggaccgtaggggtaaccaggcgtggacgtacgtcaagtacgaagtcggtgcgtgacacgnttcgtctcttctacc

SEQ ID NO: 277886 - DNA, 631 bp, Homo sapiens
  misc_feature: GYAE6OF02HFKFX.29.35.D02.1.454.CMB.1.raw
tcagatagagtactcacgaccggtgctcgatttagcacacgatagttgggtttgggggaggaactgctcagttaggacccagacggaaccatggaagccccagctcagcttctcttcctcctgctactctggctcccagataccagcggagagattgtgttgacacagtctccagccaccctgtctttgtctccgggataaagagccaccctctcctgcagggccagtcagagtgttaacaactacttggcctggttccaacagaaacctggccaggctcccaggctcctcatctatgatgcatccaacgacgggccactggcatccccagcctaggttcaggtcggcaggtgggtctgggacagacttcactctcaccatcacgcccgcctacgacgccgtaggacggtatttcgtcggttaccgtttttatttagtttcggtttccggtttggggtccgttacgtacctaaccggttcggtcccgtttaccccgttcgttaccgtttttcgggacccgtaacgggggtaccctaaggtccgtaggaacgtacgtacgaacggtaaccggtaacgttggtacggtcgttacggacctaccgtagttccgtacgtttccttaccgttaccg

SEQ ID NO: 277887 - DNA, 530 bp, Homo sapiens
  misc_feature: GYAE6OF02IVKGI.29.35.D02.1.454.CMB.1.raw
  modified_base (163)..(163): a, c, t, g, unknown or other
  misc_feature (163)..(163): n is a, c, g, or t
  modified_base (297)..(297): a, c, t, g, unknown or other
  misc_feature (297)..(297): n is a, c, g, or t
  modified_base (311)..(311): a, c, t, g, unknown or other
  misc_feature (311)..(311): n is a, c, g, or t
tcagatagagtactcacgaccggtgctcgatttagcacacgatagttgggtttggggaggaactgctcagttaggacccagacggaaccatggaagccccagctcagcttctcttcctcctgctactctggctccagataccagcggagagattgtgttgacncagtctccagccacctgtctttgtctccgggagaaagagccaccctctcctgcagggccagtcagagtgttaacacttacttggaccttggttaccaacagaaacctggccaggctcccaggctcctcatctangatgcatccgaacnggccactggcatcccagccaggttcagtcgcagttgggtctgggacagtcttcacgtctcgaccatcacgccgtctacgacgctagaggattcgtcgtcgttattgttgtcgttgggcgtagctacgtcgtccgtccgtctacgttttcggccgtacgggtaccagtcgtggacgtagtcgagacgtactgtcgcgtgtcaccatctcgtcgttctacg

SEQ ID NO: 277888 - DNA, 653 bp, Homo sapiens
  misc_feature: GYAE6OF02HIOB0.29.35.D02.1.454.CMB.1.raw
  modified_base (194)..(194): a, c, t, g, unknown or other
  misc_feature (194)..(194): n is a, c, g, or t
  modified_base (199)..(199): a, c, t, g, unknown or other
  misc_feature (199)..(199): n is a, c, g, or t
  modified_base (207)..(207): a, c, t, g, unknown or other
  misc_feature (207)..(207): n is a, c, g, or t
  modified_base (257)..(257): a, c, t, g, unknown or other
  misc_feature (257)..(257): n is a, c, g, or t
  modified_base (402)..(402): a, c, t, g, unknown or other
  misc_feature (402)..(402): n is a, c, g, or t
  modified_base (440)..(440): a, c, t, g, unknown or other
  misc_feature (440)..(440): n is a, c, g, or t
tcagatagagtactcacgaccggtgctcgatttagcacacgatagttgggtttggggaggaactgctcagttaggacccagacggaaccatggaagccccagctcagcttctcttctcctgctactctggcctccagataccagcggagagattgtgttgacacagtctccagccacctgtctttgctcggganaaagngccacctncctgcagggccagtcagagtgttaaacaactcgttggcctggttaccaanagaacctggccagcctccaggctccgtcagtctagtgatgcataccaagacggccaactggacctaacgtcccaagtccgaagggttcaaggtcggaccttagggtcgggtcgtgggaacacggtacgttcactctaccgaaccncgtaacgcgtaccgtccctaggacgccgtagaacggtnttcgcgttaccgtttatttagttcgtcggttagggtcgtaacggctaaggtcggcccttaccgtccgtttacgtttcggccgaacgggggtaaccctaaggccgttaggggtactacgtacggtaccggtaaacgtacccggttacgggttcggaccgttaccggaccggtaacccctagtttaccgttttcgttacccggttaaccttcccg

SEQ ID NO: 277889 - DNA, 659 bp, Homo sapiens
  misc_feature: GYAE6OF02F9GZZ.29.35.D02.1.454.CMB.1.raw
  modified_base (205)..(205): a, c, t, g, unknown or other
  misc_feature (205)..(205): n is a, c, g, or t
tcagatagagtactcacgaccggtgctcgatttagcacacgatagttgggtttgggggaggaactgctcagttaggacccagacggaaccatggaagccccagctcagcttctcttcctcctgctactctggctcccagataccagcggagagattgtgttgacacagtctccagccaccctgtctttgtctccgggagaaacgngcccaccctctcctgcgacgggccagtcagagtagttaacaacttacgttcggccttggttacccaaacgacgaaaaccctcgggaccacggccttcccaggcctcctcattcctatgaatcgactactccaaaccgaggggccctaacgtcggaccaccgtaccccacgccgtaggttccgaggtcggacgtagggttcgggtcgtagggaaccgagtaccttcactcctacaccgtactcgaccggccgtacgtaacggcgtcccgtaggtacggtactttcggttcgttacgttttaactttagttcgttcggtttcggacgttacggtactacggttccgtccgttaccccgttcgttacggtttccggaccggtacgggaacctaacggcgtaggacgtactacggagacgtagtggtcgtcgtgcgactcgtacgtcgttctcttccg

SEQ ID NO: 277890 - DNA, 733 bp, Homo sapiens
  misc_feature: GYAE6OF02HWS1P.29.35.D02.1.454.CMB.1.raw
  modified_base (199)..(199): a, c, t, g, unknown or other
  misc_feature (199)..(199): n is a, c, g, or t
  modified_base (261)..(261): a, c, t, g, unknown or other
  misc_feature (261)..(261): n is a, c, g, or t
tcagatagagtactcacgaccggtgctcgatttagcacacgatagttgggtttgggggaggaactgctcagttaggacccagacggaaccatggaagccccagctcagcttctcttcctcctgctactctggctccagataccagcggagagattgtgtgacacagtctcagccaccctgtctttgctcgggagaaagngcccacctctcctgcagggccagtcgagtagtagttaaacaactcttggcttggttaccaanagaaacctggaccgaggctccaggctcctacatctaatgaactcgctatacccaagacgggccaacgtcggacactacccgagtccgaacgggtttcaggttcggacgtaggtcggggttacctagggggaacctaaggtaaccctttcgtaaccttaccgtcctaaccctaacgtacccacggtacccggacccttaggaccgtacccggtggaaacggttcgtttacgttacggttacccgtttttaagttacgttttacggttcgtttacggggtaccggtaacggtacctaaacggtccggttacccgttaccccggttactttaccggttttaccgccgggtaaaccggggtaccgaagggtaccgtaggggtaacgtaccgtacgaaacgggtacgtaaacccggtgggttaacggaaccgttcgacgtacccttacgtacggtttcgttacccttagttaacccg

SEQ ID NO: 277891 - DNA, 672 bp, Homo sapiens
  misc_feature: GYAE6OF02IEFY7.29.35.D02.1.454.CMB.1.raw
  modified_base (204)..(204): a, c, t, g, unknown or other
  misc_feature (204)..(204): n is a, c, g, or t
tcagatagagtactcacgaccggtgctcgatttagcacacgatagttggggtttggggaggaactgctcagttaggacccagacggaaccatggaagccccagctcagcttctcttcctcctgctactctggctcccagataccagcggagagattgtgttgacacagtctccagccaccctgtctttgtctccgggagaaagngccaccctctcctgcagggccagtcagagtagttaacaacttacttggcctggttacccaaacagaaacctggccaggcctcccaggcctcctcattctatgatcgacactacccaaacggcgggacctacgtcggacctactccccgacggtaccgtaggttaccaggtcggacgtagggttcggggtacgtagggaaccgtagtacctttcaacttcctaccaccgtatccgacgccgactacgacgcgtaggacggtacttctacggttaccgttttagtttacgttcgttcgttcgggtacgttacgtaccgtaaccgtcggtccccttaccggttaccgttaccgttttcgggaccggtaacggggtaaccaacgggtcgtagggacgtacgtacgtaacggaaccgtaacgttggtcggtcctacgaccgaccgttactaccgttacgttccttacgtaccg

SEQ ID NO: 277892 - DNA, 760 bp, Homo sapiens
  misc_feature: GYAE6OF02IGX15.29.35.D02.1.454.CMB.1.raw
  modified_base (198)..(198): a, c, t, g, unknown or other
  misc_feature (198)..(198): n is a, c, g, or t
  modified_base (203)..(203): a, c, t, g, unknown or other
  misc_feature (203)..(203): n is a, c, g, or t
  modified_base (261)..(261): a, c, t, g, unknown or other
  misc_feature (261)..(261): n is a, c, g, or t
tcagatagagtactcacgaccggtgctcgatttagcacacgatagttgggtttgggggaggaactgctcagttaggacccagacggaaccatggaagccccagctcagcttctcttcctcctgctactctggctcccagataccagcggagagattgtgttgacacagtctccagccacctgtctttgtctccggganaaagngccacctctcctgcagggccagtcagagtgttaacaactacttggcctggttaccaanagaaacctggccaggcctccgaggcctcctcatctatgatgctactaccaaagcgggaccacgtcggcctacgtcccaacggacccgtagggtttcaggtcggaccgtagggttcggggtacgtcggggaactacggtacctttccaacgttccctaccaaccctattcccgaacgacccgtaccgtaacggaccggtaccgtacggtaacgggtacgtttccgttacggttacccgtttttaacgttttaacgttttcggtttaccggtttcggggttaccggttaacggtaccgtaaaccggttccgggttaccccgtttacccggtttaccgtttacccggtttttccgggacccgggtaaccggggtaacccgtaacgggtacggtacgggtaacgtacgtaccggtaacggtaaccggtaaccggttcgggtacgggtaccgtacggtaccctaccgttaccgttccgtttaccggttcccttacgttaccccg

SEQ ID NO: 277893 - DNA, 632 bp, Homo sapiens
  misc_feature: GYAE6OF02HXT0Y.29.35.D02.1.454.CMB.1.raw
tcagatagagtactcacgaccggtgctcgatttagcacacgatagttgggtttggggaggaactgctcagttaggacccagacggaaccatggaagccccagctcagcttctcttcctcctgctactctggctcccagataccagcggagagattgtgttgacacagtctccagccacctgtctttgtctccgggagaaagagccaccctctcctgccagggccagtcagagtgttaacaactacttggccttggttaccaacagaaaaccctggaccacggcctcccgaggctcccgtcactctatgatgcatccaaacgacgggccacgtcggcacgtcccagcctaggttccaggtggctaggtgggtcaggggacagtacttcacctctaccacctatcgacgcccgcctacgacgcgtaggaggtactttcgtgttccgttttattagtttcgttcgtttcgggtcgttagcctaacgtcggtcccttcccggtcttacgttttcgggaccgtacggggtaacccgtaacggcgtagggacgtacgtacgaacggtaaccggtaacgttcgggtacggtcgtacggccctaaccgtaccttccgttacgtttccgttaccttacccg

SEQ ID NO: 277894 - DNA, 699 bp, Homo sapiens
  misc_feature: GYAE6OF02G5SJX.29.35.D02.1.454.CMB.1.raw
  modified_base (198)..(198): a, c, t, g, unknown or other
  misc_feature (198)..(198): n is a, c, g, or t
tcagatagagtactcacgaccggtgctcgatttagcacacgatagttgggtttggggaggaactgctcagttaggacccagacggaaccatggaagccccagctcagcttctcttcctcctgctactctggctcccagataccagcggagagattgtgttgacacagtctccagccaccctgtctttgtctccggganaaagcgccaccctctcctgcagggccagtccagagtagttaaacaacttacttggccttggttacccaaacaacgaaacctggaccacggcctcccgaggcctccctcatcctagtgatcgcactaccgaacgcgggccctacgtggacctactcccgagtccgtaggttcaggtcggaccgtagggttcgggtcgtaggggaactaggtaccttccgaccttccaccgtaaccctataccgacgcccgacctaaggacgtccctagggacgttacttcgttacggttaccgttttaattacgtttcggttacggttcgggtacgttacgtaccgtaacggttccggtacccttcccggttacgtttaccggtttaccgggaccggtaacggggtaacccgtaaggtccgtaggaacgtacgtaccgaacgggtaacgttaaccggtgggtacggccgttacgaccgtaccgtcgttccgtttcgttaccgttctaacccg

SEQ ID NO: 277895 - DNA, 619 bp, Homo sapiens
  misc_feature: GYAE6OF02GUW1P.29.35.D02.1.454.CMB.1.raw
  modified_base (199)..(199): a, c, t, g, unknown or other
  misc_feature (199)..(199): n is a, c, g, or t
tcagatagagtactcacgaccggtgctcgatttagcacacgatagttgggtttgggggaggaactgctcagttaggacccagacggaaccatggaagccccagctcagcttctcttcctcctgctactctggctcccagataccagcggagagattgtgttgacacagtctccagccaccctgtctttgtctccggganaaagagccaccctctcctgcagggccagtcagagtgttaacaactacttggcctggttaccaacagaaacctggccaggctcccaggctcctcatctatgatgcatccaacgacgggccacgtggacactcccagcccaggttcagtgcaggtgggtctagggacagtacttcactctacactatcacgcccgacctagacgtccgtaggaggtatttcgtacgttccgttttatttagtttcgttcgtttgggtcgttacgtacctaaccgtcggtcccgttcccgttacgtaccgttttcggacccgtaacggggtaaccctaacggtccgtagggtagacgtacgaaggtaaccggtaaacgttgggtacggtaccgtcggtaccgacctacgttaccttcggttccttactacccg

SEQ ID NO: 277896 - DNA, 572 bp, Homo sapiens
  misc_feature: GYAE6OF02FR7KQ.29.35.D02.1.454.CMB.1.raw
  modified_base (206)..(206): a, c, t, g, unknown or other
  misc_feature (206)..(206): n is a, c, g, or t
tcagatagagtactcacgaccggtgctcgatttagcacacgatagttgggtttgggggaggaactgctcagttaggacccagacggaaccatggaagccccagctcagcttctcttcctcctgctactctggctcccagataccagcggagagattgtgttgaccacagtctccagccaccctgtctttgtctccgggagaaaagngccaccctctcctgcagggccagtcagagtgtaacactacttggcctggtaccaacagaaacctggccaggctcccaggctcctcatctatgatgcactaccaacgacgggccactgggacactcccagcctaggttcagtgcagtgggtctgggacagtctcactctcaccatcacgccgctagacgcgtggaggacttcgtacgtccgtttattagttcgttcgttcgggtcgtagtacgtacgtcggtccctcccgtctacgttttcggaccgtacgggtacctacggtcgtacgggagtacgtcgacggaacgaacgttcggtaggtctgaccgtactagttccgttcggtaccttctaccg

SEQ ID NO: 277897 - DNA, 696 bp, Homo sapiens
  misc_feature: GYAE6OF02JELRZ.29.35.D02.1.454.CMB.1.raw
  modified_base (619)..(619): a, c, t, g, unknown or other
  misc_feature (619)..(619): n is a, c, g, or t
  modified_base (670)..(670): a, c, t, g, unknown or other
  misc_feature (670)..(670): n is a, c, g, or t
tcagatagagtactcacgaccggtgctcgatttagcacacgatagttgggtttgggggaggaactgctcagttaggacccagacggaaccatggaagccccagctcagcttctcttcctcctgctactctggctcccagataccagcggagaggtattggtgttgactacagtctccagccacctgtctttgtctccgggagaagacgccacctctcctgcgagggccagtcagagtcgttaacacttacgttggccttggttacccaaacgagtaaaccctggccaaggtcctcccaggcctccgtcatctatgatgcatccaacgacggccacgtcggcacgtacccagaccgaggttcaggtcggactaggtcgggtcgtcgggacaggtaccttcgaaccttccgtaccaccgtacttaccgacggtccccgaccgtaaacggcggtacccgttagggaacggttacgtttaccgttacggttacccgtttttaatttaaggtttccggttacggttttcgggaccgttacgtacccgtaacgttccggtacccgttccccgttacttacggttttaccgggaccgtacggggtaacgacgtacggacgggttanaccgtagtaccggaaccggttactagggttcgacgttacgactaacccgtnttaccgtttgtccctttacgtacccg

SEQ ID NO: 277898 - DNA, 697 bp, Homo sapiens
  misc_feature: GYAE6OF02GG64K.29.35.D02.1.454.CMB.1.raw
  modified_base (371)..(371): a, c, t, g, unknown or other
  misc_feature (371)..(371): n is a, c, g, or t
  modified_base (391)..(391): a, c, t, g, unknown or other
  misc_feature (391)..(391): n is a, c, g, or t
tcagatagagtactcacgaccggtgctcgatttagcacacgatagttgggtttggggaggaactgctcagttaggacccagacggaaccatgggaagccccagctcagctctcttcctcctcgctactctggctcccacgataccagcggagagattgtgttgtacacagtctccacgccaccctgttctttgtcgtccgggagaaagagccaccctcctctcgcacgggccagtcagagtacgttaacaactacttggcccgttggttaccaaaccaacgtaaaccgtccggtccacggtacctccccagggcttcccacctatcgtataggactgccactacccaaacgacgggcctacgtcggctacncccgacgccgtacggttacnggtaggccgtaagggtcgggttcggtagggaactagtaccgtttccacttcccgtccaaccgtacttaccgacgtaccgtaccgtacgtacggtcccgtaggtacggtacgttcttacggttcgtttacgtttagttcgtcggtttcgggacgttacgtacgtaaccgtcggttcccgtaccgttccgttacgttcggtacccggaagggtaccgtaacgtcggtagtacgtacgtacgtaacggagttaaccgaggttcggacgttacgaccgttactaccgttctacggttccttacgtacccg

SEQ ID NO: 277899 - DNA, 595 bp, Homo sapiens
  misc_feature: GYAE6OF02GHTJC.29.35.D02.1.454.CMB.1.raw
tcagatagagtactcacgaccggtgctcgatttagcacacgatagttgggtttgggggaggaactgctcagttaggacccagacggaaccatggaagccccagctcagcttctcttcctcctgctactctggctcccagataccagcggagagattgtgttgacacagtctccagccacctgtctttgtctccgggagaaagagccaccctctcctgcagggccagtcagagtgtaacaactactggcctggttccaacagaaacctggccaggctcccaggcctctcatcatgatgcatccaacagggccacgtgcatcccagccgaggtcaggtgcaggtgggtctgggacagtactcactctccactatcacgccgacctagacgccgtagaggtacttcgtcgttaccgttttattatttcgttcgtttgggtacgtagtacctaacgttcggtcccgttcccgttccgttacgttttcgggcccgtaacggggaccctaaacgtcgtaggtacgtacgtccgaacggaacgtaaccgttggtacggtctacggtccaaccgtattccgtacggtttccttcgttaacccg

SEQ ID NO: 277900 - DNA, 687 bp, Homo sapiens
  misc_feature: GYAE6OF02IJCZR.29.35.D02.1.454.CMB.1.raw
  modified_base (199)..(199): a, c, t, g, unknown or other
  misc_feature (199)..(199): n is a, c, g, or t
  modified_base (204)..(204): a, c, t, g, unknown or other
  misc_feature (204)..(204): n is a, c, g, or t
tcagatagagtactcacgaccggtgctcgatttagcacacgatagttgggtttgggggaggaactgctcagttaggacccagacggaaccatggaagccccagctcagcttctcttcctcctgctactctggctcccagataccagcggagagattgtgttgacacagtctccagccaccctgtctttgtctccggganaaagngccaccctctcctgcagggccagtcagagtgttaaccaacttacttggccttggttcccaaacagaaacctggaccaggcctcccaggcctcctcatctatgatgcataccaacgacgggccactggacactccccagccaggttcagtggcagtgggtctgggacacggacttcactctaccaccactacacggtcccgcctacgacgtccgtaggaaggttacttccgtaggttacccgtttttaagtttagtttcggtttcgtttcggggtaccgtttacggacctaaacgttcggtaccccgttccccggttacgtttaaccgtttttccgggaccggtaacgggggtaaccctaaaggtcccgttaggggtaacgtacgttaccggaacggtaaccggtaaccgtttacgggtccggtacgttacccggacctaacccgttacttacccggttagttttccccgttactttaaccccg

SEQ ID NO: 277901 - DNA, 561 bp, Homo sapiens
  misc_feature: GYAE6OF02GO16R.29.35.D02.1.454.CMB.1.raw
  modified_base (199)..(199): a, c, t, g, unknown or other
  misc_feature (199)..(199): n is a, c, g, or t
  modified_base (204)..(204): a, c, t, g, unknown or other
  misc_feature (204)..(204): n is a, c, g, or t
tcagatagagtactcacgaccggtgctcgatttagcacacgatagttgggtttgggggaggaactgctcagttaggacccagacggaaccatggaagccccagctcagcttctcttcctcctgctactctggctcccagataccagcggagagattgtgttgacacagtctccagccaccctgtctttgtctccggganaaagngccaccctctcctgcagggccagtcagagtgttaaacactacttggcctggtaccaacagaaacctggccaggctccaggctcctcatctatgatgcatccaacagggccactggcatcccagccaggttcagtgcagtggtctgggacagacttcactctacaccatcacgccgctagacgctgagtacttcgtgtaccgtttattacgttgttcgtttgggtcgttacgctaactcggtccttcccgtacgtaccgttttcggacccgtaacgggacctaaggcgtacggagtacgtcgtacggtaacgtaacgtgtcggtcgtcgcgaccgtacgttctcggttccttctaccg

SEQ ID NO: 277902 - DNA, 904 bp, Homo sapiens
  misc_feature: GYAE6OF02FQD20.29.35.D02.1.454.CMB.1.raw
tcagatagagtactcacgaccggtgctcgatttagcacacgatagttgggtttgggggaggaactgctcagttaggacccagacggaaccatggaagccccagctcagcttctcttcctcctgctactctggctcccagataccagcggagagattgtgttgacacagtctccagccacctgtctttgccgtaccgggagaaagcgccaccctctcctgcgacgggccagtcagagtacgttaacaacttacttggcccttggttacccaaacgaagaaaaccgtcggacccgaacgggcctccccgacggcctccgtaccattctaatgatgaccaatacccgaaacgacggggacctacgtgggacctaacgtcccccacggtcccgtaagggtttaccgaacgggttcgggaccgtaaggggttcgggggttccgttaggggggaaccctaacgggttaaccgtttaccggaaccctttacccgttaccccgaaacccgttaaacgtcccgaacggtaccccgggtacccgtaaaccgggtaccggtaccccggttagggtaacgggttaacgttttacccgttacgggtttaccccggttttttaaacgttttacgttttacgggtttaccggttttacgggggtaccgggttaacggtacccgttaaaccgggttcccgggttacccccgtttaccccgggtttacccgtttaacccggttttttaccggggacccgggttaaccggggggtaaacccgtaaacgggtaccggttacggggtaacggttacgtaaccggaaccggtaaaccggtaaaccggttcgggttaacgggtaccgtacggtacccgtaaccgttaaccgtttaccggtttcgtttaccgtttaccgttacccgg

SEQ ID NO: 277903 - DNA, 778 bp, Homo sapiens
  misc_feature: GYAE6OF02HPQZ8.29.35.D02.1.454.CMB.1.raw
  modified_base (197)..(197): a, c, t, g, unknown or other
  misc_feature (197)..(197): n is a, c, g, or t
  modified_base (202)..(202): a, c, t, g, unknown or other
  misc_feature (202)..(202): n is a, c, g, or t
tcagatagagtactcacgaccggtgctcgatttagcacacgatagttgggtttggggaggaactgctcagttaggacccagacggaaccatggaagccccagctcagcttctcttcctcctgctactctggctcccagataccagcggagagattgtgttgacacagtctccagccaccctgtctttgctccggganaaagngcccacctctcctgcagggccagtcagagtacgttaacaacttacgttggccttggttaccaaacagtaaacctggccaaggcctaccccgaggcctccctcgacttctaactgattgctataccaacgacgggccacgtcggacactcccgagccctaggttacaggtcggactaggttcgggtactaggggaactacggtaccttcacgtcctaccaaccacttccgaaccggacccgtacccgtaacggaccgtaccgtacggtacggttactttacgttcgttacccggttttaatttacgtttcggttacggtttacggggttaccgttaacggtaccgttaaccggttccgggtacccccgttaccccggtttaccgtttaacccgggtttttccgggacccgggttaaccgggggtaacccgttaaaccggtaccggttacgggtaacgtaccgttaccggtaaacgggtaaacccggttaaaccggttcgggtaacgggtcccgttaccggtaaccctacccggtaaccgtttccgtttaccggtttccctttacccgttaaccccgg

SEQ ID NO: 277904 - DNA, 659 bp, Homo sapiens
  misc_feature: GYAE6OF02F889H.29.35.D02.1.454.CMB.1.raw
  modified_base (204)..(204): a, c, t, g, unknown or other
  misc_feature (204)..(204): n is a, c, g, or t
  modified_base (263)..(263): a, c, t, g, unknown or other
  misc_feature (263)..(263): n is a, c, g, or t
tcagatagagtactcacgaccggtgctcgatttagcacacgatagttgggtttgggggaggaactgctcagttaggacccagacggaaccatggaagccccagctcagcttctcttcctcctgctactctggctcccagataccagcggagagattgtgttgacacagtctccagccaccctgtctttgtctccgggagaaagngcccaccctctcctgcagggccagtcagagtgttaacaactacttggcctggtaccaanagaaacctggaccaggcctcccgaggcctcctcatctatgatgacataccaacgacgggccacgtgcactcccagccgtaggttcaggtcggctaggtcgggtcgtgggactaggtaccttcacttcctacacctatccgacgcccgtccgtacggacgtccgtaggacggtactttcgtacggttaccgtttatttacgtttcggttcggtttcgggtcgttacgtaccgtaacgttccggtcccgttacccggttccgttaccggttttcgggacccggtaacggggtaaccgtacggtacggtacggacgtacgtacgaacggtaacggtaacgttcgggtaccggtcgtcgtacccgtaccgtacgttccgttcgttccttaccgttacccg

SEQ ID NO: 277905 - DNA, 718 bp, Homo sapiens
  misc_feature: GYAE6OF02F8JJX.29.35.D02.1.454.CMB.1.raw
  modified_base (204)..(204): a, c, t, g, unknown or other
  misc_feature (204)..(204): n is a, c, g, or t
tcagatagagtactcacgaccggtgctcgatttagcacacgatagttgggtttgggggaggaactgctcagttaggacccagacggaaccatggaagccccagctcagcttctcttcctcctgctactctggctcccagataccagcggagagattgtgttgacacagtctccagccaccctgtctttgtctccgggagaaagngccaccctctcctgcagggccagtcagagtgttaacaactactggcctgttccaacagaacctggccaggctccaggctcctcatctatgatgcactaccaacgacgggccacgtggcctactcccgagtccgaggttcaggtcggacgtaggtggggtaccgtaggggactacggtaccttacgaaccttcctaccaaccgtactccgaccgtcccgtaccgtaacggacgtccgtacggaggttacgtttcgtcggttaccgttttaatttagtttcggttcgtttcgggggtaccgttaacggtacctaacggttccggttaccccgttcccggttaccgtttaccggtttttaccgggacccggttaacgggggtaaacccgtaacggtccgggtaaggggtacgtacgttaccgaaacgggtaacccggtaacggttcggggtacggttaccgtacggtaccctaacccggttacgtttaccgtttcggttaccctttaccgttacccg

SEQ ID NO: 277906 - DNA, 748 bp, Homo sapiens
  misc_feature: GYAE6OF02IZ46U.29.35.D02.1.454.CMB.1.raw
  modified_base (199)..(199): a, c, t, g, unknown or other
  misc_feature (199)..(199): n is a, c, g, or t
tcagatagagtactcacgaccggtgctcgatttagcacacgatagttgggtttgggggaggaactgctcagttaggacccagacggaaccatggaagccccagctcagcttctcttcctcctgctactctggctcccagataccagcggagagattgtgttgaacacagtctccagccaccctgtctttgtctcggganaagacgccaccctctcctgcgagggccagtcagagtagttaacaacttcgtcggcctggttaccaacagaaaccgtggcctaggcctccgaggtcctcctactactctactagactcgactacgtacccaacggacgggtccacgtcggacctactcccgacgtacccgtaggttaccgacggttcgggacgtaacggggtttcggggtcccggttaaaggggggaacctaacggttacccttttaccgacccgttacccgtacccgtaaccctaacggtaacccgtcccggacccggttacccgtaacggtaccggtacccgtaggtaaccggttacgttaccgttccgggttacgttttaactttacggtttcgtttccggttacgggttaccgtacgtaccgtaaccggtccggtacccgttcccgttaccgttacgtttaccggaccgggtaaccgggacgtaacgtacgtaggtacgtcgtacggaacgtaacgtacgtcggtaggaccggtcacgcgtaccgttcgtcttacgtacgttaccg

SEQ ID NO: 277907 - DNA, 261 bp, Homo sapiens
  misc_feature: GYAE6OF02GB01L.29.35.D02.1.454.CMB.1.raw
  modified_base (256)..(261): a, c, t, g, unknown or other
  misc_feature (256)..(261): n is a, c, g, or t
tcagatagagtactcacgaccggtgctcgatttagcacacgatagttgggtttgggacagacttcactctcaccatcagccgcctagagcctgaggattctgccgtttattattgtcttgggcgtagcaactggcctcccgtcacttttggccaggggaccaagctggagatcagacgaactgtggctgcaccatctgtctcatcttcccgccatctgaagtactctatctgagcgggctggcaaggcgcagtagnnnnnn

SEQ ID NO: 277908 - DNA, 679 bp, Homo sapiens
  misc_feature: GYAE6OF02H7NBP.29.35.D02.1.454.CMB.1.raw
tcagatagagtactcacgaccggtgctcgatttagcacacgatagttgggtttggggggaactgctcagttaggacccagacggaaccatggaagccccagctcagcttctcttcctcctgctactctggctcccagataccagcggagagattgtgttgacacagtctccagccacctgtctttgctcgggagaaagcgcccacctctcctgcgagggccagtcagagttgttaaacaactacgttggccttggttaccaacacgaaacctggaccaggcctcccgaggcctcctctatctagtcgatcgactactaccgaacgcgggacctacgtcggacctactcccacgtccgtaggttcaggtcggacgtagggtggtacgtggactagtaccttacacgttcctacacctacgtcgaccgtccgtacgtacgccgtacgtaggaggtctttcgtcgttaccttttagtttacgttcggttcggttacgggtacgtacgtacgtacggtccgtccgttacccgtacgtttccggttacggccggtaacggggtaactacgggtcgtaaggtacgtacgttacgacggttaaccgtcggttacgggtcgtaccggtaccgacccgttacgttaacgttccgttacgtttaccctttaccgtaccgtttacccccg

SEQ ID NO: 277909 - DNA, 583 bp, Homo sapiens
  misc_feature: GYAE6OF02HWA2Q.29.35.D02.1.454.CMB.1.raw
  modified_base (262)..(262): a, c, t, g, unknown or other
  misc_feature (262)..(262): n is a, c, g, or t
  modified_base (371)..(371): a, c, t, g, unknown or other
  misc_feature (371)..(371): n is a, c, g, or t
tcagatagagtactcacgaccggtgctcgatttagcacacgatagttgggtttggggaggaactgctcagttaggacccagacggaaccatggaagccccagctcagcttctcttcctcctgctactctggctcccagataccagcggagagattgtgttgacacagtctccagccaccctgtctttgtctccgggagaaagagccaccctctcctgcagggccagtcagagtgttaacaactacttggcctggttaccaanagaaacctggccaggctcccaggcctctcatctatgatgcatccaacgagggtccacgtcggcactccccgagccctaggttcaggtcggcgaggtcgggtctgggacngacttcactctcaccatcacgccgctagcgtcctaggacgtattcgtcgttccgttttattacgtttcgttcgttgggtccgtagacgtaacgttcggcccttcccgttactaccgttttcggacccgaaggggtacccaaggccgttaggagtacgtacgagtacggaacttggtcggacgtgaccacacgttcgtacgttcctagtaccg

SEQ ID NO: 277910 - DNA, 763 bp, Homo sapiens
  misc_feature: GYAE6OF02G339D.29.35.D02.1.454.CMB.1.raw
  modified_base (197)..(197): a, c, t, g, unknown or other
  misc_feature (197)..(197): n is a, c, g, or t
tcagatagagtactcacgaccggtgctcgatttagcacacgatagttgggtttgggggaggaactgctcagttaggacccagacggaaccatggaagccccagctcagcttctcttcctcctgctactctggcctccagataccgagcggagagattgtgttgacacagtctccagccacctgtctttgctcggganaaagacgccacctctcctgcgagggccagtcagagtagttaacaacttacgttggccttggttaccaaacgaacggtaaaaccctggaccaacgggtcctaccccgaggtcctcctactatcctaagtgaattcggaccaactacccgaaaacgcgggtacccacgtacggaccaccttacccgagtaccccgtagggtttccgaaggtcggaccgtaagggttcggggtaccgtaggggactaacggtacctttacgaccttaccgtaccaacctacgttacgaccgacccgtacccgtaacggaccgtacctagggacgttacgttcgtacgttaccgtttttagttacgtttacgttcggttagggtacgtaacgtacgtaaacgttccggtacctttacccgttacgttaccgttttcgggacccggtaacggggtaacctaacggacgttacgggacgtaacgttacggaaaccggtaaccggtaaacggttcgggtaccggtacgttaccgaccgtaaccgttacttacccggtttagttacccgtttaccttaacccgg

SEQ ID NO: 277911 - DNA, 686 bp, Homo sapiens
  misc_feature: GYAE6OF02G4REI.29.35.D02.1.454.CMB.1.raw
tcagatagagtactcacgaccggtgctcgatttagcacacgatagttgggtttgggggaggaactgctcagttaggacccagacggaaccatggaagccccagctcagcttctcttcctcctgctactctggctcccagataccagcggagagattgtgttgacacagtctccagccaccctgtctttgtctccgggagaaagacgccacctctacctgcagggccagtcagagtgttaacaactacttggaccttggttccaactagaaacctggccaggcctcccaggcctcctcatctatgatcgacatacccaagagggaccacgtcggacctactcccgaagcctaagggtttccaaggttcggaccgagggtttcgggtacgttagggacaggttaaccttcaaccttctaccgacctaagttccaccgcccgtacccgtacgaacgtccgtacggtacggtactttcgttacggttacccgttttatttacgtttcgtttcggtttcgggtacgttacgtaccgtaacggtccggtcccgtttaccccggttcttaccgttttacggccggttaacggggaccgtaacgtcgtaggtacgtacgttacggaacgtacggtaacgtacggtacggtacgttcggaccaccgttaacttccgttacgttcctaccgttacc

SEQ ID NO: 277912 - DNA, 756 bp, Homo sapiens
  misc_feature: GYAE6OF02GYUI5.29.35.D02.1.454.CMB.1.raw
  modified_base (219)..(219): a, c, t, g, unknown or other
  misc_feature (219)..(219): n is a, c, g, or t
  modified_base (342)..(342): a, c, t, g, unknown or other
  misc_feature (342)..(342): n is a, c, g, or t
  modified_base (682)..(682): a, c, t, g, unknown or other
  misc_feature (682)..(682): n is a, c, g, or t
  modified_base (728)..(728): a, c, t, g, unknown or other
  misc_feature (728)..(728): n is a, c, g, or t
tcagatagagtactcacgaccggtgctcgatttagcacacgatagttgggtttgggggaggaactgctcagttaggacccagacggaaccatggaacgccccagctcagcttctcttcctcctgctactctggcctcccagactaccaggcggagagtattgtgttgacacagtcctaccacgccctaccttgttctttcggtaccgtaccggggaaanaaacgccgcccctaacccttctcccgtgacgacgggacctagtcaagtacgttacgttaaaccacttacgttcggcgttacgttaaccaaacgacgtaaaccgtcgaccgtaggcctacccgnggtcctccctatagttctagtacgatacgacctaccgtaacccgaacggaccgggtacccaacggtccggtaccaccgttcccgaaggtccgtaaggttccggagggtcggacggttacggggtgggttaccgaacgggaaccgtacggttcctaccgcctttaaccaccgtaccgtactaccggaccgacccgtacgtacgaccggtcgtacggttacgttcttacgttccgttaacgttttatttagttcggtttacggttaggtaccttacgtacgtaaccggtccgtcccgttaccgttcgtttaaccggtcggacggtacgggtaacaggtacgngtacgtacgacggtacgtacggtacgtcggtcgacgtccgtaaccncgttacctcgtttctaccttcgtacccg

SEQ ID NO: 277913 - DNA, 643 bp, Homo sapiens
  misc_feature: GYAE6OF02I3CRB.29.35.D02.1.454.CMB.1.raw
tcagatagagtactcacgaccggtgctcgatttagcacacgatagttgggtttgggggaggaactgctcagttaggacccagacggaaccatggaagccccagctcagcttctcttcctcctgctactctggctcccagataccagcggagagattgtgttgacacagtctccagcccacctgtctttgtctccgggagaaagcgcccaccctctcctgcgacgggccagtcaggtagtagtaacaactacgttggcctggttaccaacgacgaaacctggccgaggcctcccgaggcctcctctactctatgatgcactccaacgcggccacgtcggacacctcccgagcccgtaggttccaggtcggcgagggttcgggtcgtgggactacggtaccttcaccgttcctacgacctacgtaccacggacccgaccgtacgacgcccgtagggacgtactttcgtacgtaccgttttattacgtttgttcgttgggtcgttacgacgtacgtcgtcccttcccgtcgttaccgtttcggaccggtacggggaaccgtaggtccgtaggacgtactaccgaaggtacgtaacgtcgggtacgcgtacgaccaccgttagtccgtacgttccttacgttacccg

SEQ ID NO: 277914 - DNA, 660 bp, Homo sapiens
  misc_feature: GYAE6OF02GP696.29.35.D02.1.454.CMB.1.raw
  modified_base (306)..(306): a, c, t, g, unknown or other
  misc_feature (306)..(306): n is a, c, g, or t
tcagatagagtactcacgaccggtgctcgatttagcacacgataggtttggggtttgggggaggaactgctcagtttagggacccagacggaacctatggaagcccagctcagcttctcttcctcctgctactctggctcccaggataccagcggagagattgtgttgacacagtctccagccacctgtctttgtcgtccggggagaaagagccgaccctctctgccaggggcctaggtcagtagtgttaaacactacttggcctggttccaacaagaaacctggccaggctcccgaggctccgtnatctatgaatggcagaccaagacgggcctagtggacactccagccagttacagtcggactaggtcggtctggggaacaggtaccttacacttcacaaccattccgagaccgtacgtaggacgtctacggagtacttcgtagtaccgtttattagttagtacgtttacgggacgtacgaccgtaacggttcccggtaccgttacccgttccgtttaacggtttcggtaccggtaaacgggggtacccttaaaggacgttagggaacgtacggttaccgtaacggtaaccggtaaacgttcgggtaccggttacgtacgaccgtactacgttacgtccgttacgttaccgttaccg

SEQ ID NO: 277915 - DNA, 696 bp, Homo sapiens
  misc_feature: GYAE6OF02H53SY.29.35.D02.1.454.CMB.1.raw
  modified_base (203)..(203): a, c, t, g, unknown or other
  misc_feature (203)..(203): n is a, c, g, or t
  modified_base (264)..(264): a, c, t, g, unknown or other
  misc_feature (264)..(264): n is a, c, g, or t
tcagatagagtactcacgaccggtgctcgatttagcacacgatagttgggtttggggaggaactgctcagttaggacccagacggaaccatggaagccccagctcagcttctcttcctcctgctactctggctccagataccagcggagagattgtgttgacacagtctccagcccaccctgtctttgtctccgggagaaagngccaccctctcctgcagggccagtcagagtgttaaacaactacttggccttggttaccaanacgaaacctggaccaggcctcccaggctcctcatctatgatcgctactaccaacgacgggaccactggccaacgtcccagtccgaggttcaggtcggacaggtgggtctgggacacggtacttcgactcgtaccaccgtatccgacgccgacctaggacgcctaggaggtactcgtacgtaccgttttaattacgtttacggttcgttacggggtacgttacggtacgtaaaccgttcggtacccgttaccccggttaccgtttacccggttttccgggacccggttaaccgggggaaacccgtaaacggtaccggtacgggtagtaacgttaccggaacggtaaaccggtaaccgttacgggtaccgggtacgttaccggtacccgtaacccgttaacgttacccggttacggtttcccttaccgtacccg

SEQ ID NO: 277916 - DNA, 602 bp, Homo sapiens
  misc_feature: GYAE6OF02FMYNJ.29.35.D02.1.454.CMB.1.raw
  modified_base (391)..(391): a, c, t, g, unknown or other
  misc_feature (391)..(391): n is a, c, g, or t
tcagatagagtactcacgaccggtgctcgatttagcacacgatagttgggtttgggggaggaactgctcagttaggacccagacggaaccatggaagccccagctcagcttctcttcctcctgctactctggctcccagataccagcggagagattgtgttgacacagtctccagccacctgtctttgtctccgggagaaagagccaccctctcctgcagggccagtcagagtgttaacaactacttggcctggttccaacacgaacctggccagctccaggctcctcatctatgatgcactccaacacgggccactcggcactccccgagcctaggttcaggttcggcaggtgggtcgtgggacagtactcactctcaccatcgacgccnctaggacgccgtgacgtactttacgtcgttaccgtttatttacgtttcggttcgtttcgggtcgtacgtcgtaaccgtcggtcccgtcccgttcgttaccgttttggaccgtacgggtaccgaacgtcgtagggtacgtacgtacgaggtaacgtaacgttggacggttcgtacggtaccgtaccctagttccgttcgtttcgtccttacc

SEQ ID NO: 277917 - DNA, 785 bp, Homo sapiens
  misc_feature: GYAE6OF02HRWOF.29.35.D02.1.454.CMB.1.raw
  modified_base (200)..(200): a, c, t, g, unknown or other
  misc_feature (200)..(200): n is a, c, g, or t
  modified_base (263)..(263): a, c, t, g, unknown or other
  misc_feature (263)..(263): n is a, c, g, or t
tcagatagagtactcacgaccggtgctcgatttagcacacgatagttgggtttgggggaggaactgctcagttaggacccagacggaaccatggaagccccagctcagcttctcttcctcctgctactctggcctcccagataccagcggagagattgtgttgacacagtctccagccaccctgtctttgtctccggganaagacgccacctctcctagcagggccagtcagagtgtaaacaacttattggcctggttccaanagaaacctggaccaggcctccaggcctctcactctagtgatgcctatacccaaacgacggccccaacgtcgggacctacgtacccacggtacccgtaacggtttcgaacggttcggtacccgtagggttcgggggttccggtacgggggaacgtaacggtaaccgtttccgaaccgtttcccgtacaaccccgtagttaccgtaaccggccgtacccgtaacggaaccgtacccgtgggaacgttacgtttccgtcggttaacccgttttttatttaagttttcggtttccgggtttacggggttaccgttaacggtaccgtaaacccggttccgggttcccccgtttaaccccggttactttaacccgggtttttccgggaacccgggtaacgggggtaaacccgtaaacggtcggttacgggaacgtacgttaccgtaacggtaaccggtaaccggttgggtaccggtccgttaccggacctaccgtacgtttcccgtacgtttaccttaccgttaaccc

SEQ ID NO: 277918 - DNA, 662 bp, Homo sapiens
  misc_feature: GYAE6OF02H1FGY.29.35.D02.1.454.CMB.1.raw
  modified_base (199)..(199): a, c, t, g, unknown or other
  misc_feature (199)..(199): n is a, c, g, or t
  modified_base (212)..(212): a, c, t, g, unknown or other
  misc_feature (212)..(212): n is a, c, g, or t
  modified_base (264)..(264): a, c, t, g, unknown or other
  misc_feature (264)..(264): n is a, c, g, or t
tcagatagagtactcacgaccggtgctcgatttagcacacgatagttgggtttggggaggaactgctcagttaggaccagacggaaccatggaagccccagctcagcttctcttcctcctgctactctggctccagataccagcggagtagattgtgttgaacacgagtctccagccaccttgtctttgctccgggganaaagcgccacctntcctgccagggccagtcagagtgttaaaccaactacttggctggttaccaanagaaacctgaccaggctccaggtctctcatctatgatcgacagtaccaacgagggccacgtggactacgtcccagccgtaggttcaggtcggctaggttgggtctgggaactagtacttcgaactccgtcgaccgtactacacgtccgtaccgtacgtacgtccgtaggacgtacgttaccgttacgttaccgtttaacgtttagtttcgttacgttcggacgttaacgactaaccgtcggtacccgttaccgttccgttacgttttacggaccgtaaccgggtaaccgtaacggtacgtaggtacgtacgtacgacggtaacggtaaccgtaggtacggtaccgtacggtacccgtaaccgttacgttaccggttacgttaccgttaccgttacccg

SEQ ID NO: 277919 - DNA, 605 bp, Homo sapiens
  misc_feature: GYAE6OF02I2TDT.29.35.D02.1.454.CMB.1.raw
  modified_base (206)..(206): a, c, t, g, unknown or other
  misc_feature (206)..(206): n is a, c, g, or t
  modified_base (219)..(219): a, c, t, g, unknown or other
  misc_feature (219)..(219): n is a, c, g, or t
  modified_base (276)..(276): a, c, t, g, unknown or other
  misc_feature (276)..(276): n is a, c, g, or t
tcagatagagtactcacgaccggtgctcgatttagcacacgatagttgggtttgggggaggaactgctcagttaggacccagacggaaccatggaagccccagctcagcttctcttcctcctgctactctggctccagataccagcggagagattgtgttgacacagtctccagccaccctgttctttgtcctccggggagaaagngcccacctctccngcagggccagtcagagtgtaacactctgcctgtcacagaactgcagctccagctccnatctatgatcgctatccaacgcgggccacgtcgacctactcccgaggcctagggttcaggtcggctagggtcggtacgtgggactagacgttaccacttccacacctatccgacgccgactaggcgtacgtaggacgtacttcgttacgttacgtttatttagttcggttcgttcgggtacggttacgtaccgtaaccggttcggtacccgttaccggttaccgttacggtttccgggaccgtacggggtaaccacggtccggtaggtacgtacgtacggaacggtacgtaacgtcggtcgcgtgtaccactcgtcgtctacttctccg

SEQ ID NO: 277920 - DNA, 688 bp, Homo sapiens
  misc_feature: GYAE6OF02FTHQY.29.35.D02.1.454.CMB.1.raw
  modified_base (199)..(199): a, c, t, g, unknown or other
  misc_feature (199)..(199): n is a, c, g, or t
  modified_base (204)..(204): a, c, t, g, unknown or other
  misc_feature (204)..(204): n is a, c, g, or t
  modified_base (263)..(263): a, c, t, g, unknown or other
  misc_feature (263)..(263): n is a, c, g, or t
tcagatagagtactcacgaccggtgctcgatttagcacacgatagttgggtttgggggaggaactgctcagttaggacccagacggaaccatggaagccccagctcagcttctcttcctcctgctactctggctcccagataccagcggagagattgtgttgacacagtctccagccaccctgtctttgtctccggganaaagngccaccctctcctgcagggccagtcagagtgttaacaactacgttggcctggttccaanagaaacctggccaggctcccaggctcctcatctatgatgacataccaacgacgggccacgtcggcactcccacggcctaggttcaggttcggacgtagggttcggggtccgtaggggaacctacggtaaccttccgaaccgttccctaccaaaccccgtattaccgaccggtacccgtacccgtaacggacgtaccgtagggtaacggtacgttcgttacggttaccgttttagtttacgtttcggttcggtttcgggtacggttacgtccgtaacgtcggtcccgttcccgttccgtaccgttttcgggaccggtacggggtaaccgtaacggtcgtagggacgtacgtacgtaacggtaacggtaacgttacggtacggtcgtacgacgtaccgtacgttccgttcgttaccttacgtacccg

SEQ ID NO: 277921 - DNA, 688 bp, Homo sapiens
  misc_feature: GYAE6OF02GYZ5E.29.35.D02.1.454.CMB.1.raw
  modified_base (198)..(198): a, c, t, g, unknown or other
  misc_feature (198)..(198): n is a, c, g, or t
  modified_base (214)..(214): a, c, t, g, unknown or other
  misc_feature (214)..(214): n is a, c, g, or t
tcagatagagtactcacgaccggtgctcgatttagcacacgatagttgggtttgggggaggaactgctcagttaggacccagacggaaccatggaagccccagctcagcttctcttcctcctgctactctggctcccagataccagcggagagattgtgttgacacagtctccagccacctgtctttgtctccggganaaagcgccacctctcngcgacgggccagtcagtgtagttaaccaacttacgtggccttggttaccaacaacgaaacctggaccaggcctccgaggtcctcctcattctatgatcgctacgtaccgaacggacgggcctacggtcggacctaaccgtccccgaacggtcccgtaagggttccaaggggttcggacgtacggggtttcggggtacggtaggggaacctacggtaaccttcgaaccttcctaccaaccgtatcccgacgtccgaccgtacgacgtccgtacggtaggtacttcgtcgttacgtttagttagttcgttcggttcggtcgtacgacgtacgtcgtccgtccgttcgttacgtttcggaccggtacgggaaccgtacggtacgtacggacgtacgtacggaacggtaacggtaacggttcggtacggtcgtacgtaccgtaccttaccgttccgttacgtttccttacgttacccg

SEQ ID NO: 277922 - DNA, 606 bp, Homo sapiens
  misc_feature: GYAE6OF02JYQ04.29.35.D02.1.454.CMB.1.raw
  modified_base (204)..(204): a, c, t, g, unknown or other
  misc_feature (204)..(204): n is a, c, g, or t
tcagatagagtactcacgaccggtgctcgatttagcacacgatagttgggtttgggggaggaactgctcagttaggacccagacggaaccatggaagccccagctcagcttctcttcctcctgctactctggctcccagataccagcggagagattgtgttgacacagtctccagccaccctgtctttgtctccgggagaaagngccaccctctcctgcagggccagtcagagtgttaaacaacttacttggccttggttaccaaacagaaacctggaccaggctcccaggcctcctcatctatgatgcatccaacacgggccacgtggcactcccgacacccgtaggttccaggtcggcgaggttcggggtctgggggacagtaccgttcaacctcgtcacctatcacgccgctacgcgccgtggacgtattcgtagtcctttaagttattgtttcgttaggtccggtagtctaacggttgtccctccgttcgtacgtttcgggacccgtaggggtacctaacggtcgtagggtacgacttacggtaagccggtaaacttggtcggtacgtcggacctaccgtattcgtaggttactccttaccg

SEQ ID NO: 277923 - DNA, 602 bp, Homo sapiens
  misc_feature: GYAE6OF02JD4NA.29.35.D02.1.454.CMB.1.raw
  modified_base (541)..(541): a, c, t, g, unknown or other
  misc_feature (541)..(541): n is a, c, g, or t
tcagatagagtactcacgaccggtgctcgatttagcacacgatagttgggtttgggggaggaactgctcagttaggacccagacggaaccatggaagccccagctcagcttctcttcctcctgctactctggctcccagataccagcggagagattgtgttgacacagtctccagccaccctgtctttgtctccgggagaaagagccaccctctcctgcagggccagtcagagtgttaacaactacgttcggcctggttaccaacagaaaacctggccaggcctccaggctcctcactctatgatgcactccaacgacgggccagtcggcactcccacgcctacggttcacggtggacgaggtcgggtctggggacacggtacttcgacttcacctaccatcacgcccgacctacggcgccgtaggaggtcttcgtcggttacgtttatttagttgttcgttacgggcttaacgctaaccggtcggtcccttccgttcttacgttttcggaccggtacgggacctaacggtcgtgggaacngtacgaacggtacgtaacttgggtacgtcgtacgccactacgtcttcgttcctactacccg

SEQ ID NO: 277924 - DNA, 574 bp, Homo sapiens
  misc_feature: GYAE6OF02FP3AT.29.35.D02.1.454.CMB.1.raw
  modified_base (204)..(204): a, c, t, g, unknown or other
  misc_feature (204)..(204): n is a, c, g, or t
tcagatagagtactcacgaccggtgctcgatttagcacacgatagttgggtttgggggaggaactgctcagttaggacccagacggaaccatggaagccccagctcagcttctcttcctcctgctactctggctcccagataccagcggagagattgtgttgacacagtctccagccaccctgtctttgtctccgggagaaagngccaccctctcctgcagggccagtcagagtgttaacaactacttggcctggttccaacagaaacctggaccaggctcccaggcctcctcatctatgatgcatccaacgagggccacgtggcatccccagccaggttcaggtgcgaggtggtctgggacagacttcactctcaccatcacgccgctacgacgccgtgacggtattcgtggtaccgttttattacgttgttcgttgggtcgtagctaacgtcggtccctcccgtactacgtttcggccgtaacggggaccacgtcgtaggagtacgtcgaacggacgtaacgttgggtcgtcgtcgccgtaccgtacgttccgttcgttccttaccgtaccg

SEQ ID NO: 277925 - DNA, 597 bp, Homo sapiens
  misc_feature: GYAE6OF02JV6P9.29.35.D02.1.454.CMB.1.raw
  modified_base (149)..(149): a, c, t, g, unknown or other
  misc_feature (149)..(149): n is a, c, g, or t
  modified_base (195)..(195): a, c, t, g, unknown or other
  misc_feature (195)..(195): n is a, c, g, or t
  modified_base (200)..(200): a, c, t, g, unknown or other
  misc_feature (200)..(200): n is a, c, g, or t
  modified_base (228)..(228): a, c, t, g, unknown or other
  misc_feature (228)..(228): n is a, c, g, or t
  modified_base (231)..(231): a, c, t, g, unknown or other
  misc_feature (231)..(231): n is a, c, g, or t
  modified_base (255)..(255): a, c, t, g, unknown or other
  misc_feature (255)..(255): n is a, c, g, or t
tcagatagagtactcacgaccggtgctcgatttagcacacgatagttgggtttgggaggaactgctcagttaggacccagacggaaccatggaagccccagctcagcttctcttcctcctgctactctggctcccagataccagcgganagattgtgttgacacagtctccagccacctgtctttgctccggganaaagngccacctctcctgcagggccaggtcagngtntaacactattggcctggttccaanagaaacctggccaggctccgaggctcctcagtctatgatgcatccaagtggccatggcatcccagccaggttcaggtgcaggtcggtctagggactagacttcacgtctcaccatcgacgccgactagacgtccctaggtacggtatttcgtacgtacccgttttattacgttcggttacgtttacgggccgttaaggaccgtaagtttcgggaccccttccggttacttaccggttttcggacccgtacggggaacctacgtcgttacggagtactacgacgtaacgtagtcggtacgtccttacgaccctaaccgtattccgttacgttccttattaccg

SEQ ID NO: 277926 - DNA, 744 bp, Homo sapiens
  misc_feature: GYAE6OF02JFFLO.29.35.D02.1.454.CMB.1.raw
  modified_base (111)..(111): a, c, t, g, unknown or other
  misc_feature (111)..(111): n is a, c, g, or t
tcagatagagtactcacgaccggtgctcgatttagcacacgatagttgggtttgggggaggacgtgctcagttaggaccagacggaaccatggaagcccagctcagcttcncttctctgctactctggctccagataccagcggagagattcgtagttgaacacagtcctccagcccaacctgtcttgtctccgggagaaagtcgccacctctcctagcgagggccagtccagtacgtacgttaaaccacttacgttggaccttggttaccaaacgacgtaaaacccgttcggaccctaacgggtaccttaccccgaagggtcccttaccctacctacttaccgttaaccttagaacgttcgaccacgttaccccaaacggacgggccccaacgttggaaccactccccgaggtaccctacggttccagggtcggacctagggtcgggtctacggggaactacggtaccttactacccgtcgtccaactacgtacgtacgcccgtaccgtagacgtccgtacggacgtacgttcgtcgttacctttagttacgttcgtacgttcggtacgtacgtacgtaaccgtgtacccgttccgtacgttacgtttccggacgtacgggtaccgaacggtccgtagggtaaccgtacgaaccgtacggtaaccggtaaccgttacgggtcggacgttaccggtaccgtaaccgtaccgtttaaccgttccggttaccttcccgttaaccgg

SEQ ID NO: 277927 - DNA, 721 bp, Homo sapiens
  misc_feature: GYAE6OF02GVVGR.29.35.D02.1.454.CMB.1.raw
  modified_base (200)..(200): a, c, t, g, unknown or other
  misc_feature (200)..(200): n is a, c, g, or t
tcagatagagtactcacgaccggtgctcgatttagcacacgatagttgggtttgggggaggaactgctcagttaggacccagacggaaccatggaagccccagctcagcttctcttcctcctgctactctggctcccagataccagcggagagattgtgttgacacagtctccagcccaccctgtctttgtctccggganaaagagcccaccctctcctgcagggccagtcagagtgttaacaactacgttaggccttggttaccaaacaagaaaccgtggaccaggcctacccaggcctcctcatctatgatgacactacccaaacgacgggaccacgtggacactaccccgacgaccgtacggttacaaggtcggacgtaggttcgggtcggtagggactagtaccgttcaaccgttctacccgaaaccctactaccgaacgcccggtacctaacggaccgtccgtaggaacggtacttcgtacgttaccgtttatttacgtttacggtttcgttggggtaccgtaagtacctaacgttccggtcccttacccggtttacgtaccgttttacgggacccggtaacggggtaaacccgtaaggtaccgtagggtacgtagttacccgaacggtaaccggtaacggttacggtacgggtaccgtaccgggtacctaaccggttaaccgttccgtttaccggtttcccttaccgtaaccccg

SEQ ID NO: 277928 - DNA, 724 bp, Homo sapiens
  misc_feature: GYAE6OF02GXA5R.29.35.D02.1.454.CMB.1.raw
tcagatagagtactcacgaccggtgctcgatttagcacacgatagttgggtttggggaggaactgctcagttaggacccagacggaaccatggaagccccagctcagcttctcttcctcctgctactctggctcccagataccagcggagagattgtgttgacacagtctccagccaccctgtctttgtctccgggagaaagagcccaccctctcctgcagggccagtcagagtgttaacaactacttggcctggttccaacagaacctggccaggcctcccgaggcctcctcatctatgatgcactccaacgacgggcccaacgtggaccactccccgagcccgtaggtttccaggtcggcgtaggttcggggtcgtaggggacaggtacctttaccgaaccttcccgtaccaacctacgtaccgaccggacccgtaccgtaacggccgtaccgtagggtagttactttcgttaccggtttaccgtttttatttacggtttcggtttccgggtttcggggtaccgttaacgtaccgtaaccggttcccggttcccccgtttaccccggttaccgtttttaccggtttccgggaacccggggtaaccggggtaaacccgtacggtccggtagggaacgttactaaccggtaacggtaaccggtaagttcgggtacgtccgtacgacccgtaccttacgttcgttccgttaccttacgtaccccg

SEQ ID NO: 277929 - DNA, 817 bp, Homo sapiens
  misc_feature: GYAE6OF02GF786.29.35.D02.1.454.CMB.1.raw
tcagatagagtactcacgaccggtgctcgatttagcacacgatagttgggtttgggggaggaactgctcagttaggacccagacggaaccatggaagccccagctcagcttctcttcctcctgctactctggctcccagataccagcggagagattgtgttgacacagtctccagccaccctgttctttgtcgtccgggagaaagacgccaccctctcctgccgacgggccagtccagagttcgttaaccaacttacgttggcccttgggtttacccaaacgtaacgaaaacccttcgggacccgaacgggtaccttacccccgaacgggccttcccctactaacttcctaagttcggaattcgacctactacccgaaaaccggaccggggtacccaacgttcgggacctaacccgtacccccgaacggtccccgtaaggggtttccgaacgggttcggccgtaacggggtcggggggttaccgttacgggggacctaacgggtaactttcccgaaccgttccctaccgacctacgttccgaccgacccgtaccgtacgtaacggtcccgtaggtacggttacgtttcgttacggtaccgttttagtttcgttacgttcggtttacgggtcgttacgtacgtaccgttacggtcccgttcccgtaccgtttacgttttccggaccggttaacgggacccgtaaaggtcgtacgggaacgtacgtaaccgtacggtaaccggtaacggttcggttacggaccgttaccgacccgtaaccgtaccgtttccgttacggtttaccgttaccgttaacccg

SEQ ID NO: 277930 - DNA, 550 bp, Homo sapiens
  misc_feature: GYAE6OF02F3ARQ.29.35.D02.1.454.CMB.1.raw
  modified_base (204)..(204): a, c, t, g, unknown or other
  misc_feature (204)..(204): n is a, c, g, or t
tcagatagagtactcacgaccggtgctcgatttagcacacgatagttgggtttgggggaggaactgctcagttaggacccagacggaaccatggaagccccagctcagcttctcttcctcctgctactctggctcccagataccagcggagagattgtgttgacacagtctccagccaccctgtctttgtctccgggagaaagngccaccctctcctgcagggccagtcagagtgttaacaactacttggcctggttccaacagaaacctggccaggctcccaggctcctcatctatgatgcatccaacgagggccaacgtggcatccccagcccaggttccagtggcaggtgggtctgggacagacttcacttctcaccgtatcacgccgcctacgacgcctggacggtattccgtgtccgtttatttagttgttcgttggtcgtagcacgtcggcctccgtctacgtttcggccgtacgggaccacgcgtaggagatcgagtaacgtaacgtgtacggtcgtcgctaccacttctcgttcttctaccg

SEQ ID NO: 277931 - DNA, 750 bp, Homo sapiens
  misc_feature: GYAE6OF02F9IGQ.29.35.D02.1.454.CMB.1.raw
  modified_base (205)..(205): a, c, t, g, unknown or other
  misc_feature (205)..(205): n is a, c, g, or t
tcagatagagtactcacgaccggtgctcgatttagcacacgatagttgggtttggggaggaactgctcagttaggacccagacggaaccatggaagccccagctcagcttctcttcctcctgctactctggctcccagataccagcggagagattgtgttgacacagtcttccagcccaccctgtctttgtctccgggagaaagngcccacctctcctgcagggccagtcagagtgttaacaacttacttggccttggttccaaagagaaacctggccaggcttccgaggcctcctcatctatgatgctactaccaacgagggaccacgtggctaacctcccaacgtcccgtaggttccaggttcggacgtagggttcgggttccgtagggggaccacgttaccgttcaaccttcttacccaaccgtacttaccgaaccgcccgtacccgtaacggaccgtccgtacgggacggtacgtttacgttacggtttccgttttaagttttacgtttacggtttccggtttacggggttacggttacggtaccgtaaaccggttccgggttaccccgtttaccccggttccgtttaacccggtttttaccggggacccggttaaccggggggtaacccttaaacgggtaccgttacgggaacgtacgtaccggtaacgggtaccgggtaaccgttcgggttacggccgtaggtaccctaccgtaacgttccgtttacgttccttacgttacccg

SEQ ID NO: 277932 - DNA, 634 bp, Homo sapiens
  misc_feature: GYAE6OF02H4E8A.29.35.D02.1.454.CMB.1.raw
  modified_base (262)..(262): a, c, t, g, unknown or other
  misc_feature (262)..(262): n is a, c, g, or t
  modified_base (327)..(327): a, c, t, g, unknown or other
  misc_feature (327)..(327): n is a, c, g, or t
  modified_base (365)..(365): a, c, t, g, unknown or other
  misc_feature (365)..(365): n is a, c, g, or t
tcagatagagtactcacgaccggtgctcgatttagcacacgatagttgggtttgggggaggaactgctcagttaggacccagacggaaccatggaagccccagctcagcttctcttcctcctgctactctggctcccagataccagcggagagattgtgttgacacagtctccagccaccctgtctttgtctccgggagaaagagccaccctctcctgcagggccagtcagagtgttaacaactacttggcctggttccaanagaaacctggccaggctcccaggctcctcatctatgatgcatccaacacgggccacgtggctacncccagccgaggttcagtggcgaggtcgggtctgggacngacttcactctcacactcgacgccgaccgtacgcgtccgtggaggtacttcgtcggttaccgtttttatttacgtttcggtttcgtttggggtcgttacgccgtaaccgttcgggtcccgttccccgtccgttaccgtttttccgggacccgtaacggggaaccgaaacggccgttagggacgtactaccggaacggtaaccgtaacggttcgggtcgtaccgtcggtaccaacccgtacgttcccgtttcggttacctttcttacccg

SEQ ID NO: 277933 - DNA, 661 bp, Homo sapiens
  misc_feature: GYAE6OF02GW0XD.29.35.D02.1.454.CMB.1.raw
tcagatagagtactcacgaccggtgctcgatttagcacacgatagttgggtttgggggaggaactgctcagttaggacccagacggaaccatggaagccccagctcagcttctcttcctcctgctactctggctcccagataccagcggagagattgtgttgacacagtctccagccaccctgtctttgtctcgggagaaagagccacctctcctgcagggccagtcagagtgttaacaacttacttggccttggttaccaacagaaacctggccaggcctccaggctcctcatctatgatgcactccaagacgggccacgtggacctactcccgagcccgtaaggttcaaggttcggaccgtagggttcggggtctaggggaactacggtacctttacgaacttcctacgaacccattccgacggtcccgaccttaaggaaccgtccgtaggacggtaacgttcgttcgtacccgtttttaattacgtttacgttccgtttgggtaccgttaacggtacctaaccgttcggtcccgttacccgttcgttaccgttttcggacccgtaacggggtaccaacggtcgttaggaacgtacgtacgaacggaacgtaacgtggtacggcgttcgacctacctagtcttcggttacttcgtaccg

SEQ ID NO: 277934 - DNA, 617 bp, Homo sapiens
  misc_feature: GYAE6OF02HHFXA.29.35.D02.1.454.CMB.1.raw
  modified_base (202)..(202): a, c, t, g, unknown or other
  misc_feature (202)..(202): n is a, c, g, or t
tcagatagagtactcacgaccggtgctcgatttagcacacgatagttggggtttgggggaggaactgctcagttaggacccagacggaaccatggaagccccagctcagcttctcttcctcctgctactctggctcccagataccagcggagagattgtgttgacacagtctccagcccaccctgtctttgtctccgggganaaagagccaccctctcctgcagggccagtcagagtgttaacaacttacttcggccttggttaccaacagaaacctggaccaggcctcccaggctcctcatctatgatgcactccaacgacgggccacgtcggcactccccgacgccaggttcaggtcggtcgaggtcgggtcgtagggacacgtcttcactcctcacctactcgacgaccgcctagacgccgtggagactttcgtcgttaccgtttattacgttgttcggttggtcgtcgtaccgtacgtcggtcccttcccggttctaccgttttcggaccgtacggggtaacccaaggccgtaggagcgtacggagtaaccggtacgtacgggtcggtaccttcggacctaccgtactaccgttacgttacttccgttacccg

SEQ ID NO: 277935 - DNA, 714 bp, Homo sapiens
  misc_feature: GYAE6OF02H7SR1.29.35.D02.1.454.CMB.1.raw
  modified_base (709)..(709): a, c, t, g, unknown or other
  misc_feature (709)..(709): n is a, c, g, or t
tcagatagagtactcacgaccggtgctcgatttagcacacgatagttgggtttgggggaggaactgctcagttaggacccagacggaaccatggaagccccagctcagcttctcttcctcctgctactctggctccagataccagcggagagattgtgttgacacagtctccagccacctgtctttgctccgggagaaagacgccacctcgtcctagcgagggccagtacagtagttagttaaaccaacttacgttcgggccttacgggtttaccaaacacggtaaaaccctggacccgaaggccttacccgaaggtcctccctacattctagtgatcgacctaagtacccgaaagaacgggcctaacggttcggactacgtccccgaaggcccgtaagggttccaagggttcggaccggttaacgggttgggggtaccgttaggggaaaccgttacggaaccggtttccgaacttacccgttaccaaccgaacgtttcccgaacggcccgtaaccggtagaaccggtcctaggaacggttacttcggttacgtttaccggttttaatttagttcggtttacgttggggtaccgttacgacgtaccgtcgtcccgttacccgtgtttaccgtttcggaccgtacgggaacctaggcgtgactacgcgagaacgtcgtgtacgcgtagtacgacctgttcgtacgttctntaccg

SEQ ID NO: 277936 - DNA, 286 bp, Homo sapiens
  misc_feature: GYAE6OF02F421Q.29.35.D02.1.454.CMB.1.raw
  modified_base (263)..(263): a, c, t, g, unknown or other
  misc_feature (263)..(263): n is a, c, g, or t
  modified_base (265)..(286): a, c, t, g, unknown or other
  misc_feature (265)..(286): n is a, c, g, or t
tcagatagagtactcacgaccggtgctcgatttagcacacgatagttgggtttgggggacagacttcactctcaccatcgagccgcctagagcctgaggactctgccgtttattattgtcttggcgtagcaagtggcctcccggtcacgttttgccaggggaccaagctggagatcagacgaactgtggctgcaccatctgtcttcaatcttcccgccatctgaagtactctaatctgagcgggctggacaaggcgcaatagngnnnnnnnnnnnnnnnnnnnnnn

SEQ ID NO: 277937 - DNA, 536 bp, Homo sapiens
  misc_feature: GYAE6OF02FQS0J.29.35.D02.1.454.CMB.1.raw
tcagatagagtactcacgaccggtgctcgatttagcacacgatagttgggtttgggggaggaactgctcagttaggacccagacggaaccatggaagccccagctcagcttctcttcctcctgctactctggctcccagataccagcggagagattgtgttgacacagtctccagccaccctgtctttgtctccgggagaaagagccaccctctcctgcagggccagtcagagtgttaacaactacttggcctggttccaacagaaacctggccaggctcccgaggctcctcatctatgatgcatccaacaggccacgtgcatcccagcagttcagtggcaggtgggtctgggacagacttcactctcacctactcgacgccgctacgacgctgaggacttctcgtacctttattattgtcgttcgggcgtagcgacgtcggtcctccgtcgtacgtttcggccgaggggaccacgtcgtaggagactcacggacgaactggtcggcgtcgcaccgtactcgtgttacttctaccg

SEQ ID NO: 277938 - DNA, 645 bp, Homo sapiens
  misc_feature: GYAE6OF02GQQ3T.29.35.D02.1.454.CMB.1.raw
  modified_base (203)..(203): a, c, t, g, unknown or other
  misc_feature (203)..(203): n is a, c, g, or t
  modified_base (292)..(292): a, c, t, g, unknown or other
  misc_feature (292)..(292): n is a, c, g, or t
  modified_base (298)..(298): a, c, t, g, unknown or other
  misc_feature (298)..(298): n is a, c, g, or t
tcagatagagtactcacgaccggtgctcgatttagcacacgatagttgggtttgggggaggaactgctcagttaggacccagacggaaccatggaagccccagctcagcttctcttcctcctgctactctggctcccagataccagcggagagattgtgttgacacagtctccagccaccctgtctttgtctcgggagaaagngccaccctctcctgcagggccagtcagagtgttaacaacttactggccttggttaccaacagtaaacctggccaggctccaggctcctnatctangatgcatccgaacgacgggccacgtggacctatcccaggcccgtaaggttcaaggtcggcgtaggttcggggtcgaggggaacacgtaaccttcaacttccgtaccacctatccgacgccgaccgtacgacggcctaggacggtacgtttcgttcgttccgttttaatttagtttcgtttcgttacgggtcgttaacgtccgtaacgttcggtacccttcccggttcctttaaccgttttcgggacccggtaacggggtaaccaaggtccggtaggacgtactacgaacgaacggtaacgtcggtggtcgtacgtcctaccgtacttcgtcgtttacctacttaccg

SEQ ID NO: 277939 - DNA, 616 bp, Homo sapiens
  misc_feature: GYAE6OF02FVGZ2.29.35.D02.1.454.CMB.1.raw
  modified_base (312)..(312): a, c, t, g, unknown or other
  misc_feature (312)..(312): n is a, c, g, or t
tcagatagagtactcacgaccggtgctcgatttagcacacgatagttgggtttgggggaggaactgctcagttaggacccagacggaaccatggaagccccagctcagcttctcttcctcctgctactctggctcccagataccagcggagagattgtgttgacacagtctccagccaccctgtctttgtctccgggagaaagagccaccctctcctgcagggccagtcagagtgtaacaactacttggcctggttccaacgagaaacctggccaggctcccaggctcctcatctatgatgccatccaacgnggaccacgtggcatcccagccgtaggttcaggtcggcgtaggtcgggtcgtggggacacgtaccttacacctctaccaccactccacgcccgacctacgacgtccgtggaacggtattccgtgttaccgttttatttagttcgttcgttgggtcgttacgacgtacgtcgtcccgtcccgttcgttaccgtttcgggccgtacggggaccaacggtcgtagggacgagtacgaacggtaacggtaacgttcggtcggtacgtcggaccgtaccgtacttaccggttgttacccgttcttacccg

SEQ ID NO: 277940 - DNA, 680 bp, Homo sapiens
  misc_feature: GYAE6OF02FFT02.29.35.D02.1.454.CMB.1.raw
  modified_base (203)..(203): a, c, t, g, unknown or other
  misc_feature (203)..(203): n is a, c, g, or t
  modified_base (261)..(261): a, c, t, g, unknown or other
  misc_feature (261)..(261): n is a, c, g, or t
tcagatagagtactcacgaccggtgctcgatttagcacacgatagttgggtttgggggaggaactgctcagttaggacccagacggaaccatggaagccccagctcagcttctcttcctcctgctactctggctcccagataccagcggagagattgtgttgacacagtctccagccaccctgtctttgctccgggagaaagngccaccctctcctgcagggccagtcagagtgttaacactacttggcctggttaccaanacgaaacctggccaggctcccaggcctctcatctatggatgacactaccgaacacgggccacgtcggcactccccgagccgtaggttccgaggtcggaccgtaggtcggggtacgtacgggggactaacggtacctttccaaccgtttccctacccaacctaacgtccgaaccggtaccccgtacccgttaacggacgtacccgtacgggtaacggttacgtttaccgttaccggttaccgttttaagtttacgtttcgttccggtttacggggtaccgttacggtaccgtaaccgtccggtacccgttcccgttaccgttacgttttaccgggaccgtaaccggggacctaacggtcgtacggagtacgacgacgaacgtacgtggtcgtctcgactaccgtctctcgttctccttac

SEQ ID NO: 277941 - DNA, 686 bp, Homo sapiens
  misc_feature: GYAE6OF02FTXSS.29.35.D02.1.454.CMB.1.raw
  modified_base (199)..(199): a, c, t, g, unknown or other
  misc_feature (199)..(199): n is a, c, g, or t
  modified_base (205)..(205): a, c, t, g, unknown or other
  misc_feature (205)..(205): n is a, c, g, or t
  modified_base (263)..(263): a, c, t, g, unknown or other
  misc_feature (263)..(263): n is a, c, g, or t
tcagatagagtactcacgaccggtgctcgatttagcacacgatagttgggtttggggaggaactgctcagttaggacccagacggaaccatggaagccccagctcagcttctcttcctcctgctactctggctcccagataccagcggagagattgtgttgacacagtctccagcccaccctgtctttgtctccggganaaagcnccaccctctcctgcacgggccagtcagagtagtaacaactacttggcctggttccaanagaacctggccagcctccaggctcctcatctatgatgctactaccaacgcggaccacgtcggccactcccgagaccgtagggttcaggtcgacgaggttcgggtcgtacgggactacggtaccttaccgtaccgttcctacctacctacgtcaccgcccgtaccgtacgacgtccgtaggtaacggtacttccgtacggttaccgttttaagtttcggtttagttcggtttcgggtacggttacgtaaccgtaccgttaccggtccccgttacccgttacccgttaccggttttccggacccggtaaccgggtaacccgtaaggtccgtacgggaacgtagtaccggtaacgtaaccggtaacgttcgggtaccggtcgtacgtacctacgtaccgttcgtttacgtttcctccgttaacccg

SEQ ID NO: 277942 - DNA, 712 bp, Homo sapiens
  misc_feature: GYAE6OF02JFIE8.29.35.D02.1.454.CMB.1.raw
  modified_base (484)..(484): a, c, t, g, unknown or other
  misc_feature (484)..(484): n is a, c, g, or t
tcagatagagtactcacgaccggtgctcgatttagcacacgatagttgggtttggggaggaactgctcagttaggacccagacggaaccatggaagccccagctcagcttctcttcctcctgctactctggctcccagataccagcggagagattggtgttgacacagtctccagccaccctgtctttgtcgtccgggagaaagacgcccaacccttctccgtgccgaggggcctaggtccaggacgttacgtaaaccaaccttacgttcggaccgttgggttacccaaaacgacgtaaacccgttcgggaccctagggcctaccccgaagggtccttacccgtcaacttcctagtccgagttcgactacgtaccaaacgtacgggacctacgtcggactacctaccgacggtacccgtaaggttcgacggtgacgtagggtcgggtaccgtagggactaggtccttacacgttcgtaccactntacccgacgccgtacctagacgtcgtacgtacgtacttcgtacgttaccgtttagttcgttacggttcgttgggtacctacgtacgtacgtccgtcccgttaccgtccgttacgtttacggacccggtaagggtaccctaaggtccgtagggaactagtaccgaggtaaccgtaacgtcgggttacggcttacgaccgtacgtacgttccgtacgttcgtaccgtccg

SEQ ID NO: 277943 - DNA, 816 bp, Homo sapiens
  misc_feature: GYAE6OF02GYRBV.29.35.D02.1.454.CMB.1.raw
tcagatagagtactcacgaccggtgctcgatttagcacacgataggttgggtttgggggaggaactgctcagttaggacccagacggaaccatggaagccccagctcagcttctcttcctcctgctactctggcctccagataccagcggagagtattgtgttgacacgagtcctccagccctaccctgttctttagtccgtaccgggagaaagcgcccaccctctacctgcgaggccaagtcaagtagtacgttaaacaacttacgtggaccttaggttacccaaacgacgaaaccgtcggaccgaggcctaccgacggccttaccctacactaccttaagtgtaatcggtacctaactacccgtaaacgaccgggacctaactcgggactaactccccgagaccccgtaaggttcaacgtcggacgtacggttggggtccgttagggggacctaaggtaccctttacgaacccgttacctaccgtaaccctacgttacgaccggaccccgtacccgtaaaggtaccctaccgttagggaacggttcgttaaccgttcgtttaacccgggttttaatttacgtttcggtttaccgttacgggggtaccgttaacgtaccgttaaccggtcccggttacccttaccccggtttaccgtttaacccggttttgggttaacccgaacggggggttaaacccctaggttacccgttagggaaccggttacttaccggtaaacggtaacggaacggtttcggtacggtaccgttgaacccggtacctaaccgttcggtactttacccttagttaaccccg

SEQ ID NO: 277944 - DNA, 740 bp, Homo sapiens
  misc_feature: GYAE6OF02JTOGY.29.35.D02.1.454.CMB.1.raw
  modified_base (466)..(466): a, c, t, g, unknown or other
  misc_feature (466)..(466): n is a, c, g, or t
tcagatagagtactcacgaccggtgctcgatttagcacacgatagttgggtttgggggtagggaactgctcagttaggacccagacggaaccatggaagccccagctcagcttctcttcctcctgctactctgctcccagactaccagcggagagtattgtgttgactacagtcctccagcccaccctgttctttgtctcgggagaagacgcctaccctctcctgcagggccagtccagagtcgttaaacaccttacttcgggacccttgggttacccaactaacgaaaccgtacggaccgaggacctcccgaacggtcctaccctcgtactactactaggtactgcactaccaacgacggaccctacgtcggcacgtccacgtcccgacggttccacgtacggcgtacgggttcgggtcggtacggggtacgaaaaaacgtccgtttacgtaccttccggtaccncccgtaatccgaacggccccgaaccgttacggaccgtccgtacggtacgtagtttaccgttccggtaccgttttacgttacgtttccggtttacggtttcgggtacggtactacggtaaccgtcgttacccgtacccgttcgttaccgtttccggtaccggtacggtaccggtacgtcgtggtaaccggtgtacggtaaccggtaacgaccgtttaggtacggtcccgttacggacccgtacgtaccttcgttaccggttccttaccgtaccgg

SEQ ID NO: 277945 - DNA, 601 bp, Homo sapiens
  misc_feature: GYAE6OF02IGRWL.29.35.D02.1.454.CMB.1.raw
  modified_base (203)..(203): a, c, t, g, unknown or other
  misc_feature (203)..(203): n is a, c, g, or t
  modified_base (262)..(262): a, c, t, g, unknown or other
  misc_feature (262)..(262): n is a, c, g, or t
tcagatagagtactcacgaccggtgctcgatttagcacacgatagttgggtttggggaggaactgctcagttaggacccagacggaaccatggaagccccagctcagcttctcttcctcctgctactctggctcccagataccagcggagagattgtgttgacacagtctccagccaccctgtctttgtctccgggagaaagngccaccctctcctgcagggccagtcagagtgttaaacaactacttggcctggttccaanagaaacctggccaggctccaggctctcatctatgatgcatccaagcgggccacgtggcactcccagccaggttcagtggcaggtggtctgggacagtacttcactctcaccatccacgccgcctagacgcgtaggaggtacttcgtcgtaccgttttatttacgtttggttcgttcgggtcgttaacgcgtaaccgtcggtcccttcccggttccgtacgttttcggaccggtaacggggtaaccgaacggcgtacgggagtactaccgaacggaaccggtaagttcggtacggtcgtcggtaccgacctaccgttccgttacgttccgttacctaccg

SEQ ID NO: 277946 - DNA, 732 bp, Homo sapiens
  misc_feature: GYAE6OF02HRP63.29.35.D02.1.454.CMB.1.raw
  modified_base (198)..(198): a, c, t, g, unknown or other
  misc_feature (198)..(198): n is a, c, g, or t
  modified_base (204)..(204): a, c, t, g, unknown or other
  misc_feature (204)..(204): n is a, c, g, or t
  modified_base (231)..(231): a, c, t, g, unknown or other
  misc_feature (231)..(231): n is a, c, g, or t
  modified_base (261)..(261): a, c, t, g, unknown or other
  misc_feature (261)..(261): n is a, c, g, or t
tcagatagagtactcacgaccggtgctcgatttagcacacgatagttgggtttgggggaggaactgctcagttaggacccagacggaaccatggaagccccagctcagcttctcttcctcctgctactctggcctcccagataccagcggagagattgtgttgacacagtctccagccacctgtctttgctccggganaaacgngccacctctcctgcagggccagtcagngtagttaacaattcgttggctggtaccaanagaaacctggacaggcttccaggctcctcactctactgatcgtcacttccaacgtacggccacgtacggcacgtccctacgcccgtaaggttcacggttcggcgtaacgtcggggttacgtacggggaacgtacggtaacctttacgtaaccttccgttaaccacccgtaacgtaccgtaccggacccgtacccgtacgggtaaccggtcccgtaggtacgggtactttaccgtccgggtttacccgtttttaagtttacgtttggtttccggtttacggggtacgttagggtacctaaacggttccggttcccgttccccggttcttaaccgttttccggggaccgtaacgggggtaacccgaaaggtccggttaggaacgttacgtaccggtaaggtaacccgtaacgttcgggtacgttcgacgtcccgtaacgtacgttaccgtttaggttcccgttacttaacccg

SEQ ID NO: 277947 - DNA, 576 bp, Homo sapiens
  misc_feature: GYAE6OF02FYHTO.29.35.D02.1.454.CMB.1.raw
tcagatagagtactcacgaccggtgctcgatttagcacacgatagttgggtttgggggaggaactgctcagttaggacccagacggaaccatggaagccccagctcagcttctcttcctcctgctactctggctcccagataccagcggagagattgtgttgacacagtctccagccaccctgtctttgtctccgggagaaagcgccaccctctcctgcagggccagtcagagtgttaacactacttggcctggttccaacagaaacctggccaggcctcccaggctcctcatctatgatgcactccaagacggccacgtggaccactcccagtccgagttacgagtcggcgaggttgggtctggggacaggtaccttcgactctaccacctactcgacgtccgacctagacgccgtggacgtattcgtcggtaccgtttatttacgttcgtcgtttcgggtctagcctaacgtcggtacccttccgttactacgtttcggaccgtacggggtacctacgcgtagagtactacgacgacgtagtggacgtctcgcacgtacttcgtcttctactcg

SEQ ID NO: 277948 - DNA, 687 bp, Homo sapiens
  misc_feature: GYAE6OF02HJ8P1.29.35.D02.1.454.CMB.1.raw
  modified_base (199)..(199): a, c, t, g, unknown or other
  misc_feature (199)..(199): n is a, c, g, or t
  modified_base (235)..(235): a, c, t, g, unknown or other
  misc_feature (235)..(235): n is a, c, g, or t
tcagatagagtactcacgaccggtgctcgatttagcacacgatagttgggtttgggggaggaactgctcagttaggacccagacggaaccatggaagccccagctcagcttctcttcctcctgctactctggctccagataccagcggagagattgtgttgacacagtctccagccaccctgtctttgtctccgggganaaagcgccaccctctcctgcagggccagtcagagtnttaacaactacttgcctggttaccaacagaaacctggaccaggctccccgaggcctcctcatctatgatgacatacccaacgacgggaccacgtcggaccactcccaacggtcccaggtttacaacggttcggacgtaggtgggtaccgtaggggaaccttacggacctttccgaacttcctaccgaaacctatacgaccgcccgaccgtacgtacgtccgtaggaacggtattcgttacggtaccgttttaattacgtttggtttaccgtttcgggtacgttacgacgtaaccgttcggtacccttcccgttacccgtttacgttttaccgggaccggtaaccggggtaaacccgtaaacgtcgtacgggtagacgtacgaacggtaacggaacttacgggtcggtccgttacgacctaaccgtagttccgttacgtttccttacgtaccg

SEQ ID NO: 277949 - DNA, 710 bp, Homo sapiens
  misc_feature: GYAE6OF02GBM2G.29.35.D02.1.454.CMB.1.raw
tcagatagagtactcacgaccggtgctcgatttagcacacgatagttgggtttgggggaggaactgctcagttaggacccagacggaaccatggaagccccagctcagcttctcttcctcctgctactctggctcccagataccagcggagagattgtgttgacacagtctccagccacctgtctttgtctccggggagaaagagcccaccctctcctgcagggccagtcagagtgttaacaactacttggcctggttccaacagaaacctggccaggctccaggcctcctcatctaatcgatgcataccaacgagggccacgtggcctactccccgagtcccgtaaggttccaaggttcggacgaggttcgggtcgtagggggacctaggtacctttcgaaccttcctaccacccataccgacgcccgtacctacggacgtcccgtaggaggttactttaccgtcggttacccgtttttaatttacggtttcggtttccggtttacggggtccgttacgtaccgtaacggttccgggtacccttcccccggttcgtttaaccgttttcgggacccgtaaacgggggtaaccctaaacggttacgtacgggtaacgtacgttacgaacggtaaccgtaaacggttcgggttaccgggtactccggtacccgaaccgttaccgttcgtccggtttacttaccgtttacccg

SEQ ID NO: 277950 - DNA, 777 bp, Homo sapiens
  misc_feature: GYAE6OF02J16O8.29.35.D02.1.454.CMB.1.raw
  modified_base (204)..(204): a, c, t, g, unknown or other
  misc_feature (204)..(204): n is a, c, g, or t
tcagatagagtactcacgaccggtgctcgatttagcacacgatagttggggtttgggggaggaactgctcagttaggacccagacggaaccatggaacgccccagctcagcttctcttcctcctgctactctggctcccagataccagcggacgagattgtgttcgacacagtctcacgcccaccctgtctttgcgtccggganaagcgccacccgtctcctgccgacgggtccagtcagacgtacgttaacaacttacgttcggaccttcggttaccaaacgtagtaaaccgtcggcctacgggcctcccggaggtcctcccttacacgttcctaatcggtacctgtaccacttaccgaaacggtaccggacctaaccggtcggaacctacgtaccccgaggttcccgtagggttccaagggttcgggccgtacggggttttccgggggacgttacggggaaccgtaaacggtcctttaaccgtaaccgtccttacaccaacggttccaaccgccgtaacctacgacgtacgtacggtaggttctaccggttacgttaccgtttaagttgttaccggtttcgttaccgggttacggtcgtacgtaccggttaccgtcccgttcccggtactttaccgggttacgggtacccggacggggtaacctacggtacgttacgggtaggtacctcgtaacggtaaccggttaacgcggttccgggtactaccggacctccggttaacgtttccgggtaactttcccgttaagtttaccccg

SEQ ID NO: 277951 - DNA, 851 bp, Homo sapiens
  misc_feature: GYAE6OF02JGMJQ.29.35.D02.1.454.CMB.1.raw
tcagatagagtactcacgaccggtgctcgatttagcacacgatagttgggtttgggggaggaactgctcagttaggacccagacggaaccatggaagccccagctcagcttctcttcctcctgctactctggctcccagataccagcggagagattgtgttgacacagtctccagccaccctgtcctttgtctccgggagaaagagccaccctctcctgcagggccagtcagacgtgttaacaactacttgggcctggttccaaacagaaacctggcccaaggctccccaggcctcctcatctactgatgacgatacccaacgacgggtcccaacgtggccaactccccagccacggttccgaagtcgggccaacgggtttcggggtccgttcgggggaacgtaacggtacctttaccgaacgttccttaccgaaaccctacgtaccgtaaccgggtaccccgtaccccgttaaccggtacggtaccccgttacgggaaaccggggttaacgtttccgtttaccgggtaccccgggttttttaaactttttaacgttttacggtttcccggttttcgggggtaccggtttaaccggtaacccgttaaacccgggttccggggttacccccgtttcccccgggtttacccgtttaaccgggttttttttaccggggtaccccgttaacgggggggttaaacccctaacgggtaccccgttaggggtacggtaacgttccggtaaaccgggtaaaccggttaaaccggttcgggttaacgggtacccgtttaccggtaaccgacccggtaaaccgtttccggtttaccggtttaccctttaccgtttaacccg

SEQ ID NO: 277952 - DNA, 612 bp, Homo sapiens
  misc_feature: GYAE6OF02JGR3T.29.35.D02.1.454.CMB.1.raw
  modified_base (315)..(315): a, c, t, g, unknown or other
  misc_feature (315)..(315): n is a, c, g, or t
  modified_base (337)..(337): a, c, t, g, unknown or other
  misc_feature (337)..(337): n is a, c, g, or t
  modified_base (351)..(351): a, c, t, g, unknown or other
  misc_feature (351)..(351): n is a, c, g, or t
  modified_base (604)..(604): a, c, t, g, unknown or other
  misc_feature (604)..(604): n is a, c, g, or t
tcagatagagtactcacgaccggtgctcgatttagcacacgatagttgggtttggggaggaactgctcagttaggacccagacggaaccacggaagccccagctcagcttctcttcctcctgctactctggctcccagataccagcggagagattgtgttgacacagtctccagccaccctgtctttgtctccgggagaaagcgccaccctctcctgcagggccagtcagagtgtaaacactactggcctggttccaacagaacctggccaggctccgagctcctcatctatgatgcatccaacgagggcccacnggcactcccagccaggttcagnggcaggtgggtcgngggacagtaccttcgactctacaccataccgcgcccgtcgtaggacgtcgtggacggtaacttccgtacggttccgttttaacttagtttcggttacgtttcggggtacgttacggacctaccgtccggtcccgttacccgtccgttaccgttttcgggacccggtacggggaaccctaagggtccgtagggtaacgtcgtacgaagaccggtaacgttggtacgcgtcgactaccgcttcgttcgtcttacncttccccg

SEQ ID NO: 277953 - DNA, 671 bp, Homo sapiens
  misc_feature: GYAE6OF02JC6FW.29.35.D02.1.454.CMB.1.raw
  modified_base (203)..(203): a, c, t, g, unknown or other
  misc_feature (203)..(203): n is a, c, g, or t
tcagatagagtactcacgaccggtgctcgatttagcacacgatagttgggtttggggaggaactgctcagttaggacccagacggaaccatggaagccccagctcagcttctcttcctcctgctactctggctcccagataccagcggagagattgtgttgacacagtctccagccaccctgtctttgtctccgggagaaagngccaccctctcctgcagggccagtcagagtgttaaacactacttggcctggttccaacagaaacctggccaggcctcccgaggctccctcatctatgatcgcactaccaagacgggccaacgtcggccaactccccgagtccctaaggttccaggtcggacctagggttcggggtcctaggggaactaggtacttcgaccttcgtaccaccgtactcgacgtcccgacgtacggacgtccgtaggaggtacgtttcgtcggtaccttttagtttacgttcggttaccggttgggtccgttaggtacctaaccggttccggtcccgttacccgtccgtttaccgttttcgggacccgtaacgggggtacctacggtacgtacgggtacgtacgtacgacggtaaccggtaacgtcggttacggtccgtacgaccgtaccgtattccgtacgttaccttacgttaccccg

SEQ ID NO: 277954 - DNA, 680 bp, Homo sapiens
  misc_feature: GYAE6OF02JQK81.29.35.D02.1.454.CMB.1.raw
  modified_base (198)..(198): a, c, t, g, unknown or other
  misc_feature (198)..(198): n is a, c, g, or t
  modified_base (210)..(210): a, c, t, g, unknown or other
  misc_feature (210)..(210): n is a, c, g, or t
  modified_base (259)..(259): a, c, t, g, unknown or other
  misc_feature (259)..(259): n is a, c, g, or t
  modified_base (286)..(286): a, c, t, g, unknown or other
  misc_feature (286)..(286): n is a, c, g, or t
  modified_base (294)..(294): a, c, t, g, unknown or other
  misc_feature (294)..(294): n is a, c, g, or t
tcagatagagtactcacgaccggtgctcgatttagcacacgatagttgggtttgggggtaggaacgtgctcagttaggacccagacggaaccatggaagccccagctcagcttctcttcctcctgctactctggctcccagataccagcggagagattggtgttgacacagtctcagccaccctgtctttgctcgganaagagccacctntcctgcagggccagtcagagtgttaacaactcgttggcctggttccaanacgaactggccaggctccgacgctccncatctagngctgcatccaagtacggccacgtgcactcccgagtccaggttcacgtggcctaggttcggcgtgggacacgtacttcgacttctaccacgtatcgacgtccgactacgacgtcctagtacggtacttcgtacgttccgtttaactttacgttacgttttcgttacgggttacggtacggttacgtaaccgtcggttacccgttacccggttccgttaccggttttaccggacccgggttaaccggggtaacccggtaaacggtccggttaacgggtacggttacgtaccggtaaccggtaaccggtaaccgttacggggtaccggttaccgtacggtaccgtaccggtaccgttaccgtttaccggttaccgttaccgttaacccg

SEQ ID NO: 277955 - DNA, 823 bp, Homo sapiens
  misc_feature: GYAE6OF02GIRY7.29.35.D02.1.454.CMB.1.raw
tcagatagagtactcacgaccggtgctcgatttagcacacgatagttgggtttggggaggaactgctcagttaggacccagacggaaccatggaagccccagctcagcttctcttcctcctgcttactctggctcccagataccagcggagagattgtgttgacacagtctccacgccacctgttctttgtctaccgggagaaagacgccacccttctccgtgcgacgggccagtcgagtagttacgttaacaacttacgttcggccttaggttacccaacgaacggaaaccgttcgggaccagggccttacccgacggtccttccgacacgttctatcggatcgactactaccgaacgcgggacctacgtcggacctaccgtcccgaacgtcccggtaagtttccgaacggttcgggaccgttacgggggttcgggtacggtacggggaaccgtaacggtttaccttaccggtaccttcccgtacctaaacccggtacttaccggaccggaccccggtaaccgttaacggaccggttaccgtacggggttaacggttaccgtttccgttaccggttttaccggtttttaacgtttacgtttccggttttacggtttacggggtacgttaacggtaccgtaaacgggtttccggtccccggtttacccgtttcccgtttaccgggtttaccggggtaaccgggtaaccgggggttaaccctacgggttacgtacgggtaacggtacgttacggaacggttaacggtaacgttcgggtacgtcgtacgacctacgtacgttcctttcggttccttacgttcccg

SEQ ID NO: 277956 - DNA, 789 bp, Homo sapiens
  misc_feature: GYAE6OF02G7DB1.29.35.D02.1.454.CMB.1.raw
tcagatagagtactcacgaccggtgctcgatttagcacacgatagttgggtttgggggaggaactgctcagttaggacccagacggaaccatggaagccccagctcagcttctcttcctcctgctactctggcctcccagataccagcggagagattggtgttgacacagtcctaccagtcccacccttgttcctttgtccgtccggggaagaaagcgcccaccctctcctgccgagggccagtcagtagtagttaaacacttacgttcggccttaggttacccaatacgtaaacccgtggccgacggccgtccccgggccttaccctcactctatgtatcgactactacccaacgacgggtcctaacgtcggaccaacgtccccgacgaccggtacggttaccgagggttcggcgtaggttcggggtcgtacggggacgtacggtaccttacctacttccgtaccaaccgtactaccgaaccgtcccggtaccgtaacggaccggtaccgtaggacgggttacgttcgttaccggtttaccgtttttaaggtttacttttcgggtttacggtttcggggttaccgttacggtaaccgttaccggttacccgggtcccgtttccccgttaccgtttaccggtttttacccggggacccggttaaccggggtaacctaacgggtaccggtacgggtaacgttagtaccgtaacgtaaccggtaacgttacgggtcgtacgtaccggttaccgaccgtcttacggttccgtttccttacgtccttaccccg

SEQ ID NO: 277957 - DNA, 611 bp, Homo sapiens
  misc_feature: GYAE6OF02FKEPP.29.35.D02.1.454.CMB.1.raw
  modified_base (308)..(308): a, c, t, g, unknown or other
  misc_feature (308)..(308): n is a, c, g, or t
tcagatagagtactcacgaccggtgctcgatttagcacacgatagttgggtttggggaggaactgctcagttaggacccagacggaaccatggaagccccagctcagcttctcttcctcctgctactctggctcccagataccagcggagagattgtgttgacacagtctccagccacctgtctttgtctccgggagaaagagccaccctctcctgcagggccagtcagagtgtaacaactacttggcctggttccaacagaaacctggccaggctcccaggcctcctcatctatgatgcatccaacngggccacgtggcatccccagccaggttcagtcggcaggtgggtcgtgggacagacttcactctacaccatcacgcccgcctagacgcctaggagacttcgtagtccgtttagtttacgttcgttcgtttacgggtcgttacgacgtaaccgtcggtccctacccggttccgtacgtttttcggaccgtacggggtaacccgtaacggtcgtacggacgtacgtacgtacggtaaccggtaacgtacgggttcggtactcggtaccgacccgtaacgttccgttcgttaccttaccgttacccg

SEQ ID NO: 277958 - DNA, 571 bp, Homo sapiens
  misc_feature: GYAE6OF02IW8GB.29.35.D02.1.454.CMB.1.raw
  modified_base (205)..(205): a, c, t, g, unknown or other
  misc_feature (205)..(205): n is a, c, g, or t
  modified_base (214)..(214): a, c, t, g, unknown or other
  misc_feature (214)..(214): n is a, c, g, or t
  modified_base (566)..(566): a, c, t, g, unknown or other
  misc_feature (566)..(566): n is a, c, g, or t
tcagatagagtactcacgaccggtgctcgatttagcacacgatagttgggtttgggggaggaactgctcagttaggacccagacggaaccatggaagccccagctcagcttctcttcctcctgctactctggctcccagataccagcggagagattgtgttgacacagtctccagccaccctgtctttgtctccgggagaaacgngccaccctntcctgcagggccagtcagagtgttaacaactcttggcctggttaccaacagaaacctggccaggctcccaggctcctcatctatgatgcatccaacagggccactggcacgtcccagccaggttcagtggcagtgggttcctgggactagaccttcacttctacaccatcaggccgcctagacgcgtagacggacttcgtcgtccgttttattagtttcgtcgtttcgggcgttacgacctacgttcgggtcccttcccggttcttacgttttccggaccgtaggggaacctaggcgtagtagactcgagacggtaacgtcggtaggtctggacacccgtatctcggttctntaccg

SEQ ID NO: 277959 - DNA, 708 bp, Homo sapiens
  misc_feature: GYAE6OF02HGSIO.29.35.D02.1.454.CMB.1.raw
tcagatagagtactcacgaccggtgctcgatttagcacacgatagttgggtttggggaggaactgctcagttaggacccagacggaaccatggaagccccagctcagcttctcttcctcctgctactctggctcccagataccagcggagagattgtgttgacacagtctccagccaccctgttctttgtctccgggagaaagagccaccctctcctgcgagggccagtcagagtgttaacaactacttggccttggttaccaacagaaacctggccaggcctcccaggcctcctcatctatgatgactataccaacgagggccacgtggaccatccccaagcctaagggtcagtggcgtaggtcggggtctggggaacacggtacctttacgacgttacctaccaacccgtataccgacggtaccccgtccgttacggaaccgtcccgtgggtaacggtatttccgttacggttaccggtttttatttacgtttacggtttcgtttacggggtccgttacggtaccaaccggttccggtcccgttcccggttaccgtttaccgtttttacgggacccgtaacgggggtaaaccctacggtaccgtacggggactacgttaccgaacggtaaccggtaacgtttgggtaccgggtccgtacgttacccgaaccgtaccgttacgtttaccgtttccttacgtaacccg

SEQ ID NO: 277960 - DNA, 558 bp, Homo sapiens
  misc_feature: GYAE6OF02GCK00.29.35.D02.1.454.CMB.1.raw
  modified_base (261)..(261): a, c, t, g, unknown or other
  misc_feature (261)..(261): n is a, c, g, or t
tcagatagagtactcacgaccggtgctcgatttagcacacgatagttgggtttgggggaggaactgctcagttaggacccagacggaaccatggaagccccagctcagcttctcttcctcctgctactctggctcccagataccagcggagagattgtgttgacacagtctccagccaccctgtctttgtctccgggagaaagagccaccctctcctgcagggccagtcagagtgttaacaactacttggcctggtccaanagaaacctggccaggcctccaggcctcctcatctatgatcgcactccaacagggccacgtggcactcccagccaggttcaggtggcgaggtgggtctgggacagtacttcactctcacatcacgccgactagacgcgtacgagtacttcgtcgtccgtttattagtttcgtcgttggtcgtagtcgtaacgtcggccttccgtctacgtttcggccgtagggacctaaggtcgtacgacgtatcgacgaacggtactaggtcggtcgtgcctacgtacgtctcgttcgttcttaccg

SEQ ID NO: 277961 - DNA, 610 bp, Homo sapiens
  misc_feature: GYAE6OF02IHKQF.29.35.D02.1.454.CMB.1.raw
  modified_base (203)..(203): a, c, t, g, unknown or other
  misc_feature (203)..(203): n is a, c, g, or t
  modified_base (386)..(386): a, c, t, g, unknown or other
  misc_feature (386)..(386): n is a, c, g, or t
tcagatagagtactcacgaccggtgctcgatttagcacacgatagttgggtttgggggaggaactgctcagttaggacccagacggaaccatggaagccccagctcagcttctcttcctcctgctactctggctccagataccagcggagagattgtgttgacacagtctccagcccacctgtctttgtctccgggagaaagngccaccctctcctgcagggccagtcagagtgttaacaactacgttggcctggttccaaacagaaacctggccaggcctcccaggcctcctcatctatgatgcatccaacgagggccacgtggcactccagccaggttcagtggcaggtcgggtctgggacaggtacttcacgtctaccaaccntccgacgccgtccgtagacgcgtgacggtacttctcggttccgttttagttcgtttcggttacgttcgggtacgtacgtcgtaacgtcggtcccttacccgttcgttaccgttttcggacccgtaacggggtaaccaacggtcgtagggacgtacgtcgtaacggtaacggtacgttcgggtacgtacgtcgcctacggtacttccgtcgttccttacctaccg

SEQ ID NO: 277962 - DNA, 788 bp, Homo sapiens
  misc_feature: GYAE6OF02JGSJX.29.35.D02.1.454.CMB.1.raw
tcagatagagtactcacgaccggtgctcgatttagcacacgatagttgggtttggggaggaactgctcagttaggacccagacggaaccatggaagccccagctcagcttctcttcctcctgctactctggctccagataccagcggtagagtattgtgttgacacagtctccagccacctgtctttgtcgtccggagaaagagcccaccctctccgtgcgacgggccagtcagtagtgttaaacacgttacttggacctggttaccaaacgtacgaaaccttggacccgaaggtcccttccccgaaggtccctaccctacgtaacttcccgttaagtacgaacttggctaacgttacccaaacggtaacggggcccctaaggttcgggaccttaaccgtttccccgacggtcccgtagggtttaccagggtccggcttaacggggttcgggtaccgttagggggaactacggtacctttacgaaccgttcccgtaccgaacccgtacgttaccgaaccggtccccgtaaccgttaacggaccgtcccgtaggtaaacggtcctttaccgtacgttacccgttttagtttaacgtttcgtttcggttacgggtaccggtaataacccgtaaccgttccgggtaccctttacccggtacgtttaccgttttcgggaacccgacgggttaaccgtaacgtccggtacggaacgtacgtacggaacggtaccgtaacggttggtacgtacgttacgacccgttacgccttacggtcgttacttaccgtacc

SEQ ID NO: 277963 - DNA, 600 bp, Homo sapiens
  misc_feature: GYAE6OF02FNPPP.29.35.D02.1.454.CMB.1.raw
  modified_base (196)..(196): a, c, t, g, unknown or other
  misc_feature (196)..(196): n is a, c, g, or t
  modified_base (200)..(200): a, c, t, g, unknown or other
  misc_feature (200)..(200): n is a, c, g, or t
  modified_base (259)..(259): a, c, t, g, unknown or other
  misc_feature (259)..(259): n is a, c, g, or t
  modified_base (593)..(593): a, c, t, g, unknown or other
  misc_feature (593)..(593): n is a, c, g, or t
tcagatagagtactcacgaccggtgctcgatttagcacacgatagttgggtttgggggaggaactgctcagttaggacccagacggaaccatggaagccccagctcagcttctcttcctcctgctactctggctcccagataccagcggagagattgtgttgacacagtctccagccacctgtctttgctcggganaagngccacctctcctgcagggccagtcagagtgttaacaactacgttggcctggttaccaanagaaacctggccaggctccaggctcctcatctatgatgcatccgaacgagggccactggcacttcccgagtccaggttcagtgctaggtgggtctgggacagtctcgactcgtcaccgtatccgacggccacgtagacgccgtaggaggtcttacgttcgtccgttttaattgtttcggtcgttcgggtcgtacgtctaaccgtcgtacccgtccgtactttaccgtttcggcccgtaacggggtaacctacggcgttaggacgtacgtccgtaaggtaccggtacgtcgggtcgtacgtacgtaccgtaccgtacgttccgtgttacccgttnttacccg

SEQ ID NO: 277964 - DNA, 694 bp, Homo sapiens
  misc_feature: GYAE6OF02FRA53.29.35.D02.1.454.CMB.1.raw
tcagatagagtactcacgaccggtgctcgatttagcacacgatagttgggtttgggggaggaactgctcagttaggacccagacggaaccatggaagccccagctcagcttctcttcctcctgctactctggctcccagataccagcggagagattgtgttgacacagtctccagccaccctgtctttgtctccgggagaaagagccaccctctcctgcgagggccagtcaggagtgttaaacaacttacgttggccttggttacccaacagaaacctggaccaggcctcccaggcctcctcatctatgatgcacgtaccaacgacgggccacgtgggaccacttcccagcccgtaggttcgaaggtcggacgagggttgggtccgtagggacacggtactttacgaccttccgtaccaaccctacgtaccgaccggtacccgtaccgtacggacgtcccgtaggtacggtactttccgtcgttacccggtttttatttacgtttcggtcgtttgggaccgttacgaccgtaacgttccgggtccctttcccggttcttaccggttttccgggacccggttaagggacccgtaaggtccgtagggtaacgtacgttccgaacggtaacgtaaccgttgggtacggtccgtacggtaccgaccttaagttccgttagtttcccttgttaaccccg

SEQ ID NO: 277965 - DNA, 548 bp, Homo sapiens
  misc_feature: GYAE6OF02GWISL.29.35.D02.1.454.CMB.1.raw
  modified_base (203)..(203): a, c, t, g, unknown or other
  misc_feature (203)..(203): n is a, c, g, or t
  modified_base (489)..(489): a, c, t, g, unknown or other
  misc_feature (489)..(489): n is a, c, g, or t
tcagatagagtactcacgaccggtgctcgatttagcacacgatagttgggtttggggaggaactgctcagttaggacccagacggaaccatggaagccccagctcagcttctcttcctcctgctactctggctcccagataccagcggagagattgtgttgacacagtctccagccaccctgtctttgtctccgggagaaagngccaccctctcctgcagggccagtcagagtgttaacaactacttggcctggttccaacagaaacctggccaggctcccaggcctcctcatctatgatgcactaccaacgacggccacgtggcactcccagccaggttcagtggctaggtggtcgtgggacagtacttcactctcacatcagccgactagacgcgtgagtattcgtcgtcgttattacttgtcgttggtcgtagtactacgtcgtcctccgtctacgtttcggaccgtacgggaccacgacgtgganactcgacggacgtaacgtggtcgtacgtcgaccaccgtactacgtcgttcttactaccg

SEQ ID NO: 277966 - DNA, 780 bp, Homo sapiens
  misc_feature: GYAE6OF02GXP09.29.35.D02.1.454.CMB.1.raw
  modified_base (199)..(199): a, c, t, g, unknown or other
  misc_feature (199)..(199): n is a, c, g, or t
  modified_base (204)..(204): a, c, t, g, unknown or other
  misc_feature (204)..(204): n is a, c, g, or t
tcagatagagtactcacgaccggtgctcgatttagcacacgatagttgggtttgggggaggaactgctcagttaggacccagacggaaccatggaagccccagctcagcttctcttcctcctgctactctggctcccagataccagcggagagattgtgttgacacagtctccagccacctgtctttgtcgtccggganaaagngccctaccctctcctgcacgggccagtcagtagttgttaaaccaactactttggcctgggtttaccaaacgagaaacccgtggcccaaggccttccccgaggtcctccctcgattcctatgattcgactactaccaacgcgggaccctacgtcggacacgtccccagtccccgtaggtttcgaaggttcggccgtaggttcgggggttacacggggtaccaggttcctttacctaccgttccgtacctaaccctacgtacccgtaccgacccgtacccggtaagtaccgtaccgtacgggtacgttacgtttaccggttacggtttacccgttttaacgttttacgtttcgggtttcgtttacggggttacgggttaccgtaccgtaaccggttaccggtccccgtttacccggttaccgttacccggtttttaccgggacccgggttaaccggggtaacccggtaacggttaacccggtagggtacgtaccgttaccggaacggtaaccgtaacggttcgggtaacgtccgtaccgtaccgtccgtaaccgttcgttccgttcgttaccttcccg

SEQ ID NO: 277967 - DNA, 685 bp, Homo sapiens
  misc_feature: GYAE6OF02IFO9V.29.35.D02.1.454.CMB.1.raw
tcagatagagtactcacgaccggtgctcgatttagcacacgatagttgggtttgggggaggaactgctcagttaggacccagacggaaccatggaagccccagctcagcttctcttcctcctgctactctggctcccagataccagcggagagattgtgttgacacagtctccagccacctgttctttgctccgggagaaagacgccaccctctcctgcagggccagtcagagtgttaaacaacttacgttcggccttggttacccaaacgaacgtaaaacctgggcccgaaggcctaccccgaggtcctccctcgaacttctaactcggtatcgtactacctaccaaacggacgggcctaacgtcggccaacctcccacggtaccgtacggttccaggtcggacgtaggtcgggtcgtacgggacgtaggtacttcacgtctaccgacctactcgaacgtcccgtacgtaggacgtcgtaggacggttacttcgttcgttccggttttattacgtttcgttacggttcggttacgtacgtacgtaccggtccgtccctaccgttccgttacgttttcgggaccggtaacggggaccgtacgtccggtacgacgtacgtacgacggaaccggtaacgtcgggtcgacgttacgctaccgtcgttacgttcttccgtaccttcccg

SEQ ID NO: 277968 - DNA, 590 bp, Homo sapiens
  misc_feature: GYAE6OF02JA5QZ.29.35.D02.1.454.CMB.1.raw
  modified_base (200)..(200): a, c, t, g, unknown or other
  misc_feature (200)..(200): n is a, c, g, or t
  modified_base (205)..(205): a, c, t, g, unknown or other
  misc_feature (205)..(205): n is a, c, g, or t
  modified_base (379)..(379): a, c, t, g, unknown or other
  misc_feature (379)..(379): n is a, c, g, or t
tcagatagagtactcacgaccggtgctcgatttagcacacgatagttgggtttgggggaggaactgctcagttaggacccagacggaaccatggaagccccagctcagcttctcttcctcctgctactctggctcccagataccagcggagagattgtgttgacacagtctccagccaccctgtctttgtctccgggganaaagngccaccctctcctgcagggccagtcagagtgttaaacaactacttggcctggttccaacagaaacctggccaggctcccaggctcctcatctatgatgcatccaacgacggggccacgtcggcactccccgagccctaggttcagtcggcgtagtgggtctggggacagctacnctctcaccatcacgccgcctagacgcctaggagtacttcgtcgttccgttttatttagttcgttcgttcggggtcgttacgactaacgtcggtcccgttcccgttcgtacgttttcggccgtacggggaccgtaacgtccgtaggagacgtcgacggaacggtaacgtggtcggctacgacgtacctacgttcgtcgttccttcgtacccg

SEQ ID NO: 277969 - DNA, 884 bp, Homo sapiens
  misc_feature: GYAE6OF02INFLH.29.35.D02.1.454.CMB.1.raw
tcagatagagtactcacgaccggtgctcgatttagcacacgatagttgggtttggggaggaactgctcagttaggacccagacggaaccatggaagccccagctcagcttctcttcctcctgctactctggctcccagataccagcggagagattgtgttgacacagtctccagccaccctgtctttgtctccgggagaaagagccaccctctcctgcagggccagtcagagtgttaacaacttacttggcctcggttaccaacacgaaaccgtggacccaggcctccgaggcctcctcactctatgatcgcactacccaaacgacgggccccaacgttcggaccaccgtccccgaacggcccgtacgggtttccaaggtcgggacgtaacggggttcggggtaccgtacgggggtaacctagggtaccctttcccgtaaccgtttcccgtacccctaacccgttaacgttcccggaaccggtacccccggtacccgttaacggggtaaccggttaccccggttagggtaacgggttaactttaccggtttaccgggtttaccccggttttttttaaagttttaacggttttttcggttttacccgggttttacggggggttaccggttttaagggtacccgttaaacccgggttccgggttccccccgtttacccccggtttaccggtttacccggttttttaccggggaacccgggttaaccgggggtaaccccgtaaagggtccgggttaacgggaacggttaccgttaaccggacgggttaaacccgggtaccgtttcggggtacccggggttaccttaccgggtaccccgtaaccgttcgttttacccggtttcggttaccccgttttacgttaccccg

SEQ ID NO: 277970 - DNA, 691 bp, Homo sapiens
  misc_feature: GYAE6OF02I7ML9.29.35.D02.1.454.CMB.1.raw
tcagatagagtactcacgaccggtgctcgatttagcacacgatagttgggtttgggggaggaactgctcagttaggacccagacggaaccatggaagccccagctcagcttctcttcctcctgctactctggctcccagataccagcggagagattgtgttgacacagtctccagccacctgtctttgtctccgggagaaagagccaccctctcctgcagggccagtcagagtagttaaacaactacttggcctggttaccaaacgagaaacctggccaggctacccaggctcctcatctatgatgctactaccaacgacgggaccaccgtggccaactcccgacgccgtaacggttccgaaggtcggacgtaggttcggggttcgacggggacacggtacctttcgacgttctccgaacctactcgaacgccgtcctaaggacgtacccgtagaggttactttacgtcgttacccggttttaatttacgtttacggtttcgtttggggtcgttaacgtcctaacggtcgtcccgttcccgtacgttaccgttttaccggccgtaacggggtaaccgtaacggtacggttcgggaacgtacgtaccgaagggtaacccgtaacgttgggtacggaccgtaccggtacctaacccgtaacttcccggttacgttacgtttaccttaaccccg

SEQ ID NO: 277971 - DNA, 790 bp, Homo sapiens
  misc_feature: GYAE6OF02GPGHX.29.35.D02.1.454.CMB.1.raw
  modified_base (206)..(206): a, c, t, g, unknown or other
  misc_feature (206)..(206): n is a, c, g, or t
tcagatagagtactcacgaccggtgctcgatttagcacacgatagttgggtttgggggaggaactgctcagttaggacccagacggaaccatggaagccccagctcagcttctcttcctcctgctactctggcctcccagactaccagcggagagattgtgttgacacagtctccagcccaccctgttctttgtccgtccgggaanaaagcgccctaccctctccgtgccgagggccagtcagtagtacgtaacacgttactggccttggtaccaaacgacgtaaaccgtggacccaggccctacccgaggtcccttccgtacgtatccttaagtcgaactcgacctacgtaacccgaaacggccgggaccctaacggtccggacctaccgtaccccgaggtacccgttaagggttcaagggtcggacgtacggggttcggtcgtaacggggactacgtacttccgtactcctaccgacctacgccgaccggtcccgaacgtacggtaccgtaccggttaggtaaccggttctttaccgtttaccggtttaccgtttaagttttccggtttacgggtttccggtttaacggggtccgttaaacggtaccggttaaccggttcccggtaccccgtttaccccggttacggttttacccgtttccggggaaacccggtaaggggtaaccctacgggtaccgttcgggaattaccgacgtaacgggaccgttacggtcggtacgtacgtacgacccgttaacttcgttcgttacttcccgttaacgttccccg

SEQ ID NO: 277972 - DNA, 695 bp, Homo sapiens
  misc_feature: GYAE6OF02IO7R2.29.35.D02.1.454.CMB.1.raw
  modified_base (201)..(201): a, c, t, g, unknown or other
  misc_feature (201)..(201): n is a, c, g, or t
tcagatagagtactcacgaccggtgctcgatttagcacacgatagttgggtttggggaggaactgctcagttaggacccagacggaaccatggaagccccagctcagcttctcttcctcctgctactctggctcccagataccagcggagagattgtgttgacacagtctccagccaccctgtctttgctccggagaaagngccacctctcctgcaggccagtcagagtgttaacaactattggcctggttccaacacgaaacctggccaggcctccccgggctcctcatctatgatgacactaccaacgcgggccacgtcggcacgtcccagtccaggttccagtgggccaggttcgggtctacggggactaacggtctttaccgaccgtccttacaacccctaagttccgaacggtccccgtaccgtaacggtaccgccgttagggaacggtactttaccgttacggttccgttttaagtttacgtttcggttccgtttggggtaccgttacggtaccgtaaccggtcggtacccgttcccggttccgttaccgtttttcggacccggtaccggggtacccgtaacggtccgtacgggaacgtacgttaccgaacggtaaccggtaacggttcggtagggtccgtacgacctaccgtacgttccgtaccggtttccttaccgtactttccccg

SEQ ID NO: 277973 - DNA, 774 bp, Homo sapiens
  misc_feature: GYAE6OF02IWXYW.29.35.D02.1.454.CMB.1.raw
tcagatagagtactcacgaccggtgctcgatttagcacacgatagttgggtttgggggaggaactgctcagttaggacccagacggaaccatggaagccccagctcagcttctcttcctcctgctactctggctcccagataccagcggagagtattgtgttgacacagtctccagccaccctgtctttgtctccgggagaaagacgcccaccctctccgtgcgacgggccagtcagagtagttaaacaacttacttcggcctggttaccaacacgaaacctggccaggcctcccgaggtcctccctcatctatgatgcactccaacgacgggccacgtggccactcccgagccgtaaggttcaggtcggcgtaggttcggggtacgttcggggaacacggttaccttccgaccttcctacccaaccctacgttaccgacggacccccggtaccgtaacgggaccgtacccgttcggtaacgggttacgtttaccgttacggtttacccgtttttaagttttacgttttcggtttccggtttcggggtacggttaccggtaccgtaaccggttccggtccccgttaccccgtttaccgtttaccggtttttaccggggacccggtaaacgggggtaacccgtaaacgggtccgttaacggggtaacgtacgttaccgaaaccggtaaccggttaaaccgttcggggttacggtaccgttacggtaccgtaacccgttacgtttaccgttccggtttacctttaccgttaacccg

SEQ ID NO: 277974 - DNA, 692 bp, Homo sapiens
  misc_feature: GYAE6OF02G57G0.29.35.D02.1.454.CMB.1.raw
  modified_base (203)..(203): a, c, t, g, unknown or other
  misc_feature (203)..(203): n is a, c, g, or t
tcagatagagtactcacgaccggtgctcgatttagcacacgatagttgggtttggggaggaactgctcagttaggacccagacggaaccatggaagccccagctcagcttctcttcctcctgctactctggctcccagataccagcggagagattgtgttgacacagtctccagccaccctgtctttgtctccgggagaaagngccacctctcctgcagggccagtcagagtgttaacactacttggccttggttaccaacagaaacctggccaggcctccgacggtctccctcattcctatgatcgccatccgaaacgcgggcctaacgtcggcaactcccagcccgtaggttcgaggtcggcgtagggttcgggtcgtacgggacacggtacttccgactcctaccactactcgaccgtcccgtacctacggacgtcctaggaggtactttaccgttcggttaacccgtttttattacgtttcggttcggtttaggggtccgtaacggtaccgtaaccgtccggttacccgtttacccgtttcgttaaccgttttcgggcccggtaacggggtaaccctaaaggtcgtaacggggacgttacgtaccgaacggtaacggtaacgttcgggacggttaccgtacggtaccctaaccgttacgttacgtttcgtttacccgttcctaacccg

SEQ ID NO: 277975 - DNA, 565 bp, Homo sapiens
  misc_feature: GYAE6OF02HIHNV.29.35.D02.1.454.CMB.1.raw
  modified_base (260)..(260): a, c, t, g, unknown or other
  misc_feature (260)..(260): n is a, c, g, or t
  modified_base (365)..(365): a, c, t, g, unknown or other
  misc_feature (365)..(365): n is a, c, g, or t
  modified_base (424)..(424): a, c, t, g, unknown or other
  misc_feature (424)..(424): n is a, c, g, or t
  modified_base (524)..(524): a, c, t, g, unknown or other
  misc_feature (524)..(524): n is a, c, g, or t
tcagatagagtactcacgaccggtgctcgatttagcacacgatagttgggtttgggggaggaactgctcagttaggacccagacggaaccatggaagccccagctcagcttctcttcctcctgctactctggctcccagataccagcggagagattgtgttgacacagtctccagccaccctgtctttgtctccgggagaaagagccaccctctcctgcagggccagtcagagtgttaacactactggcctggttccaanagaaacctggccaggcctccaggcctcctcattctagtgatgccatccaacgcgggccacgtcggcactcccgagcctagggttcaggtcggcaggtcgggtcgngggacagtacttcacgtctaccgacctagtcacgccgtaccgtagacgcctggacggtnttcgtgttaccgttttattgttgttacgttcgggtcgtagtaccgtacgttcggtcccttcccgttcctacgtttcggccgtacgggaccagcgtcgagngtacgagtacgagtgtggctgcactctctcgtcttctaccg

SEQ ID NO: 277976 - DNA, 732 bp, Homo sapiens
  misc_feature: GYAE6OF02JZ38A.29.35.D02.1.454.CMB.1.raw
tcagatagagtactcacgaccggtgctcgatttagcacacgatagttgggtttgggggaggaactgctcagttaggacccagacggaaccatggaagccccagctcagcttctcttcctcctgctactctggcctcccagataccgagcggagagtattgtgttgacacagtcctccgacgccacccttgtctttcgtcgtcggggaagaaacgcgcccaccctctcctgcgacgggcaggtcaggagttacgttaaacactacgttcggactcggttaccaacaacgaacctggaccaggcctccgacgtcctcctctatactatacgtatcgacactaccgaacgcgggtccacgtcggacacgttccgagtccgtacggttcagggtcgacgtggtacgggtcgtacgggaactaacgtcttaccacgttaacctccgaacccgtactttaccgcggacccgttaccgtacggtaccgttcgtaacgggacgtttacgtttccggttcgtttaacccgttttacgttaggttttccggtttggttccgggtacgtaacggttaccggtaaaccgttccggttcccccggtttaccttccggttaccggttttacgggacccgtaacgggaccgttacgggcgtacggtacgtaccgacgtaacggtacgtacccgggtgtccggtactccggactaacgttccgttcgttacgttaccgtacttccccg

SEQ ID NO: 277977 - DNA, 656 bp, Homo sapiens
  misc_feature: GYAE6OF02HWY04.29.35.D02.1.454.CMB.1.raw
  modified_base (203)..(203): a, c, t, g, unknown or other
  misc_feature (203)..(203): n is a, c, g, or t
tcagatagagtactcacgaccggtgctcgatttagcacacgatagttgggtttgggggaggaactgctcagttaggacccagacggaaccatggaagccccagctcagcttctcttcctcctgctactctggcctccagataccagcggagagattgtgttgacacagtctccagccaccctgtctttgctccgggagaaagngccacctctcctgcagggccagtcagagtagttaaacaactacttcggccttggttaccaacagaaaccctggaccaggcctacccaggcctccctcacttctatgatcgactactacccaagacgggcccacgtcggacactcccgagtcccgtaggttccaggtcggactagggttcgggtcgtagggaactacggtaccttcaccttccgtacccaacctacgtccgacgtcccgtacctacggacgtccgtaggacggtactttccgtggttaccgttttattagttccgttgttcgggcgttagactaaccgtcggtcccttccgttacttacgtttcgggaccgtaggggtaaccaaggtccgtaggactacgtcgaacggaaccgtacgttggtacggtacgtacggacctacgtaccgtttacgttcggttaccttcgttacccg

SEQ ID NO: 277978 - DNA, 743 bp, Homo sapiens
  misc_feature: GYAE6OF02G6MJV.29.35.D02.1.454.CMB.1.raw
  modified_base (200)..(200): a, c, t, g, unknown or other
  misc_feature (200)..(200): n is a, c, g, or t
  modified_base (205)..(205): a, c, t, g, unknown or other
  misc_feature (205)..(205): n is a, c, g, or t
tcagatagagtactcacgaccggtgctcgatttagcacacgatagttgggtttgggggaggaactgctcagttaggacccagacggaaccatggaagccccagctcagcttctcttcctcctgctactctggctcccagactaccagcggagagattgtgttgacacagtctccagcccacctgtctttgtctccggganaaagngccaccctctccgtgcagggccagtcagagtagttaacactagttggccttggttaccaacagaaaccgtggccaggcctcccgaggcctcctcgatctatgactgctatccaacgacggccacgtcggcacgtccccgagtcctaggttcaggttcggacgagggtcgggttcgtaggggacaggtactttacgaccgtctacctacctactcgacgtacccgtacccgtaacggaccgtcccgtacggtaacggttacgtttaccgttggttttaccgttttaacgtttaacgttttcgggtttaccgttttacgggggtccgttaacgggtaccgtaacgggttaccggttccccgttaccccggttacccgtttaaccggtttttccggggacccgggttaaccgggggtaacccgtaaacggttacccggtagggtaacggttactaccggtaacgggaacccggtaaaccggttcgggtacggtccgtacgacccgtaacctcgttaccgtacgtttcccttccgttaaccg

SEQ ID NO: 277979 - DNA, 657 bp, Homo sapiens
  misc_feature: GYAE6OF02JKG4W.29.35.D02.1.454.CMB.1.raw
  modified_base (197)..(197): a, c, t, g, unknown or other
  misc_feature (197)..(197): n is a, c, g, or t
tcagatagagtactcacgaccggtgctcgatttagcacacgatagttgggtttgggggaggaactgctcagttaggacccagacggaaccatggaagccccagctcagcttctcttcctcctgctactctggctcccagataccagcgggagagattgtgttgacacagtctcagccacctgtctttgtctcggganaaagacgccaccctctcctgcgagggccagtcaggacgtagttaacaactacttcggccttggttccaacagaaacctcggaccgacggcctcccgaggtcctcctcatctatgactcgacactaccaacgacgggaccacgtcggccacttcccgagtccgtacggttccaaggtcggacgtaggttacggggttcgtacggggactaacggtaaccttcgtaccttcctacgacctacgtcgacgacccgactacggacgcgtagacgtagttcgttcgtaccgtttatttacgttcgttcgtttcggtacgttcgtacctacgtcggtcccttccgttcgttacgttttcggaccggtacgggacctaacggtcgtacggtacgacgtacgacgtaacggtacgtcggtacgtcgtaccgacgtaacctacgttcgttcggttaccttacgttaccg

SEQ ID NO: 277980 - DNA, 723 bp, Homo sapiens
  misc_feature: GYAE6OF02IF5HM.29.35.D02.1.454.CMB.1.raw
  modified_base (194)..(194): a, c, t, g, unknown or other
  misc_feature (194)..(194): n is a, c, g, or t
  modified_base (199)..(199): a, c, t, g, unknown or other
  misc_feature (199)..(199): n is a, c, g, or t
  modified_base (256)..(256): a, c, t, g, unknown or other
  misc_feature (256)..(256): n is a, c, g, or t
tcagatagagtactcacgaccggtgctcgatttagcacacgatagttgggtttggggaggaactgctcagttaggacccagacggaaccatggaagccccagctcagcttctcttcctcctgctactctggctcccagataccagcggagagattgtgttgacacagtctccagccacctgtctttgctcgganaaagngccacctctctgcaggccagtcagtagtgttaaacaactcttcggctggttccaaanagaaacctggaccaggcctaccgaggctcctcaatctatgatcgctactaccaaacgcgggaccacgtggcctactccccgagacccgtaggttcgaaggttcggaccgtaggggttcggggtaccgtacggggtaacctaacggttacctttaccgaacctttcccgtaccctaaccgtaacgtcccgaaccgggtacccgtaccgttaacggccgtaccgtacggtaggtacgtttccgttacggtttaccgttttaatttacgtttcggtttcggtttagggtaccggttagtacctaacggttcggtcccttacccggttaccgttaccgttttcgggacccggtaacggggtaccgtaaacggtcggttaggaacgtacgtacggtaacggtaacggtaacgttcggtaggtccgtagtacccgtaaccgtaccgttaccgtacgtttccttaccttacccg

SEQ ID NO: 277981 - DNA, 709 bp, Homo sapiens
  misc_feature: GYAE6OF02JKB29.29.35.D02.1.454.CMB.1.raw
  modified_base (198)..(198): a, c, t, g, unknown or other
  misc_feature (198)..(198): n is a, c, g, or t
  modified_base (203)..(203): a, c, t, g, unknown or other
  misc_feature (203)..(203): n is a, c, g, or t
  modified_base (291)..(291): a, c, t, g, unknown or other
  misc_feature (291)..(291): n is a, c, g, or t
tcagatagagtactcacgaccggtgctcgatttagcacacgatagttgggtttggggaggaactgctcagttaggacccagacggaaccatggaagccccagctcagcttctcttcctcctgctactctggcctcccagataccagcggagagattgtgttgacacagtctccagccacctgtctttgtctccggganaaagngccaccctctcctgcagggccagtcagagtgttaacaacttactggcctggttccaacagtaacctggccaggcctcccgaggctccncatctatgatgactatccaacgcggccacgtggaccactcccagccgtaggttccgaggtcggaccgtaggttcgggtaccgtacggggactaacggtacttacgaccgttacccgtaccaacccgtaagtccgaaccggtacccgtaccgtaacggtaccgtcccgtaacgggtacggttacgtttaccggttaccggttaccgtttttaacgtttagtttcgggtttacgttacggggtaccgttacgtaaccgtaaccgttccgggtacccgtttcccggtacgtttacggtttccggacccgggtaaccgggtaaccgtacggtcgtaggtacgtactcggtaacggaccgttaacgtcggtacgtccggttacgacctacgtaacgttccgtacggttaccttaccttacccg

SEQ ID NO: 277982 - DNA, 790 bp, Homo sapiens
  misc_feature: GYAE6OF02IBSQF.29.35.D02.1.454.CMB.1.raw
tcagatagagtactcacgaccggtgctcgatttagcacacgatagttgggtttgggggaggaactgctcagttaggacccagacggaaccatggaagccccagctcagcttctcttcctcctgctactctggctccagataccagcggagagattgtgttgacacagtctccagccaccctgtcttttgtctccgggagaaagacgccaccctctcctgcagggccagtcagagtagttaaacaactacttggccttggttaccaacagaaacctggccaggcctcccaggcctcctcacttctatgatgctataccaacgacggaccacgtggacaacgtcccagccgaggttcaggttggctaggtagggtcgtacgggactagaccgtttcgaacctcgtaccacctattccgacgaccgaccgtacgacgccgtagacggtaactttcgttacgttccgtttttagtttaactttcggtttcgtttacgggttaccggttaacggtaccgtaaaccgttcgggttaccccgtttaccccggtttacccgtttaaccgggttttttttaccggggaacccgggtaaaccgggggtaaccccggtaaacggggttaacccggttacggggtaacggtaaccgttaaccggtaaccgggtaacccgggtaaaaccggtttccgggggtttaaccgggttacccggtttaccggtaaccccggttaaccccggttaaccggttttaccccgggtttacggtttttaccccgtttaccgttttaacccccg

SEQ ID NO: 277983 - DNA, 687 bp, Homo sapiens
  misc_feature: GYAE6OF02JW9FJ.29.35.D02.1.454.CMB.1.raw
  modified_base (352)..(352): a, c, t, g, unknown or other
  misc_feature (352)..(352): n is a, c, g, or t
  modified_base (661)..(661): a, c, t, g, unknown or other
  misc_feature (661)..(661): n is a, c, g, or t
tcagatagagtactcacgaccggtgctcgatttagcacacgatagttgggtttgggggaggaactgctcagttaggacccagacggaaccatggaagccccagctcagcttctcttcctcctgctactctggctccagataccagcggagagattgtgttgacactagtctccagccaccctgttctttgtctccgggagaagagcccacctctcctgcgagggccagtcaggagtgttaacaactacgttggccgtggttaccaacacgaacctggccacggctcccgagcctcctcatctatgatcgctactaccaacgacgggacccaacggtcggccaactaccccgnggtacccctagggttccgaaggttcggacgtacgggttcggggtcgaacggggtacctaaggtacctttaccaacccgttccgttaaccaccgttaaacgtccgtaaccgacccgtaccgtaacgacggtccgtacggtacggtagtttccgtcggttaccgttttattacggtttcgttcggtttacgggtcgtactcgtacgttccgtcccgttcctacgttacgtttcggacccgtacgggtaccgtaacgtcggtacgtaggtcgtacgacggtaacgtactcggtcggtactacgtaccgtacnccgttacgttcgttacttccgtaccg

SEQ ID NO: 277984 - DNA, 731 bp, Homo sapiens
  misc_feature: GYAE6OF02G04HJ.29.35.D02.1.454.CMB.1.raw
tcagatagagtactcacgaccggtgctcgatttagcacacgatagttgggtttggggaggaactgctcagttaggacccagacggaaccatggaagccccagctcagcttctcttcctcctgctactctggcctccagataccagcggagagattgtgttgacacagtctccagccacctgtctttgctccgggagaaagcgcctaccctcgtcctgccagggtccagtccagtagtcgttaaacaacttcgtggcctggttaccaacaacgaaacctggaccagggcctaccgaggtctcctcatctatcgaatcgactactaccaacgacgggccacgtcgacacctaccgacgtacctacggttacgaggttcgacgtaggttacgggtcgttagggaacccaaggtaccgttacctaaccgttccggtaccctaccggtaactttccggaacgcccggtaacccgttaggaccgttacccgttacgggtaacggttacgtttaccggttaccgtttaccgggttttaaattttacggtttcgggtttaccggtttacgggttaccggttaacggtaccgtaacggttcccgggtacccgttccggttaccgttacgtttcggaccggtacgggaaccgtaagtaccgtagtacgtacgtacgaacggaacggttaacgtcggttacgcgtacgtaccgactacgtccgtcgttacctacgttacccg

SEQ ID NO: 277985 - DNA, 972 bp, Homo sapiens
  misc_feature: GYAE6OF02I1SHQ.29.35.D02.1.454.CMB.1.raw
tcagatagagtactcacgaccggtgctcgatttagcacacgatagttgggtttggggaggaactgctcagttaggacccagacggaaccatggaagcccccagctcagcttctcttcctcctgctactctggcctcccagataccagcggagagattgtgttgacacagtctccagccaccctgttctttgtctccgggagaaagacgccaccctctcctgcacgggccagtcagagtagttaaccaacttacgttcggacccttggttaccccaaacgaacgtaaaacccgtcggggaccccaacgggtccccttacccccgtaacggggtttcccccttaccgtaatttaccgttaaacttggtaagttaccggaccctaacgttacccccgaaaaccggaccgggggaccccctaaccggtttcgggaccccttaaccggttaccccccaacggttccccgttaaacgggtttcccgaagggttccgggacggtaggggttcggggttacggtacggggaaacttaccgaccgtttccgaacctttccgacccaaccctattaccccgaaccggtacccccggtaccgtttaaaccgggacgtccccggttaggtaaaccgggttaccttttccgttacggtttaaccccggtttttagttttaaccggtttttccgggtttcggtttacggggtccggtttaacgacccgttaaccgttcccggggttcccccgtttacccggttacccgttttaccgggttttacccgggtaacccggggtaaaccggggtacccgttaaacgggtcccggttaaaggggtaaccgttacgttaccgggtaacccggttaaaccgggtaaaccgggtttcgggtacccgggtttaaccggttaacccgacccggtaaccgttaacccgtttccggtttaccggtttacccccgttttacctaacccggtttcccccc

SEQ ID NO: 277986 - DNA, 898 bp, Homo sapiens
  misc_feature: GYAE6OF02JVJZ0.29.35.D02.1.454.CMB.1.raw
  modified_base (206)..(206): a, c, t, g, unknown or other
  misc_feature (206)..(206): n is a, c, g, or t
tcagatagagtactcacgaccggtgctcgatttagcacacgatagttgggtttgggggaggaactgctcagttaggacccagacggaaccatggaagccccagctcagcttctcttcctctgctactctggctcccagataccagcggagagattgtgttcgacacgtagtctccagcccacccgtgtctttgtcctaccgggaanaaacgacgccctacccgttctccgttcggcctaggggccctaggtaccagggtacgtttacggttaaaccaaaccgtttcgttcgggtacccgttagggtttacccaaaaccgaacggtaaaacccgttcggggaccctaaggggtcccttacccccgaacgggtcccttaccccgtacgtacttaccgtagtaccggtaacgtcggacctaccgtacccgaaacgggaccgggttacccaacggttcggaccctacgttacccccgacggtacccgtagggttaccaggggttacggacgttacgggtacgggtccggtagggaaccctacggttaccctttagtaacccgtcgtaacccgtaaccttaggtacctaaccggtaccgtaacccgtaacgggtacggtaccggtaccggtaacgggttaaccgtttcggttaacccgggttttaccgtttttacggtttaccgtttaccggtttaccgggttcgggttaaccgttacggtaccgtaaccggttccggttccccgttaaccgggttcccgttttaacccgtttcgggtacccggtaaccggggttaccgtacgttcggtacgggttacgaccgtacgtacggtaaccggttacgtacgggtcgtaccgtcgtaccctagtaaccggtttcttaacgtttccgttactacccgg

SEQ ID NO: 277987 - DNA, 606 bp, Homo sapiens
  misc_feature: GYAE6OF02HATSH.29.35.D02.1.454.CMB.1.raw
  modified_base (258)..(258): a, c, t, g, unknown or other
  misc_feature (258)..(258): n is a, c, g, or t
  modified_base (385)..(385): a, c, t, g, unknown or other
  misc_feature (385)..(385): n is a, c, g, or t
tcagatagagtactcacgaccggtgctcgatttagcacacgatagttgggtttgggggaggaactgctcagttaggacccagacggaaccatggaagccccagctcagcttctcttcctcctgctactctggctcccagataccagcggagagattgtgttgacacagtctccagccaccctgtctttgctcgggagaaagcgccaccctctcctgcagggccagtcagagtgttaacactactggcctggttccaanagaaacctggaccaggcctccaggcctccgtcactctatgatcgcactaccaacgacgggcccacgtggaccactccccagccaggttcacggtggcaggtgggtccgtgggacagtacttcactcncacctatcacgccgctagacgtcctaggtacgtattcgtcgttccgtttatttacgttcgttccgttgggaccgttgaccgtacgtcggtccctcccgtcgttacgtttcggaccggtacgggacccgtaacggccgtaggacgacgtaccggaacggtaaccgtaacgtcgggtcggtactaccggaccgtactaccgtccgtttacgtcttacctaccg

SEQ ID NO: 277988 - DNA, 833 bp, Homo sapiens
  misc_feature: GYAE6OF02G61KM.29.35.D02.1.454.CMB.1.raw
  modified_base (256)..(256): a, c, t, g, unknown or other
  misc_feature (256)..(256): n is a, c, g, or t
  modified_base (650)..(650): a, c, t, g, unknown or other
  misc_feature (650)..(650): n is a, c, g, or t
tcagatagagtactcacgaccggtgctcgatttagcacacgatagtgggttagggggaggaactgctcagttaggacccagacggaaccatggaagccccagctcagcttctcttcctcctgctactctggctcccagataccacggcggaagtagtagttggtcgttagacgtacacggtcctacccaggtcccttaccttgttcctttagggtccttaccggggagaaccgaccgtcccctaccctcgtcccgnggaccgacgggtaccctaggtacgtaggtaggttacgtttaacctaaccgtttaccgttcgggtaccgtacggtaacctaaaccgaacgtaacccgtccggaaccgaccggtccctaccggacggtcccttcctacgtacttacgtagtcgtaacggtcaacctaccgttaaccccgaaaccgggaccgggtaccttaacggccgggtaacctaacccctccccgtaacgggtaccccggttagggttaccggtacggtaccggtggtaggggtttccgggtacgtacggggacctaagtacccgttctaacctcctaccgactacgtacgcgtaccgaccgtaggactcgtaggacgtatcgttacgtcttaagttcgttagttcgttacggngtacgtacgacgttaccggcccttaccggttactaccggtttcggaacccgttacggacggttacgacggggttaacggaccgttacggacggttaacggtaccggttaacggttaccggtaccgggactcgggtaccctaccgggttacttacccgttacggttccccgttacgtttacccg

SEQ ID NO: 277989 - DNA, 800 bp, Homo sapiens
  misc_feature: GYAE6OF02JAAYH.29.35.D02.1.454.CMB.1.raw
tcagatagagtactcacgaccggtgctcgatttagcacacgatagttgggtttgggggaggaactgctcagttaggacccagacggaaccatggaagccccagctcagcttctcttcctcctgctactctggctcccagataccagcggagagattgtgttgacacagtctccagccaccctgtctttgtcgtccgggagaaagagcccaccctctcctgcgagggccagtcagagtagttaacaactacgttggcctggtaccaacgagaaacctggaccaggcctcccgaggcctcctcatctatgatgcactaccgaaacgacgggaccacgtcggactacgtccccgaggcccgtaggttccaagggttcggaccgtagggttcgggtccgtaggggaacctaaggtacctttcgaacctttctacccgtaaccacgttaccgaccggtcccgtaacccgtaacggaaccggtaccggttacgggtaagggttaacgtttaccggttacgggtttacccggtttttaagttttacggttttacgggtttccggttttacggggtaccggttaacggtacccgttaaaccggtttcgggttccccgtttaccccgggtttaaccgttttacccgggtttttaccgggaacccgggttaaccgggggaacccgtaaaccgggtacggttacggggtaacgtacgtaccgtaacgggaaccggttaaacggttacgggttcgggaccgttaccggacccgtaccgttaccgttacgtttacgtttccgttacctacccg

SEQ ID NO: 277990 - DNA, 610 bp, Homo sapiens
  misc_feature: GYAE6OF02FPLNI.29.35.D02.1.454.CMB.1.raw
  modified_base (199)..(199): a, c, t, g, unknown or other
  misc_feature (199)..(199): n is a, c, g, or t
  modified_base (259)..(259): a, c, t, g, unknown or other
  misc_feature (259)..(259): n is a, c, g, or t
  modified_base (287)..(287): a, c, t, g, unknown or other
  misc_feature (287)..(287): n is a, c, g, or t
  modified_base (367)..(367): a, c, t, g, unknown or other
  misc_feature (367)..(367): n is a, c, g, or t
tcagatagagtactcacgaccggtgctcgatttagcacacgatagttgggtttgggggaggaactgctcagttaggacccagacggaaccatggaagccccagctcagcttctcttcctcctgctactctggctcccagataccagcggagagattgtgttgacacagtctccagccaccctgtctttgtctccggganaagagccaccctctcctgcagggccagtcagatgtaacaactacttggcctggttccaanagaaacctggccaggctcccaggctccncatctatgatgacatccaaacgacgggccacgtggcactcccagccaggttcagtgcaggtgggctgggacaggacttcnctctcacatcacgccgccgtagacgtccctggacggtacttcttcgttaccgttttatttacgtttcggttacgttcggggacgttaggaccgtaacgtccgggtcccttcccggttaccgtttaccgtttcggggacccgtacgggggaacccaaggtccgtagggtacgtacgtacgacggtaacgtaacggttggtcggcctacgaccctacgaccgttaccgttcggtcttccttaccg

SEQ ID NO: 277991 - DNA, 711 bp, Homo sapiens
  misc_feature: GYAE6OF02HVNQ6.29.35.D02.1.454.CMB.1.raw
  modified_base (303)..(303): a, c, t, g, unknown or other
  misc_feature (303)..(303): n is a, c, g, or t
tcagatagagtactcacgaccggtgctcgatttagcacacgatagttgggtttgggggaggaactgctcagttaggacccagacggaaccatggaagccccagctcagcttctcttcctcctgctactctggctccagataccagcggagagattgtgttgacacagtctccagccacctgtcttgtctcgggagaaagcgccacctctcctgcagggccagtcagtagtagttaaacaacttacttggccttggttaccaacacgaaaccgtgggaccacgggcctcccgaggccttcctanacttctatgatcgactactaccgaacgtacgggcctacggtcggacctacgtcccgaacggtcccgtagggttccaagggttcggcgtacgggttcgggtacggtggggaactacggtacctttccgaccttctacccaacctagtccgacgtcccgtaccgtacggaccgtccgtagggtacggtactttacgttcggtttaccgtttttaagtttacggtttcggtttcggttacggggttaccgttaacggtacctaaccggttccggttacccgttcccggttaccgtttaccggttttccgggaccgggtaacgggtaaccgaacggtcgtagggactacgtacgaacgaacggtacgtgggtcggtacgtccgcgtacctacttacgtcgttactcttaccg

SEQ ID NO: 277992 - DNA, 209 bp, Homo sapiens
  misc_feature: GYAE6OF02G5QKW.29.35.D02.1.454.CMB.1.raw
  modified_base (197)..(197): a, c, t, g, unknown or other
  misc_feature (197)..(197): n is a, c, g, or t
  modified_base (201)..(201): a, c, t, g, unknown or other
  misc_feature (201)..(201): n is a, c, g, or t
tcagatagagtactcacgaccggtgctcgatttagcacacgatagttgggtttgggggaggaactgctcagttaggacccagacggaaccatggaagccccagctcagcttctcttcctcctgctactctggctcccagataccagcggagagattgtgttgacacagtctcagccacctgtctttgtctccggganaagngccacctc

SEQ ID NO: 277993 - DNA, 621 bp, Homo sapiens
  misc_feature: GYAE6OF02HC9P6.29.35.D02.1.454.CMB.1.raw
  modified_base (263)..(263): a, c, t, g, unknown or other
  misc_feature (263)..(263): n is a, c, g, or t
tcagatagagtactcacgaccggtgctcgatttagcacacgatagttgggtttgggggaggaactgctcagttaggacccagacggaaccatggaagccccagctcagcttctcttcctcctgctactctggctcccagataccagcggagagattgtgttgacacagtctccagccaccctgttctttgccgtccgggaagaaagcgcccaccctctcctgcaggccagtcagagtgttaacactatggccttggtaccaanagaaccgtggccaggcctccaggcctcctcatctatgatcgcactaccgaacgcggccagtcgcactcccagccgtagttacgagtggacgtaggtcgggtcgtgggactacggacttaccgactcctaccacctacgtcgacgtcccgtactaacgcgtccgtaggtagtacttcgttcgttaccgttttattcgtttcgttacggttggtcgtacgcgaacgttccggtcccgttaccgtcgttacgtttccggaccgtaacgggtaccgacgtacgtaggtacgacgtacgaacggtacggtaacgtcggtacggcgttaccgacctacgtccgttacgtcgttcctacttcccg

SEQ ID NO: 277994 - DNA, 579 bp, Homo sapiens
  misc_feature: GYAE6OF02GNKV0.29.35.D02.1.454.CMB.1.raw
tcagatagagtactcacgaccggtgctcgatttagcacacgatagttgggtttgggggaggaactgctcagttaggacccagacggaaccatggaagccccagctcagcttctcttcctcctgctactctggctcccagataccagcggagagattgtgttgacacagtctccagccaccctgtctttgtctccgggagaaagagccaccctctcctgcagggccagtcagagtgttaacaactacttggcctggttccaacagaaacctggccaggctcccaggctcctcatctatgatgcatccaacacgggccactggcactcccagccaggttcagtggcaggtgggtctgggacagccttcgaccttctaccacctatccacgcccgcctagacgtcctggacggtattcgtcgtaccgtttattagttcgttcgttgggtcgtagctaaccgtcggtcccttcccgtcgttacgtttcggccgtaacggggaccaacggcgtggtacgctacgacggacgtaacgttggtacggtctacgacctaccgtactccgtacgttccttactacccg

SEQ ID NO: 277995 - DNA, 711 bp, Homo sapiens
  misc_feature: GYAE6OF02HW4HP.29.35.D02.1.454.CMB.1.raw
  modified_base (199)..(199): a, c, t, g, unknown or other
  misc_feature (199)..(199): n is a, c, g, or t
  modified_base (259)..(259): a, c, t, g, unknown or other
  misc_feature (259)..(259): n is a, c, g, or t
  modified_base (287)..(287): a, c, t, g, unknown or other
  misc_feature (287)..(287): n is a, c, g, or t
tcagatagagtactcacgaccggtgctcgatttagcacacgatagttgggtttggggaggaactgctcagttaggacccagacggaaccatggaagccccagctcagcttctcttcctcctgctactctggctccagataccagcggagagattgtgttgacacagtctcagccacctgtctttgctccgggagaaagngccaccctctcctgcagggccagtcagtagtgttaaacaacttctggccttggtccaaanagaaacctggccaggctccgaggctccnatctatgatgactactccaaacggacgggaccctacgtcggaccactacccaacggtcccgtaaggttaccaggttcggctagggttcgggtcggtagggacgtactaccgttcaacgttcaccacctactacaccggaccgtccgtaaggaccgccgtaacggacgggttactttacggtacggttacccgtttttaaactttacggtttcggtttacggtttacggggtccgttaacgtaccgtaaaccggttcgggtacccccgtttcccggttacccggtttacgtttttaccggggaacccggtaacgggggtaacccgtaaacggtacgttagggaacgtacgttcgaaacggtaacggtaacgtaggttccggacgtacgacctaaccgtacgttacttacgttccgttacctaccg

SEQ ID NO: 277996 - DNA, 602 bp, Homo sapiens
  misc_feature: GYAE6OF02HQYJ0.29.35.D02.1.454.CMB.1.raw
  modified_base (204)..(204): a, c, t, g, unknown or other
  misc_feature (204)..(204): n is a, c, g, or t
tcagatagagtactcacgaccggtgctcgatttagcacacgatagttgggtttgggggaggaactgctcagttaggacccagacggaaccatggaagccccagctcagcttctcttcctcctgctactctggctcccagataccagcggagagattgtgttgacacagtctccagccaccctgtctttgtctccgggagaaagngccaccctctcctgcagggccagtcagagtagttaaccaactacttcggccttgggttaccaaacgagaaaacctggccaggctcccaggcctcctcatctatgatgcatccaacagggccactggcatcccagccaggttcagtgctaggtcgggtcgtgggacacggtacttcgtaacctcgtacaccgatccaacgcccgacctagacgccgttacgacggtaattccgtcgtaccggtttatttacgtttcgttcgttgggtcgtagtacctacgtcgtccgttacccgtcgtaccgttttcggaccgtacgggaccgaaggtacgtaggagtacgtcgaagtcgaacgttggtacggtcgtacgaccaccgattccgtcgttcgttcttaccg

SEQ ID NO: 277997 - DNA, 783 bp, Homo sapiens
  misc_feature: GYAE6OF02F5DFU.29.35.D02.1.454.CMB.1.raw
tcagatagagtactcacgaccggtgctcgatttagcacacgatagttgggtttggggaggaactgctcagttaggacccagacggaaccatggaagccccagctcagcttctcttcctcctgctactctggctcccagataccagcggagagattgtgttgacacagtctccagccaccctgtctttgtctccgggagaaagagcccaccctctcctgcacgggccagtcagtagtgttaacaactacttggcctgttccaatagaaacctggccaggcctccgaggcctcctcatctatgatgacatacccaacgtacgggccctaacgtcggacctaatcccccgagacccgtaaggtttccgaacggttggaccgtaagggttcggggtccgtacggggtaacgacggttaaccgttcaacccgtttcctaccgaaccctactacccgtaacggacccggtaccctaacggacggtacccgtacggaacgggttactttccgtaccggtttacccggtttttaagtttaacgttttacgggtttccgtttacgggggtccggttaacggtaccctaaacggttccgggtaccccgtttaccccggttaccgtttacccgtttttaccgggaccccgggtaacgggggtaacccgtaaacggtacgtacggggtaacgtacgtaccgaaacgggaaacccggttaacgttacgggttacggtaccggttcgaccgtaacccgtaacttccggttacggttttaccttacccgtttaacccg

SEQ ID NO: 277998 - DNA, 772 bp, Homo sapiens
  misc_feature: GYAE6OF02G2GMO.29.35.D02.1.454.CMB.1.raw
  modified_base (395)..(395): a, c, t, g, unknown or other
  misc_feature (395)..(395): n is a, c, g, or t
tcagatagagtactcacgaccggtgctcgatttagcacacgatagttgggtttgggggaggaactgctcagttaggacccagacggaaccatggaagccccagctcagcttctcttcctcctgctactctggctcccagataccagcggagagattgtgttgaacacagtctccagccaccctgtctttgtctcgggagaaagcgccaccctctcctgcacgggccagtcagtagtagttaaaccaactacttggccttggttacccaaacgaacgaaacctggaccgacggcctccccgacggtcctccctactactacttagtcgtaatcgcataccgaaacgcgggaccctaacgtcgggcctaccgtaccccacggacccgtacggtacgnggttaccggcgtaagggtttccgggtacggtacgggaacgtagtaaccggtttacctaccgttcctaaccctaaccctaacgttcccgaaccggtaccccgtaaccgtaccgggtaaccgtccccggtaggtaacggttaactttccgtaggtttacccgtttttaatttacgtttacggttcgtttacgggttacgtacggtacccgttacgtccgggtacccttaccccggttacgttttacgtttaccggtaccgggtaaccgggtaaccggtaacgtcggtacgggtactacgtacgaaccggtaacgttaacggtcggtccgtacgttaccgacgtaccgttacttaccggttctttacccttgtaaccccg

SEQ ID NO: 277999 - DNA, 601 bp, Homo sapiens
  misc_feature: GYAE6OF02GS3JZ.29.35.D02.1.454.CMB.1.raw
  modified_base (198)..(198): a, c, t, g, unknown or other
  misc_feature (198)..(198): n is a, c, g, or t
tcagatagagtactcacgaccggtgctcgatttagcacacgatagttgggtttgggggaggaactgctcagttaggacccagacggaaccatggaagccccagctcagcttctcttcctcctgctactctggctccagataccagcggagagattgtgttgacacagtctccagccaccctgtctttgtctccggganaaagagccacctctcctgcagggccagtcagagtgttaacactacttggcctggtaccaacagaaacctggccaggctccaggctcctcatctatgatgcatccaagacgggccacgtggcactcccacgccgaggttcaggtcgcaggtcgggtctgggaacagtacttcactcctcacctatcgacgccgacctagacgcctagaggtacttctgtccgtttattagttcgttcgttagggtcgttagaccgtaacgtcggcccttaccgtaccgtaccgttttacggccgtaacggggtaaccgtaacggtacggtacgggacgtacgtacgaacgaacggtaacgttggtcggtacgttacggaccctacctagttaccttcgttcccttacttacccg

SEQ ID NO: 278000 - DNA, 616 bp, Homo sapiens
  misc_feature: GYAE6OF02FWUDM.29.35.D02.1.454.CMB.1.raw
  modified_base (199)..(199): a, c, t, g, unknown or other
  misc_feature (199)..(199): n is a, c, g, or t
  modified_base (204)..(204): a, c, t, g, unknown or other
  misc_feature (204)..(204): n is a, c, g, or t
  modified_base (302)..(302): a, c, t, g, unknown or other
  misc_feature (302)..(302): n is a, c, g, or t
  modified_base (316)..(316): a, c, t, g, unknown or other
  misc_feature (316)..(316): n is a, c, g, or t
  modified_base (380)..(380): a, c, t, g, unknown or other
  misc_feature (380)..(380): n is a, c, g, or t
tcagatagagtactcacgaccggtgctcgatttagcacacgatagttgggtttggggaggaactgctcagttaggacccagacggaaccatggaagccccagctcagcttctcttcctcctgctactctggctcccagataccagcggagagattgtgttgacacagtctccagccaccctgtctttgtactccggganaaagngccaccctctcctgcagggccagtcagagtgttaaacaactacgttggcctggttacccaacagaaacctggccaggctcccgaggctcctcatctangatgcatccaacgnggccacgtgccatcccagcctaggttcaggtgctaggtggtctgggacagtctcactctacacntcgacgcccgactagaccgcgtaggagtacttcgtacgttacccgtttattatttacggtctttagggcttaacgctaaccgtcggtccccgtccgttcgttacgtttcgggaccgtaacggggtaaccaggtccgtagggtacgtagtaccgaacggtaaccgggtaaccttaggggtccgtacctggtaccctaacccgtagtttccgttaccggtttacttcccttaacccgg

SEQ ID NO: 278001 - DNA, 939 bp, Homo sapiens
  misc_feature: GYAE6OF02FJI5M.29.35.D02.1.454.CMB.1.raw
  modified_base (201)..(201): a, c, t, g, unknown or other
  misc_feature (201)..(201): n is a, c, g, or t
  modified_base (207)..(207): a, c, t, g, unknown or other
  misc_feature (207)..(207): n is a, c, g, or t
tcagatagagtactcacgaccggtgctcgatttagcacacgatagttgggtttggggaggaactgctcagttaggacccagacggaaccatggaagccccagctcagcttctcttcctcctgctactctggctcccagataccagcggagagattgtgtttgacacagtctaccagcccaccctgtctttgtctccggganaaacgngccaccctctccgtggcacgggccagtcaggagtcgttaacaacttaccttggaccccttgggtttaccccaaacgtacggaaaaccccgttcgggaccccgaacggggttcccttaccccccgtaacggggtcccctttaccccgttaccgtaacgtttcccttaagttcggtaaacgtttcggacccgtaaccttacccccgaaaaccggtaaccgggggtaccccctaaaccggtttcggggacccgtaaccgtttcccccccggaagggttacccccgttaacgggttttacccgtaacggggttaccgggtaaccggttaacggggggtttacggggggttacccggttaacggggggtaaaccccgtaaacggtttaacccggtttaacccgttaacccccggtttaacccttaccccgtaaaccccggtaacgtttaccccggaccggtaccccgtacccgtaaccggtaccggacccgttacggtaacggtaacgtttaccgttccggttaacccgttttaacgtttacgtttacgttccggtttacgggtacgttacgtaccgtaacgttccggtacccgttacccgttacgttaccgttttccgggaccgtaacggggtaacctaaccggcggtacgggtacgtacgtaccgtacggtaaccgtaacgtacggtacggtcctcggacctacgtacctacggttcgttaccgtaccttacccg

SEQ ID NO: 278002 - DNA, 778 bp, Homo sapiens
  misc_feature: GYAE6OF02GF88Z.29.35.D02.1.454.CMB.1.raw
  modified_base (204)..(204): a, c, t, g, unknown or other
  misc_feature (204)..(204): n is a, c, g, or t
tcagatagagtactcacgaccggtgctcgatttagcacacgatagttggggtttggggaggaactgctcagttaggacccagacggaaccatggaagccccagctcagcttctcttcctcctgctactctggctcccagataccagcggagagattgtgttgacacagtctccagcccacctgtctttgtctccgggagaaagngccaccctctcctgcagggccagtcagagtgttaacaacttacttggcctggtaccaacagaaacctggccaggcctacccgaggcctcctcactctatgatggcatacccgaacgacggggaccctacggtcggacctactaccccgacgacccgtacgggtttccaaggttcgggacgtaggggttcggggttcggtacgggggacaacggttaacctttaccgaaccctttccttaccgaacccacgttccgaccggtacccgtacccgtaacggaccggtacccgtgggtaacggtacgtttccgtcgttacccggttttatttagttttcggtcggtttacgggtacgttacggtaccgtaaccggttcgggtccccgttacccggttccgttaccggtttttccgggtacccggtaacggggggtaaaccctaaacgggtccgttaacgggtaacggtacgtaccggtaaagggtaacccggttaaacgttacggggttacggtacccggtacgggtaaccgttacccgtacgtttacccgttacggttttcccgttactttaccccg

SEQ ID NO: 278003 - DNA, 851 bp, Homo sapiens
  misc_feature: GYAE6OF02GRW7P.29.35.D02.1.454.CMB.1.raw
tcagatagagtactcacgaccggtgctcgatttagcacacgatagttgggtttggggaggaactgctcagttaggacccagacggaaccatggaagccccagctcagcttctcttcctcctgctactctggctcccagataccagcggagagattgtgttgacacagtctccagcccacctgtctttgtcgtccgggaagaaacgacgcccacccgtctcctgcgagggccagtcaggagttacgttaaacaacttacgttcggaccttacggttaccaaacgaacggtaaaccgtcgggacccgacgggaccttccccgaagggtccttcccctacgtacttaccgtaagttcgaacgttcgacctaaccgttaccccgaaacggaccgggggtacccaacggtttcgggacctaccgtaccccgaacggtaccccgtaagggtttacccgagggttaccgggaccgttaaggggttacgggggttaccggtaacgggggtaactaacggttaacccgtttacgaacccttaccgttaccgaaacccttacgtacgtaaccggacccgtacccgtaacggtaccgtaccgttacgggtaacggttacgttacgttacggtttacccgttttagtttacggtttcggtttacgggtttacgggtaccggttaacgtaccgtaaaccggttccgggttaccccgttacccggttacccgtttacggttttacccgggaccgggtaacgggtaaccgaacggtcggtacggtacgtacgtacgaacggtaaccggtaacgttcggtaacgcgtacgaccgtacgtaacgtccgtttacgtccttacttacccg

SEQ ID NO: 278004 - DNA, 655 bp, Homo sapiens
  misc_feature: GYAE6OF02F4BCV.29.35.D02.1.454.CMB.1.raw
  modified_base (199)..(199): a, c, t, g, unknown or other
  misc_feature (199)..(199): n is a, c, g, or t
tcagatagagtactcacgaccggtgctcgatttagcacacgatagttgggtttggggaggaactgctcagttaggacccagacggaaccatggaagccccagctcagcttctcttcctcctgctactctggctcccagataccagcggagagattgtgttgacacagtctccagcccaccctgtctttgtctccggganaaagacgccaccctctcctgcacgggccagtcagagtgttaacactacttggcctggttaccaacagaaacctggccaggctcccgaggctcctcatctatgatgacataccgaactacggggccacgtggccactaccccagaccgtacggttacgacggtcggacgtaggttgggtcgtgggacacgtaccttctacctctccgaccactcgacgcccggtactacgacgtctaggagtacttcgtcgttacccgttttatttacgtttcggttcgtttacgggtacgttacggaccgtaaccgggtcccgttcccggttacttacggtttccgggacccgtacggggtaacctaacggcgtagggacgtacgtacgacggtacggtaacgttggtacggtacgtcgaacccgtacgtacgttcccgttaggtcctttactccgtttacccccg

SEQ ID NO: 278005 - DNA, 934 bp, Homo sapiens
  misc_feature: GYAE6OF02IIQYG.29.35.D02.1.454.CMB.1.raw
tcagatagagtactcacgaccggtgctcgatttagcacacgatagttgggtttgggggaggaactgctcagttaggacccagacggaaccatggaacgccccagctcagcttctcttcctcctgctactctggcctccagataccgagccggtagacgtattcggtgttgaacctacgagttcctccgacgacccctaccccgttggttaccgttttcggtaccggttacccgggggaaagaaaacggtaccggtaccccctaaccccgttccgttccccgtaggcccggaacggggtacccctaagggttaacctaggtaacggtttaaccggtttaaaaccccaactttacccggttcggggtcccgttaacgggtttaaccccaaaaccggaaacggtaaacccgtccgggaccgtaagggtcccctacccggtaacggtccccttaccctaacgtaagttagtaaccgttaggtacgtacgaacccgtaacctaacccggaaacggcggggtaaccccctgggtaccggtaccctaaccccgttaccgaaccgtaccggttacgtaccgtggtaacggcgttacggggttcgggtacggttacggaaccgtaccgtaccgttaccaccgtttcctaaaccgaaccgttatacccgtaccgggtacccctacgttaaccggccgttaaccggaaggttacggttacgtttccggtaaacggtttaccctttagtttacgttcggtttaccgtcggggtaccttaacgttacccgtacccggttcgcccgttttaccccggtgttttcccggttaccggccgggaaccggttaccgaacggtccggtagtaccgaccttacggtaccgtaaggtcctacggtgttacgtcggtaacctccgtaagtttccccgtatttaccctgttaacccc

SEQ ID NO: 278006 - DNA, 844 bp, Homo sapiens
  misc_feature: GYAE6OF02F7XKB.29.35.D02.1.454.CMB.1.raw
  modified_base (200)..(200): a, c, t, g, unknown or other
  misc_feature (200)..(200): n is a, c, g, or t
  modified_base (260)..(260): a, c, t, g, unknown or other
  misc_feature (260)..(260): n is a, c, g, or t
tcagatagagtactcacgaccggtgctcgatttagcacacgatagttgggtttggggaggaactgctcagttaggacccagacggaaccatggaagccccagctcagcttctcttcctcctgctactctggctccagataccagcggagagattgtgttgacacagtctccagcccacctgtctttgtctcgggagaaangccacctctcctgcagggcagtcagagtattaacaacttacttggaccttggttaccaanacgaaaccgtggaccacggcctccgaggcctcctctatctatcgtatcgacgtactaccgaaacgtacggggccctaaccgtcggggacctaccgtaccccgtaacggcccctaagggtttccgaagggttcggtacgtaaggggttcgggtccggtaggggggactaacgtaccgttcgtaaccttacctaccgtaacctacgtacgaccgtacccggtacctacggtaccgtaccgtacgggtaacgttacgtttcggttaccggttacccgtttttacgttttacgttttacggtttaccgggttttacggggttaccggttaacgggttacccgttaaaccgtttcccgggggttaccccttttaaccccgggttaccggttttacccggttttaccggggtaacccgggttaaaccggggggttaaaccctaaacgggtcccgggtttaacggggaacggtttaacgtaacggtaaaccgggtaaccggtaaccgtttacggggttacgggtcgttaccggtaccgttaacccgttccgttaaccgtttacggtttaccccgtttacgtttaaccccgg

SEQ ID NO: 278007 - DNA, 599 bp, Homo sapiens
  misc_feature: GYAE6OF02GDHWP.29.35.D02.1.454.CMB.1.raw
  modified_base (201)..(201): a, c, t, g, unknown or other
  misc_feature (201)..(201): n is a, c, g, or t
  modified_base (206)..(206): a, c, t, g, unknown or other
  misc_feature (206)..(206): n is a, c, g, or t
  modified_base (369)..(369): a, c, t, g, unknown or other
  misc_feature (369)..(369): n is a, c, g, or t
  modified_base (380)..(380): a, c, t, g, unknown or other
  misc_feature (380)..(380): n is a, c, g, or t
tcagatagagtactcacgaccggtgctcgatttagcacacgatagttgggtttggggggaggaactgctcagttaggacccagacggaaccatggaagccccagctcagcttctcttcctcctgctactctggctcccagataccagcggagagattgtgttgacacagtctccagccaccctgtctttgtctccgggganaaagngccaccctctcctgcagggccagtcagagtgttaacactacttggcctggtccaacagaaacctggccaggctcccaggctcctcatctatgatgcatccaacagggccactggcatcccagccaggttcagtggctggtgggtctgggacagacttcactcncacatcagccncagagctggagtattctcgtccgtttattagtttgtcgtttcgggtacgttacggaccgtaacgttccggtcccgttccccggtttaccgttaacgtttttccgggacccggtaacgggggtaaccctaaacggcgttacggagtacgtaccgaacggtaacggtaacgtcggtggtccgtaggaccctaccgtacttcgtcggttccttacttacccg

SEQ ID NO: 278008 - DNA, 699 bp, Homo sapiens
  misc_feature: GYAE6OF02IQXO3.29.35.D02.1.454.CMB.1.raw
  modified_base (141)..(141): a, c, t, g, unknown or other
  misc_feature (141)..(141): n is a, c, g, or t
  modified_base (155)..(155): a, c, t, g, unknown or other
  misc_feature (155)..(155): n is a, c, g, or t
  modified_base (223)..(223): a, c, t, g, unknown or other
  misc_feature (223)..(223): n is a, c, g, or t
tcagatagagtactcacgaccggtgctcgatttagcacacgatagttgggtttgggggaggaacgtgctcagttaggacccagacggaaccatggaagccccagctcagcttctcttcctcctgctactctgctcccagtntaccagcggagagnttgtgttgacacgtgtcctcacgccaccctgttactttgcgtccggagaaagcgccacccttctccgngacgacggcacgtcgaagtgtagttaacaacttacgttcggacttcggtaccaagacgtaacctaggtaccgacgtacctcccacggtcctaccctcgacttaccgtaagtcgtagtcactaccgtaccgaaaccgcggtaccgacgtacggtctaaccggtacccacgtaccggtacgtacgtaacggcgtacctaacgggttcgggtacggtacgggacgttacggtaacgttacctaaccgtcctaccgtaaccgtacgacccgtaacgtccgtaacccgaggaccggtaccgtaggacgtacttacgttaccgtacgttttagtacgtttcgtcgtttcgcggtactcgacttcggccttaccgtctcgtttacgccgtacggacctaaggtccggtagcgttacgactacggtaagtaccgtggcgaccgttcgaccgttacggacttcgtccgttacgtacttaccccgg

SEQ ID NO: 278009 - DNA, 581 bp, Homo sapiens
  misc_feature: GYAE6OF02FP7LS.29.35.D02.1.454.CMB.1.raw
  modified_base (262)..(262): a, c, t, g, unknown or other
  misc_feature (262)..(262): n is a, c, g, or t
  modified_base (398)..(398): a, c, t, g, unknown or other
  misc_feature (398)..(398): n is a, c, g, or t
tcagatagagtactcacgaccggtgctcgatttagcacacgatagttgggtttgggggaggaactgctcagttaggacccagacggaaccatggaagccccagctcagcttctcttcctcctgctactctggctcccagataccagcggagagattgtgttgacacagtctccagccaccctgtctttgtctccgggagaaagagccaccctctcctgcagggccagtcagagtgttaacaactacttggcctggttccaanagaaacctggccaggctcccaggctcctcatctatgatgcatccaacagggccagtggccatcccagccagttcagtgctaggtgggtctgggacaggtacttcactctacaccatcacgccgctagcgctgagtnttctgtccgtttattagttgtcgttggtcgtacgtctacgtcggtccttccgtctaccgttttcggaccgtacggggaacctaacggtcgtacggtaacggtactcggaacggtaacgtaaacggttcggtacggtaccttacggaccgtaacctacgttccgttacgttaccttccgtaccg

SEQ ID NO: 278010 - DNA, 681 bp, Homo sapiens
  misc_feature: GYAE6OF02G4Q61.29.35.D02.1.454.CMB.1.raw
  modified_base (193)..(193): a, c, t, g, unknown or other
  misc_feature (193)..(193): n is a, c, g, or t
  modified_base (197)..(197): a, c, t, g, unknown or other
  misc_feature (197)..(197): n is a, c, g, or t
  modified_base (205)..(205): a, c, t, g, unknown or other
  misc_feature (205)..(205): n is a, c, g, or t
  modified_base (374)..(374): a, c, t, g, unknown or other
  misc_feature (374)..(374): n is a, c, g, or t
tcagatagagtactcacgaccggtgctcgatttagcacacgatagttgggtttgggggaggaactgctcagttaggacccagacggaaccatggaagccccagctcagcttctcttcctcctgctactctggctccagataccagcggagagattgtgttgacacagtctcagccacctgtcttgctcggganaagngccacctntcctgcagggccaggtcagagtgttaacaacgttacttggacctggttaccaaactacggaaaacctggaccaagggtcctcccgaggcctacccgtacaacttctaatggattcggaccataccgaacgacgggtaccatcgggcaacgtcccacggcctagggttcncggttacggccgaaggttcgggttacgaggggaacacgtaccttaccgacttccgtaccgacgtacttccgaacgtccaccgtagacgtcctagggacgttacttccgtaggtaccgttttattgttaggttacgttacgggacgtactaccgtaacgtccgtcccgttaccggtacttacggtttacggaccggttaacggggacctaaggtcgtaaggtacggtactaccggtaaggaacggtttaacgtgggtacggaccgtagaccgtaccgttgttaccgttacggttcttacccggttacc

SEQ ID NO: 278011 - DNA, 621 bp, Homo sapiens
  misc_feature: GYAE6OF02GS9EU.29.35.D02.1.454.CMB.1.raw
tcagatagagtactcacgaccggtgctcgatttagcacacgatagttgggtttgggggaggaactgctcagttaggacccagacggaaccatggaagccccagctcagcttctcttcctcctgctactctggctcccagataccagcggagagattgtgttgacacagtctccagccacctgtcttgtctcgggagaaagcgccaccctctcctgcacgggccagtcagagtagttaacaactacgttggccttggttaccaacaagaaaccgtggaccaggcctccccgaggcctcctcattctaatgatcgctatacccaacgacgggccacgtcgcactccagcctaggttcagtcggcgtaggtcgggtcgtagggacacgtcttcgacttctaccactactcgacgtccgtcgtacgacgcgtaggaggtacttcgtcgttacgttttagttagttcgttcgttcgggtacgtacgtacgtacgtcgtcccgtcccgtacttacgttttcggacgtacggggtaccgtaacgcgtaggagtacgtacgaacgtaacggtacttcgggtacggtacgtcggtacctaccgtacgtacgtttcgttacttcgtacccg

SEQ ID NO: 278012 - DNA, 592 bp, Homo sapiens
  misc_feature: GYAE6OF02GU0SZ.29.35.D02.1.454.CMB.1.raw
  modified_base (197)..(197): a, c, t, g, unknown or other
  misc_feature (197)..(197): n is a, c, g, or t
  modified_base (261)..(261): a, c, t, g, unknown or other
  misc_feature (261)..(261): n is a, c, g, or t
tcagatagagtactcacgaccggtgctcgatttagcacacgatagttgggtttggggaggaactgctcagttaggacccagacggaaccatggaagccccagctcagcttctcttcctcctgctactctggctcccagataccagcggagagattgtgttgacacagtctccagccaccctgtctttgctccggganaaagagccaccctctcctgcagggccagtcagagtgttaaacaactacttggcctggttccaanagaacctggccaggctccaggctcctcatctatgatgcatccaacgcggccactggcactcccagccaggttcagtgctagtcggtcgtgggacagtacttcactcacaccatcagccgacctagacgtccgtgaagtacttcgtcgttaccgtttatttacgtttgttcgtttgggtcgtacgactaacgttcggtcccttaccgtcttacgtttcggccgaacggggtaaccacgcgttagggaacgtacgttacgaacgaaccgtaaacgttgggtacgtaccgtaggaccctaccgtacgttccgttacggttaccttacgtaaccg

SEQ ID NO: 278013 - DNA, 710 bp, Homo sapiens
  misc_feature: GYAE6OF02F0NG6.29.35.D02.1.454.CMB.1.raw
  modified_base (166)..(166): a, c, t, g, unknown or other
  misc_feature (166)..(166): n is a, c, g, or t
  modified_base (327)..(327): a, c, t, g, unknown or other
  misc_feature (327)..(327): n is a, c, g, or t
tcagatagagtactcacgaccggtgctcgatttagcacacgatagttgggtttgggggaggaactgctcagttaggacccagacggaaccatggaagccccagctcagcttctcttcctcctgctactctggctcccagataccagcggagagattgtgttgacanagtctccagccaccctgtctttgtctccgggagaaagcgccaccctctcctgcagggccagtcagagtagttaacaacttacgttcggcctggttacccaacacgaaaccctggccaagggcctccccaggtcctcctcactctatgaatgcactccaacngggcctacgtggcacgtcccagccgtagttcagttcggctaggttcgggtcgtgggactaggtacttccacgttacctaccaaccgtactacgacgacccgtccgtaacggacgtcccgtaggtacggtactttaccgtcggtaccgttttaactttaggtttacgtcgtttcggggtaccgttacgtaccgtaacgttccggcccgtttacccgttccgttaaccgtttttccggggaaccgttaacggggaaccctaagggtaccgtacggggtaactacgtacccggtaagggtaacccggtaaacgttggggtaccgggttaccgtaccggaccctaacccggtaattcccggttacggtttacctaccgtttaccccg

SEQ ID NO: 278014 - DNA, 817 bp, Homo sapiens
  misc_feature: GYAE6OF02GZCRW.29.35.D02.1.454.CMB.1.raw
  modified_base (261)..(261): a, c, t, g, unknown or other
  misc_feature (261)..(261): n is a, c, g, or t
tcagatagagtactcacgaccggtgctcgatttagcacacgatagttgggtttggggaggaactgctcagttaggacccagacggaaccatggaagccccagctcagcttctcttcctcctgctactctggctcccagataccagcggagagattgtgttgacacagtctccagccaccctgtctttgtctccgggagaaagagccaccctctcctgcagggccagtcagagtgttaacactacttggccttggttccaanagaacctggccaggctccaggctcctcatctatgatgcatacccaacgtacggggacctacgtcgggtaccactaccccgagcccgtagggtttcaaggtcggcgtacggttcggggttaccgtacgggggacctaacgggtacctttaccgaccgttcctacccgtaacccaacgtttacccgaccggtccccgtacccgtaacggtaaccggtacccgtagggtaaacgggtacgttttaccgttaccgggttacccggttttttaacgtttacttttacggtttaccggttttacgggggtaccggtttaacgggtacccgtaaacccgttacgggttacccccgtttccccggtttacccgtttacccgggttttttaccgggaccccgggttaacgggggtaaccccgtaaacggtaccggttacggggtaacgtaccgtaccggtaaccgggtaaacccggtaaacggttacgggttaccggggtacgttaccggtacccgtaacccgtaccgtttaccggtttacgtttacccgttacccgttaacccg

SEQ ID NO: 278015 - DNA, 581 bp, Homo sapiens
  misc_feature: GYAE6OF02ICVD8.29.35.D02.1.454.CMB.1.raw
  modified_base (200)..(200): a, c, t, g, unknown or other
  misc_feature (200)..(200): n is a, c, g, or t
  modified_base (393)..(393): a, c, t, g, unknown or other
  misc_feature (393)..(393): n is a, c, g, or t
  modified_base (423)..(423): a, c, t, g, unknown or other
  misc_feature (423)..(423): n is a, c, g, or t
tcagatagagtactcacgaccggtgctcgatttagcacacgatagttggggtttgggggaggaactgctcagttaggacccagacggaaccatggaagccccagctcagcttctcttcctcctgctactctggctcccagataccagcggagagattgtgttgacacagtctccagccaccctgtctttgtctccggganaaagacgccaccctctcctgcagggccagtcagagtagttaacactacttggcctaggttccaacagaaacctggccaggcctccaggtcctcctcatctatgatcgcactccgaacgacgggcccacgtcggccaacttcccagccaggttcagtggcaggtgggtcagggactagaccttcactcaccacnctcacgccgaccgtagacgccgtgacggtnttcgtcgttccttagtttattcgttcgttcgggtctacgctaccggtcgtccctacccgttacgttacgtttcggccggtacgggaaccaacggtcgtgaggatacgacggtaacgtacgtcggtgcgtacgaccacgtcttgtcgttactccttacg

SEQ ID NO: 278016 - DNA, 751 bp, Homo sapiens
  misc_feature: GYAE6OF02IM7CI.29.35.D02.1.454.CMB.1.raw
tcagatagagtactcacgaccggtgctcgatttagcacacgatagttgggtttggggaggaactgctcagttaggacccagacggaaccatggaagccccagctcagcttctcttcctcctgctactctggcctccagataccagcggagagattgtgttgacacagtctccagccaccctgtctttgcgtccgggagaaagcgcccaccctctcctgcagggccagtcagagtgtaacactacgttggcctggttaccaacacgaaacctggccaggcctacccgaggcctccgtcagtctagtgatcgactactaccaacgacgggacccacgtcggacctacctacccgagtcccgtaacggttcgacggtcggacgagggttcgggtcgtagggaactacggtaccttcgaacctttccgtaccaacccgtacgtacccgacggtccccgtacccgtaacggaccggtacccgtaagggtaacgggttactttccgggtaccggttttaccgtttttaagtttacggtttcggtttccggtttacggggaccgtttacgaccgttaaccggttcggtccccgttaccccgtttacgtttaccggttttcgggaacccgggtaaccggggtaacccgtaacggttccggtaaggtaccgtacgtaccggtaacggtaacggttaaccgttgggtaccggtccgtacgtaccctaaccgttcgttaccgttcgtttcctacgttacccg

SEQ ID NO: 278017 - DNA, 704 bp, Homo sapiens
  misc_feature: GYAE6OF02H9WBO.29.35.D02.1.454.CMB.1.raw
  modified_base (196)..(196): a, c, t, g, unknown or other
  misc_feature (196)..(196): n is a, c, g, or t
  modified_base (262)..(262): a, c, t, g, unknown or other
  misc_feature (262)..(262): n is a, c, g, or t
  modified_base (289)..(289): a, c, t, g, unknown or other
  misc_feature (289)..(289): n is a, c, g, or t
  modified_base (293)..(293): a, c, t, g, unknown or other
  misc_feature (293)..(293): n is a, c, g, or t
  modified_base (327)..(327): a, c, t, g, unknown or other
  misc_feature (327)..(327): n is a, c, g, or t
tcagatagagtactcacgaccggtgctcgatttagcacacgatagttgggtttgggggaggaactgctcagttaggacccagacggaaccatggaagccccagctcagcttctcttcctcctgctactctggctccagataccagcggagagattgtgttgacacagtctccagccacctgtctttgcgtcggganaaagcgcccacctctcctgcgacggccagtcgagagtagtaacactcgttcggcttggttaccaanagaacctggaccaggctccgagctccnatcntgatgcactaccaagcggtcccatacggcctacncccgagcccgtaagggttcacggtggaccgtaggttcggggtccgtagggaactacgtaacccgtttcaccgttactaccgaccttacgtaccaccggtacccggaccgttacggaccgggttacgtacggacgggtttaccttacgtttcggttacccgtttttagttaacgttttcgggtaccgtttggggtaccgttacgtacgtaccggttcggtccccgttaccgttaccgttccggttttaccgggacccgaaccggggttaaccgtcgtaccggttaggaccgacgttacgaacggtaccgtaaggtggtaccgggttacaccggttaccgtacggtacctttccggtacgtttccgtacccgttacccg

SEQ ID NO: 278018 - DNA, 767 bp, Homo sapiens
  misc_feature: GYAE6OF02IHPWU.29.35.D02.1.454.CMB.1.raw
tcagatagagtactcacgaccggtgctcgatttagcacacgatagttgggtttgggggaggaactgctcagttaggacccagacggaaccatggaagccccagctcagcttctcttcctcctgctactctggctccagataccagcggagagattgtgttgacacagtctccagccaccctgtctttgtctccgggagaaagcgccacctctcctgcagggccagtcagtagtagttaaacaactacgttcggccttggttacccaaacaggaaaacccttgggacccagggcctaccccgagggtcctccgtacacttcctaagtgtattacgacctactacccaaacgacggggccctaacggtcgggacctaacgtccccgaacggtcccgtaagggtttccgaaggttcggaccgtaggggtttcggggtacggttacgggggaactacggttaacctttccgtaaccgttcccttaaccgaaccccttagtacccgtacggacccgtacccgtaacggtaccgtaccgtacgggtacggtacgtttccgtacggtttaccgttttatttacgtttcggtttcgttacgggtcgtagtactacggttcgtcccgttccgttaccgttacgttttcgggacccgtaacggggtacccgtaggtaccgtacgggtacgtacgtacggtaacggaaccgtaacggttcgggtacggtacgttcggaccctaccgttacgttccggtttacttccgtttactacccg

SEQ ID NO: 278019 - DNA, 712 bp, Homo sapiens
  misc_feature: GYAE6OF02H20HF.29.35.D02.1.454.CMB.1.raw
tcagatagagtactcacgaccggtgctcgatttagcacacgatagttgggtttggggaggaactgctcagttaggacccagacggaaccatggaagccccagctcagcttctcttcctcctgctactctggctccagataccagcggagagattgtgttgacacagtctccagcctaccctgtctttgtctccgggagaaagagccaccctctcctgcagggcagtcagtagtagttaaacaactacttggccttaggtaccaaacgaagaaaacccgttgggaccaaggcctaccccaggcctcctcatctaatgattcgacactaccaacgacgggcctaacgtcggactactaccccaagccgtaacggtttacaaggttcggacgtagggttcggggtaccgtagggggacaacggtaaccttccgaacgtttacctaccaaccctaatccgaacggtacccgaccgttaagacgtcccgttagggaacggtattttaccgtacgttacccggttttttaaatttacggtttacggttcgtttacgggggaccgttaagaccgtaaaccgttcggtaccccgttacccgtacgtttaccgttttccgggaacccgttacggggaaaccctaaggtcctagggatacgtacgaggaacgtaagtggtacggccgtgaccgtacctagttacgtcgttcgttactaaccg

SEQ ID NO: 278020 - DNA, 773 bp, Homo sapiens
  misc_feature: GYAE6OF02GE3E3.29.35.D02.1.454.CMB.1.raw
tcagatagagtactcacgaccggtgctcgatttagcacacgatagttgggtttgggggaggaactgctcagttaggacccagacggaaccatggaagccccagctcagcttctcttcctcctgctactctggcctcccagataccagcggagagattgtgttgacacagtctccagcccacctgttctttgtcgtccgggagaaagacgccaccctctcctgcacgggccagtcagagtagttaacactcgtggccttggttaccaatacgaaacctcggaccaggcctcccgaggtccttcctctactcctatgtatgcctactaccgaacgacgggccacgtcggactacctaccccgagtacccgtaaggttccagggttaccggcgtagggttacgggtcgtacggggactacggtacttaccgacgttccgtaccaaccgtactaccgacggcccgtaccgtaaacggcccgttacggtacggtacgggtaactttccggttacggttacccggtttttaatttagtttaccgggtttcggtttacggggtacccgttaacggtacccgttaacggtccgggtttcccccttacccggtttaccgttaccggtttttcggggaccccggtaacgggggtaaccctaaacggtccgggtagggtaaccgttacgaacgtaaccggtaacggttaaccggttggggtcccgtacgtttacccggaaccgttccgttaacttccggtttccgttactttacccgttacccg

SEQ ID NO: 278021 - DNA, 773 bp, Homo sapiens
  misc_feature: GYAE6OF02JJR8Q.29.35.D02.1.454.CMB.1.raw
  modified_base (218)..(218): a, c, t, g, unknown or other
  misc_feature (218)..(218): n is a, c, g, or t
  modified_base (267)..(267): a, c, t, g, unknown or other
  misc_feature (267)..(267): n is a, c, g, or t
tcagatagagtactcacgaccggtgctcgatttagcacacgatagttgggtttggggaggaactgctcagttaggacccagacggaaccatggaagccccagctcagcttctcttcctcctgctactctggcctcccagataccagcggagagattgtgttgacacagtctccagccaccctgtctttgtctaccgggagaaagacgcccacccttcncctgcacgggtccagtcagtgtattaacactacttggacctgtaccaanacgaaacctcggcacggcctccgacggcctcctcgactacctagttgagtcgcactacccaacggaccgggacccaaccggttcgggacctaaccgtcccgtaacgtcccgttaacgggttactacggtcggccggtaaggttcgggggttacggacgggtactaaacgggtccttaccgtaccgttactaccccgtaacctagtaccgtacccgacccggtaccgttaacgccggtaccctggtaacggttaccttccggttacgtttaccggttttactttacggtttacggttaccgtttcgggggtaccgttacgtaccttaccggttacgttcccccggtttaacccgttccgtttaacccgggttttaccgggaacccgggttaccgggaaccgtaaacgggttacccgtagggtaacggtacctagggtaccgtaacccgtaaggttcggtcggtaccgtcgtaccctaacgtcgttactacggttccttacgttaccc

SEQ ID NO: 278022 - DNA, 509 bp, Homo sapiens
  misc_feature: GYAE6OF02FYM48.29.35.D02.1.454.CMB.1.raw
  modified_base (204)..(204): a, c, t, g, unknown or other
  misc_feature (204)..(204): n is a, c, g, or t
  modified_base (465)..(465): a, c, t, g, unknown or other
  misc_feature (465)..(465): n is a, c, g, or t
  modified_base (489)..(489): a, c, t, g, unknown or other
  misc_feature (489)..(489): n is a, c, g, or t
  modified_base (500)..(500): a, c, t, g, unknown or other
  misc_feature (500)..(500): n is a, c, g, or t
  modified_base (505)..(505): a, c, t, g, unknown or other
  misc_feature (505)..(505): n is a, c, g, or t
tcagatagagtactcacgaccggtgctcgatttagcacacgatagttgggtttgggggaggaactgctcagttaggacccagacggaaccatggaagccccagctcagcttctcttcctcctgctactctggctcccagataccagcggagagattgtgttgacacagtctccagccaccctgtctttgtctccgggagaaagngccaccctctcctgcagggccagtcagagtgttaacaactacttggcctggttccaacagaaacctggccaggctcccaggctcctcatctatgatgcatccaacagggccacgtggcatcccagccaggttcagtgcagtggtctgggacagactcactctcacatcagccgcagcgcctgagtattctgtaccgtttattattgtcgtttgggctagccaactcgcctcccgtctacgttttcggcgagggaccacggntacgagattcgagacgatgtggcngcaccatcgtnttctntacc

SEQ ID NO: 278023 - DNA, 783 bp, Homo sapiens
  misc_feature: GYAE6OF02HHAHM.29.35.D02.1.454.CMB.1.raw
  modified_base (230)..(230): a, c, t, g, unknown or other
  misc_feature (230)..(230): n is a, c, g, or t
tcagatagagtactcacgaccggtgctcgatttagcacacgatagttgggtttggggaggaactgctcagttaggacccagacggaaccatggaagccccagctcagcttctcttcctcctgctactctggctcccagataccagcggagagattgtgttgacacagtctccagccacctgtctttgtctccgggagaaagacgccacctctcctgcagggccagtcagngtagttaacaactacttggcctggtccaacagaaacctggccaggctccaggcctctcatctatgatgacactccaaacgcgggccacgtggccactcccagccaggttcaggtcggacagggttcgggtccgtaggggaaccaggtacctttacgaccgttacctaccaacccgtagtcccgtaaccggcccggtaccgtaacggaaccggtacccgtagggtaacggttaacgtttccgttacggttaccccgttttttaagttttaacgttttcggtttaaccggttttcggggtaccggtttaacggtaccgttaaaccgggttccgggtaccccgtttacccccgttaccgttttaaccgttttttccggggaaccccgggttaacgggggtaaaccccggtaacggttacggttacggggtaaccgttaacgttacccggtaaacgggtaaaccggttaaaccggttacgggggttacggtaccggtttacggtacccgtaacccgttaacttacccggtttacggtttaccgtttaccgtacccgg

SEQ ID NO: 278024 - DNA, 293 bp, Homo sapiens
  misc_feature: GYAE6OF02I9G65.29.35.D02.1.454.CMB.1.raw
  modified_base (258)..(258): a, c, t, g, unknown or other
  misc_feature (258)..(258): n is a, c, g, or t
  modified_base (264)..(265): a, c, t, g, unknown or other
  misc_feature (264)..(265): n is a, c, g, or t
  modified_base (267)..(293): a, c, t, g, unknown or other
  misc_feature (267)..(293): n is a, c, g, or t
tcagatagagtactcacgaccggtgctcgatttagcacacgatagttggggtttgggacagacttcacctcctcaccatcagccgcctagagcctgaggattctgccgtttattattgtcttgggcgtagcaacgtggcctcccgtcacttttggcctagggggtaccaagctggtagatcagacgaactggtggctgcacatctgtcttcatcttcccgccatcgtgaagtactctatctgagcgggctgcaaggcncatagnntnnnnnnnnnnnnnnnnnnnnnnnnnnn

SEQ ID NO: 278025 - DNA, 705 bp, Homo sapiens
  misc_feature: GYAE6OF02GHZ5U.29.35.D02.1.454.CMB.1.raw
tcagatagagtactcacgaccggtgctcgatttagcacacgatagttgggtttggggaggaactgctcagttaggacccagacggaaccatggaagccccagctcagcttctcttcctcctgctactctggctcccagataccagcggagagattgtgttgacacagtctccagcccaccctgtctttgtctccgggagaaagcgccaccctctcctgcagggccagtcagagtgttaaacaacttacttggccttggttacccaacgacgaaacctggaccacgggcctacccgaggcctcctcactctatgatgcatcccaacgacgggccacgtggaccactaccccgagcccgtaggttcgaggtcggactagggttgggtccgtaggggacctacggtaccttacgaccgttcctccgaaccctactaccgacgcccggtacctaacggacgtcccgtaggtaacggtactttacgtcggtttaccttttaagttcgtttacggtcgttcgggtacgttaacgaccgtacgttcccgggtacccttcccggttacgtttacgtttccgggaccggtaacggggtaccaacgggtcgtacgggaacgtacgtaccgaacgggttaaccgtaacgttgggtcccggtacgtccggtaacctacccggtactttcgtttccggttacctttaccttaccccgg

SEQ ID NO: 278026 - DNA, 681 bp, Homo sapiens
  misc_feature: GYAE6OF02IPR98.29.35.D02.1.454.CMB.1.raw
  modified_base (197)..(197): a, c, t, g, unknown or other
  misc_feature (197)..(197): n is a, c, g, or t
  modified_base (230)..(230): a, c, t, g, unknown or other
  misc_feature (230)..(230): n is a, c, g, or t
  modified_base (259)..(259): a, c, t, g, unknown or other
  misc_feature (259)..(259): n is a, c, g, or t
  modified_base (310)..(310): a, c, t, g, unknown or other
  misc_feature (310)..(310): n is a, c, g, or t
tcagatagagtactcacgaccggtgctcgatttagcacacgatagttgggtttgggggaggaactgctcagttaggacccagacggaaccatggaagccccagctcagcttctcttcctcctgctactctggctccagataccagcggagagattgtgttgacacagtctcagccaccctgtctttgtctccggganaaagacgccacctctcctgcagggccagtcagngtagttaacactactggcctggttccaanagaaacctggccaggctcccaggcctctcatctatgatgactataccaagnggacctacgtggacactccgagaccgtaggttcaggtcggtaccaggttcggggtactaggggaacctaggtacctttcgaacctttcctaccgaccgatccgacgacccgtacgttagacggtcccttaggaacggttcttccgtacggttacccgtttttaatttaacgttcggttacggtttacggggcgttaactcggtaaaccgttcgggttaccccttcccgttacgtttaaccggttttcgggacccggtaagggggaacccttaaggaccgttgggaacggtacttacggaacggtaaccggtaactcgggttaccgacgttccgacctaaccgttatcccggttatttcccgtacgttaccc

SEQ ID NO: 278027 - DNA, 777 bp, Homo sapiens
  misc_feature: GYAE6OF02FGS4Q.29.35.D02.1.454.CMB.1.raw
  modified_base (239)..(239): a, c, t, g, unknown or other
  misc_feature (239)..(239): n is a, c, g, or t
  modified_base (269)..(269): a, c, t, g, unknown or other
  misc_feature (269)..(269): n is a, c, g, or t
  modified_base (284)..(284): a, c, t, g, unknown or other
  misc_feature (284)..(284): n is a, c, g, or t
  modified_base (295)..(295): a, c, t, g, unknown or other
  misc_feature (295)..(295): n is a, c, g, or t
  modified_base (304)..(304): a, c, t, g, unknown or other
  misc_feature (304)..(304): n is a, c, g, or t
tcagatagagtactcacgaccggtgctcgatttagcacacgatagttgggtttgggggaggaactgctcagttaggacccagacggaaccatggaagccccagctcagcttctcttcctcctgctactctggctcccagataccagcggagagattgtgttgacacagtcctccagccaccctgtctttgtctccggggagaaacgagcccaccctctcctgccacgggtccagtcagngttagtaacactacttggcctggttccaanagaacctgccaggcncccagctccgnatctatgangtacataccaacgtcgggccagtcgacacgtaccccgagtcccgtaagttcgaggtcggtacgagggtcgggtctaggggacctacggtaccttaccgaccttccgtaccaacctactacccgacgtaccccggtacctaacggtccgtacccgtaacgggtacggttacctttacggttaccggttttaaccgtttaacgtttttaacggtttccggttaaccgggttttcggggtaccgttaaacggtcccggttaacccggtccggggtttacccctttaccccgggtttacgtttaacccgggtttttaccggggaaccccgggttaaggggggtaaacccctttacgggtaccgttacggggtaacgtaccgaaccggttaacgggtaacccggtaacgttaccggggtccgttacgtccggaacccttaccgtaaccgttccgtacggtttaccttacttaccccgg

SEQ ID NO: 278028 - DNA, 527 bp, Homo sapiens
  misc_feature: GYAE6OF02FW0HZ.29.35.D02.1.454.CMB.1.raw
  modified_base (260)..(260): a, c, t, g, unknown or other
  misc_feature (260)..(260): n is a, c, g, or t
  modified_base (523)..(523): a, c, t, g, unknown or other
  misc_feature (523)..(523): n is a, c, g, or t
tcagatagagtactcacgaccggtgctcgatttagcacacgatagttgggtttggggaggaactgctcagttaggacccagacggaaccatggaagccccagctcagcttctcttcctcctgctactctggctcccagataccagcggagagattgtgttgacacagtctccagccaccctgtctttgtctccgggagaaagagccacctctcctgcagggccagtcagagtgttaacaactacttggccttggtccaanagaaacctggccaggctcccaggctcctcatctatgatgcatccaacagggccactggcatcccagccaggttcagtggctaggtgggtctggggacagtacttcacgtctacacctatcagccgtcctacgacgccgtggaggagttctcgtccgttatttattgtcgttggtcgtagctaacgtcgtcctccgttctcgtttcggccgtagggaccacgcgtggagatcgaggacgaactgtagtctgcacatcgtgtctntacc

SEQ ID NO: 278029 - DNA, 774 bp, Homo sapiens
  misc_feature: GYAE6OF02I348K.29.35.D02.1.454.CMB.1.raw
  modified_base (280)..(280): a, c, t, g, unknown or other
  misc_feature (280)..(280): n is a, c, g, or t
  modified_base (747)..(747): a, c, t, g, unknown or other
  misc_feature (747)..(747): n is a, c, g, or t
tcagatagagtactcacgaccggtgctcgatttagcacacgatagttgggtttgggggaggaactgctcagttaggacccagacggaaccatggaagccccagctcagcttctcttcctcctgctactctggctcccagataccagcggagagattgtgttgacacagtctccagcccaccctgttcttttgtcttccgggagaaagacgcccaccctctcctgcagggccagtcagagttagttaacaacttactggccttggttccaagagtaaaccnggccacggcctcccgaggcctcctcatctatgatgcactaccaacgtacgggaccacgtcggacaccgtacccgacggtacccgtaggttccagggtacggcggtacggttgggttccggtacgggaactacggttaccttaccgtaccgttaccctaacccgaccgtacgttacccgaaccggtaccccgtacccgtttaacgaccgggtacccgtacgggtaacggtttacctttaccgttacgggttttacccggtttttaatttaccggtttttcggttttaccgggtttaccggggttacggttaaccgttaaccgtaaccggttcccggtcccgtttaccccgtttacgtttaccggttttccgggaaccgggtaccggggtaacgtacgttacgggtacggtagtacgtacggtaaccggaacgttaccggttaggtccggacgttcgtacctaccgttnttaccgttcgttaccgttacgttcccg

SEQ ID NO: 278030 - DNA, 734 bp, Homo sapiens
  misc_feature: GYAE6OF02H1D6C.29.35.D02.1.454.CMB.1.raw
  modified_base (260)..(260): a, c, t, g, unknown or other
  misc_feature (260)..(260): n is a, c, g, or t
  modified_base (673)..(673): a, c, t, g, unknown or other
  misc_feature (673)..(673): n is a, c, g, or t
tcagatagagtactcacgaccggtgctcgatttagcacacgatagttgggtttggggaggaactgctcagttaggacccagacggaaccatggaagccccagctcagcttctcttcctcctgctactctggctccagataccagcggagagattgtgttgacacagtctccagcccacctgtctttgctccgggagaacgcgccacctctctgcacgggcagtcagagttagtaaacactacgttcggctggttaccaanacgaacctggaccgaggcctccgaggtcctccctactactcttagtcgtaacgtcgtaccaccttaccgaaacggcgggacctacgtcgggacctaccttacccgacgtccgttacggtcgacggttcggaccgtaggtcggggtacgtacggggtaacacggttccttaccgacctttcctaacccgtacctcgttaccgcccgtacccgtacgtacgaccggtacgtacgggtacgttacgttcgttaccggttacgtttttactttaggttccggtttacggttcggtacgttaccgtacgtaaccggttccggtcccgtttaccggtacgtttacccggtttacggaccgggtaccgggtaaccgacggttcgtagggtactagtaccggtaacggaccggttaaccgnggttccgaccgtccgtaacgtaccgttacggttccgttttacgtcctttacccgttacccg

SEQ ID NO: 278031 - DNA, 749 bp, Homo sapiens
  misc_feature: GYAE6OF02G5VNE.29.35.D02.1.454.CMB.1.raw
  modified_base (204)..(204): a, c, t, g, unknown or other
  misc_feature (204)..(204): n is a, c, g, or t
  modified_base (263)..(263): a, c, t, g, unknown or other
  misc_feature (263)..(263): n is a, c, g, or t
tcagatagagtactcacgaccggtgctcgatttagcacacgatagttgggtttgggggaggaactgctcagttaggacccagacggaaccatggaagccccagctcagcttctcttcctcctgctactctggctcccagataccagcggagagattgtgttgacacagtctccagccaccctgtctttgtctccgggagaaagngcccaccctctcctgcagggccagtcagagtgttaacacttactggcctggttaccaanagaaacctggccaggctccaggctcctcatctatgatcgctactaccaacgacgggtccaaccgttcgggacctacgtccccaggcccctaacgggtttcacggttcggaccggtagggttcggggttcgtacggggtaacacggtaccttcaccgttccctacgaccctacttaccgacggtcccgtaccgtaacgacggtaccgtacggtacgggttacgttcgtaccggttaccggttttaacgtttaacgttttcggtttaccggtttcggggtaccgttacgtaccgttaaacggttccgggtaccccgttacccggttaccgttaccggtttttccgggacccggttaaccggggaccgtaaacggtcgttacgggaacggtactaccggtaacggtaaccggtaaaccgttgggtccgggtaccgttacgtaccctacccggtagttacccgttggtttacccgttaccgtttaacccg

SEQ ID NO: 278032 - DNA, 600 bp, Homo sapiens
  misc_feature: GYAE6OF02F8NWG.29.35.D02.1.454.CMB.1.raw
  modified_base (318)..(318): a, c, t, g, unknown or other
  misc_feature (318)..(318): n is a, c, g, or t
tcagatagagtactcacgaccggtgctcgatttagcacacgatagttgggtttgggggaggaactgctcagttacggacccagacggaaccatggaagccccagctcagcttctcttcctcctgctactctggctcccagataccagcggagagattgtgttgacacagtctccagcccaccctgtctttgtctccgggagaaagagccaccctctcctgcagggccagtcagagtgttaaacaactacttggcctggttaccaacagaaacctggaccaggctcccaggcctcctcatctatgatgcactccaacgngggacctatcggcactcccagcctaggttcaggtggacaggtgggtctgggacagtcttcacgtctaccaccatcacgcccgtacctagacgccgtgaggtcttcgtgtaccgttttaatttatttcgtttcgttgggcgtacgtacaacgtcgtacccgtcccgtttcgtaccgttttcgggaccggtacggggaaccgtaacggtcgtaggagtacgtacgacggtaacggtaacgtacggtcggtactcggactaccagttcttcgttacttcttaccg

SEQ ID NO: 278033 - DNA, 712 bp, Homo sapiens
  misc_feature: GYAE6OF02HZSOW.29.35.D02.1.454.CMB.1.raw
  modified_base (214)..(214): a, c, t, g, unknown or other
  misc_feature (214)..(214): n is a, c, g, or t
  modified_base (249)..(249): a, c, t, g, unknown or other
  misc_feature (249)..(249): n is a, c, g, or t
  modified_base (301)..(301): a, c, t, g, unknown or other
  misc_feature (301)..(301): n is a, c, g, or t
  modified_base (308)..(308): a, c, t, g, unknown or other
  misc_feature (308)..(308): n is a, c, g, or t
  modified_base (539)..(539): a, c, t, g, unknown or other
  misc_feature (539)..(539): n is a, c, g, or t
  modified_base (654)..(654): a, c, t, g, unknown or other
  misc_feature (654)..(654): n is a, c, g, or t
tcagatagagtactcacgaccggtgctcgatttagcacacgatagttgggtttggggggaactgctcagttaggacccagacggaaccatggaacgccccagctcagcttctcttcctcctgctactctggctccagataccagcggagagattgtgttgacacagtctccagcccacctgttctttgtctccgggaagaaagcgtccaccctntccgtgcagggccagtcagtagtgttaaacaactntcggccttagtccaaagaagaacctaggccacggctaccgtaggcctcctanactactntacgagtcacactaccaacgacggtcaacgtgggacctacaccccgagacccgtaggtaccgtagggtcggacgacgggttggggtccgtaggggaaccgtaagtaaccttccgtacttaaccgtacctaaaccacgttcgaacgtcccgtacgttacggacgaccgttaggaacggtacgtttacgtacgtttacggttttaattacgtttacgttacggttttacgggngttaactacgacgtaccgacccgttccgttaccgtctttacggccgggtaacgggtaaccgtacggacgtaacggtagaccgttacgacgggtaaaccgcggttaccggttaggngttaacccggtacccgacgtacttccggttaacggttccttaccggtatttcccccgg

SEQ ID NO: 278034 - DNA, 863 bp, Homo sapiens
  misc_feature: GYAE6OF02FZ2QJ.29.35.D02.1.454.CMB.1.raw
tcagatagagtactcacgaccggtgctcgatttagcacacgatagttgggtttgggggaggaactgctcagttaggacccagacggaaccatggaagccccagctcagcttctcttcctcctgctactctggctccagataccagcggagagattgtgttgacacagtctccagccacccttgttcttttgtccgtaccggggaagtaaacgacgccctaaccctctcctgcgacgggccagtcaggtagttacgttaaaccaacgttacgttaggcccttagggttacccaaactaacggaaaacccgttcggaaccagggtcccttaccccgaagggtcccctccccttacgtaacttccttaagtacggtaacttcggacctaacttaccccgaaaaccggccgggacccctaacgtcggaacctaccgtaccccgacggtaccgtaacggtttccaggttacggaccggtaaggggtttccggggttcgtacggggaacgtaacggttaccttacgtaacccgttcgttacccgaaccgtaacgtttacccgacggtaccccgtaaccgttaacggtaccggtaccggttacggtacgggttaactttcccggttaccggtttaccgtttttaacgttttacgtttacggtttacgggtttacgggttaccggttaacggtaccgttaaccggtccgggtttccccgttacccggtttacccgttaccgggtttttaccgggaccgggttacccggggtaaccgtacggtaccgtacgggtaacgtacgtacggtacggtaacgtacgtacggtacgtcgtacgcgtacgtacgttcgttacttccgttacgttacccg

SEQ ID NO: 278035 - DNA, 782 bp, Homo sapiens
  misc_feature: GYAE6OF02G0O3J.29.35.D02.1.454.CMB.1.raw
tcagatagagtactcacgaccggtgctcgatttagcacacgatagttggggtttgggggaggaactgctcagttaggacccagacggaaccatggaagccccagctcagcttctcttcctcctgctactctggctcccagataccagcggagagattgtgttgacacagtcctccagcccaccctgtctttgtctccgggagaaagcgcccaccctctcctgcagggccagtcagtagtacgttaaacaacttacttcggccttggttaccaacgaagaaacccgtggaccacggcctcccgaggtcctcctcatctatgactgacctactaccaacgtacgggacccacgtcggactactccccgacggtaccctaggttaccgaggtcggacggtaacggttcggggttctaggggtaaccgtaacgtaacctttaccgaacccgtttaccctaaccgtaacctacgtcccgaccggtaccccgtaccggtaacggtaccgtccgtaaggacggttaccttcggttacggtttaccgtttttaagttacggtttcggtttaccgggtttcggggtaccgttaaccggtactaacccggttcccggtaccctttcccggtttaaccgtttaccgggttttaccggaacccgggtaacgggtaacccgaacggtaccgggttagaacggttaccgtaaccgaacgggtaaccctaacggtcggttaacggcgttacgacccgttaaccgtcgttaccgttccgtttaccctcgttaaccccg

SEQ ID NO: 278036 - DNA, 599 bp, Homo sapiens
  misc_feature: GYAE6OF02GO0CO.29.35.D02.1.454.CMB.1.raw
  modified_base (198)..(198): a, c, t, g, unknown or other
  misc_feature (198)..(198): n is a, c, g, or t
  modified_base (263)..(263): a, c, t, g, unknown or other
  misc_feature (263)..(263): n is a, c, g, or t
  modified_base (294)..(294): a, c, t, g, unknown or other
  misc_feature (294)..(294): n is a, c, g, or t
tcagatagagtactcacgaccggtgctcgatttagcacacgatagttgggtttgggggaggaactgctcagttaggacccagacggaaccatggaagccccagctcagcttctcttcctcctgctactctggcctccagataccagcggagagattgtgttgacacagtctccagcccacctgtctttgcctcggganaaagcgccaccctctcctgcagggccagtcagtagtagtaacactacgttggccttggtaccaanagaaacctggccaggcctccgaggtcctccnctatctagtcatgctagtccaacgacggccacgtcggacctacgtcccagcccgtagttaccaggtcggacctaggggtcggtcgtagggactagtaaccttcgtactccgtaccaccgtactccgacgacccgtcgtagacgtccgtaggacgtacttcgtcgttaccgtttattgttcgttacgttgggctcgactacgtccgtcctccgttcgtacgtttccggaccgtaggaccagtcgtaggacacgtcgacgtaacgtactcggtgacgtcgacgtacctattcgtcgttcctactccg

SEQ ID NO: 278037 - DNA, 770 bp, Homo sapiens
  misc_feature: GYAE6OF02H8YUA.29.35.D02.1.454.CMB.1.raw
tcagatagagtactcacgaccggtgctcgatttagcacacgatagttgggtttggggaggaactgctcagttaggacccagacggaaccatggaagccccagctcagcttctcttcctcctgctactctggctcccagactaccaggcggagagattgtgttgaacacagtcctccacgccctaccttgtcttttacggcgtacgggaagaaacgcgccctacctctcctggccgagggacctagtacaggtagttaacgttaacaacgttgttccggaccttcggttaaccaagtacggtaaaccgtcggacctacgggccctacccgaggtcccttacccgatacgttcgtaacgtacgtacgtacgacctaacctaccggaacggacccgtaccgtaccggtcttacccctaacgtaccctacggttaccggtgtaacgggttcggtacggtcgggttagggttacgggaccggtacgggtaccttaacgtaccgttcccgtacttaccgacccgtagtactccggacccgtacgtacgtaccgacgttcgtacgtacgtttacgtttcgttaacgttttcgtttaagtttccggttacggtttacggttacggtaccgtacgtaccggttaccggtccgttcccgttacgttaccggttaggtacccgggactaaccgggtacacgggtctacgggacgtacgtacgtacgtcggccgttacgcgtactccggtctacgttcttaccgtcttaccctacttacccg

SEQ ID NO: 278038 - DNA, 899 bp, Homo sapiens
  misc_feature: GYAE6OF02F6L45.29.35.D02.1.454.CMB.1.raw
  modified_base (204)..(204): a, c, t, g, unknown or other
  misc_feature (204)..(204): n is a, c, g, or t
tcagatagagtactcacgaccggtgctcgatttagcacacgatagttgggtttgggggaggaactgctcagttaggacccagacggaaccatggaagccccagctcagcttctcttcctcctgctactctggctcccagataccagcggagagattgtgttgacacagtctccagccaccctgtctttgtctccgggagaaagngccaccctctcctgcagggccagtcagagttgtaaacactacgttcggcctggttaccaacagaaaccgtggaccacggcctcccgaggtcctcctcacttctatgatgctacaccaacgcgggaccacgtgggacctactccccgagtaccggtaggttccgaggttcggtaccgtaggggttcgggtaccggtacggggaactacggttacccttaccgtaccttacccgttacccgtaacctaccgttacccgaaccccgggtacccccggttaaccggttaaccgggaacccgggttcccgtttaaggggtaaccgggtttaacctttttacccgggttaccgggttttacccggttttttaaaggtttttaacggttttccgggttttaacccgggtttcgggggttaaccggtttaccgggtacccggtttaaaccccgggtttcccggggttacccccgtttacccccgggtttaccgtttttacccggggttttttacccggggacccggttaaaccggggggaaaccccgttaaacgggttccgttaacgggggtaacgttacgtaacccgggtaaacggtaaccgggttaaccggtttacggggtaccggttaccggttaccgtaccccgttaaccggttaccggtttaccgttccggttttacccgttaacccgttttaccccg

SEQ ID NO: 278039 - DNA, 823 bp, Homo sapiens
  misc_feature: GYAE6OF02IXFE5.29.35.D02.1.454.CMB.1.raw
  modified_base (96)..(96): a, c, t, g, unknown or other
  misc_feature (96)..(96): n is a, c, g, or t
tcagatagagtactcacgaccggtgctcgatttagcacacgatagttggggttgggaggaacctgctcagttaggacccagacggaaccatggaanccccagctcagcttctcttacctcctgctactctggcctccagataccagcggagactattgtggttcaacgaccagttctccgacgtccaacccgttgtctttcgctaccgggaagaaacgcgtcccaaccttcgtccgtgccgtacgggcctacgtccgaagtacgtacgttaacaacttcgtcggtaccctggttaacccaacgaacggtaacccgtcgggaccctaacgggtccctccgaaggtcccttaccctataactcctaagttccgaagttcggacctacgtaccaaacgggtccggtcctaacggtcggaccacgttacccgaggttaccgtacggttcgacggtcggtacgtacggttggccgttaggaccgtagtctttaccgacttccgaaccgtacgaagtccgacgtacccggtatacggcgtcggtaggtacgtacttcgttaccggttactttgtttaacgtcggttttacgggaacgggttacctaacgggtactaaccgggtaccgttcccccgttaaccgttcccgggtttaacgtttaccccggggaacccgaagggttaaccccggaacgttacccgggtaacggtttaacggcccgttaaccggttaaccggaacggttaaacccgttcgggtaaccgggtccttaacccgggaccttaacccggttacgttacccgttaccggtttacttaacccccttccgg

SEQ ID NO: 278040 - DNA, 825 bp, Homo sapiens
  misc_feature: GYAE6OF02H68U5.29.35.D02.1.454.CMB.1.raw
  modified_base (394)..(394): a, c, t, g, unknown or other
  misc_feature (394)..(394): n is a, c, g, or t
tcagatagagtactcacgaccggtgctcgatttagcacacgatagttgggtttgggggaggaactgctcagttaggacccagacggaacatggaagccccagctcagcttctcttcctcctgctactctggcctcccagactaccgagccggagagattgtgttgacacgtagtcctaccagcccaccttgttctttgcgtccgggaagaaacgcgcccaccctctcctagacgcgggtcccagtcgagacggttagttaaaccacttacgttcggccttcggttaccaaactacggtaaacctgggacccagggtcccttaccccacggtccttcccgtaccacttaccgtaattaggaacttcggcctaacgtaccgaacggacgggtaccncgtacggacctaccgtcccgtacgaccgttacggttcgacgggttcggtcgtacggggttcgggttacgacgggtaaccgtacggttaccttaaccctaccttcccgtaaccgaacccttaccgtacccggaaccggtaccccggtacccgtaacgggtcccgttacccggtaacgggtaaccggtttacgtttacccggtttacgtttacccggtttttttaaatttcggtttaccggtttcgggttcgggtaaccgtttacgaccggtttaccggccgggtttccccgttaaccggttaccgttttaccgggtttaccggaaccgggtaaccgggtacccggtagtcgttaacggctacgtacgtaacggaacggttaccgtgggtccggacccttagaccctacttacgtcgtaccttcgtactcccg

SEQ ID NO: 278041 - DNA, 785 bp, Homo sapiens
  misc_feature: GYAE6OF02J2NG6.29.35.D02.1.454.CMB.1.raw
  modified_base (156)..(156): a, c, t, g, unknown or other
  misc_feature (156)..(156): n is a, c, g, or t
  modified_base (160)..(160): a, c, t, g, unknown or other
  misc_feature (160)..(160): n is a, c, g, or t
  modified_base (212)..(212): a, c, t, g, unknown or other
  misc_feature (212)..(212): n is a, c, g, or t
  modified_base (218)..(218): a, c, t, g, unknown or other
  misc_feature (218)..(218): n is a, c, g, or t
  modified_base (237)..(237): a, c, t, g, unknown or other
  misc_feature (237)..(237): n is a, c, g, or t
  modified_base (325)..(325): a, c, t, g, unknown or other
  misc_feature (325)..(325): n is a, c, g, or t
tcagatagagtactcacgaccggtgctcgatttagcacacgatagttgggtttgggggaggaactgctcagttaggacccagaccggaaccatggaagccccagctcagcttctcttcctcctgctactctcggcctacccagtataccagcgganagtnttgtgttagacacgacgtcctccacgccaccttgtcgtttgtcgaccggganaacgcncctacccgtctcagcccgngggcctagcctagtcgtacgtaacctaacttccgtggtacctcgttaccaaagacgtaaccgcgccgacggtctccgcgcctacctcncttctgtcgagtcactactaccgacgaccgaccgctacggctacctccgacgtaccgtcgttacgagtcggcgtgggtccgtaggtaccgaccgtaggtacctactaccgtacctaccgtacccacgttacccgacccggccgtaaccggtaacgtaccggttcgttacggtaaccggtttccggttaccgtttaaccggtttacccgttttaacggtttcgtttaaccggggtttccggtttaacccggggttccgtaccgttaacccggtacccggttaaacccgttccccggttcccggtttaaccgtttaccgggtaacccgggtacggttaaacccggggacgtacccggtaggtttacccggagttccgtaaccggtagtaaacccgggtcgtttcccggaatccgttaaccggcctaacggtccttacgtcccgttacgtaccgttaccccgg

SEQ ID NO: 278042 - DNA, 788 bp, Homo sapiens
  misc_feature: GYAE6OF02JCWEX.29.35.D02.1.454.CMB.1.raw
  modified_base (202)..(202): a, c, t, g, unknown or other
  misc_feature (202)..(202): n is a, c, g, or t
  modified_base (207)..(207): a, c, t, g, unknown or other
  misc_feature (207)..(207): n is a, c, g, or t
  modified_base (221)..(221): a, c, t, g, unknown or other
  misc_feature (221)..(221): n is a, c, g, or t
tcagatagagtactcacgaccggtgctcgatttagcacacgatagttgggtttggggaggaactgctcagttaggacccagacggaaccatggaagccccttagctcagcttctcttcctcctgctactctggcctcccagataccaggcggagagattggtgttcgacacagtctccagccacctgtctttgctccggganaagcnccaccctctctgcncgggccagtcaggtacgtagttaaaccaacttacgttcggccctggttacccaaacgaggtaaaacccttggggaccaacgggcccttacccgacggacccttccctacattcctaagtggtactacggcctaactacccaaacggtcgggacctacggtcgacctacctacccgacggccgttaacggttcgaacggtcggtccgtaggggttacggggtcgtacggggaactaacggttcttaaccgtaccttccgtaccaacctactccgacggtacccgtacccgtaacggtacggtacccggtacgggtaacgttacggtttccggttacggtttaccctttttaagtttacgttttcggttaacggttcggggtaccgttaacgttacccaaggttcccgggccctttacccggttccgtttacggttttccgggacccgggtacggggtaaaccctacgggtcgttaacggggacttaccgtacggaacggtaaccggttaacgtcggttaccggcgttccacgtaccctattccggtttacgttaccttagttaccccg

SEQ ID NO: 278043 - DNA, 257 bp, Homo sapiens; identical to SEQ ID NO: 276983
  misc_feature: GYAE6OF02IS8XQ.29.35.D02.1.454.CMB.1.raw
  modified_base (256)..(257): a, c, t, g, unknown or other
  misc_feature (256)..(257): n is a, c, g, or t

SEQ ID NO: 278044 - DNA, 733 bp, Homo sapiens
  misc_feature: GYAE6OF02JGJC8.29.35.D02.1.454.CMB.1.raw
  modified_base (198)..(198): a, c, t, g, unknown or other
  misc_feature (198)..(198): n is a, c, g, or t
  modified_base (213)..(213): a, c, t, g, unknown or other
  misc_feature (213)..(213): n is a, c, g, or t
  modified_base (262)..(262): a, c, t, g, unknown or other
  misc_feature (262)..(262): n is a, c, g, or t
tcagatagagtactcacgaccggtgctcgatttagcacacgatagttgggtttgggggaggaactgctcagttaggacccagacggaaccatggaagccccagctcagcttctcttcctcctgctactctggctcccagataccagcggagagattgtgttgacacagtctccagccacctgtctttgtctccggganaaagagcccacctcncctgcgagggccagtcagagtgttaacactacgttggcctggttccaanagaaacctggccaggcctcccaggcctccgtcatctactggtactcgctactaccaaacggagggccctaacgtcggacctagtcccccgaagtcccgtaaggtttccagggttcggacgtacggggttcgggtccgtcgggggaacctaaggtaccctttacgacccttccgtaaccgtaccctaagtccgaccggtacccgaccgttaacggacggtcccgtagggaacggtagtttccgttacggttacccgttttagtttaagtttcggtttcgggtttgggtaccgttaggtaccctaacggttcggttccccgttaccccggttctttaccgttttccggggaccgtaaacgggggtacctaaacggtcgttacgggaacggtacttgaacccggtaaacgttacggtttcggcttaccggactaacccgtattcccgtcgtttccgttactacccgttacccgg

SEQ ID NO: 278045 - DNA, 609 bp, Homo sapiens
  misc_feature: GYAE6OF02IOUCM.29.35.D02.1.454.CMB.1.raw
  modified_base (205)..(205): a, c, t, g, unknown or other
  misc_feature (205)..(205): n is a, c, g, or t
tcagatagagtactcacgaccggtgctcgatttagcacacgatagttggggtttgggggaggaactgctcagttaggacccagacggaaccatggaagccccagctcagcttctcttcctcctgctactctggctcccagataccagcggagagattgtgttgacacagtctccagccaccctgtctttgtctccgggagaaagngcccaccctctcctgcagggccagtcagagtgttaacaactacttggcctggttaccaacagaaacctggccaggcctccaggctcctcatctatgatgcactccaacgacggccactcggcactcccagccctaggttccaggtcgacgaggtgggtcgtggggacacggtacttacacttcctaccaccactccgacgccgacctacgacgccgtagaggtattcgttcgtcgtttatttacgtttcgttcgttcgggtcgtacgacgtaccgtcggtcccttcccgtcgtaccgttttcggaccgtacgggtaccgaacggtcgtacggacggtactacgtacgaacggtaacgttcgggtcgtcgtacgctaccgtacttccgtcgttcttccttaaccg

SEQ ID NO: 278046 - DNA, 718 bp, Homo sapiens
  misc_feature: GYAE6OF02IELZW.29.35.D02.1.454.CMB.1.raw
tcagatagagtactcacgaccggtgctcgatttagcacacgatagttgggtttgggggaggaactgctcagttaggacccagacggaaccatggaagccccagctcagcttctcttcctcctgctactctggctcccagataccagcggagagattggtgttgacacagtctcagccacctgtcttgctcgggagaagcgccacctctcctgacacgggccagtcagagttacgtaacaactcttacggcttcggttaccaaacgaacgaaacctcggaccaggtcctcccgaggcctcctcaattcgtaatgactcgactactacccgaaacgcgggaccctacggtcggacctaaccgtcccacggtacccgtagggtttccaagggtcggacgtagggtttcgggggttacggacgggaccgttaacggtacctttaccgaccgttcctacccgtaacctacgtaccgaccggtcccgtacgtacgacggtcgtaggtacgtactttcggtaccgtttcgttttaattaggtttcgttcggtttcgggacgttacgaccgtaacggtccgtaccccgttcccggttacgtttacggtttcgggaccggtaacggggaacccaggtccgaagggtacacggtacgaaggtccgttaacggtgggtaaccgcgttaacgacccgtaacgtacttccggttacttaccgttctacccg

SEQ ID NO: 278047 - DNA, 882 bp, Homo sapiens
  misc_feature: GYAE6OF02FXK8W.29.35.D02.1.454.CMB.1.raw
  modified_base (201)..(201): a, c, t, g, unknown or other
  misc_feature (201)..(201): n is a, c, g, or t
tcagatagagtactcacgaccggtgctcgatttagcacacgatagttgggtttggggaggaactgctcagttaggaccagacggaaccatggaagccccagctcagcttctcttcctcctgcttactctggctccagactaccagcggagagattgtgttgacacgagtcctcacgccacccttgtctttgcgtcgggganaagcgccacccttctcctgcgacggccagtcaggtacgttacgttaaaccacttacgttcggccgttaggtaccaaacgtacgtaaaccgttcggaccgtacggtccgtacccgaggtcctcctactacgttacgttaacttcgaacgttacgacctacgtacccgaacggaccgggaccacggtcggacctaccgtacccgtacggacccgttacggttacgacgggtcggacgtacgggttcgggttaccggtacggggtaacctacggttaaccgttaccgtacttaccgtaccctaacctacgtaccgtaaccggacccgtaccggtacgtaaccggtaccggttaacgggtaacggttacgttttaccggttacggtttaaccgtttttaacgttttaacggttttcggtttacgggttttacggggttaccggttaacggtaaccggttaacccggtttacccgggtttccccgttaacccgggtttaccggtttacccgggtttttacccggggaaccggggtttaaccggggaacccgtaaacggtccggtaacgggtacgtaacgttaccgtaacgggtaaccggttaaacggtcgggttaacggtacccggtacggttaaccgtaaccgttacgttaccggttttaccgttaccgttaccgtttaccccgg

SEQ ID NO: 278048 - DNA, 916 bp, Homo sapiens
  misc_feature: GYAE6OF02HSBIQ.29.35.D02.1.454.CMB.1.raw
  modified_base (207)..(207): a, c, t, g, unknown or other
  misc_feature (207)..(207): n is a, c, g, or t
  modified_base (213)..(213): a, c, t, g, unknown or other
  misc_feature (213)..(213): n is a, c, g, or t
tcagatagagtactcacgaccggtgctcgatttagcacacgatagttggggtttggggaggaactgctcagttaggacccagacggaaccatggaagccccagctcagcttctcttcctcctgctactctggcctcccagactaccaggcggagagacttggtgttagacacagtcctccagccaccctgttctttgcgtccggganaaagcnccaacctctcctgcacgggccacgtcagtagttacgttaaaccacgttactttgggaccttgggtttaccaaacgtaacgaaaacccgttcggacccaacgggccctacccgaggtccttacctcctaataccgttaatggtaactcgtacaaccgttacccgaaacggtaccgggtccccgtaccgtacgggtccgtaacccttcccggaaccggtccccgttaggttaccgtagggttacggacgttaacggggttcgggttcggtacggggtaaaccgtacgggttaaccctttaccgtacccgtttaccggtacccaaaccgttaaccgtcccgtaacggtcccgtaacccgttacgggtaacgtacccgttacgggttaacggttaaaccgtttccgtcgggtttttaaacccggttttttagtttaaaccggttttcgtttcggggttacgggttaccgttacggtaccgtttaaacccgggttcggttaccccgttacccgggttaacccgtttaacggtttacccgggacgttaaccggggggtaacccttaacgggtacggtttaccggggagtaccgggttacccgtaaccgggtaaaccgttaaccggtacgggttaccggtacgtttaccggaacccgttaaccggtaaccgtttcccggttccggttttacccgttaccctttaccccgg

SEQ ID NO: 278049 - DNA, 718 bp, Homo sapiens
  misc_feature: GYAE6OF02F47RS.29.35.D02.1.454.CMB.1.raw
  modified_base (204)..(204): a, c, t, g, unknown or other
  misc_feature (204)..(204): n is a, c, g, or t
tcagatagagtactcacgaccggtgctcgatttagcacacgatagttgggtttgggggaggaactgctcagttaggacccagacggaaccatggaagccccagctcagcttctcttcctcctgctactctggctcccagataccagcggagagattgtgttgacacagtctccagccaccctgtctttgtctccgggagaaagngccaccctctcctgcagggccagtcagagtgttaacactacttggcctggttccaacagaaacctggccaggcctcccgaggctcctcatctatgatgcatcccaaacgacgggccctacgtcggctactccccagccctagggttcaaggttcggcgtaacgggtttcggggtccgttagggggaaccaacggtaccctttaccgaccttccctaccgaccctaagtccgacgcccgaccgtacgacgtccgtagtacggtactttcgtacgttaccgttttagtttacgtttacggttcgtttacggggtccgttaacgtaccgtaacgttccgggccccttcccggttaccgttaccggtttttaccggacccggtaacgggtaaccgaccggtaacgtacgggaacgttaacgttaaaccggtaaccgtttagggtcgggtaccgttaccggtacctacccgtacgtttcccgttagttacccgtttaccttaccgttcccgttaccccg

SEQ ID NO: 278050 - DNA, 773 bp, Homo sapiens
  misc_feature: GYAE6OF02F7UOY.29.35.D02.1.454.CMB.1.raw
  modified_base (213)..(213): a, c, t, g, unknown or other
  misc_feature (213)..(213): n is a, c, g, or t
  modified_base (314)..(314): a, c, t, g, unknown or other
  misc_feature (314)..(314): n is a, c, g, or t
tcagatagagtactcacgaccggtgctcgatttagcacacgatagttgggtttgggggaggaactgctcagttaggacccagacggaaccatggaagccccagctcagcttctcttcctcctgctactctggctcccagataccagcggagagattggtgttgacacagtcctccagcccacccttgttctttcgtcgtccggggaagaaagngcccaccctctcctgcacgggccagtcagagttagttaacaacttacttcggccttgggttaccaaacacggaaacctcggccaaggcctccaggcctccncacttcatgatgcactccgaacgcgggacctacgtcggcctaactcccgagtaccccgtagggttccaggtacgggaccgtaggggttacgggtccggtacggggaacgtacggtaccgtttacaccctttccgacgtaaccctagtcccgacggccccggtaccgtacggacgtacccggtagggacggttacgtttcgtaccggtttacgttttaacgttttacgtttcgggttacggtttcgggtaccggttaacgtaccgtaacggttcccggtcccgtttacccggttccggttttaaccggttttccgggggacccggtaacgggggttaaacccgtaaccgggttcggtacgggaagttaccgttacgggaacgtaaccgggtaacggtttcgggtcggtcgttaccggaccgtaaccgttacgttccggtacgtttccttacttaccccgg

SEQ ID NO: 278051 - DNA, 635 bp, Homo sapiens
  misc_feature: GYAE6OF02HKUZM.29.35.D02.1.454.CMB.1.raw
  modified_base (253)..(253): a, c, t, g, unknown or other
  misc_feature (253)..(253): n is a, c, g, or t
tcagatagagtactcacgaccggtgctcgatttagcacacgatagttgggtttgggggaggaactgctcagttaggacccagacggaaccatggaagccccagctcagcttctcttcctcctgctactctggctcccagataccagcggagagattgtgttgacacagtctcagccaccctgtctttgctccgggagaagcgccaccctctcctgcagggccagtcagatgtaacactactggcctgtccaanagaacctgcagcctccagctctcatctatgatcgctactaccaacgacggccacgtcggaccacgtacccgacggaccgttaggttaccgaggttcggacgacggggtttcgggtccgtaggggaacctacgtccgtttacaaccgttccgttaccaccgtagtccgtaacgcccgtaccgttaacggacgtcccgtaaggtcgtacgtttcgtcgttaaccttttagttacgtttgttcggttgggtacgttacgactaacgttcgtacccgtccgttacgttaccgtttgggaccgtaacggggtaacctacggcgtacggtacgagtacgacgtaacgacgtggtacgtcgtcgactaccgtagttctcgtcttactac

SEQ ID NO: 278052 - DNA, 728 bp, Homo sapiens
  misc_feature: GYAE6OF02HGWUT.29.35.D02.1.454.CMB.1.raw
  modified_base (429)..(429): a, c, t, g, unknown or other
  misc_feature (429)..(429): n is a, c, g, or t
tcagatagagtactcacgaccggtgctcgatttagcacacgatagttgggtttgggggaggaactgctcagttaggacccagacggaaccatggaagccccagctcagcttctcttcctcctgctactctggctcccagataccagcggagagattgtgttgacacagtctccagccctacctgttctttgtcctacggggagaaagacgcccaccctctcctgcgagggccagtcagtagtagttaacactacgttggcctggttaccaacgacgaaaccgtggacccacggcctcccgaggcctaccgtcactctatgatcgactactaccgaacgcgggtaccctacgtcggaccaccgtcccgaacgcccgtaaggttcgacggttcggcgtagggttgggtcgtagggacctacgtaccttacnctcctacgaccctagtccgacgtcccgtacgtacggccgtaccgtacgggtaacgttactttaccggttcggtttaccgtttttagtttacggtttcggttaccggtttaggggtaccgtttaacgaccgttaccggttcccggttcccgtttacccgttaccgtttaccgtttacgggacccgggtaccggggaactaacgggttacgacgggtacgtacacggaacggtaaccggtacggtcggtcgtaccgttaccggacttaccggtactttaccggtcgtttaccgtctacccg

SEQ ID NO: 278053 - DNA, 605 bp, Homo sapiens
  misc_feature: GYAE6OF02I6JAT.29.35.D02.1.454.CMB.1.raw
  modified_base (259)..(259): a, c, t, g, unknown or other
  misc_feature (259)..(259): n is a, c, g, or t
  modified_base (284)..(284): a, c, t, g, unknown or other
  misc_feature (284)..(284): n is a, c, g, or t
  modified_base (297)..(297): a, c, t, g, unknown or other
  misc_feature (297)..(297): n is a, c, g, or t
tcagatagagtactcacgaccggtgctcgatttagcacacgatagttgggtttgggggaggaactgctcagttaggacccagacggaaccatggaagccccagctcagcttctcttcctcctgctactctggcctcccagataccagcggagagattgtgttgacacagtctccagccaccctgtctttgtctccgggagaaagcgccaccctctcctgcagggccagtcagagtgtaacactacttgcctggtccaanagaactgccagcctccaggctcctnactctatgatgcntccaagaggccacgtcgcactccagcagtcagtgacaggtcggtctgggacacgtacttcactcacactacgtcacgacccgtccgtacgacgtaccgtgaggtacttcgttccgtaccgttttatttacgtttagttcgtttacgggtccgttacggtacctaaccgtcgggtccccttacccggttcttaccgttttcgggccgtacggggtaccgaacgtcggttagacggtactacggtacgaacggttaacgtcggtacggtccgcggtaccgacgtaccttccgtaccgtcttacgttcccg

SEQ ID NO: 278054 - DNA, 674 bp, Homo sapiens
  misc_feature: GYAE6OF02JDBUJ.29.35.D02.1.454.CMB.1.raw
  modified_base (206)..(206): a, c, t, g, unknown or other
  misc_feature (206)..(206): n is a, c, g, or t
  modified_base (343)..(343): a, c, t, g, unknown or other
  misc_feature (343)..(343): n is a, c, g, or t
  modified_base (354)..(354): a, c, t, g, unknown or other
  misc_feature (354)..(354): n is a, c, g, or t
tcagatagagtactcacgaccggtgctcgatttagcacacgatagttgggtttgggggaggaacgtgctcagttagggacccagacggaaccatggaagccccagctcagcttctcttcctcctgctactctggctcccagataccagcggagagattgtgttgaacacagtctccagccaccctgtctttgtctcgggagaaagngccacctctcctgcgagggccagtcgagacgtagttaaaccaactacgttggacctggttaccaacaacgaaaccttggccgagcctaccacggctcctacatctagtgaactcgactactaccaagcggacctacncggcactaccncgactacggtcagtcggctaacggggtgggtctaggggaacacggtacttccaaccgttactacctaaccgtatccgaccgaccgtactaacggacgtaccgtaggtacggtacttccgttacgttaccgtttacgtttacgttcgtttacggttcgggtaccgttacggtactaaccggttcgtcccgttaacccgtttccgtaaccgttttccgggaaccggtacggtaaccgacggttcgtagggacttacgaggacggtaacggtactaggcgttaccgtcgactaccggtacttcggtctttacgtacttaccgg

SEQ ID NO: 278055 - DNA, 709 bp, Homo sapiens
  misc_feature: GYAE6OF02GDTVQ.29.35.D02.1.454.CMB.1.raw
  modified_base (204)..(204): a, c, t, g, unknown or other
  misc_feature (204)..(204): n is a, c, g, or t
tcagatagagtactcacgaccggtgctcgatttagcacacgatagttgggtttgggggaggaactgctcagttaggacccagacggaaccatggaagccccagctcagcttctcttcctcctgctactctggctcccagataccagcggagagattgtgttgacacagtctccagccaccctgtctttgtctccgggagaaagngccaccctctcctgcagggccagtcagagtcgttaacaactcttggccttggttaccaacagaaacctggaccacggtcctccgaggcctcctcatctatgatgcataccgaacgacgggaccacgtcggcactcccgagccgtagttcgaggtcggcgtaggttcgggtcgtggggacctaggtaccttactacgtcctaccgacgtactacgacggccgtaccgtacggaccgtccgtacggtaacggtctttccgtacggtttaccgttttatttacgtttcggttcggttcggggtaccgttacggaccgtaaccgtccggtaccccgttacccggttaccttacgggtttccggacccggtaacggggtaccctaaacggtccgtaacgggacgtacgttacgtaacgggtaaccggtaacggttcgggtaccgggttacctccggaaccttacccggttaacgtttcccgtttaccggtttacccttacgttaaccccg

SEQ ID NO: 278056 - DNA, 802 bp, Homo sapiens
  misc_feature: GYAE6OF02F58M3.29.35.D02.1.454.CMB.1.raw
  modified_base (197)..(197): a, c, t, g, unknown or other
  misc_feature (197)..(197): n is a, c, g, or t
  modified_base (202)..(202): a, c, t, g, unknown or other
  misc_feature (202)..(202): n is a, c, g, or t
  modified_base (212)..(212): a, c, t, g, unknown or other
  misc_feature (212)..(212): n is a, c, g, or t
tcagatagagtactcacgaccggtgctcgatttagcacacgatagttgggtttgggggaggaactgctcagttaggacccagacggaaccatggaagccccagctcagcttctcttcctcctgctactctggctcccagataccagcggagagattgtgttgacacagtctccagccacctgtctttgctccggganaaagngccaccctcncctgcagggccagtcagtagtagttaaacaactacttggcccttggttccaacagaaacctggccaaggctcccaggctcctcatctatgatgcactccgaacgacgggccacgtgggccacttccccgaagcccgtaagggttccagggttcggacgaacgggtttgggggttacccgttagggggaacgtacggttaaccgtttaccgtaaccgtttacctacccgtaaacccgtaacgttaccggtaacccgggtaccccgtacccgtttaaacgggaacggtacccgttacgggtaacgggttaaccttttaccggttaccggttacccggtttttaacttttaacggttttacggtttccgggttttaccggggttaccggttaacgggtaaccgttacccggttacggtccccggtttaccccggttacccgttaacccggttttttcccgggaacccgggttaaccggggtaacccgtaacgggtccgttacggggacgtacgtaccgtacggaaccggtaacgtcgggtacggttcgtacgtaccgacccgtacgttaccgtcgttccttcccgttaacccg

SEQ ID NO: 278057 - DNA, 668 bp, Homo sapiens
  misc_feature: GYAE6OF02JQCVK.29.35.D02.1.454.CMB.1.raw
  modified_base (172)..(172): a, c, t, g, unknown or other
  misc_feature (172)..(172): n is a, c, g, or t
  modified_base (175)..(175): a, c, t, g, unknown or other
  misc_feature (175)..(175): n is a, c, g, or t
  modified_base (199)..(199): a, c, t, g, unknown or other
  misc_feature (199)..(199): n is a, c, g, or t
tcagatagagtactcacgaccggtgctcgatttagcacacgatagttgggtttgggggaggaacgtgctcagtttaggacccagacggaaccatggaagccccagctcagcttctcttcctcctgctactctggctccagataccagcggagagattgtgttgacacagtcnccngccacctgttctttgctccggganaaacgcgccaccctctcctggcgagggccaggtcacgtagtacgttaaacactacgttaggcctaggttcccaaacgacgtaaacctggaccgaggtccctacccgaggtcctccgtacaacttcgtaatgactcgaccactaccaaacgcgggaccacgtcggactactccccgagacccgttaaggttcaacggtcggaccgtacgggttcgggtcgtacggggacctacggttaccttcgacctttacgactacctagtccgacgcccgacgtacgacgtccgtagtacgtacttcgtcgttacgtttagttacgttcgttacgttcggtcgtacgtacgtaacgtccgtaccgttaccgttactcggtttacgaccggtaccggaacgaggtccgtacgtacgtacgtacgacgtaacgtacgtcgcgttcgacgtaccgaccgtattccgtacgtctcgtaccg

SEQ ID NO: 278058 - DNA, 670 bp, Homo sapiens
  misc_feature: GYAE6OF02GJMYY.29.35.D02.1.454.CMB.1.raw
  modified_base (301)..(301): a, c, t, g, unknown or other
  misc_feature (301)..(301): n is a, c, g, or t
tcagatagagtactcacgaccggtgctcgatttagcacacgatagttgggtttgggggaggaactgctcagttaggacccagacggaaccatggaagccccagctcagcttctcttcctcctgctactctggctcccagataccagcggagagattgtgttgacacagtctcagccaccctgtctttgtctccgggagaaagacgccaccctctcctgcacgggccagtcagacgtagttaaccaacttacttggccttcggttaccaacacgaaacctggccaaggcctcccaggctccncatctatgatgcactccaacgcgggccacgtcggactacgtcccaggccctaggttcaggtcggactgggttgggtcgtggggaactacgtaccttcacttcgtccaccacgtaccgacggcccgtaccgtaaggcgcctagggacggtatttcgttcggttaccgtttatttacgtttggtttacggttgggtaccgttaggccttaaaccggtcggttacccttcccggttacgttaccgtttcgggaccggtacggggaacctaacggccggttacgagtacgtaccgacgggtaaaccggtactttagggcgtaccgtcggaaccttaccgtacgttacccgttacgttccttacgttaacccgg

SEQ ID NO: 278059 - DNA, 692 bp, Homo sapiens
  misc_feature: GYAE6OF02JS4PK.29.35.D02.1.454.CMB.1.raw
  modified_base (151)..(151): a, c, t, g, unknown or other
  misc_feature (151)..(151): n is a, c, g, or t
  modified_base (197)..(197): a, c, t, g, unknown or other
  misc_feature (197)..(197): n is a, c, g, or t
  modified_base (201)..(201): a, c, t, g, unknown or other
  misc_feature (201)..(201): n is a, c, g, or t
  modified_base (209)..(209): a, c, t, g, unknown or other
  misc_feature (209)..(209): n is a, c, g, or t
  modified_base (269)..(269): a, c, t, g, unknown or other
  misc_feature (269)..(269): n is a, c, g, or t
  modified_base (648)..(648): a, c, t, g, unknown or other
  misc_feature (648)..(648): n is a, c, g, or t
tcagatagagtactcacgaccggtgctcgatttagcacacgatagttgggtttgggggaggaactgctcagttaggacccagacggaaccatggaagccccagctcagcttctcttcctcctgctactctggctcccagataccagcgganagatttgtgttgacacagtctccagccacctgtctttgctcggganaagngccacctntccgtgcagggccagtcagagtgttaaaccaacttacgtttggccttgggttacccaaanacgtaaaaccttgggccctaagggcctaccccgaacggccttccctacaacgtctaacgttgaacgttgactactacccgaaacgcgggtacccacgttacgggacctacgtaccccgaaggcccgttaaagggtttccgaaggtcggtgaacggtttcggggactcggggaacacggtaccttacactccgttacaaccctactacgaccgccgtacctacgacgtccgttagaacgtgtttccgtagttacccgtttattacgttgttcgttcgggtaacgtcgtactaaccgttcggacccttcccgttaacgtccgtttacggcccggttaagggacctaacggcgtacggatacgtcacggtacaacgttcggnggtaccttggacccttacgtacgttactcgttcctagttacccg

SEQ ID NO: 278060 - DNA, 713 bp, Homo sapiens
  misc_feature: GYAE6OF02IQDH9.29.35.D02.1.454.CMB.1.raw
  modified_base (216)..(216): a, c, t, g, unknown or other
  misc_feature (216)..(216): n is a, c, g, or t
  modified_base (220)..(220): a, c, t, g, unknown or other
  misc_feature (220)..(220): n is a, c, g, or t
tcagatagagtactcacgaccggtgctcgatttagcacacgatagttgggtttggggaggaactgctcagttaggacccagacggaaccatggaagccccagctcagcttctcttcctcctgctactctggctcccagataccagcggagagattgtgtgacacagtcctccacgcccaccttgttctttgtctccgggagaaagcgcccaccctntccngcagggccagtcagtagtagttaaacacttacttggcctcggttaccaacaagaaacctcggccacggccttcccgacggtcctccctactactactatgactcgctactaccaacggaccgggacaacgtcggacacctaccgaccgccgtacggttacgacggtcggtacgaggttgggtccgtaggaacgtacgtcttacctactctacctacctactaccgcgtacccgaccgtaacgtacgtccgtcggtaacggtttacgtcgtaccggtttaccgtttttacgtttgttttacggttacggttcggggttacgttacggtacctaaccggttccgtcccgtttaccccgttacgtttaccggttttccgggacccggtaacgggggaaaccttacggtacgttcgggtacgtacgtacgtaacggactaaccggtggtaccgtcgtacgacgtactacgttccgtacgttaccgttagttaccccg

SEQ ID NO: 278061 - DNA, 755 bp, Homo sapiens
  misc_feature: GYAE6OF02F5KI0.29.35.D02.1.454.CMB.1.raw
  modified_base (200)..(200): a, c, t, g, unknown or other
  misc_feature (200)..(200): n is a, c, g, or t
  modified_base (210)..(210): a, c, t, g, unknown or other
  misc_feature (210)..(210): n is a, c, g, or t
  modified_base (334)..(334): a, c, t, g, unknown or other
  misc_feature (334)..(334): n is a, c, g, or t
tcagatagagtactcacgaccggtgctcgatttagcacacgatagttgggtttgggggaggaactgctcagttaggacccagacggaaccatggaagccccagctcagcttctcttctcctgctactctggctcccagactaccagcggagagattgtgttgacacagtcctcagcccacctgttctttgcctcgggaanaaacgacccncctctccgtgaccgagggcccagtccgaagtacggtagttaaaccaactcgttcggccttcggttaccaaacgacgtaaaccgtcggaccgaaggcctaccgacgccttccgacagttctatanagtcgactactaccgaacgaccgggtacctacgtacggacctaacgtccccgaaggttaccgtacgggtttacgacgggttcggacggttagggtcgggtaccggtacggggaacttaacggtcttaaccggactcctaaccgactacggtaccaccggcccgtacgtacgacggtacgtacggtacgttacgttaccgttcggtttaacgttttacgtttacgtttacggttcggttacgggtacggttacgtacgtaccggttaccggttcccgttccggtttaccgttacggtttaccgaccgggttaaccggaccggtaacgtcggtaggtaccgtacgacgtaccggtaacgtcggtacggtcggtaccgtacgtaccgtacgttcttccgtgtttccttaccgttacctaccccg

SEQ ID NO: 278062 - DNA, 864 bp, Homo sapiens
  misc_feature: GYAE6OF02F6467.29.35.D02.1.454.CMB.1.raw
tcagatagagtactcacgaccggtgctcgatttagcacacgatagttgggtttggggaggaactgctcagttaggacccagacggaaccatggaagccccaggctcagcttctcttcctcctgctactctggctcccagataccagcggagagattgtgttgacacagtctccagcccacccgtgtctttgtcgtccgggagaaaggacgccacccgtctccgtgccgacgggcctagtccaagtaggttcgttaaaccaaccttaacgttcggccttcgggttacccaaaccgacgaaaacccgtcggacccgtaagggccctaccccgaagggcctaccccgttccacttccgttaatcggtaagtcggcctaacgttaccccaaacgaacggggcccgtaaccgttacggggaccctaacgttccccccgaaggtaccccgtaacggggtttccgtaaacgggttcgggtaaccgtaacggggtttcggggggttaccggtacgggggtaaccgtaaacgggttacctttaacccggtaacctttacccgttaacccaaacccgtaaccttacccggaacccggtaccccggtaaccccgttaacgggtaacggtccccggttaaggtaccgggtaaacttttccggttaccggtttacccgttttaacgtttaagtttcggtttacggtttcggggtacggttacgtaccgtaacgttcggtaacccttcccgtacgtaccgttttcggacccggtacgggtaacccgtaggtaccgtacggaagtacgcgtaacggacggtaacgttcggtacggtccgtacgacccgtacgtacgttcgttccggttcctcttacccg

SEQ ID NO: 278063 - DNA, 278 bp, Homo sapiens
  misc_feature: GYAE6OF02FZG2G.29.35.D02.1.454.CMB.1.raw
  modified_base (255)..(256): a, c, t, g, unknown or other
  misc_feature (255)..(256): n is a, c, g, or t
  modified_base (258)..(278): a, c, t, g, unknown or other
  misc_feature (258)..(278): n is a, c, g, or t
tcagatagagtactcacgaccggtgctcgatttagcacacgatagttgggtttgggacagacttcactctcaccatcagccgcctagagcctgaggattctgccgtttattattgtcttgggcgtagcaactggcctcccgtcacttttggccaggggaccaagctggagatcagacgaactgtggctgcaccatctgtcttcatccttcccgcatctgaatactctatctgagcgggctggcaaggcgcatagnncnnnnnnnnnnnnnnnnnnnnn

SEQ ID NO: 278064 - DNA, 698 bp, Homo sapiens
  misc_feature: GYAE6OF02F9LRK.29.35.D02.1.454.CMB.1.raw
  modified_base (615)..(615): a, c, t, g, unknown or other
  misc_feature (615)..(615): n is a, c, g, or t
tcagatagagtactcacgaccggtgctcgatttagcacacgatagttgggtttgggggaggaactgctcagttaggacccagacggaaccatggaagccccagctcagcttctcttcctcctgctactctggctccagataccagcggagagattgtgttgacacagtctccgagccaccctgttctttgtctccgggagaaagagcccaccctctcctgcgagggccagtcagacgtagttaaacaactacttggccttggttacccaaacagaaacctcggccacggcctcccgacggtcctccctctatcctatgatgtcactaccgaacgcggaccacgtcggccacttcccacgccgtacggtttacgacggtcggtcgagggtttcggggtacggttcggggacacggtaccgttacgtaaccgttccgtaccgacctaactccgtaacggcccgtaaccgtaggaaccgtccgtaggtacggtacttacgttcggttaccgttttagtttactttcggttcggtttcgggtacgtcgtaccgtaacggtccggtcccgttaccggtaccgttacggtttacggacccggtacggggaaccacggtcgngggtaagacgtcgaacggtaccgtaacgtggtacggtactacggtaccctaccgtacggttctaccgttcgttaccgttaccg

SEQ ID NO: 278065 - DNA, 745 bp, Homo sapiens
  misc_feature: GYAE6OF02GODG1.29.35.D02.1.454.CMB.1.raw
  modified_base (158)..(158): a, c, t, g, unknown or other
  misc_feature (158)..(158): n is a, c, g, or t
tcagatagagtactcacgaccggtgctcgatttagcacacgatagttgggtttgggggaggaactgctcagttaggacccagacggaaccatggaagccccagctcagcttctcttcctcctgctactctggctcccagataccagcgagagattgtnttgacacagtctccagccaccctgtctttgctcgggagaaagcgcccacctctctgcgagggccagtcagagttacgttaaacaccgttacttgggaccttcggtacccaagaacgtaaacctggacctaacgggcctacccgaggtcctccgtacacttccttaagtcgagtcgacctaactacccgaaacggtaccggggaccacgttacggcctaaccgtcccgaacgtacccggtaagggttaccgtacggttcggacgtaggggttcggggtaccgttaggggacctaacggtacttaccgaccttacctaccgactaacgtccgaacgtcccgtaccgtagtacgtaccgacggtaaacggttacttttccgtaccggtttacgttttaaacttgtttcgttacggttcggggtactacgtaccgtacgtcccggttccctacccggttagttaccgtttaccgggacgtacggggaaccctagggtaccgtaggtacgtactcgtaacggtaaccctaagggttcgcgggtaaccttccggaacctacgtacgttaacgtcggtttacctacgttacccg

SEQ ID NO: 278066 - DNA, 135 bp, Homo sapiens
  misc_feature: GYAE6OF02JA71A.29.35.D02.1.454.CMB.1.raw
  modified_base (130)..(135): a, c, t, g, unknown or other
  misc_feature (130)..(135): n is a, c, g, or t
tcagatagagtactcacgaccggtgctcgatttagcacacgatagttgggtttgggcacagcggccctgggctgcctggtcaaggactacttccctcgtctctactgagcgggctggcaaggcgcatagnnnnnn

SEQ ID NO: 278067 - DNA, 762 bp, Homo sapiens
  misc_feature: GYAE6OF02IHWN1.29.35.D02.1.454.CMB.1.raw
  modified_base (194)..(194): a, c, t, g, unknown or other
  misc_feature (194)..(194): n is a, c, g, or t
  modified_base (199)..(199): a, c, t, g, unknown or other
  misc_feature (199)..(199): n is a, c, g, or t
tcagatagagtactcacgaccggtgctcgatttagcacacgatagttgggtttgggggagaactgctcagttaggacccagacggaccatggaagccccagctcagcttctcttcctcctgctactctggctccagataccagcggagagattgtgttgactacagtctccagccacctgtctttgctcggganaaagngccacctctcctgcagggccagtcagtacgttagttaaacacgttacgtggtccttcggttaccaactaacgtaaaaccgttggaccctaggcccttacccgacggcccttaacctcgtaactttcgtacttcgtacgtcggtaccaacttacccgaaaaccggtcgggggtaacccctacggtacgggtccaaccgttccccgtaaccggtcccgttaaggggtttccgaaacgggtttggcccggttaggggttcggggtcgttaccggggataacggtacctttctaaccttccctactaaccattcccgagtaccccgtacgtaacggacgttccgtacggaaacgttcgttacggttacgtttaccggttttaaatttaccgtttgtttaccgggttggttaccgtacgtacgtaccgttccggtaccttcggttacctacggttttcggacccgtacgggactaacggtccggtagtacggactacgacggtaaccggtacgttacggtcggacttacggccgttaacgtacgtttcggttacgttcctacttcccg

SEQ ID NO: 278068 - DNA, 852 bp, Homo sapiens
  misc_feature: GYAE6OF02GLCZ3.29.35.D02.1.454.CMB.1.raw
tcagatagagtactcacgaccggtgctcgatttagcacacgatagttgggtttgggggaggaactgctcagttaggacccagacggaaccatggaagccccagctcagcttctcttcctcctgctactctggctcccagataccagcggagagattgtgttgacacagtctccagcccaccctgttctttcgtccgtccgggaagaaagacgaccctacccctctcctgcgagggccagtcagagttattaacaacttacttcggccttggttaccaaacgaacggtaaaccgtcggcctaacggccctaccccgaggtcccttccccagaacttccgttatcgatcgtcaactacccgaacggacgggtccccacgtcgggacctacctaccccgacggtacccgttacgggtttcgaacggttcggaccgtaggggtttcggggtaccggttacgggggaaacctacggttacccgtttctaacccttaccctacccggtaaaccctcttacccggaccggtccccggtacccgtaacgggacggtaccccgtagggtaaacggttcctttaccggttaccggttttacccgttttttaagttttccgttttcggggtttaccgtttcgggggtaacccgttaacggtcccggtttaaccggtcccgggttaccccggttttaccccgtttccgttttaaccgggtttcccgggaacccggttaaccggggaaacccttacgggcggttacgacggttacgtaaccgaaggttaccggtaacggttcgggtaccggtcgttccgaaccttcccgttacgttaccggttttgttacccgtacctttacccg

SEQ ID NO: 278069 - DNA, 840 bp, Homo sapiens
  misc_feature: GYAE6OF02JN5T9.29.35.D02.1.454.CMB.1.raw
tcagatagagtactcacgaccggtgctcgatttagcacacgatagttgggtttgggggaggaactgctcagttaggacccagacggaaccatggaagccccagctcagcttctcttcctcctgctactctggctcccagataccagcggagagattgtgttgactacagtctccagccaccctgtcttgtctccgggagaaagacgccaccctctcctgcgaggccagtcagacgtacgttaaaacctcttacggcctggttaccaacgagaaaccttggaccacggcctacccacggccttacccgtctacgttctatgtactgacacttccgaaaccgacggggtacctacgtcgggactaccgtaccccgacggtccgtaacggttaccgaaggtccgggacctacggggttaccggggttacgtacgggggaacctacggtaaccgtttacgacccgttaccgttacctaacccgtacgttccggaaccgtccccgtaccggttaaacgaccggttcccgtacgggtaacggtacgtttcccggttaccggttacccgttttaacgtttacgttttccggttacggtttaccgggttaacggtacgttacccggttaacctttccgggtcccccggtttacccggttccgtttaaccgttttacccgggcccggtaaacggggtacccggtaaccgtccgggtaacggtaacgtttacgtccggaacgggttaacccggttaaccggtacgggttcggtaacccgtaccggttaaccggcccgttaaccggtttcccgttaccgggtttaccctttaccgtacgtttaccccccgg

SEQ ID NO: 278070 - DNA, 577 bp, Homo sapiens
  misc_feature: GYAE6OF02F29CC.29.35.D02.1.454.CMB.1.raw
  modified_base (197)..(197): a, c, t, g, unknown or other
  misc_feature (197)..(197): n is a, c, g, or t
  modified_base (210)..(210): a, c, t, g, unknown or other
  misc_feature (210)..(210): n is a, c, g, or t
  modified_base (257)..(257): a, c, t, g, unknown or other
  misc_feature (257)..(257): n is a, c, g, or t
tcagatagagtactcacgaccggtgctcgatttagcacacgatagttgggtttggggaggaactgctcagttaggacccagacggaaccatggaagccccagctcagcttctcttcctcctgctactctggctcccagataccagcggagagattgtgttgacacagtctccagccacctgtctttgtctccggganaagcgccaccctntcctgcagggccagtcagagtgttaacacttctggcctggttccaanagaaacctggccaggctacccgggctcctcatctatgatcgcatccaacgacggtccactggcacgtccagccaggttcagtcggcaggtcgggtacgtggacaggtacttcaactctacacctatcgaggccgcgtacgacgccgtagaggtacttcgtgttaccgtttattacgttgttcgtgggtcgtagacgaacgttcggaccttcccgtacttacgttttcggaccgtacgggactaacggtcgtacggagtacgtacgagaacgtacgttggcggtactcgactaccgtagtccttcgtcttctactttcccg

SEQ ID NO: 278071 - DNA, 744 bp, Homo sapiens
  misc_feature: GYAE6OF02H6E69.29.35.D02.1.454.CMB.1.raw
  modified_base (201)..(201): a, c, t, g, unknown or other
  misc_feature (201)..(201): n is a, c, g, or t
  modified_base (206)..(206): a, c, t, g, unknown or other
  misc_feature (206)..(206): n is a, c, g, or t
  modified_base (324)..(324): a, c, t, g, unknown or other
  misc_feature (324)..(324): n is a, c, g, or t
tcagatagagtactcacgaccggtgctcgatttagcacacgatagttgggtttgggggaggaactgctcagttaggacccagacggaaccatggaagccccagctcagcttctctttcctcctgctactctggcctccagataccagcggagagattgtgttgacacagtctccagccacctgttctttgtcgtccggganaaagngcccaccctctcctgcgagggccaggtcagtagttgttaaacacttagttggccttcggttaccaaacgaagtaaaccgtggaccaacggtcctacccgaggtacctccgtactactntagtcagtcgactaaccgaccgaacggcgggaccaccgtgcctaccgacctaggtacctacggtttcgagtcggactaggggttcgggtacgtaggggaaccgtagtaaccgtttaccaccgttctacccgtaacacgtaccggccgtaccgacgttacggaacgttccggtaggaacgttcttcggttacgtttaccgtttttagttaccgtttcggtttcggttacggggtaccttaacgtaccgttaacggttcccggtccccgtttacccggtttacgttttacccggttcgggaaccgtaaaccggggttaccaacgggtacgtacgggaagttaccaggtaaccggaacggttaacggttggtaaccgtcgacgtaccgtaaccgtcctttgtaccgttttaccaggtttcccc

SEQ ID NO: 278072 - DNA, 645 bp, Homo sapiens
  misc_feature: GYAE6OF02FIT1D.29.35.D02.1.454.CMB.1.raw
  modified_base (200)..(200): a, c, t, g, unknown or other
  misc_feature (200)..(200): n is a, c, g, or t
  modified_base (233)..(233): a, c, t, g, unknown or other
  misc_feature (233)..(233): n is a, c, g, or t
  modified_base (316)..(316): a, c, t, g, unknown or other
  misc_feature (316)..(316): n is a, c, g, or t
  modified_base (341)..(341): a, c, t, g, unknown or other
  misc_feature (341)..(341): n is a, c, g, or t
  modified_base (613)..(613): a, c, t, g, unknown or other
  misc_feature (613)..(613): n is a, c, g, or t
tcagatagagtactcacgaccggtgctcgatttagcacacgatagttgggtttgggggaggaactgctcagttaggacccagacggaaccatggaagccccagctcagcttctcttcctcctgctactctggctcccagataccagcggagagattgtgttgacacagtctccagccaccctgtcctttgtctccggganaaagcgccacctctcctgcacgggccagtcagngtgttaacaacttacttggccctggttccaacagaaacctggccaggcctcccaggcctcctcatctatgatcgcatccaacncgggcctacgtggcctaactcccgngacctaggttcaggttcggacgtaggtcgggtcgtagggaccaagtaccttacgaccttacgtccaccctaactaccgacgtcccggaccgtacgaccggcctacggtaacggtacttcgtacggttaccgtttaatttacgtttcgtttcggttcgggtacgtacgtaccgtaacgtacggtccctccgttaccgttacgttttacggaccgtacgggaaccgtaacggtcgtaggacgtactacgacggtaacgaacgttggtcggtccncgtaccgacctactcctgttaccttcttaccg

SEQ ID NO: 278073 - DNA, 719 bp, Homo sapiens
  misc_feature: GYAE6OF02F207Q.29.35.D02.1.454.CMB.1.raw
  modified_base (151)..(151): a, c, t, g, unknown or other
  misc_feature (151)..(151): n is a, c, g, or t
  modified_base (399)..(399): a, c, t, g, unknown or other
  misc_feature (399)..(399): n is a, c, g, or t
tcagatagagtactcacgaccggtgctcgatttagcacacgatagttggggtttgggggaggaactgctcagttaggacccagacggaaccatggaagccccagctcagcttctcttcctcctgctactctggctccagataccagcgganagattgtgttgacacagtctccagccaccctgttctttgtcgtaccggggaagaaagacgccaccctctcctggcacgggccagtcagtagtagtaacaacttacgtggcccttaggttacccaaacgaacgtaaaccgtcggaccacgggtcctacccgacggtcctaccctcatctatgtatcgcactaccgaacgacgggccacgtggctaccgtacccgacgccgtaggttcgaggtcggacgngggttgggcgtagggactacggtacttacgtactcctaaccaccacgtacgaaccggtccgtaccgaacggacgtccgtaggaacggttacttttccgtcggtttaccgtttttaagtttacgtttcggtttcgttcggggtaccgtacgtaccgtaaacgttccggacccgtttcccggttacttaccggtttcgggaaccggtaccgggaacctacggtacgtaggtacgtacgtacggaacgtaccgggtaacgttgggtaccgtacggtaccgtaccgaaccgttcgttccgtacgttacccgtttacgtaacccg

SEQ ID NO: 278074 - DNA, 651 bp, Homo sapiens
  misc_feature: GYAE6OF02JFIAI.29.35.D02.1.454.CMB.1.raw
  modified_base (173)..(173): a, c, t, g, unknown or other
  misc_feature (173)..(173): n is a, c, g, or t
  modified_base (214)..(214): a, c, t, g, unknown or other
  misc_feature (214)..(214): n is a, c, g, or t
  modified_base (333)..(333): a, c, t, g, unknown or other
  misc_feature (333)..(333): n is a, c, g, or t
  modified_base (356)..(356): a, c, t, g, unknown or other
  misc_feature (356)..(356): n is a, c, g, or t
  modified_base (362)..(362): a, c, t, g, unknown or other
  misc_feature (362)..(362): n is a, c, g, or t
  modified_base (482)..(482): a, c, t, g, unknown or other
  misc_feature (482)..(482): n is a, c, g, or t
  modified_base (629)..(629): a, c, t, g, unknown or other
  misc_feature (629)..(629): n is a, c, g, or t
tcagatagagtactcacgaccggtgctcgatttagcacacgatagttggggtttggggaggaactgctcagttaggacccagacggaaccatggaacgccccagctcagcttctacttcctcctgctactctggctcccgagactaccgaggcggagagtacttggtaggttnacactagtctccgagccaccttgtctttgcgtaccgggganaacgcgccaccctctccgtgcgacgggccaaggtcagtatacgttaacacttagtggaccttaggtccaaacacggtaaccgtcgaccgaggcctaccgaggcctcacatctaatgaangacacgtacacggacggcctacnggaccncgtacccgacgtcgtaagggttcaagtcgacggtaggtcggtacggtacgggaacttagtccttacgacgttctaccacctacgtcgaccgacccgtcgaacgtcgtacccgtgtacgtnttacgtccgttacgttcttagttcgtagttacgggctaagtcgtaacgtcggtacctccgttacgttcgttccggacggaacggtccaacggtcgagggtacacgtaccgcggtaacgacgttgtccggacttaccgacgttaaccncttcggtcttacctacgttccc

SEQ ID NO: 278075 - DNA, 666 bp, Homo sapiens
  misc_feature: GYAE6OF02INE0N.29.35.D02.1.454.CMB.1.raw
  modified_base (154)..(154): a, c, t, g, unknown or other
  misc_feature (154)..(154): n is a, c, g, or t
  modified_base (285)..(285): a, c, t, g, unknown or other
  misc_feature (285)..(285): n is a, c, g, or t
  modified_base (413)..(413): a, c, t, g, unknown or other
  misc_feature (413)..(413): n is a, c, g, or t
  modified_base (419)..(419): a, c, t, g, unknown or other
  misc_feature (419)..(419): n is a, c, g, or t
  modified_base (430)..(430): a, c, t, g, unknown or other
  misc_feature (430)..(430): n is a, c, g, or t
tcagatagagtactcacgaccggtgctcgatttagcacacgatagttgggtttgggggaggaactgctcagttaggacccagacggaaccatggaagccccagctcagcttctcttcctcctgctactctggctcccagataccagcggagagnttgtgttgacactagtctccagccacccgtgttctttgtccgtccggggaagaaagcgccacccttctccgtgccgagggcctaaggtccaggtagttcgttaaacacttacgttggcctaggttaccaanacgaaacctgggcctaggcctccaggtcctcctctatctagtacgtatgcctaactcccgaaagtcggacctacgtcgacacggtcccagccgtaaggttcgaggtcgctagggttcgggcagggacngtactnacttcacgacntaccgcgcgtacgtagacgtacgtacggagttacttcgttacgttacgtttacttacgttcgttcgtacgggtcgtacgacgtaccgttcgtcccgttaccgtacgtttaccggttcgggaaccgtacgggtaaccgcggtcgtacgggtacgtactacggacggtaacgttaccggtcggtacggtcgtaaccttacgtaccgtacgtttccggttacgttacgttaccgtaccg

SEQ ID NO: 278076 - DNA, 785 bp, Homo sapiens
  misc_feature: GYAE6OF02IBKN0.29.35.D02.1.454.CMB.1.raw
  modified_base (166)..(166): a, c, t, g, unknown or other
  misc_feature (166)..(166): n is a, c, g, or t
  modified_base (199)..(199): a, c, t, g, unknown or other
  misc_feature (199)..(199): n is a, c, g, or t
tcagatagagtactcacgaccggtgctcgatttagcacacgatagttgggtttgggggaggaactgctcagttaggacccagacggaaccatggaagccccagctcagcttctcttcctcctgctactctggctcccagataccagcggagagattgtgttgacanagtctccagcccacctgtctttgtcgtcggganaagacgccacctctctgcgaggccagtcagacgtagttaaacaacttacgtggccttcggttaccaacgtacgaaacctggaccgaaggcctcccgaggcctacctcacttctactgtatacgactacctaccgaaacgcggaccacgtacggctaccgtacccacggtccctagggttcgagtcggtacgtaggtacgggtccgtacgggtaacgtacgttaccgtactaacccgtttccgtaacccgacctaccgttccgaaccggtccccggaaccgttaaccgggacccggtaccgttaaacgggtacggttaacgttttccgttacgttttaccgttttaagtttaccgtttaccggtttcggttacgggtccggttaacgtaacccgtaaccggtttcccggtaccccgtttccggttaacccgtttcgggtttacccgggtaccgggtaaccgggttaccggtaacggtcccttaagggggtacctacggtaacggaccggtaaaccggttacgttcgggtaccggacgtaccgtcccgaacgttacccgtacggttacgtttccttacgtttacccgg

SEQ ID NO: 278077 - DNA, 889 bp, Homo sapiens
  misc_feature: GYAE6OF02FPXDL.29.35.D02.1.454.CMB.1.raw
tcagatagagtactcacgaccggtgctcgatttagcacacgatagttgggtttggggaggaactgctcagttaggacccagacggaaccatggaagccccagctcagcttctcttcctcctgctactctggctcccagataccagcggagagattgtgttgacacagtctccagccaccctgtctttgtcgtccgggagaagacgccaccctctccgtgcgacgggcctagtccgaagtacggttagttaaaccaacttaccgttggacccttgggttacccaaacgaacgtaaaacccgtcgggaccaacgggcctaccccgacgggtacccttcccgtacctaacgtttccttaagtcggtaacgttcggtacctaacgttaaccccgaaaaccggtaccgggggtacccctaaccggttacggtaccctaaacccgtacccccgaacggtaccccggttaacgggtttaccgaacgggttcgggaccgttaacgggggttcggggttaccggtacggggaaccctaacggttaccgttaccgtacccgttcctaacccgaccctaactacccgaaccggtacccgtaccgtacggtaccgtccgtagggaacggttacgttaccgttaccggttaccgttttacgttttacgtttcgggtttacggtttacggggttaccgttacggtaccttaaccggttccggttacccgttcccgttaccggtttaccggttttaccgggaccggtaaccggggtaaccgtaacggtccggtacgggtaacgtacgtacggtaaccggtaaccgtaaccggtacggtacggttaccgtacggtaccctaaccggtaccgttaccgtttaccttacccgttacccgttaacccg

SEQ ID NO: 278078 - DNA, 632 bp, Homo sapiens
  misc_feature: GYAE6OF02H9701.29.35.D02.1.454.CMB.1.raw
  modified_base (199)..(199): a, c, t, g, unknown or other
  misc_feature (199)..(199): n is a, c, g, or t
  modified_base (204)..(204): a, c, t, g, unknown or other
  misc_feature (204)..(204): n is a, c, g, or t
  modified_base (297)..(297): a, c, t, g, unknown or other
  misc_feature (297)..(297): n is a, c, g, or t
  modified_base (312)..(312): a, c, t, g, unknown or other
  misc_feature (312)..(312): n is a, c, g, or t
  modified_base (395)..(395): a, c, t, g, unknown or other
  misc_feature (395)..(395): n is a, c, g, or t
  modified_base (407)..(407): a, c, t, g, unknown or other
  misc_feature (407)..(407): n is a, c, g, or t
tcagatagagtactcacgaccggtgctcgatttagcacacgatagttgggtttgggggaggaactgctcagttaggacccagacggaaccatggaagccccagctcagcttctcttcctcctgctactctggctcccagataccagcggagagattgtgttgacacagtctccagccaccctgtctttgtctccggganaaagngccacctctcctgcagggccagtcagagttgttaaacaaactcttggcctggttccaacagaacctggccagctccgagcctctcatctagtnatcgcactccgaacncgggaccacgtcgacactcccagtccgagttacgaggtgccgtagtgggtcgtacgggactacgactttcacttctaccaccnctacgaacgccnccgtacgacgtcgtacgaaggttacttcgtcgttaccgttttaatttagttcgttcgttgggccgttacgtactaacgttcggtcccgttacccgtccgtaccgtttcggtaccgggtacgggtaaccgtaacggtacgtacggtacggatacgacgtaaccggtaacgttaggtcggtacgtcggtaccgaccgtacgttcgttacttaccgttccgttacccg

SEQ ID NO: 278079 - DNA, 638 bp, Homo sapiens
  misc_feature: GYAE6OF02HP8WC.29.35.D02.1.454.CMB.1.raw
tcagatagagtactcacgaccggtgctcgatttagcacacgatagttgggtttggggaggaactgctcagttaggacccagacggaaccatggaagccccagctcagcttctcttcctcctgctactctggctcccagataccagcggagagattgtgttgacacagtctcagccacctgtctttgctccgggagaagcgccacctctcctgcgacgggccagtcagagtacgttaaaccaacttacgttcggccttacggttaccaaacacgaaaccgtggaccgaggcctacccgaggtcctccgtactactactaagtcgtatcggactactaccgaacgtacgggaccacgtcggaccactcccgacgccgtaggttcaggtcggacgtaggtcgggtacgtgggaactacggtacttcgacctcaccaccatcgacgccgtcgtagaccgtcgtaggacgtactccgtagttaccgttttatagtttcgttcggtacggtacgtacgctaaccgtcggtcccttccgtacgttacgtttcgggaccgacgggtacacgtcgtagggactacgtcgaacgtcgaacgtcggtcgtacgtacgacctacgtacgttcgtcgttacttccgtaccg

SEQ ID NO: 278080 - DNA, 614 bp, Homo sapiens
  misc_feature: GYAE6OF02GKU8X.29.35.D02.1.454.CMB.1.raw
  modified_base (204)..(204): a, c, t, g, unknown or other
  misc_feature (204)..(204): n is a, c, g, or t
  modified_base (213)..(213): a, c, t, g, unknown or other
  misc_feature (213)..(213): n is a, c, g, or t
tcagatagagtactcacgaccggtgctcgatttagcacacgatagttgggtttggggaggaactgctcagttaggacccagacggaaccatggaagccccagctcagcttctcttcctcctgctactctggctcccagataccagcggagagattgtgttgacacagtctccagccaccctgtctttgtcctccgggagaaagngccaccctntcctgcagggccagtcagagtgttaacacttacttggccttggttccaacagaaacctggccaggctcccgggctcctcatctatgatcgcatccaacgacgggccacgtggcaactcccagcctaggttcaggtggacgtggtgggtctaggggactagacttcactcactacatcacgtccgcgtagacgccgtgaggtacttcgtcgttaccgtttatttatttggtttccgttacggggtacgttacggcgtaacgtccggttaccccgttcccgtacgttaccgttttcgggacccggtaacggggaccctaaggcgttaggacgacgtacgacgtacgtaacggtggtcgggtacctgccgacgtcgttccttacgttccttactacttccccgg

SEQ ID NO: 278081 - DNA, 737 bp, Homo sapiens
  misc_feature: GYAE6OF02G5083.29.35.D02.1.454.CMB.1.raw
  modified_base (179)..(179): a, c, t, g, unknown or other
  misc_feature (179)..(179): n is a, c, g, or t
  modified_base (371)..(371): a, c, t, g, unknown or other
  misc_feature (371)..(371): n is a, c, g, or t
  modified_base (412)..(412): a, c, t, g, unknown or other
  misc_feature (412)..(412): n is a, c, g, or t
tcagatagagtactcacgaccggtgctcgatttagcacacgatagttgggtttgggggaggaactgctcagttaggacccagacggaaccatggaacgcccagctcagcttctcttcctcctgctactctggcctccgagactaccgagacgggacgagtattgtgttgacacacgtcnccacgccctacccttggttctttacgtccgtcggggaagaaagtcgccctacccgttctccgtgacgacggcaaggtacagtagtacgttaacacgttagtcggtcctagttaccaaagaacgtaacggcgtaccgaggtccctccgaagtccttacctatacttctaggtacacgtcacttacacgaaacncgggtaccagtcggactacgcccgtagggtacctgggtacnggtacgcgtaagggttcggtcgggaggaacccgtacgttacctcggtacctttaacccgccaaacctagttccggaaccgacccgtacgtacggaaccggtacgttacggaacgggttactttccggttcggttttaacggtttactttaagtttcggtacgttggaccgggtactaacgtccgttcgggtacccgttcgtttacgtcgtttaccggaccgggtaggtaaccgacggttcgtaggacttacggaacgtacggtaacggtccgtaggtcggtaccgcgtacctacgtaccgtcgtttaccgttgtacccgttaacc

SEQ ID NO: 278082 - DNA, 965 bp, Homo sapiens
  misc_feature: GYAE6OF02F7OW6.29.35.D02.1.454.CMB.1.raw
tcagatagagtactcacgaccggtgctcgatttagcacacgatagttgggtttgggggaggaactgctcagttaggacccagacggaaccatggaagccccagctcagcttctcttcctcctgctactctggctccagataccagcggagagattggtgttgacactagtctccagcccacctgtctttgtactccggagaagacgcctaccctctacctgacgtacgggcctagtcacggtagttacgtttaaacaacttaacgttcggtaccgtttacgggttacccaaacgacgtaaaaccccgttcgggaccctaacgggtacccttccccgaagggtcccttacccttacgtaacgttaccgttagttacggtaagttcgtaccaacgttaccccaaacggtaaccgggtaccctaaccgggtcggtactaaacccttaccccgaacggtaccccgttaaaggggttaccgtaaggggttacgggtaccggttaaggggttcggggttaccggtacggggtaacctaacggttcccgtttaaccgtaaccgtttacccttaccgtaacccgttaactaccgaccgggtccccgtaacggttacggaacggtacccggtagggttaaacggttaccgttttccggttacggtttacccgtttttaaggtttcggttttaacgggttccgttttacgggggtaaccgttaacgggacccgttaacggttcccggttaccccgtttacccggtttcctttaaccgggttttacccgggaacccgggttaccggggaaacccctttaaacgggtcccgggttaaacgggttaacgtacccgttacggtaaaccgggtaacccgttaaaccgggtttcggggtaacccggttaccggtaccggtaacccctaaacggttaacccggttttccgtacggttttttaccccgtaccggttttacccc

SEQ ID NO: 278083 - DNA, 677 bp, Homo sapiens
  misc_feature: GYAE6OF02JMUWX.29.35.D02.1.454.CMB.1.raw
  modified_base (161)..(161): a, c, t, g, unknown or other
  misc_feature (161)..(161): n is a, c, g, or t
  modified_base (194)..(194): a, c, t, g, unknown or other
  misc_feature (194)..(194): n is a, c, g, or t
  modified_base (199)..(199): a, c, t, g, unknown or other
  misc_feature (199)..(199): n is a, c, g, or t
  modified_base (208)..(208): a, c, t, g, unknown or other
  misc_feature (208)..(208): n is a, c, g, or t
tcagatagagtactcacgaccggtgctcgatttagcacacgatagttgggtttgggggaggaactgctcagttaggacccagacggaaccatggaagcccagctcagcttctcttctcctgctactctggctcccagactaccagcggagagattgtgttnacacagtctcagccacctgtctttgctcggganaagcnccaccttcncctgcgagggccagtcagtagtagttaaccacttacgttggcctggttaccaaacgacgtaaccgtcggaccacggtcctacccgaggtccttccacgtacttcgtaattgacgttgcctaactaccgaacggacggtccaaccgtggaccctacgtacccaggtccgtaggtttaccgagttcggaccacgggtttaggccgtaggggacaggttacctcggtactccgtaccaccgttaagcgtaccgaccgtacgtacgtacgacgtacggtacgtcgttacgttacggttaccgttttagttcgttacggttcgttacgggtacgtacgaccgtacgtcggtcccttaccggttcgttacgtttacggaccggttacggaccggtagtcgtagtacgacgtacgacggtaactacggtcggtaccgcgacgtaccgtacgtccgttactcgttccgttacgtccg

SEQ ID NO: 278084 - DNA, 765 bp, Homo sapiens
  misc_feature: GYAE6OF02HA3BQ.29.35.D02.1.454.CMB.1.raw
  modified_base (201)..(201): a, c, t, g, unknown or other
  misc_feature (201)..(201): n is a, c, g, or t
  modified_base (206)..(206): a, c, t, g, unknown or other
  misc_feature (206)..(206): n is a, c, g, or t
  modified_base (263)..(263): a, c, t, g, unknown or other
  misc_feature (263)..(263): n is a, c, g, or t
  modified_base (274)..(274): a, c, t, g, unknown or other
  misc_feature (274)..(274): n is a, c, g, or t
tcagatagagtactcacgaccggtgctcgatttagcacacgatagttgggtttgggggaggaactgctcagttaggacccagacggaaccatggaagccccagctcagcttctcttcctcctgctactctggctcccagataccagcggagagattggtgttgacacagtctccagcccaccctgtctttgtctccggganaaagngccaccctctcctgcacgggccagtcagagtgttaacaactacttgcctggtccaanagaacctgccnggctccgagtcctctcatctatgtatgacacgtaccgaacgacgggacctacgtggacctaccgttccccgacgtaccggtacgggtttaccgagggttacggacgtaggggttcggggtacgtacggggtaaccgtacggtacccttttacaccctttcctacccggtaacctacgtaccgtaccggccccttaccggttaacggaccgggtccccttaggggtaacgttacgtttccggttaccggtttaccgtttttacgtttaagttttcggttaccggtttcgggtacgttaaccggtaccgtaaccggttcccgggacccttttcccccggttacgttaacccgggttttaccggtacccggtaaccggggtaaccgtaaacggtccgttaacgggacgtacgttagaaccggtaaccgtaacggttcggttacggccgtaccgcgttaccgtagttaccgtttcggttacccgttacgttaccc

SEQ ID NO: 278085 - DNA, 830 bp, Homo sapiens
  misc_feature: GYAE6OF02HYAMW.29.35.D02.1.454.CMB.1.raw
  modified_base (494)..(494): a, c, t, g, unknown or other
  misc_feature (494)..(494): n is a, c, g, or t
tcagatagagtactcacgaccggtgctcgatttagcacacgatagttgggtttggggaggaactgctcagttaggacccagacggaaccagtggaacgccccagttcagcttctcttcctcctgctactctggctccagactaccagcggagagattggtgttagacacgagtctccgagcccacctgtctttcgtcgtcgggaagaacgcgccctacctcgtctcggcgacgggctagtcgagagttacgtaacacttacgtcggtcctcggtaccaacgtaacgtaaccgtcggacctacggtcctacccggaggtcccttaccgtcgtataccgttagtacggtactcgtacgaaccgttaaccggaaccggtaccgggtacccacggtcggtaccctaaccgtacccgaccggtccggtaacggttacggtaacggtcggtaccggtggggttaccgggtacgacggggtactaaacggtcgtttaaccnccgttaccgtaccaaccctaacgtacccgtacccggtacccgtaccgaacggtaccggttaccggttaacgggaacggtttacgttaccgtttacccggtttacgtttttagtttacggtttacggttaccggggttacgggttacgttaccgtaccggtaccgttcccgggttcccgttaacccggttacgtttaccgggtttccgggtaccgggaacgggttaaccgaggtaccggttaacggacgtacacggtacggtaaccggtaacggtaccggtcgtacgttacaccgttacgtccggttcttaccggttacttccgtacccgttacccg

SEQ ID NO: 278086 - DNA, 593 bp, Homo sapiens
  misc_feature: GYAE6OF02HBZQV.29.35.D02.1.454.CMB.1.raw
  modified_base (203)..(203): a, c, t, g, unknown or other
  misc_feature (203)..(203): n is a, c, g, or t
  modified_base (295)..(295): a, c, t, g, unknown or other
  misc_feature (295)..(295): n is a, c, g, or t
  modified_base (308)..(308): a, c, t, g, unknown or other
  misc_feature (308)..(308): n is a, c, g, or t
tcagatagagtactcacgaccggtgctcgatttagcacacgatagttgggtttggggaggaactgctcagttaggacccagacggaaccatggaagccccagctcagcttctcttcctcctgctactctggctcccagataccagcggagagattgtgttgacacagtctccagccaccctgtctttgtctccgggagaaagngccaccctctcctgcagggccagtcagagtgttaacaactacttggcctggttccaacagaaacctggccaggctccaggctcctcatctangatgcatccaacngggccatggcatcccagccaggttcagtggcaggtggtctgggacaggacttcactctcaccatcgaagccgcctacgagtccgtgacggtattcgttgtccgtttattagtttgttccgtttgggcgtagctacgtcggcctcccggtacctacgttttcggaccgtacggggtaccctaaacggtcctacgggagtacgtcgaacggtaacgtaaccgttcggttacggtaccgttaggaccctaaccgtaccttccgttacggttacctttccgttaacccg

SEQ ID NO: 278087 - DNA, 731 bp, Homo sapiens
  misc_feature: GYAE6OF02HPNBY.29.35.D02.1.454.CMB.1.raw
  modified_base (173)..(173): a, c, t, g, unknown or other
  misc_feature (173)..(173): n is a, c, g, or t
  modified_base (272)..(272): a, c, t, g, unknown or other
  misc_feature (272)..(272): n is a, c, g, or t
  modified_base (307)..(307): a, c, t, g, unknown or other
  misc_feature (307)..(307): n is a, c, g, or t
tcagatagagtactcacgaccggtgctcgatttagcacacgatagttgggtttggggaggaactgctcagttaggacccagacggaaccatggaacgccccagctcagcttctcttcctcctgcctactctggcctcccagactaccgaggcggagagtattgtgttgacacngtcctccagcccacctgttctttgcgtccgggaagaaagcgcccaccctctcctgcgaggccagtcagacgtattaacaactcgttggctggtaccaanacgaacctggaccaggcctccgaggtcctccctanacttctagtgactcgactacgtacccgaaacgcgggcccacgtcggacacgtcccgacgcctaggttccgaggtcgcgtagggtgggtaccgtacgggaactacgtacttccgaccttctaccgaacctagttacccgaccggtcccgtaccgtaacggaccgtccgtaggtacgttacttccggtcgtttaaccgttttattacggtttcggttccggtttaggggtaccttaacgtacccgttaacggtcccggttcccgttacccggttacgtttaacccggttttcgggaaccgggttaccggggaacctaaggtcccgggtaaggtcgtaaccgttaggaaccggtacggtaacgttcgggtacggttactccggtacccaccgttacgttccgtaccgtttaccgttaccttaccccg

SEQ ID NO: 278088 - DNA, 789 bp, Homo sapiens
  misc_feature: GYAE6OF02I2V8S.29.35.D02.1.454.CMB.1.raw
  modified_base (263)..(263): a, c, t, g, unknown or other
  misc_feature (263)..(263): n is a, c, g, or t
tcagatagagtactcacgaccggtgctcgatttagcacacgatagttgggtttgggggaggaactgctcagttaggacccagacggaaccatggaagccccagctcagcttctcttcctcctgctactctggctccagataccagcggagagattgtgttgacacagtctccagcccacctgtctttgtctccggggagaaagcgccacctctacctgcagggccagtcagtagtgttaacaacttacttggcctggtccaanagaacctgccaggcctaccgagcctctcatctatcgatcgcactccaacgacgggccacgtcggcactacccgagtccgtaggttacagtggacgtagggttcggggtctaggggacacgtaccttcgaacctctaccgacctaacttccgacggtacccgtaccgtacggaccggtcccgttagggaaccggttacgttacccggttccggtttaaccggttttttaacgttttaacggttttacgggtttacgggttttcggggttaccgtttacggtaacccgttaaaccgggtttcccgggtacccccgttttaccccgggttaccgttttaccgggtttttaccggggtaaccccgggttaacggggggtaacccctaaacgggtccggttaacgggtaacggtaccttaaccgggtaaccggttaaaccggtaaccggttagggtacccgggtaacttacccgggtaccctaaccggttaccgttaccgtttaccggtttaccgtttacccgttaacccg

SEQ ID NO: 278089 - DNA, 753 bp, Homo sapiens
  misc_feature: GYAE6OF02FKQS6.29.35.D02.1.454.CMB.1.raw
tcagatagagtactcacgaccggtgctcgatttagcacacgatagttgggtttgggggaggaactgctcagttaggacccagacggaaccatggaagccccagctcagcttctcttcctcctgctactctggctcccagataccagcggagagattgtgttgacacagtctccagccaccctgtctttgtctccgggagaaagagccaccccttctcctgcacggggccagtcagtagtagttaaacaactaacttggccttgggttaccaacgaagaaacctggaccacgggcctccccggggactccctactagtacctaatcggattcgactagtacccgaaacgacgggccctaacgtcggaccaactccccgacgtaccctaagggtttcaacgggttcggtacgaagggttcgggggtactacgggggaacgtaacggtacttccgaaccgttcctaccgaaccctaagtccacggtcccgtaccgtacggacgtcctaggtacggtacttcgtacgttaccgttttaacgttattttcgggttcgtttacgggggtcgttacggtaccgtaacggttccggtacccgtttcccggttacgtttacccgttttcggggtaaccggtacgggggtaaccctaacgggtacgttacgggtacgttaacgtaccggaacggtaacgaaaccggttcggttacggtccttaggacccacgtacttaccgttagtacctttcaccgttcccg

SEQ ID NO: 278090 - DNA, 623 bp, Homo sapiens
  misc_feature: GYAE6OF02IQEG9.29.35.D02.1.454.CMB.1.raw
  modified_base (198)..(198): a, c, t, g, unknown or other
  misc_feature (198)..(198): n is a, c, g, or t
  modified_base (203)..(203): a, c, t, g, unknown or other
  misc_feature (203)..(203): n is a, c, g, or t
  modified_base (212)..(212): a, c, t, g, unknown or other
  misc_feature (212)..(212): n is a, c, g, or t
  modified_base (232)..(232): a, c, t, g, unknown or other
  misc_feature (232)..(232): n is a, c, g, or t
  modified_base (240)..(240): a, c, t, g, unknown or other
  misc_feature (240)..(240): n is a, c, g, or t
  modified_base (253)..(253): a, c, t, g, unknown or other
  misc_feature (253)..(253): n is a, c, g, or t
  modified_base (555)..(555): a, c, t, g, unknown or other
  misc_feature (555)..(555): n is a, c, g, or t
  modified_base (569)..(569): a, c, t, g, unknown or other
  misc_feature (569)..(569): n is a, c, g, or t
  modified_base (596)..(596): a, c, t, g, unknown or other
  misc_feature (596)..(596): n is a, c, g, or t
  modified_base (608)..(608): a, c, t, g, unknown or other
  misc_feature (608)..(608): n is a, c, g, or t
  modified_base (617)..(617): a, c, t, g, unknown or other
  misc_feature (617)..(617): n is a, c, g, or t
tcagatagagtactcacgaccggtgctcgatttagcacacgatagttgggtttggggaggaactgctcagttaggacccagacggaaccatggaagcccagctcagcttctcttcctcctgctactctggctcccagataccagcggagagattgtcgttgacacagtctcagcccacctgttctttgctaccggganaaagngccacctcncctgcaggccagtcagagtntaacactntggctggtccaanagaacctgaccaggcctccagcctacgcatactatgatcgctaactacaacgacgggtcccaagtcggctaactcccgacgtaccccgtaaggttcaacggttcggcgttaacggggtcgggtcttacggggaaactcggtaaccgttcaaactttcgccaaactcgtcctaacgacccgtacgtacgacgtccgttaggacgttacttcggaccgtttaccgttattacgttcggtcggttcgacgtacgacctacgtccgggttacctcccgttcttaccgtttggaccgagggtaaccngtcggtagacgtanccgaggtaacctaacggtggactcggnacacgtattcgnttaccgttntaaccg

SEQ ID NO: 278091 - DNA, 659 bp, Homo sapiens
  misc_feature: GYAE6OF02F7684.29.35.D02.1.454.CMB.1.raw
tcagatagagtactcacgaccggtgctcgatttagcacacgatagttgggtttggggaggaactgctcagttaggacccagacggaaccatggaagccccagctcagcttctcttcctcctgctactctggctcccagataccagcggagagattgtgttgacacagtctccagcccaccctgttctttgtctccgggagaaagcgccaccctctcctgcgagggccaggtcagagttagttaacaacttacttggccttggttaccaacagaacctggaccaggcctccccgaggcctcccgtcactctagtgatgcactaccgaacgacggcccacgtgggacctacgtccccgagacccgtacggttcgagtcggcgtagggtcgggtcgtagggactaggtaccttcgaccttctaccgactactcgaccgtccgactacggcgccgtaggtacgtacttcgtacgttcgtttatttacgtttgttccgttgggtaccgttacgtacctacggtcggtcccttacccgttaccgttaccgttttcgggacccgtacggggacctacggtacgtaggactacgtacgaacggtacgtaacgttcggtacggtcgtaccgacctaccgtacgttcgttcgttaccgttccgtacccg

SEQ ID NO: 278092 - DNA, 857 bp, Homo sapiens
  misc_feature: GYAE6OF02HO7YX.29.35.D02.1.454.CMB.1.raw
  modified_base (214)..(214): a, c, t, g, unknown or other
  misc_feature (214)..(214): n is a, c, g, or t
  modified_base (824)..(824): a, c, t, g, unknown or other
  misc_feature (824)..(824): n is a, c, g, or t
tcagatagagtactcacgaccggtgctcgatttagcacacgatagttgggtttgggggaggaactgctcagttaggacccagacggaaccatggaagccccagctcagcttctcttcctcctgctactctggcctcccagactaccaggcggagagattgtggttgactacagttcctccagccctaccctggttctttgtccgtccggggaanaaagacgcctaccctctcctgcgacgggccagtcaggtacgttagttaaccaaacttacgttcggcctttacggttacccaaacaacggtaaaacccgttcggacccgtaacgggcctacccccgtaacgggtccccttaccccgtaccgtaacttacccttaagttccggaagtcggtacctaacgttaccccgaaaaccgggtaccggggtaccccgtaacggtccggacctaccgtaccccacggtacccgtacgggtttacgacgggtcggtacgtagggttcggggtccgtacggggaacgtaacgttaccgttaccacgtttccaccgtaaccctagtacccggaccgtccgacccggttaacggaccggtccgtacgggtagtaccgtttcgttacgtttaccgggttttaattttcggtttacggtttccggtttagggttccggttaacgtaccgtacccgggtttacgtccccggtttcccgtttacccggttaaccggttttccgggacccggttaaacggggaacccctaaggttccggtaacggtacgttaccgtaacggtacggaacgttaacggttggacggttcgtaccgtacncccgttactcggttactacccgttaccgtcccg

SEQ ID NO: 278093 - DNA, 736 bp, Homo sapiens
  misc_feature: GYAE6OF02GGVMC.29.35.D02.1.454.CMB.1.raw
  modified_base (171)..(171): a, c, t, g, unknown or other
  misc_feature (171)..(171): n is a, c, g, or t
  modified_base (206)..(206): a, c, t, g, unknown or other
  misc_feature (206)..(206): n is a, c, g, or t
  modified_base (488)..(488): a, c, t, g, unknown or other
  misc_feature (488)..(488): n is a, c, g, or t
tcagatagagtactcacgaccggtgctcgatttagcacacgatagtttgggtttgggggaggaactgctcagttaggacccagacggaaccatggaagccccagctcagcttctcttcctcctgctactctggctccagataccagcggagagattgtgttgacacagtcnccagccctaccttgtcctttgtcgtcccggggaanaaaacgcgccctacccctcgtcccgtagcggaccgggcctaggtcaacggtaaggttacgttaaaaccaactttcgttacgggccgtttacggttaccccaaagaacgaaacccgttcgggaccctacgggcccttaccccgaggtccctccctacgtattccgtatcgatcgacctactacccgaaagcggaccgtaacgtcggacctaccgtcccgacgccgttacgggtacgtggtcggacgtaggtttcgggtcgtacgggacttacgaccctttacncgtacctcctaccgtcgtaccaccggccgtaacggtaccgaacgtcggtacggtacggtacgttcgtacgtttaccgtttagtttcgtttacgttttcggtcgggttacgttacgtacgtaccgtcgtcccgttcccgttaccgtcgtttaccggaccggtacggtaaccgagtcgtagtacgtagtacgacgtaacgtacgtacggtcggtcgtcgactaccgtcgttcgtacttccttacgtcccg

SEQ ID NO: 278094 - DNA, 663 bp, Homo sapiens
  misc_feature: GYAE6OF02GCVLA.29.35.D02.1.454.CMB.1.raw
tcagatagagtactcacgaccggtgctcgatttagcacacgatagttgggtttgggggaggaactgctcagttaggacccagacggaaccatggaagccccagctcagcttctcttcctcctgctactctggctcccagataccagcggagagattgtgttgacacagtctccagccaccctgtctttgctccgggagaaagacgccaccctctcctgcagggccagtcagtgtagttaacaacttacgttcggccttaggttacccaaacgaacgtaaaaccctcgggaccacgggtcctccccgaacggtcctccctacacttaccgtaatcgacttcgacctacgtaccaacggacggacccagtcgacactcccgagaccgtaggttaccaggtcggctaggtcgggtcgtagggacaaggtaccttacgacttcgccaaacagtccacgcccgtaccgtacgacgtccgtaggtacggtacttcgtacgttacgttttattacgtttcggttcggttgggtacgtacgccgtaaccgtcggtcccgtaccgtcgttacgtttacggccggtaaccggggtaacacggtacgagggtactacgtacgacgtacgtaacgtggtacgcgtacgacctacgtctcgtctccttacttaccg

SEQ ID NO: 278095 - DNA, 591 bp, Homo sapiens
  misc_feature: GYAE6OF02FKNRQ.29.35.D02.1.454.CMB.1.raw
  modified_base (205)..(205): a, c, t, g, unknown or other
  misc_feature (205)..(205): n is a, c, g, or t
tcagatagagtactcacgaccggtgctcgatttagcacacgatagttgggtttgggggaggaactgctcagttaggacccagacggaaccatggaagccccagctcagcttctcttcctcctgctactctggctcccagataccagcggagagattgtgttgacacagtctccagcccaccctgtctttgtctccgggagaaagngccaccctctcctgcagggccagtcagagtgtaaacactacttggccttggttccaacagaaacctggccaggcctccgaggctcctcatctatgtatcgcataccaacgacgggccacgtcggacacgtcccacgcctaggttcgaggtcggacgtaggtggggtacgtggggaacaggtacttcacttcgcaccactcgacgccgtaccgtacgacgccgtaggacggtacttcgtcgttaccgtttatttagttgttcgttcgggtcgtacgtcgtacgtcggtcccgtcccgtcgtacgtttcggacgtacgggaccacgtcgtgatacgcgtacggactacgtggtcgtacgtgcctacgtacttcgtcgttactctaccg

SEQ ID NO: 278096 - DNA, 726 bp, Homo sapiens
  misc_feature: GYAE6OF02GTWTJ.29.35.D02.1.454.CMB.1.raw
  modified_base (235)..(235): a, c, t, g, unknown or other
  misc_feature (235)..(235): n is a, c, g, or t
tcagatagagtactcacgaccggtgctcgatttagcacacgatagttgggtttgggggaggaactgctcagttaggacccagacggaaccatggaagccccagctcagcttctcttcctcctgctactctggctcccagataccagcggagagattgtgttgacacagtctccagccaccctgtctttgtcgtccgggagaaagagcccaccctctcctgcacgggccagtcagngtgttaacaactacttgggcctggttaccaacagaaacctggccacggctcccgaggcctcctcatctatgatgcactaccaacgacgggccacgtcggacactcccgagtccgtacggttcgacggtcggacgtacgggtcggggtctacggggacacggtacctttaccgaccttccacctaccctactaccgaccgggtacccgtaccgtaacggtacggtacccgtagggtaacgggttactttacccggttacggtttacccgttttttatttacggtttcggttttccgggttacggggttaccgttacggtaccgttaaccggttccgggttaccccgtttcccgtttccgtttaccggttttccgggacccgggtaacgggggtaaccgacggttcgtagggtacgacgttaccgaacggtaaccggtacggttcggtcggtccgtacgaccgaccttacgttcgtcgtttccttcttacccg

SEQ ID NO: 278097 - DNA, 633 bp, Homo sapiens
  misc_feature: GYAE6OF02FOE41.29.35.D02.1.454.CMB.1.raw
  modified_base (198)..(198): a, c, t, g, unknown or other
  misc_feature (198)..(198): n is a, c, g, or t
  modified_base (203)..(203): a, c, t, g, unknown or other
  misc_feature (203)..(203): n is a, c, g, or t
tcagatagagtactcacgaccggtgctcgatttagcacacgatagttgggtttggggaggaactgctcagttaggacccagacggaaccatggaagccccagctcagcttctcttcctcctgctactctggctcccagataccagcggagagattgtgttgacacagtctccagccaccctgtctttgtctccggganaaagngccaccctctcctgcagggccagtcagagtagtaacaactacttggcctggttccaacagaaacctggccaggctccagcctctcatctatgatgcatccaacacgggccaacgtggcacgtcccagcctaaggttcagtggcgtaagtggggtctaggggactacggtacttcacttcctacacctactcacgtccgaccgtagactctggtacgtagttcgtcggttaccgttttagtttagtttcgtttcgtttacgggtcttaacggccgtaaccgttccggtaccccgttcccggtttaccttaccgttttccggcccgttaacggggacctaaaggtcggtacgacggtactcgaacgtaaccggtaacgttcggtacggtcgtacgtccgaacctagttcgttacgttcctttccgttacccg

SEQ ID NO: 278098 - DNA, 978 bp, Homo sapiens
  misc_feature: GYAE6OF02GON8L.29.35.D02.1.454.CMB.1.raw
tcagatagagtactcacgaccggtgctcgatttagcacacgatagttgggtttgggggaggaactgctcagttaggacccagacggaaccatggaagccccagctcagcttctcttcctcctgctactctggctccagataccagcggagagattgtgttgacacagtctccacgcccacccttgttccttttcgtccgttccggggaagaaaacgacgcccaccccttcctcccgtgaccgacgggccaggtaccaggtaggttacgtttaaaaccaacgttaccgttcgggtcccgttacgggtttacccaaacgtaaaccggtaaaacccgtacgggaccccgtaacgggtaccccttacccccgacgggtccccttaccccgtacctacgttacccttagttacggtaacgtcggtacctaaccgttaaccccgaaaaccggtacccggggggtaacccctaacccggttccggggaaccctaacccgttaccccccgtaaccgggtaccccggttaacgggggttttcccgaacggggtttccgggaccggttaagggggttccggggttacgggttacggggggaaacccttaacggggtttaacccttacccgtaacccttcccgttaaacccgaccttaaccgtacccgacccgggtccccgtaacccgtacggtaccggtcccggttaacgggtaaccggttacgtttaccggttacgggttttacccgtttttacttttacgggttttaccggttccggttttacggggtaccgttacggtaccgttaccggttccgggttccccttaccccggttaccgtttacccggttttccgggacccgggttaaccggggaaccgtacggtacgtacgggtacgtacgtaccgaacggtaacggttaacggttcggcggttacgtccggaccgtaccgttacttcccggtttccgttaccgttacttaccccg

SEQ ID NO: 278099 - DNA, 584 bp, Homo sapiens
  misc_feature: GYAE6OF02GP4Q0.29.35.D02.1.454.CMB.1.raw
  modified_base (289)..(289): a, c, t, g, unknown or other
  misc_feature (289)..(289): n is a, c, g, or t
  modified_base (425)..(425): a, c, t, g, unknown or other
  misc_feature (425)..(425): n is a, c, g, or t
tcagatagagtactcacgaccggtgctcgatttagcacacgatagttgggtttgggggaggaactgctcagttaggacccagacggaaccatggaagccccagctcagcttctcttcctcctgctactctggctcccagataccagcggagagattgtgttgacacagtctccagccaccctgtctttgtctccgggagaaagagccaccctctcctgcagggccagtcagagtgttaacaactacttggcctggttccaacagaacctggccaggcctccaggctccncatctatgatgcatccaacgcgggccacgtggcactcccgagccgaggttcgacgtggacaggtcgggtcgtagggacacgtacttccgacttccacacctactccgacgcccgacctagacgcccgtaggacgtnttcgtacgtccgtttattacgttgtcgttgggtcgtacgctaccgtcggtccctcccgttcgtacgtttcggccgtacgggtaccaggtcgtaggactcgacgtacggtacgaacgttggtcggtctggacccactcgttccgtcgttacctcttaccg

SEQ ID NO: 278100 - DNA, 639 bp, Homo sapiens
  misc_feature: GYAE6OF02GPX1M.29.35.D02.1.454.CMB.1.raw
  modified_base (419)..(419): a, c, t, g, unknown or other
  misc_feature (419)..(419): n is a, c, g, or t
tcagatagagtactcacgaccggtgctcgatttagcacacgatagttgggtttgggggaggaactgctcagttaggacccagacggaaccatggaagccccagctcagcttctcttcctcctgctactctggctcccagataccagcggagagattgtgttgacacagtctccagcccaccctgttctttgtcgtccgggagaaagagcccaccctctcctgcgagggccagtcagtagtacgttaaacaacttacgttggccttggttaccaaacaacgaaacctggccaggcctcccaggctcctcatctatgatgcactaccaacgacgggccacgtaggcactcccagcctaggttcaggtcggctaggtgggtcgtgggactacgacttcaccgttcaccacactacgacgccncctaggctccgtaggacgtacttcggtcgttaccgttttatttgttcggtttcgttacgggtcgtacgtactaccggttccggtcccgttcccgttacgttaccggttttcggaccggtacggggtaaccgtagacgtaggtacgacgttacacgggtaacgtacggtcggtacggtcgtaccggctaccctaagttccgtgtttaccgttcttaacccg

SEQ ID NO: 278101 - DNA, 745 bp, Homo sapiens
  misc_feature: GYAE6OF02J0FED.29.35.D02.1.454.CMB.1.raw
  modified_base (643)..(643): a, c, t, g, unknown or other
  misc_feature (643)..(643): n is a, c, g, or t
  modified_base (734)..(734): a, c, t, g, unknown or other
  misc_feature (734)..(734): n is a, c, g, or t
tcagatagagtactcacgaccggtgctcgatttagcacacgatagttgggtttgggggaggaactgctcagtttaggacccagacggaaccatggaagccccagctcagcttctcttcctcctgctactctggcctcccagataccagcggagagattcgtaggttcgactactacggtctccgagcccaccttggttctttcgcgtccggggtaaaaggtcgccaccctctccgtgccgagggccctagtccaagagttaccgttaaaccaacgttacgttccggacccttagggttaccccaaacgacgtaaacccgttcggaccgaacggcctaccccggtaggtccctacccctacgtacttactacgtacggtacgtcggccctaccgtaccgaaccggacgggtacccttacgacggacccttaaccgtccccgacgtaccgtacgggtttccaacggggttacggtaaccggtacgggtttcggggtcccggtaaacggggaaacgtaccgtaccgtttaacctaccgtaccttaaccggacttaaccgtcggtaaccgcccgtaccgagtaccgtacgtacggtacgtacgttcgttacggttaccgtttattcgttcgttacggtcgtcgtacngactcggtacctccgtagttaccgtttcggaccgtaggtacctagtcgagtactcgacgacgacgtagacgtcgacgtcgctacgctagtntccgtactccg

SEQ ID NO: 278102 - DNA, 876 bp, Homo sapiens
  misc_feature: GYAE6OF02JXQOV.29.35.D02.1.454.CMB.1.raw
  modified_base (167)..(167): a, c, t, g, unknown or other
  misc_feature (167)..(167): n is a, c, g, or t
  modified_base (175)..(175): a, c, t, g, unknown or other
  misc_feature (175)..(175): n is a, c, g, or t
  modified_base (199)..(199): a, c, t, g, unknown or other
  misc_feature (199)..(199): n is a, c, g, or t
  modified_base (219)..(219): a, c, t, g, unknown or other
  misc_feature (219)..(219): n is a, c, g, or t
  modified_base (824)..(824): a, c, t, g, unknown or other
  misc_feature (824)..(824): n is a, c, g, or t
tcagatagagtactcacgaccggtgctcgatttagcacacgatagttgggttgggggaggaactgctcagttaggacccagacggaaccatggaagccccagctcagcttctcttcctcctgctactctggcctcccagataccagcggagagattgtgttcacacngtctccancccacctgttcttgtctccggganaacgacgccaccgtctcctncgtacgggccagtccaagtacgttgttaaacgacttacgttcggccgttaagtcccaaaacacgtaaaccgtcggacctaggtcctaccaacgggtcctaccctcaacgtcctaacgtcgtactcggtactactaccgtaacgcgggaccctacggtacgggacctacgtaaccccggtcgtaacccgtaacgggttccacggggtacgtacggtacccggttgggccggtttacgggggaactaccgggttaacgttacccggtaacgttcccggttaccaaccggtaaacctttaccccgaaccgggtacccgtaaccccgtaaggggaaccgtcccgggtaaccgttagggttaaaccttcccggtttagggtttacccgtttttaacgtttagtttacggggtttccctttacggggggtaccttttaacgtacccgttaaacgggttccccggttaaccttccccgggtttaacgttttccgggtttacggaacccgggtttaacggggccctaaacgggtttcccgggtaagggttaacccggtacgttcggtaaaccggttaaccgggtaacggtttagggttcccgaacccggtttntaaacccggtaccgttacggttccgggtttacctcgttttaaacccgtccgg

SEQ ID NO: 278103 - DNA, 866 bp, Homo sapiens
  misc_feature: GYAE6OF02IRV9G.29.35.D02.1.454.CMB.1.raw
  modified_base (171)..(171): a, c, t, g, unknown or other
  misc_feature (171)..(171): n is a, c, g, or t
  modified_base (601)..(601): a, c, t, g, unknown or other
  misc_feature (601)..(601): n is a, c, g, or t
  modified_base (676)..(676): a, c, t, g, unknown or other
  misc_feature (676)..(676): n is a, c, g, or t
  modified_base (813)..(813): a, c, t, g, unknown or other
  misc_feature (813)..(813): n is a, c, g, or t
  modified_base (846)..(846): a, c, t, g, unknown or other
  misc_feature (846)..(846): n is a, c, g, or t
tcagatagagtactcacgaccggtgctcgatttagcacacgatagttggggtttggggggaggaactgctcagttaggacccagacggaaccagtggaacgccccagctcagcttctcttcctcctgctactctggcctccagactaccgagcggagagtattggtggttnactacgagtcctaccacgccctaccttgttcctttcgtccgtaccggggtaagtaaacgacggccctaaccccttccgtacccttggaccacgggggaccctaaggtaacctaaaacgggttacttaaaacctaaaccgtttacggttcgggtaccgttaccgggttaacccaaaacgtaacggtaaaacccgtcgggaccccgtaaagggccccttaccccggacggttaccgttcccctaaactcgttacccgttatagtaaccgtcgtaacctaccgtaacccaacggaccgggacctaacgtcggtaccgtaactcccggtacggaccgttaggtacggaacggttcggaacggtcggggtacggttccgggtaacggtaactaccggttaaccgttcgtaacccgtttaccaccggtaaaccccntaccggttaaccggccgttacgtaaaccggtcgtaacggtcggtagttacctcgtttacggttactttaccggtntttcgggtcggtttacgggtctaaccgacgttcgaccggttcccttaaccggtcgtttaacccggtccgggaccggtacgggtaaccgtagggtccgtaagtaacggacgtttacgaggtaaccggtacgtccgggngttaaccgtcccgacttacgtacgtccgtttanccgtttaccgtctaccccgg

SEQ ID NO: 278104 - DNA, 581 bp, Homo sapiens
  misc_feature: GYAE6OF02H8QKD.29.35.D02.1.454.CMB.1.raw
  modified_base (143)..(143): a, c, t, g, unknown or other
  misc_feature (143)..(143): n is a, c, g, or t
  modified_base (191)..(191): a, c, t, g, unknown or other
  misc_feature (191)..(191): n is a, c, g, or t
  modified_base (204)..(204): a, c, t, g, unknown or other
  misc_feature (204)..(204): n is a, c, g, or t
  modified_base (208)..(208): a, c, t, g, unknown or other
  misc_feature (208)..(208): n is a, c, g, or t
  modified_base (220)..(220): a, c, t, g, unknown or other
  misc_feature (220)..(220): n is a, c, g, or t
  modified_base (270)..(270): a, c, t, g, unknown or other
  misc_feature (270)..(270): n is a, c, g, or t
  modified_base (294)..(294): a, c, t, g, unknown or other
  misc_feature (294)..(294): n is a, c, g, or t
  modified_base (313)..(313): a, c, t, g, unknown or other
  misc_feature (313)..(313): n is a, c, g, or t
  modified_base (325)..(325): a, c, t, g, unknown or other
  misc_feature (325)..(325): n is a, c, g, or t
tcagatagagtactcacgaccggtgctcgatttagcacacgatagttgggtttgggggaggaactgctcagttaggacccagacggaaccatggaagccccagctcagcttctctcctcctgctactctggctccagataccngcggagcgattgtgttgacacagtctcagccacctgtcttgctcgganaaagcgccacctntccngcaggcagtcanagtataacaactcgtgcctgtaccaagacaactgcagctaccgagcctcnatctatgatgacactaccgaacgngggccagtacgcactccanccggtagttccnggtagtacgtaggtcgggtacgtacgggaagactaccgttcacgttcctacacgtactcgacgtccgactaggcgcgtaggacgttactacgtcgttaccgtttatagttggtcgtacggtacgtagtaccgacgtcgtcccgtaccgtcgttagtttcggtaccgacgggtaaccaggtctaggtacgatacgaaggtcgtacctggtccgtgtaccgtacttaactaccggttctacgtttccgtacctaccgg

SEQ ID NO: 278105 - DNA, 583 bp, Homo sapiens
  misc_feature: GYAE6OF02F6GY2.29.35.D02.1.454.CMB.1.raw
  modified_base (140)..(140): a, c, t, g, unknown or other
  misc_feature (140)..(140): n is a, c, g, or t
  modified_base (197)..(197): a, c, t, g, unknown or other
  misc_feature (197)..(197): n is a, c, g, or t
  modified_base (202)..(202): a, c, t, g, unknown or other
  misc_feature (202)..(202): n is a, c, g, or t
  modified_base (211)..(211): a, c, t, g, unknown or other
  misc_feature (211)..(211): n is a, c, g, or t
  modified_base (260)..(260): a, c, t, g, unknown or other
  misc_feature (260)..(260): n is a, c, g, or t
tcagatagagtactcacgaccggtgctcgatttagcacacgatagttgggtttgggggaggaactgctcagttaggacccagacggaaccatggaagccccagctcagcttctcttcctcctgctactctggctcccagntaccagcggagagattgtgttgacacagtctccagccaccctgtctttgctccgggnaaagngccaccctntcctgcagggccagtcagagtgttaacaactacttggcctggttccaanagaaacctggccaggctcccaggctcctcatctatgatgcatccaacagggccacgtggcatcccagccaggttcagtggctaggtgggtctggggacaggacttcacctctcacctatcacgccgacctagacgtccctgacggtattctcgtccgtttaatttattcgtcgtttgggtcgttagactacgttggtacccgttcccgtactaccgttttggcccgtaggggtacctaagcgtacggacgtagtacgtaggtaaccgtaacgttcggtacggccgtagtccaacgtacgttccttcgttaccttacgtacccg

SEQ ID NO: 278106 - DNA, 653 bp, Homo sapiens
  misc_feature: GYAE6OF02HRLL2.29.35.D02.1.454.CMB.1.raw
  modified_base (235)..(235): a, c, t, g, unknown or other
  misc_feature (235)..(235): n is a, c, g, or t
tcagatagagtactcacgaccggtgctcgatttagcacacgatagttgggtttggggaggaactgctcagttaggacccagacggaaccatggaagccccagctcagcttctcttcctcctgctactctggctccagataccagcggagagattgtgttgacacagtctccagccaccctgtctttgtctccgggagaaagcgcccaccctctcctgcagggccaggtcagagtnttaaacactactggcctggttaccaacagaaacctggaccaggcctcccgaggtcctcctcactctatgatcgcagtaccaagcggcctacgcgcactcccgagccgtaggttcaggtcggaccgtagggttcgggtcgtagggaacctaggtaccttctacctctaccaccgtatccgacgcccgtaccgtacgacggtccgtaggtacggttattcgttcggtttaccgttttagtttacgtttacggtttcggttagggttcgtaacgtccgtaaccggtccgtcccgttcccgttacgttaccggtttcgggaccggtaacggggtacccaaggtccgtaggactacgtacgaacgtacggtaacggtgtcggtacgtcgaccgtaccttcttacggtacttcgttacctaccc

SEQ ID NO: 278107 - DNA, 1058 bp, Homo sapiens
  misc_feature: GYAE6OF02FQDEQ.29.35.D02.1.454.CMB.1.raw
tcagatagagtactcacgaccggtgctcgatttagcacacgatagttgggtttggggaggaactgctcagttaggacccagacggaaccatggaagccccagctcagcttctcttcctcctgctactctggctcccagataccgagcggagagtattggtgttgacacgtagtcctccagcccacccgttgttcttttcgtccgtaccggggaagaaaacggtccgccctaacccgttcctaccgtgacggacgggtccaagttcaaggtacgttacgtaaacacttacgttgggcccttaggtaccccaaagtaacgtaaaccgtcgggaccacggtccctaccccgaggtcccttcccggtactacgttacgtagtacgacgtcgacctaaccgtacccgaacggaccgggtaccctacggtacgggtaccttacccggtaccccgtacgggttacccggttaacggtttccggtaacgggtcgggtacggtaaggggttccgggggttaccgttaaggggaaacccgtttacggtttaacccgtacccgttaaccgtttacccgtaaaccgtaaccggtaccgtttacccgaaccccggtcccggtaaacgttacgggaaccgtccggttaacggggttacgtaccgtttttaccggttaacccggtttaaccgttttttacggttttacggttaccggggttttacccgggttacgggggttaacgttaaccgggtttaaccccgttttaaccggggttcccgggttttaccccccggtttaacccggtttttaccggggttttttaaaccccggggttttccggggaaaacccccgggggggtttaaaccgtaaaaccccgggtttacggggtaaccgggggttttaaggggaacccctttaacgggggtaaaccggttacccggttaaaaaccggggtttaaccgggtttccggggtttaaacccggcgtttaaccccgggttaccgtttaaccccggtttcggtttaacccggttttccgttttaaaccccggtttacccgtttccccggg

SEQ ID NO: 278108 - DNA, 698 bp, Homo sapiens
  misc_feature: GYAE6OF02FHWD1.29.35.D02.1.454.CMB.1.raw
tcagatagagtactcacgaccggtgctcgatttagcacacgatagttgggtttgggggaggaactgctcagttaggacccagacggaaccatggaagccccagctcagcttctcttcctcctgctactctggctcccagataccagcggagagatttgtgttgacacagtctccagccaccctgtctttgtctccggggagaaagacgccaccctctcctgcagggccagtcagagtgttaacaactacttggcctggttcccaacagaaacctggcaggctccaggctcctcatctatcgatgcatccaacagggccactggcatccccgacgtccagttcgtacgtggcgaggtcgggtctagggctaacggtcttacaccttcgttacccaccctaacgttaccgacgacccggtaccgtacggacgtacccgtgggtaacgggtacggtttccgttccgtacccggttttaacttttagtttaccggtttaccgttttggggttaccgttacgggtaccgtaacccggttcggtaccccttcccgggtttaccctaccggttttttccggggacccgttaccgggggtaaccgtaaacggccgttacgggaaggttacgtcgaacgggtaaccggaacgtacgggttccggcgtacgtccaaccggacttaccggtcgttccgttaccgtcccg

SEQ ID NO: 278109 - DNA, 729 bp, Homo sapiens
  misc_feature: GYAE6OF02FQJZO.29.35.D02.1.454.CMB.1.raw
  modified_base (211)..(211): a, c, t, g, unknown or other
  misc_feature (211)..(211): n is a, c, g, or t
  modified_base (250)..(250): a, c, t, g, unknown or other
  misc_feature (250)..(250): n is a, c, g, or t
  modified_base (274)..(274): a, c, t, g, unknown or other
  misc_feature (274)..(274): n is a, c, g, or t
  modified_base (276)..(276): a, c, t, g, unknown or other
  misc_feature (276)..(276): n is a, c, g, or t
  modified_base (301)..(301): a, c, t, g, unknown or other
  misc_feature (301)..(301): n is a, c, g, or t
tcagatagagtactcacgaccggtgctcgatttagcacacgatagttggggtttgggggaggaactgctcagttaggacccagacggaaccatggaagccccagctcagcttctcttcctcctgctactctggctcccagataccagcggagagattgtgttgacacagtcctccgagcccacccttgttccttttgtccgtccggggaanaaagacgcccaccctctcctgcacgggccagtcagagtntaaacactacttgccttgtccaananaacctgccaggctccaggcctcctnatctatgatgacactccgaacgaccggcacgtcggcacctcccacgccgtaggttcaggtcggccgtagggttgggtccgtaggggactaggaccttcgtactccgtacctacccgtactaccgccggtacccgtccgtaacggaccgtaccgtaggacggttactttccgttacggttccgtttttaactttggtttcgtttacggttcgggtaccggtacgtaccgttaaccggtccggtcccgttaccccgttccgttaaccggtttttccgggaccggtaaccggggttaccgaacggttaccggtacgggttaagaccgtttacgaccgggtaaacggtaccggtttacgggtcgtacccgtaccggttacccgtaacccgttaccgttaccgtttacggtttcccgttaccgtttaaccccg

SEQ ID NO: 278110 - DNA, 889 bp, Homo sapiens
  misc_feature: GYAE6OF02FKDIA.29.35.D02.1.454.CMB.1.raw
  modified_base (203)..(203): a, c, t, g, unknown or other
  misc_feature (203)..(203): n is a, c, g, or t
  modified_base (291)..(291): a, c, t, g, unknown or other
  misc_feature (291)..(291): n is a, c, g, or t
tcagatagagtactcacgaccggtgctcgatttagcacacgatagttgggtttgggggaggactgctcagttaggacccagacggaaccatggaagccccagctcagcttctcttcctcctgctactctggctcccagataccagcggagagattgtgttgacacagtctccagccaccctgtctttgtctccgggagaaagngccaccctctcctgcagggccagtcagagtgttaacaactacttggccttggttccaacagaaacctggccaggctccgaggcctccnatctaatgatgcactaccaagacgggcccacgtcggacctacgtccccgaacggtcccgtaaggtttccgaaggtcggaccgtaagggttcgggggttacctacgggggaaccacggttaaccgtttccaaccgtttacctaacccgaacccctaacgtttacccggaaccggaccccggtacccgtaacggtaaccggtaccccgttacgggtaacgggttaaccgttttaccggtttacgggtttaacccccggttttttaaagtttttaaccggtttttacggggttttaccggttttaccgggggttaaccggtttaacgggttaacccggttaaaccgggttaccccggggtacccccggttttacccccgggtttacccgtttaaccgggtttttttaccggggtacccgggtaaaccggggggttaacccgtaaacgggttcccggggttaacgggtacggttaaccgttaaccgaaccgggttaaaaccgggtaaccggtttacgggttaccggggtaaccgtttaccggaacccgtaacccggttaaccgttaccggtttaccggtttacccttaccgtttaaccccgg

SEQ ID NO: 278111 - DNA, 640 bp, Homo sapiens
  misc_feature: GYAE6OF02F6XCS.29.35.D02.1.454.CMB.1.raw
  modified_base (150)..(150): a, c, t, g, unknown or other
  misc_feature (150)..(150): n is a, c, g, or t
  modified_base (269)..(269): a, c, t, g, unknown or other
  misc_feature (269)..(269): n is a, c, g, or t
  modified_base (418)..(418): a, c, t, g, unknown or other
  misc_feature (418)..(418): n is a, c, g, or t
  modified_base (425)..(425): a, c, t, g, unknown or other
  misc_feature (425)..(425): n is a, c, g, or t
  modified_base (437)..(437): a, c, t, g, unknown or other
  misc_feature (437)..(437): n is a, c, g, or t
  modified_base (456)..(456): a, c, t, g, unknown or other
  misc_feature (456)..(456): n is a, c, g, or t
tcagatagagtactcacgaccggtgctcgatttagcacacgatagttgggtttggggaggaactgctcagttaggacccagacggaaccatggaagccccagctcagcttctcttcctcctgctactctggctcccagataccagcgganagattgtgttgacacagtctccagccacctgtctttgtcgtccgggagaaagcgccacctctcctgccgacgggccaggtcagtagtcgttaacaacttacgtggccctggttaccaanacgtaaaccgtggaccaggcctcccgaggtcctcctcatctatcggtatcgacctactacccgaaacgtaccgggaccacgtcggacctaccgtaccccgacgtcccgtaaggttccgaggtcggacgtagggtggtccgtagggaacngtacctnactctcacctancgacgcacgtagcgtacgnggtacgtacttcgttacgttaccgtttagttcttacggttggttacggacgttacgactaaccggtcgtacccgttccgttacgtaccgtttcggacccgtaacgggaaccctaggtccgaaggtacgacgtacgacgtacgtacgtggtaccgtactcgtactcgtacgtctcgttctcgtcc

SEQ ID NO: 278112 - DNA, 805 bp, Homo sapiens
  misc_feature: GYAE6OF02JBX73.29.35.D02.1.454.CMB.1.raw
tcagatagagtactcacgaccggtgctcgatttagcacacgatagttgggtttgggggaggaactgctcagttaggacccagacggaaccatggaagccccagctcagcttctcttcctcctgctactctggctcccagataccagcggagagattgtgttgacacagtctccagcccaccctgttctttgtcgtccggggagaaagagccaccctctcctgcagggccagtcagagttagttaacaacttacttggcccttggttacccaaacgacgtaaaaccctgggacccacgggcccttccccgaggtcccttaccctctaactttcctaataggtattcggcctaacgtaccccgaaaaccggtcggggacccctaacggttcgggaccctaacgttccccgacgtccccgtagggtttaccagggttcggccgtaagggttcggggttccgtaggggacctaagtacccgtttcactttccctaccgaacctactccgaacgcccgtcctaaccggtcgtccgtaggtacggttacgttcgttacggttacctttttagtttacgttttcggttcggttttcgggtacgttaccggtaccgttaacccggttccgggttaccccgttaccccggtttccgtttaaccggtttttccgggtacccgggtaaccgggtaaaccggtaacggtcggtacgggtaagtacgacggtaacgggtaacccgttaacggttcgggtaggaccgttcgggacccttaccggaaccgtttccggtttcttacccgttcctaaccccg

SEQ ID NO: 278113 - DNA, 716 bp, Homo sapiens
  misc_feature: GYAE6OF02FZIMF.29.35.D02.1.454.CMB.1.raw
tcagatagagtactcacgaccggtgctcgatttagcacacgatagttgggtttgggggaggaactgctcagttaggacccagacggaaccatggaagccccagctcagcttctcttcctcctgctactctggctcccagataccagcggagagattgtgttgacacagtcctccagccaccctgtctttgtctccgggagaaagcgccaccctctcctgcacgggccagtcagagttacgttaacaactcgttggccttggttaccaacacgaaacctcggaccacggcctcccgaggccttaccctctactctagtcgatcgaccactccaaacgcgggtaccacgtggcactcccagaccgtagtcaggtcggacgtaggtcgggtccgtaggggacacggtactttaccgaccttccctaccgaacctacgtccgtaccgcccgtaccgtacggacgtcccgtaggtaacggtacgtttccggtcggtttaccggtttttaagttttacgtttcgggttccgtttcggggtaccggttacgtaccgttaccggttccgggtaccccttacccggttccgttacggttttccggaccgggtacgggtaaaccgtacggacgttagggaagtactacgacggtaacggtaaccgttgggtaccgggttccaccggacgttacctaccgttcgttacgtttccttacgttaccccg

SEQ ID NO: 278114 - DNA, 854 bp, Homo sapiens
  misc_feature: GYAE6OF02H7CP8.29.35.D02.1.454.CMB.1.raw
  modified_base (170)..(170): a, c, t, g, unknown or other
  misc_feature (170)..(170): n is a, c, g, or t
tcagatagagtactcacgaccggtgctcgatttagcacacgatagttgggtttgggggaggaactgctcagttaggacccagacggaaccatggaagccccagctcagcttctcttcctcctgctactctggcctcccagatacccaggcggagagattgtgttgaacanagttctccagccctaccctgttctttgtccgtccggggagaaacgacgccctaccctcgtcctcggacgacgggcctagtcgaggtagttacgtaaaccaacttacgttcggtacgtaccggttaccaaaccgtaacgtaaaccgtcgggaccgaacggtccctacccgtacggcctttccgacctacgtaccttagtcgtagtacgacctactaccgaaaccggtcggtacccctaacggtcggactaccgtacctaccggtccgtacggtaccgtggtccggacgggtaggtcggggtacggtaccggtacgtaaccggttccgttacgtaccttacccgtaccgtaccctagttaacccctcggtacccgtaccgttaacgggacccgtacggtaccggtcggttttaaccgtccgtttaccgggtttaacctttttaagtttaccggtttcggttacccgggttaggggttaacccggtaccgttaccggtacccggttcccggtttaaacccccggttccggttaccccgttttacccgggttaaccgacccggggggttaaacgtacccgggtaaacggtccgggtaggtaccgtacgtacgggtacgtaccgtagggtcgtacggtcctacggacctacggtaccgttacggtttccttacggttcccgttaacccg

SEQ ID NO: 278115 - DNA, 820 bp, Homo sapiens
  misc_feature: GYAE6OF02GIY87.29.35.D02.1.454.CMB.1.raw
  modified_base (199)..(199): a, c, t, g, unknown or other
  misc_feature (199)..(199): n is a, c, g, or t
tcagatagagtactcacgaccggtgctcgatttagcacacgatagttgggtttgggggaggaactgctcagttaggacccagacggaaccatggaagccccagctcagcttctcttcctcctgctactctggctcccagataccagcggagagattgtgttgacacagtctccagccaccctgtctttgtcgtcggganaaagcgcccacctctcctgcgagggccagtcagagttacgttaacaacttacttggtccttggttacccaaacgaacgtaaacccgtcggacccgtaacgggtccctaccccgaggtccttaccctcattccttatacgtaagttcggcctaactacccgaaacggtccggggacccaacggtccgggacctaaccgtaccccgaccggtaccgtaacggttccgaagggtcggtacggtaggggtttcggggtaccggtacgggggaacctaacggttaccttaccctaccgttacctacccgtaacctacgtaccggtaaccggcccgtacccgtacggaaccggtccgtaagggtaccggtacgtttaccggttacggtttaccgttttagtttacggtttcgtttcgggtttacgggtacggttaccgacgtaaccggtccgttcccgttacccgttaccgtttaccggttttccgggacccgggttaaccgggtaaccgtaacggtccggtaggtaacggtactaaccggtaacggtaacggttaaccggttcggtaccggttaccgtccgtaaccgtaccgttaccgttacctttcgtttaccgttccttacccg

SEQ ID NO: 278116 - DNA, 655 bp, Homo sapiens
  misc_feature: GYAE6OF02IPG91.29.35.D02.1.454.CMB.1.raw
  modified_base (251)..(251): a, c, t, g, unknown or other
  misc_feature (251)..(251): n is a, c, g, or t
  modified_base (352)..(352): a, c, t, g, unknown or other
  misc_feature (352)..(352): n is a, c, g, or t
tcagatagagtactcacgaccggtgctcgatttagcacacgatagttggggtttggggagaactgctcagttaggacccagacggaaccatggaagccccagctcagcttctcttcctcctgctactctggctccagataccagcggagagattgtgtgacacagtctcagccacctgtctttgctcggagaagagcccacctctcctgcagggccagtcagagtgttaacactactggctaggttccaanagaacctggccaggcctcccaggcctcctcattcagtgatgccataccaacgacgggccacgtgccactccagtccaggttcaggtgactaggtgggtcgnggtaacacgtaccttcgaccttaccacgtacccagtacccgacgtaccgaccgtaaggaccgtccgtaggacggttactcgtacgttaccgttttaagttagtttcgttcgttacgggtacgttacgctaaccgttcggcccttcccgttacgttccggttttacggaccggtacgggtaacccgtagtaccggtacggaacgtacgtaccgaacggtaaccggttaacggtacgggttccggtaccgttaccggtaccggtaaccttccgttaaccgttccgtttaccgttaccgttacccg

SEQ ID NO: 278117 - DNA, 792 bp, Homo sapiens
  misc_feature: GYAE6OF02JWN5J.29.35.D02.1.454.CMB.1.raw
  modified_base (764)..(764): a, c, t, g, unknown or other
  misc_feature (764)..(764): n is a, c, g, or t
tcagatagagtactcacgaccggtgctcgatttagcacacgatagttgggtttggggaggaactgctcagttaggacccagacggaaccatggaagccccagctcagccttctcttcctcctgctactcgtggcctcccagactaccagtcggagagtagttggtgttcgactacgagttctaccagtcccacccgttggtcctttgtcgtccgggggaataaaacgcgcctaccgtctaccgtgcgacgggcctaggtccaggtacgtcgttaaacacttacgtcggccgttacggttaccaaacacggaaacctcggccgaacggtcctcccgacggtacctccctcgacttactacgtgtacgtacgccaactaacccgaacggaccggaccgtacggtcggtaacctacgtaaccccgacggtaccgtacggtacgtacggacgtcggtacgggttagggttcgtacggggtaactacgtccgtacgtacctcgacctaccgtacggtcctaacggacccgtacgtacgtaacggtccgtacgggtaactacggtttccgttaaccgttttacggttactttcggtttaccggtttcgggaccggtttaaccggttaccgtaacggttccggttaccggttcccgtttaccggtttccggttaccggtttaccgggtaccggtacccgggtaacgtacggttacgtacgggtactacgtcgtaacgtacggtaccggtcgtacgtaccgtggtaacccgnttaccgtacgtcgttactaaccgttccg

SEQ ID NO: 278118 - DNA, 890 bp, Homo sapiens
  misc_feature: GYAE6OF02F13VE.29.35.D02.1.454.CMB.1.raw
  modified_base (251)..(251): a, c, t, g, unknown or other
  misc_feature (251)..(251): n is a, c, g, or t
tcagatagagtactcacgaccggtgctcgatttagcacacgatagttggggttagggggggaactgctcagttagggacccacgacggaacccagtggtaacgccccgagtctctaggcttctcttccgtacctgacctactctacggcctaccccaggtacgtaccgtaggcggtagaggatttggtgttacgaccacgtaggttccttaccgagcccacccgttggtcttttaggccgtaccggggaanaaaggtcgaccctacccgttcggttacctcggacgtacgggacccgtagggtccaggtaacgttacggttaaacaacccgtttacgttcgggaccctttacgggttaccccaaacgaacggtaaaccccttgggacccccgtaagggtccccttaccccgagggtcccttacccgtactacgttcctaaggttccgacgtaggaccgacgtaccgaacgtacggggaccctaggtcgacctaacgtcccgagtaccgtaggttaccgaggttacggggacgttaaggggtccgggttacgtaacggggtaacctacgggtaccctttaccgtaccgtaccgttaccgaacccgtacggttacccacggtaccccgtaccgtaacggaccgtaccgtaaggtacggtagttaccgtcgttaccgtttattacgttcgttaccggttacggtacgttacgtaaccgtacggtaccgtacccgttaccggtaccgttacggtttaccggacccgggaacgggtaacccgtaggtacggttacgaacgggtacgttaccgaaggtaccgtacggtacggtcggaccgttaccggaccttaccggccttacggttacctttaccgttaccgttacttaccccgg

SEQ ID NO: 278119 - DNA, 859 bp, Homo sapiens
  misc_feature: GYAE6OF02HM9R9.29.35.D02.1.454.CMB.1.raw
  modified_base (162)..(162): a, c, t, g, unknown or other
  misc_feature (162)..(162): n is a, c, g, or t
tcagatagagtactcacgaccggtgctcgatttagcacacgatagttgggtttgggggagaactgctcagttaggacccagacggaaccagtcggaagccccaagctcgacgtcttactcttcctcctgctactcgtggcctccagataccgagcggagagnttgtgtacgacacagtccacgacgcctacccgtgttctttacggccgtacgggaagaaaacgccgtaccctaccccttgtacccgtgaccgtacgggtcccaaggttacaggtaacgtttacgtaaaccaacgtttaccgttcgggacctttagggtaacccaaacgttaacggaaccttggacccgaaacgttccctaccgagggtcccctacttaccgattaccgtaagtacgtaacgttacgaccgttaaccgacccgtaaacggaacccgggtacctaacgggttcggaccctaaaccttcccccgggaaacgttccccggttaaagggtttaccaagggttaccgggtaaccgttacggggtacggggtttccggaaaccggggtaactaaggttacccttaaccgtaccgttacccgttaaacccaagtttaacgtacccgaccggtacccggtaacccgtaacggtaaccgtacgtacggtaacggtactttacgtaccgttaacggtttacgttaagtttcggttacgggtagttaccggacgtacgtaaccgtcggtaccccgttaccgtaccgttacggttaccggacgtacgggtaaccacggtacgtacgaccggattacgaacgtacgtacgtcggtacgtacgtcgtaaccgcggtactttcgtacttaccgttacgtaaccg

SEQ ID NO: 278120 - DNA, 803 bp, Homo sapiens
  misc_feature: GYAE6OF02FMBP8.29.35.D02.1.454.CMB.1.raw
  modified_base (171)..(171): a, c, t, g, unknown or other
  misc_feature (171)..(171): n is a, c, g, or t
tcagatagagtactcacgaccggtgctcgatttagcacacgatagttgggtttggggggaactgctcagttaggacccagacggaaccatggaagccccagctcagcttctcttcctcctgctactctggctcccagactaccagcggagagattggtgttgacacagtcnccagccacctgttctttgcctcgggagaagcgcctacctctcctgcgaggccagtcagtagtacgtaaacacttacttggcctaggttaccaacgtacgaacctggaccaagggtcctacccgaggttccctacccgtctaacttccgttaactggtacgttcgaccgtaacgttaacccgaacggtaaccgggccctaacggtgggaccctacgtaccccgtaaggttaccggtaacgggttttccgagggttaccggtacgttacgggggttcgggtttaccgggttacggggacctaacggtttaacccgtttccacccggtttaacctaccctaacccggtagttaccccgaaggtccccggtacgttaaccggaccggttacccgtagggtaacgttactttcggtaccggtttaccgtttagtttaacggtttcggttcggttacgggtacgttacggtaacctaccggttccgtacccgtccggttacggttacccgttttcggaccggtaaccgggtacctaggtccggttaggacgttacgtacggtacgtaacggtcgttacgggtcgtcgtaccggtacgttaccgacgtttccggttacgttcttaccgtaccttcccgg

SEQ ID NO: 278121 - DNA, 828 bp, Homo sapiens
  misc_feature: GYAE6OF02FR9TA.29.35.D02.1.454.CMB.1.raw
  modified_base (203)..(203): a, c, t, g, unknown or other
  misc_feature (203)..(203): n is a, c, g, or t
tcagatagagtactcacgaccggtgctcgatttagcacacgatagttgggtttggggaggaactgctcagttaggacccagacggaaccatggaagccccagctcagcttctcttcctcctgcctactctggctcccagataccagcggagagtattgtgttgactacagtctccagcccacctgtctttgccgtacgggtanaagacgccaccgtctctagcagggccagtcaagcgtagtaactaactcgttcggaccttaggtacccaaagaacgaaaccgttcggaccgacggtcctaccccggaacggtcctacccctactacgttacgttactaggtaacttcggtacctaacgtaacccgaaaacggaccggggtacctaaaccggtcgggtacccaaccttaccccggtaacggtacccggttaaacggtttccgggtaacgggtacggtacccggttaagggttccggggttaaccggtaaggggaaccttaacgggtaccctttaccgacctttccgaaacccgtaaccgtactaccggaacccggtacccgttaaccgtaacggtaacgtccgtaacggtaacggttacttaccggttcggttaaccgtttaacgtttacgtttcggttacgtttacgggtacgtaacgtaaccggtttaaccgtccgggttaacccttaccggtaccgtttaccggtttccggacggttaaccgggtaaccgtaggttaccggaggtaacgtactaacggacgtaaccggaacgttcgggtacgtacgtcgacgtaccgtacgtcgtacgttacgttcctaacccg

SEQ ID NO: 278122 - DNA, 712 bp, Homo sapiens
  misc_feature: GYAE6OF02GQIG0.29.35.D02.1.454.CMB.1.raw
  modified_base (202)..(202): a, c, t, g, unknown or other
  misc_feature (202)..(202): n is a, c, g, or t
  modified_base (219)..(219): a, c, t, g, unknown or other
  misc_feature (219)..(219): n is a, c, g, or t
  modified_base (346)..(346): a, c, t, g, unknown or other
  misc_feature (346)..(346): n is a, c, g, or t
tcagatagagtactcacgaccggtgctcgatttagcacacgatagttgggtttggggaggaactgctcagttaggacccagacggaaccatggaagccccagctcagcttctcttcctcctgctactctggctcccagataccagcggagagattgtgtgacacagtctccagcctacctgttcctttgtcctccggggaanaaaacgcgcccaccctntacctgcaacgggccagtcaagtagtacgttaaacaaccttacgttcggccttaggttaccaaaactaacggaaaaccttcggaccaggccttccgaaggtcctaccctgtactctaagtcgaactnaccgaactaccgaaacgtacggaccacgttggactacgtccaacgtcgtaacggttcaaggtcgacgtacggtggtcgtacgggactaggtaccttctaacgtcctacgaacctaacgtctaaccgtaccgtaccggtagtaaccggtacgtaggtacgtaacgtttccgttacgttaccggttttatttaaggtttcgttacgttcgggtacgttacgtactaacggtcccgttacctccgttacgttaccgtttacggaccgaacgggtaccaagtccgtaggtaatacgtaacgaaggtacccgtaagttcggtacggtacctagtcccgtaactaccgttcgtacgttaccttagttacccg

SEQ ID NO: 278123 - DNA, 619 bp, Homo sapiens
  misc_feature: GYAE6OF02HYGA5.29.35.D02.1.454.CMB.1.raw
  modified_base (201)..(201): a, c, t, g, unknown or other
  misc_feature (201)..(201): n is a, c, g, or t
  modified_base (315)..(315): a, c, t, g, unknown or other
  misc_feature (315)..(315): n is a, c, g, or t
  modified_base (319)..(319): a, c, t, g, unknown or other
  misc_feature (319)..(319): n is a, c, g, or t
tcagatagagtactcacgaccggtgctcgatttagcacacgatagttgggtttggggaggaactgctcagttaggacccagacggaaccatggaagccccagctcagcttctcttcctcctgctactctggctccagataccagcggagagattgtgttgacacagtctccagccacctgtctttgcgtccgggagaaagngccacctctcctgcacgggcagtcagagtagttaaacaactacttcggccttggttacccaaataacgaaaccctcggacccacggcctacccgacggcctccgtcatccttangtangactatccaaacgacgggaccacgtcgaccactaccacgtccgagtcgagtggcgtaggtggtacgtgggactagtacctacgctacacacctagcacgaccgtccgtagcgtcgtacggtagtacttcgtacgttacgtttaagtttactaggttcgttcggtacgttacgaccgtaacgtcgtccttccgtaccgttcgtttacggaccgtagggaaccgtaagtacgtggaagtacgtacgacggaaccgtatcggtgtacgtacgacgtacctacgttacgtacgttctactaccg

SEQ ID NO: 278124 - DNA, 789 bp, Homo sapiens
  misc_feature: GYAE6OF02G9W6M.29.35.D02.1.454.CMB.1.raw
  modified_base (334)..(334): a, c, t, g, unknown or other
  misc_feature (334)..(334): n is a, c, g, or t
tcagatagagtactcacgaccggtgctcgatttagcacacgatagttgggtttgggggaactgctcagttaggacccagacggaaccatggaagccccagctcagcttctcttcctcctgctactctggctcccagataccagcggagagattgtgttgacacagtctccagccacccttgttctttgtaccgtccgggagaaacgacgccaccctccgtcctgcgacggcctagtccgagagttacgtaaacaacttcgttcggacccttaggtacctaacgaacgtaaaccgtcggacctaacgggccccttaccggaggtcccttaccctntaacgtccttagtgtaacgtcggaactaaccgttaacccaaaccgggccgggacccgaacgtccggtacctaccgtacccccgagtaacccggtggttaccgtaggtacggccgtagggtccgggtacgtaggggtactaacggtcttaccgacccttccgtaccgtaaccctagttcccaccgggacccgtaccgtacgaccggtacgtacggtacggttacgtttacggtacgtttacgtttacgtttcgtttacggtttacggtttacgggttccgtacgtacgtaaaccggttcgtcccgttaccgttaccgttaccgttaccgggtaccggtaccgggtaacgtaaccgggtacgtacggacgttaacgtacgtacgtaacggtacggttcgtacgtacgtaccgtacgtacgacgtttacgttcctttactttaccgtacgttaccccg

SEQ ID NO: 278125 - DNA, 642 bp, Homo sapiens
  misc_feature: GYAE6OF02FMJGV.29.35.D02.1.454.CMB.1.raw
  modified_base (275)..(275): a, c, t, g, unknown or other
  misc_feature (275)..(275): n is a, c, g, or t
  modified_base (287)..(287): a, c, t, g, unknown or other
  misc_feature (287)..(287): n is a, c, g, or t
tcagatagagtactcacgaccggtgctcgatttagcacacgatagttggggtttgggggaggaactgctcagttaggacccagacggaaccatggaagccccagctcagcttctcttcctcctgctactctggctcccagataccagcggagagattgtgtttgacacagtctccagccaccctgtctttgtctccgggagaaagagccaccctcctcctgcacgggccagtcagagtcgttaacaactacttggcctggttccaacagaaaccnggccagctcccngctctcatctatgatgcatccaaacgacgggccactggcactcccgacgacaggttcaggtcggcaggtgggtctgggactagtaccttcacttcctaccgaccctaacgtacgacggcccgtaccgtaacgacgaccgtaggtacggaacttccgttcgttaccgttttaagttagtttacgttcggttagggtccgttaacgtctaaccgttcggtcccgtcccgtaccgtacgttttacggtaccgtacggggtaacctaacggtcgtagggtaagactacgaacggtaacggtaacgttacgtacgggtcgtacgtccgtaccgtacgttacgtcgttaccttcgttaccg

SEQ ID NO: 278126 - DNA, 805 bp, Homo sapiens
  misc_feature: GYAE6OF02JJ4KN.29.35.D02.1.454.CMB.1.raw
  modified_base (96)..(96): a, c, t, g, unknown or other
  misc_feature (96)..(96): n is a, c, g, or t
tcagatagagtactcacgaccggtgctcgatttagcacacgatagttgggtttggggaggaactgctcagttaggacccagacggaaccatggaanccccagctcagcttctcttcctcctgctactctggctcccagataccagcggagagtattggtgtttgacacagtctccagcccacccttgtctttagtccgtccgggaagaaaacgccgaccctacccgttctccgtggaccgacggggacctacggtacgaaggtacgtaacgtttaaaccaaaccgttaccgttcggggacctttaccgggtaccctaaaacggtaacgtaaaacccgtcgggacccgtaacgggcccttaaccccgaacgggtcctcccgtaacctactttacccgtagtacggtaacgtcggtcctaacgttacccgaaacgggacggacccgtaaccgttcggcctaacgtaccccgtacggaccggttaggttacacgggttaccggacgttacgggtcggggttccgttacggggactaacggtaccgtttacctaccgtacttacccgtaccgtaacgttaccgaccgggtacccgtacggtacgtaacggtaccgtacggtacggttaacgttacgtcggttaccgtttaacttacgttacggtcgtttacggcgtacgtaccacggttacgtccgtccgttacgtacgggttccgtaccggtaggtaaaccctaggtccgaggtaccgtacgtgaaccggtaacggtactcggtcggactcgacacgtcctactcgtcttacgttacc

SEQ ID NO: 278127 - DNA, 685 bp, Homo sapiens
  misc_feature: GYAE6OF02FXHS4.29.35.D02.1.454.CMB.1.raw
  modified_base (205)..(205): a, c, t, g, unknown or other
  misc_feature (205)..(205): n is a, c, g, or t
tcagatagagtactcacgaccggtgctcgatttagcacacgatagttgggtttgggggaggaactgctcagttaggacccagacggaaccatggaagccccagctcagcttctcttcctcctgctactctggctcccagataccagcggagagattgtgttggacacagtctccagccaccctgtctttgtctccgggagaaagngccaccctctcctggcggggccagtcagagttcgtaacaacttacttggcctggttaccaacagaaacctggaccaggcctccgaggtcctcctcatctatgatgctactaccaacgacgggtccacgtcgactactcccgagaccgtaggttcaaggtcggacgtacgggttcgggggttaccgtagggggaaccaggttaccctttaccaccgttccgtacccaaccctaacgttcccgaaccggtcccgaccgttaaacggaccgtccgtagggaacgttacttccggttcgttaccggttttatacgttttgtacggttgggtacgtacgacgtacgtccggtacccttccggttcgttacgtttcgggaccgtaacgggccaagtcggtagacgtacgacgagaaccggtaactcgggtacgtaccgttacgaccctacgtacgttcgttacgtcctttacgaccgtttaccccg

SEQ ID NO: 278128 - DNA, 945 bp, Homo sapiens
  misc_feature: GYAE6OF02GXPHQ.29.35.D02.1.454.CMB.1.raw
tcagatagagtactcacgaccggtgctcgatttagcacacgatagttgggtttggggaggaactgctcagttaggacccgagacggaaccatggaagccccagctcagcttctcttcctcctgctactctggcctcccagactaccagcggagagattgtgttgaacacagtctcagccacctgttctttgtcgtaccgggaagaaacgcgccctaccctctaccgtgccgacgggccagtcaaggacgttacgttaaaccaacgttacgttcggccttcggttacccaaacgtaacggtaaaacccgtgggaccctaacgggtccccttacccccgaagggtccccttacccctacctaacgttacccgttaaagttcggtaacttcggaccttaaccgttaaccccgaaaaccgggtaccggggtaccccctaacggttaccggggacctaacccgttacccccggacggtaccccgtaaagggttccgtaacgggttcgggaccgtaacggggtttccggggttcggtaacggggtaacgtaaccggttacctttaccgtaacccgttccgtaacccaacccgtacgtacccgtacggccccgtaaccgttaaggaccggtcctaacgggaacgttacttacccgttacggtttacccgtttttaagttttcgtttggttacccggtttacggggtaccgttaacggtacccgtaaccggtttcccgggtaccccgttttacccggttacccgtttaaccggtttttacccgggacccggttaagggggtaaacccgtaacggtaccgggtaagggtaccgttaacgtaccgggtaaacgtaaaccgggttaaccggttggggttacccgtaccggttacccgggtaacccgtaaccttaccggtttacgtttccggttttacccttaccgtttaaccccgg

SEQ ID NO: 278129 - DNA, 883 bp, Homo sapiens
  misc_feature: GYAE6OF02IOMSY.29.35.D02.1.454.CMB.1.raw
  modified_base (205)..(205): a, c, t, g, unknown or other
  misc_feature (205)..(205): n is a, c, g, or t
  modified_base (211)..(211): a, c, t, g, unknown or other
  misc_feature (211)..(211): n is a, c, g, or t
  modified_base (243)..(243): a, c, t, g, unknown or other
  misc_feature (243)..(243): n is a, c, g, or t
tcagatagagtactcacgaccggtgctcgatttagcacacgatagttgggtttgggggaggaactgctcagttaggacccagacggaaccatggaagccccagctcagcttctcttcctcctgctactctaggcctacccagactaccaggccggagacgattggtgttgacacagtcctcagcccacctgtctttgctcggganaagacnccaccctctcctgcacgggcctagtcgaagtnttacttaaaccgaacttacgttcggcccttagggtttacccaaaacgtacggtaaaacccgttcgggtaccccgacgggttaccccgttaccccgtaaggggtccccctttacccctacgtaaaccgtttcccgtttaagttacgtaacggtccggtacctaaaccgtttacccggaaaaccgggtaccggggtaccccttaaaccggttccggaccttaaacccgttaccccggaacgtaccccgggttaaggttttacccgaggggttccggaccggttaggggttccggggttacccggtacgggggtacaaacgggtttacccttaccgaacccgtttaccctaccggaaccgtttaagacccggtaccgtaccccggtaccgtaccgtaccgtaccggtacggtacggttacgtttcgttaccgtttacgttttacgttacgtttccggttagttacgggtacgttacgtaccgtaaccgttccggtacccgttacccgttacgtacgtttccggaccgggtacggtaaccgtcggtacgtacggtacgtacgtacgtacggtaaccgtacgtacggtacggccgtaccgaccgttaccgttaccttaccggttacttaccgttaccgttacccg

SEQ ID NO: 278130 - DNA, 710 bp, Homo sapiens
  misc_feature: GYAE6OF02F0KSQ.29.35.D02.1.454.CMB.1.raw
  modified_base (197)..(197): a, c, t, g, unknown or other
  misc_feature (197)..(197): n is a, c, g, or t
  modified_base (202)..(202): a, c, t, g, unknown or other
  misc_feature (202)..(202): n is a, c, g, or t
  modified_base (268)..(268): a, c, t, g, unknown or other
  misc_feature (268)..(268): n is a, c, g, or t
tcagatagagtactcacgaccggtgctcgatttagcacacgatagttgggtttgggggaggaactgctcagttaggacccagacggaaccatggaagccccagctcagcttctcttcctcctgctactctggctcccagataccagcggagagattgtgttgacacagtctccagccaccctgtctttgctcggganaaagngccaccctctcctgcgaggggccagtcagagtcgttaaacacttacgttggccttggttacccaanacgaaaacctgggcccaagggcctaccccgaggcctccgtcattctatgatcgcacttccaacgacgggaccacgtcggacactcccgacgtccgtaggttacacgtggcctagggttgggtccgtaggggtacctaggacctttcgaccttacctaccgaaccgtaactccgaacgtcccgtacccgtacggaccggtaccgtacgggtaacgggttacttccgttacgttacccggtttttaatttcgtttacgtttcggtttcgggtacggttacgaccgtaaccggtcggtcccgttacccgttaccgtttaccggtttcggaccggtaaccgggtaaccgtaacggtccggtagtacggtacttacggaaccggtaacgtaaccgttggtacggtcgtacgacctaccgtacttcgttacgttccttacgttacccg

SEQ ID NO: 278131 - DNA, 628 bp, Homo sapiens
  misc_feature: GYAE6OF02F6X9C.29.35.D02.1.454.CMB.1.raw
  modified_base (199)..(199): a, c, t, g, unknown or other
  misc_feature (199)..(199): n is a, c, g, or t
  modified_base (204)..(204): a, c, t, g, unknown or other
  misc_feature (204)..(204): n is a, c, g, or t
  modified_base (271)..(271): a, c, t, g, unknown or other
  misc_feature (271)..(271): n is a, c, g, or t
  modified_base (361)..(361): a, c, t, g, unknown or other
  misc_feature (361)..(361): n is a, c, g, or t
  modified_base (393)..(393): a, c, t, g, unknown or other
  misc_feature (393)..(393): n is a, c, g, or t
tcagatagagtactcacgaccggtgctcgatttagcacacgatagttgggtttggggaggaactgctcagttaggacccagacggaaccatggaagccccagctcagcttctcttcctcctgctactctggctcccagataccagcggagagattgtgttgacacagtctccagcccacctgtctttgtcgtccggganaaagngccaccctctcctgcagggccagtcagagtacgtaaacaacttacgttggcccttggttacccaaanagaaaccctggccaggcctcccgaggcctcctcatctatgatgacatccaagacgggccacgtgccactcccagcctaggttcagtcggntaggtggtcgtgggacagtcttcactctcacntcacgccgaccgtagacgtccgtaggacggtacttctacggttaccgttttatttagtttcgttcgttcgggtacgttacgtccgtaacgtcgggtaccccttccggttccttacgttttcggaccggtaacgggacctaacgtcgtaggacgtacgtacgacggtaacgaacggttcggtacggtacgtacgtaccgtaaccggtaccttcgttaccggttcgttccttacccg

SEQ ID NO: 278132 - DNA, 698 bp, Homo sapiens
  misc_feature: GYAE6OF02G29EY.29.35.D02.1.454.CMB.1.raw
  modified_base (203)..(203): a, c, t, g, unknown or other
  misc_feature (203)..(203): n is a, c, g, or t
tcagatagagtactcacgaccggtgctcgatttagcacacgatagttgggtttgggggagaactgctcagttaggacccagacggaaccatggaagccccagctcagcttctcttcctcctgctactctggctcccagataccagcggagagattgtgttgacacagtctccagccaccctgtctttgtctccgggagaaagngcccaccctctcctgcaggccagtcagagtgttaaacactacgttggacccttggttacccaacgaagtaaaccgtggaccacgggccctacccaggtcctcccgtcactctatgatcggacactacccgaacgtacgggcctaacgtggacctacgtcccctaggacccgtaggtttcgacggtggacgtagggttcggggtcgtaggggaacctcgtacctttcgaaccctttcgacctaccgtactacggaccgtaccggtacccgttaagccgtacgtaggtaacgggttactttcgtacggtttaccttttaagtttagtttcggtacgttcgggtccgttagcctaacgtccgtacccgttcccgttacgttcgtttacggccggtaacgggtaccaacggtcgtacggaacgttacgtccgtaaggaccgtaacgtggtacggttccgaggaccctaaccgttggtaccttcggttccctataccccg

SEQ ID NO: 278133 - DNA, 898 bp, Homo sapiens
  misc_feature: GYAE6OF02IMBQZ.29.35.D02.1.454.CMB.1.raw
  modified_base (139)..(139): a, c, t, g, unknown or other
  misc_feature (139)..(139): n is a, c, g, or t
  modified_base (562)..(562): a, c, t, g, unknown or other
  misc_feature (562)..(562): n is a, c, g, or t
tcagatagagtactcacgaccggtgctcgatttagcacacgatagttggggtttgggggaggaactgctcagttacggacccagacggaaccatggaagccccagctcagcttctcttcctcctgctactctggctccngactaccaggcggagagtagtttgtggttgacacacgttcctccacgcccacccgttgttccttttggtccgtccgggaagaaacgtacgcccctaccctcttcctcggcgtaacgggcctaggtcgaaggtagtttacgttaaaccaacgttacgtttacggccgttacgggtttacccaaacgtaacggtaaaccgtcgggacccgacgggtaccctaccccggacggtccctccctaccgtattacctagttacgtacgtcgtaccgtaactacccgaacggtacggcccgtacgtcggacctacccgtacccgtacgtacccggtaggtttaccgagggttacggacggtacggggtttcgggtacggtacggtaacgtacgtaccgtttaccgtaaccgtttacctacctaacccganacccgtaacccggtacccgtacccgtaacgaccggtaccgtacgggtaacggttaccgtttcgttacggtttaaccgttttaggtttaacgtttccgggtttagttaccggggttaccgttacgtaccgtaaccgggttaccggtcccctttacccgggttaccgttttacccgggtttaacccggtacccgggtaacggggtaacctaacgggttaccgacggttaacgaccgttaccggaacggtaaacccggttaaccggttcgggtacggtacggttaacccgacccgttaaccggtctttccggtttaacgttccctttaacctaccccgg

SEQ ID NO: 278134 - DNA, 808 bp, Homo sapiens
  misc_feature: GYAE6OF02FQJL6.29.35.D02.1.454.CMB.1.raw
tcagatagagtactcacgaccggtgctcgatttagcacacgatagttgggtttgggggaggaactgctcagttaggacccagacggaaccatggaagccccagctcagcttctcttcctcctgctactctggctcccagataccagcggagagattgtgttgacacagtctccagccacctgtctttgtctcgggaagaaagacgccaccctctcctgccagggtccagtaccgagtaggtagttaaaccaacgttacgttggtccctaggtttcccaaacacggtaaaccgtacggccgaacggcctaccccaaggcctcccgtacatacgttatggaagtcgacacgtacccgaacgaccgggcctaacgtcgggtaccaacgtaccccaggaccctaagggttcagggttacggacgtaggggttcgggtacggtcgggtaacctaggtaacctttcgtacgttaccctaccgtaaccgactaccggacgtaccgtacccgtacggaccgggtaccgttacgggaacgttaccgttacgtaccggttaccgttttatttacggtttacgttaccgggtttcggggtaaccgttacggtaccgtaaaccggttccgggtaccccgttacccgggtttaccgttacggttttacgggggaccggttaaccggggaccgtaaaccggtcggttacgggtaacgtaccggtttaacgaacgggttaaccgtaaccggttcgggtaacggtaccgtacggtaacccgtccgttaacgttcgtttaaccggttaccgttacccgttaaccg

SEQ ID NO: 278135 - DNA, 822 bp, Homo sapiens
  misc_feature: GYAE6OF02JGQ1J.29.35.D02.1.454.CMB.1.raw
  modified_base (757)..(757): a, c, t, g, unknown or other
  misc_feature (757)..(757): n is a, c, g, or t
tcagatagagtactcacgaccggtgctcgatttagcacacgatagttgggtttgggggaggaactgctcagttaggacccagacggaaccatggaagccccagctcagcttctcttcctcctgctactctcggctcccagataccagcggagagattgtgttgacacagtctccagccaccctgtctttgtcgtccgggaagaaagcgccctaccctctcctgacgacgggacacgtcgagtacgtacggttaaaccaaccttacgttcggacccgttcggtttaccaaactaaacggtaaacccgttcgggaccctacgggacccttaccccgaaggtccccttacccttaccgtaactttaccgtaaatttacgggaccttacggacctaaccggttaaccccgaaaacggtacccgggggaccctacgttacggggaacccttacccgttcccccggaacgtaccccggttaacgggtttacccgaggggttaccggtcggtaaacggggtttcggggttaccgtacgggggaacctacggtacccgtttaccaaccgtttcccgtaccgaacccgtacgtaccgtaaccggtccccgaacgtacggtaaccggtccgtaagggtaacgttacgttacgttacggttaccgttttacgttacgtttcgttcggttcggacgtacgtacgaaccgttccgtaccgttacccgttcgttcgtttaacggccggttacgggtacgacgtcgtacggntacgtacgaacggtaacgtacgtcgtacgcgctacgtaccagttcgttacttcccgttatacccg

SEQ ID NO: 278136 - DNA, 738 bp, Homo sapiens
  misc_feature: GYAE6OF02GJDPZ.29.35.D02.1.454.CMB.1.raw
tcagatagagtactcacgaccggtgctcgatttagcacacgatagttgggtttgggggaggaactgctcagttaggacccagacggaaccatggaagccccagctcagcttctcttcctcctgctactctggctcccagataccagcggagagattgtgttgacacagtctccagccaccctgtctttgtctccgggagaaagcgccaccctctcctggccgacgggccagtccagagttacgtaacacttacgttcggacctggttccaactaacgaaaccctggccacgggtcctcccgaggccttaccctctacttactagttgattcgacactaccgaaacgacgggaccacgtggaccactcccagtccgacggttcaggtcggacgtacgggtcggggttacgtacggggaacctacggtacctttaccgaacgttccctaccaacccttaagcccgtaaccgtacccgtaccgtaacggacggtcccgttacggtacggttactttaccgttacggttaccgttttaacgtttacgtttcggttacgtttcggggtaccgttacggtaaccgttaaccggtccggtacccgttacccgttacgttaccgttttaccgggaccggttaaccggggtaccgtaacggtcggttagggtacgacgtacggaacgtaaccggtaacgtcggtacgtcgtcgtaccgtaaccgtctcgttcgttacttcctacccg

SEQ ID NO: 278137 - DNA, 678 bp, Homo sapiens
  misc_feature: GYAE6OF02GOE0F.29.35.D02.1.454.CMB.1.raw
  modified_base (621)..(621): a, c, t, g, unknown or other
  misc_feature (621)..(621): n is a, c, g, or t
tcagatagagtactcacgaccggtgctcgatttagcacacgatagttgggtttggggaggaactgctcagttaggacccagacggaaccagtggaagccccagctcagcttctcttcctcctgctactcgtgcctcccagataccgagcggagagattggtgttgacacgagtctccagcccacctgttctttgtcgtccgggaagaaagcgcccaccctctcctgcgcggccagtcagtagttacgtaacaacttcgttggcctcgtaccaacgagtaaccgtggccaggcctcccgaggtctcctcattctagtgtactcgacactaccgaacgacgggccctacgtcggtacacccgtaccgacgtaccgttaggttcgagttcggacgaggtttggtcgtgggaccagtactcgactcctacgactactcgaccgtccgacgtacgtacgacggtcggtaacgttacttcgttcgtttaaccgttttgttacggtttacgttcggttacgggtcgtaccgtacgtaaccgtcccggtccgttacccttcgtttacggtttccgggaccggtaacgggtactaacgtccggagtactacgtcggaagtaccgttacgnggttaaccgtcgtacccgacgttaccgtacgttccgtaacgtttccgactttacccg

SEQ ID NO: 278138 - DNA, 760 bp, Homo sapiens
  misc_feature: GYAE6OF02FX5AQ.29.35.D02.1.454.CMB.1.raw
tcagatagagtactcacgaccggtgctcgatttagcacacgatagttggggtttgggggaggaactgctcagttaggacccagacggaaccatggaagccccagctcagcttctcttcctcctgctactctggctcccagataccagcggagagattgtgttgacacagtctccagcccaccctgtctttgtccgtccgggagaaagcgcccacccttcctcctgcgacgggccagtcagtagtacgttaaacaacttacgttggacccttggttacccaacgacggtaaaacctcgggaccacgggccttaccccgagggtcctcccgtactactccttaagtcgtaatcggactaactcccgaaaccgtacgggaccctacgtcggacctaccgttacccgacgtaccgtacggttccagggtccgacgtaggttcgggtcgtacggggactacggttacctaccgtactaccctaccgaacctactaccgacggtcccgacgtaggaccgtcggtagtacgtactttccgtacggttacccgttttagttagttcggttacgttaggggtaccgttacggtaccttaacccggtcgggtacccccttccggtttaccgttacgttttaccgggaccggttaaccggggaccctaaggttcccggtagggtacgttacctaccggaacggttaacccggtaagttcgggtaacgtcgtaccggacctacgtaccgttactcgttaccgtccttacccg

SEQ ID NO: 278139 - DNA, 874 bp, Homo sapiens
  misc_feature: GYAE6OF02GFA24.29.35.D02.1.454.CMB.1.raw
  modified_base (198)..(198): a, c, t, g, unknown or other
  misc_feature (198)..(198): n is a, c, g, or t
  modified_base (203)..(203): a, c, t, g, unknown or other
  misc_feature (203)..(203): n is a, c, g, or t
tcagatagagtactcacgaccggtgctcgatttagcacacgatagttgggtttgggggaggaactgctcagttaggacccagacggaaccatggaagccccagctcagcttctcttcctcctgctactctggctcccagactaccagcggagagattgtgttgacacagtctccagccacctgtctttgctccggganaaagngccaccctctcctgcgagggcctagtcagagtcgttaaacacttacttgggccttgggttaccaacgaacgaaaacccgtggccgaacgggtccttaccccgagggtcccttccctacgacttcctaatgtaattgacctaactacccgaaacgacggggtaccccaacgtcgggaccaacgttccccgaacgtcccgtaacgggtttccgaagggttcggacccgtaacggggtttggggggttaccgttacggggggaacccctaacggttaacccgttttaccgtaaacccgtttcctaacccccggtaaacccctacgttacccggaaaccggggtcccccgtaacccggtttaaaccgggaaccccgggttcccggttaacgggtaaacggggttaacccttttacccgggttaccggttttaccccggttttttaaagttttaccggtttttacgggtttcccggttttacggggggtaccggtttaaccggtacccgtaaacggttcccgggtaccccgttcccgttaccgtttccggttttacgggacccggtaacggggtaaccgtaacggtcggtacggtagtaccgtacgaaccggtacggttaacgtcggtcgggtcctagtacccgtacgtacgtccggttacttcctacgttacccc

SEQ ID NO: 278140 - DNA, 682 bp, Homo sapiens
  misc_feature: GYAE6OF02IL6PP.29.35.D02.1.454.CMB.1.raw
  modified_base (184)..(184): a, c, t, g, unknown or other
  misc_feature (184)..(184): n is a, c, g, or t
  modified_base (201)..(201): a, c, t, g, unknown or other
  misc_feature (201)..(201): n is a, c, g, or t
tcagatagagtactcacgaccggtgctcgatttagcacacgatagttgggtttgggggaggaactgctcagttaggacccagacggaaccatggaagccccagctcagcttctcttcctcctgctactctggctcccagataccagcggagagattgtgttgacacagtctcagccaccctttnttgctccgggagaaagngccacctctcctgctagggccagtcagagtgttaaacactacgttggcctggttaccaacagtaaacctggaccagggccttcccgaaggtcctccgttcaattctaacgttcgaagtgtcaattcccaaactagttcggcctacgtcgggccaattccccgagacccgtaaggtttcaacggttggaccctaaggtgggttactacggggactaacggtacctttccggtaactccgttacaacccggtattaccgaggaccccgtaccttagggaaccgtcccgtagtaaccgggactttcggaaccgttcggttttaccgttagttaccgttcgttgggtaccgtaaggtctaaccgtgggtacccttccggtccgtaacgttttcgggaccgtaagggacccaagtccgagggtaaccgattacgacgtaacgtacgtggttacggctggactactcggtactcggtactcgtaccg

SEQ ID NO: 278141 - DNA, 944 bp, Homo sapiens
  misc_feature: GYAE6OF02GBVGM.29.35.D02.1.454.CMB.1.raw
tcagatagagtactcacgaccggtgctcgatttagcacacgatagttgggtttgggggaggaactgctcagttaggacccagacggaaccatggaagccccagctcagcttctcttcctcctgctactctggctccagataccagcggagagattgtgttgacacagtctccagccaccctgtctttgtccgtaccgggagaaaagcgaccctaccctcctcccgtacggcgacggggtcccaggttaccaaggtaggttacggttaaaaccaaacttaccgttcgggccctttacgggtttaccccaaaacgtaaccggaaaaccccgttcggggacccctaaacggggtcccttaccccccgaaggggccccttttaccccctactaaacgttccttaagtcggtaaactttcggaccctaaacggttaccccccaaaacgggaaccgggggtacccctaaacccggttcggggtaacctaacccgttcccccgaaacggtccccgtaaacggggttttccgaaacgggttcgggtacccgtaggggtttccgggggttaccggtacggggaacctaacggtacctttaccgaccttaccgttacccaacccgtacgtaccgaccggtacccgtacccgtaacgacggtcccgtaggtaacggtactttacgttcggtttaacccggttttaattttacggtttcggtttaccggtttacggggtacgttaacgggtaccttaaccggttcccgggtaccccgttacccgttccgtttaaccggttttccgggaccccgggtaaacggggtaaccctaacgggttaccgttacgggacttacggtaccgtaacgggtaaaccggtaaccgttacgggtaccggttaccgtacggtaccgtacccggttacgttacccgttcggttacccttacgttaccccg

SEQ ID NO: 278142 - DNA, 670 bp, Homo sapiens
  misc_feature: GYAE6OF02FRLVM.29.35.D02.1.454.CMB.1.raw
  modified_base (266)..(266): a, c, t, g, unknown or other
  misc_feature (266)..(266): n is a, c, g, or t
tcagatagagtactcacgaccggtgctcgatttagcacacgatagttgggtttgggggaggaactgctcagttaggacccagacggaaccatggaagccccagctcagcttctcttcctcctgctactctggctcccagataccagcggagagattgtgttgacacagtctccagccaccctgtctttgtctccgggagaaagcgccaccctctcctgcgacgggccagtccagagtgttaaacaactacgtggcctggttccaanagaaacctggccaggctccaggctccgtcatcctatgatcgcacgtccaacgacgggccacgtggacacgtcccaacgcctacggttacaggtcggcaggtcgggtacgtgggacaacggtacttcaactctaccgaacctacgtcgacgcccgtacctaacggacgaccgtaggacggtaacttccgtacggttacccgttttaatttagtttcgttcgtttacgggtaccgttagaccgtaacgtcggtccccgttccgtccttaaccgttttcgggacccgtaacgggggaacctaacggtccgtaacgggtatacgtaccgtaacggtaaccggtaacggtcggtacggtacgttaccggacctaccgtacgttccgtacgttacccgttcgttaacccg

SEQ ID NO: 278143 - DNA, 908 bp, Homo sapiens
  misc_feature: GYAE6OF02FZZHJ.29.35.D02.1.454.CMB.1.raw
  modified_base (152)..(152): a, c, t, g, unknown or other
  misc_feature (152)..(152): n is a, c, g, or t
  modified_base (320)..(320): a, c, t, g, unknown or other
  misc_feature (320)..(320): n is a, c, g, or t
  modified_base (406)..(406): a, c, t, g, unknown or other
  misc_feature (406)..(406): n is a, c, g, or t
tcagatagagtactcacgaccggtgctcgatttagcacacgatagttgggtttgggggaggaactgctcagttaggacccagacggaaccatggaagccccagctcagtcttctcttcctcctgctactctggcctccagataccagcgganagattgtagttgacactagtctccgacgcctaccctgttctttggtccgtaccgggagaaagcgccacccgtctcctgctaacgggcctagcgtagtacgttagtaaactaacttacgttggacccgtttggtccaaacacggtaaacctcgggaccacgggttaccncccgtagggtccctccttacgtacgttctaacgtcgtaacgtcgactaacccgttaccgaaacgaccgacccgtacgtacggaccncgtaccccgacggtaccgttaggtacctaggtccggtacgtaacggggttcggggttcggtaaccggggtaccttaacgttacccgttaccggacctttacccgtacccgggttaacccaagttcccgggtaccggacccggtacccgtaaacggtccggtaccggttacgttaacgggtacggtttaccggttaccggttttacccgttttacgtttaccggtttacgggttaccgggttttacgggttaccggtacccggttaaccccgtaacggttccccggtcccggtttaaccccttaccgggtttttacccggttttaacggggacccgggttttaaccgggggaacctttaacgggttacccgggtaacgttaccggtacgtttaaacccggaaaacgggttttccccggaaaagggttccgggttaccgggttacccgtaagtccccgttaaccgtaccgttcgttaacccgttttacccggtccccttaccgg

SEQ ID NO: 278144 - DNA, 709 bp, Homo sapiens
  misc_feature: GYAE6OF02IWQAB.29.35.D02.1.454.CMB.1.raw
  modified_base (201)..(201): a, c, t, g, unknown or other
  misc_feature (201)..(201): n is a, c, g, or t
  modified_base (214)..(214): a, c, t, g, unknown or other
  misc_feature (214)..(214): n is a, c, g, or t
  modified_base (234)..(234): a, c, t, g, unknown or other
  misc_feature (234)..(234): n is a, c, g, or t
  modified_base (258)..(258): a, c, t, g, unknown or other
  misc_feature (258)..(258): n is a, c, g, or t
  modified_base (268)..(268): a, c, t, g, unknown or other
  misc_feature (268)..(268): n is a, c, g, or t
  modified_base (284)..(284): a, c, t, g, unknown or other
  misc_feature (284)..(284): n is a, c, g, or t
  modified_base (295)..(295): a, c, t, g, unknown or other
  misc_feature (295)..(295): n is a, c, g, or t
tcagatagagtactcacgaccggtgctcgatttagcacacgatagttgggtttgggggaggaactgctcagttaggacccagacggaaccatggaagccccagctcagcttctcttcctcctgctactctggcctcccagataccagcggagagatttgtgttgactacagtctccagccacctggtcttgctccgggaanaagcgccaccctntccgtgcagggccagtcagntgtaacactactggcctgtaccanagaacgtgcngacctccagctccgtnactctagtcgngtcgctataccaacgacggtccacgcggtctaacctccagtccaaggttccaacggttgccgtaaggttcggtcgtacgggacctagtaccgtttccaacggtcccttaccggaaccaacgttcccgaccggtacccgtacccggttaaggaacgttcccggtaacgtacgggtaaccgttccgttaccggttaccgttttaacgtttaccggtttaggttacccggtttacggggtaaccttacggtacccgtaaacgggtttccgggtaacccccgttacccggtttaccgttaaccgttttcccgggaacccggtaacggggtacctaaacggtcgttacgagtacgtacgtacggaacttaacgtggtacgcgtaccgacgtccggaccttcgtcggtacttacctaccg

SEQ ID NO: 278145 - DNA, 848 bp, Homo sapiens
  misc_feature: GYAE6OF02JVPVI.29.35.D02.1.454.CMB.1.raw
  modified_base (221)..(221): a, c, t, g, unknown or other
  misc_feature (221)..(221): n is a, c, g, or t
  modified_base (368)..(368): a, c, t, g, unknown or other
  misc_feature (368)..(368): n is a, c, g, or t
tcagatagagtactcacgaccggtgctcgatttagcacacgatagttgggtttgggggaggaactgctctagttaggacccagacggaaccatggaagccccagctcagcttctcttcctcctgctactcgtcggcctcccaagatacccgagcggagagtagtttgtgttcggaccaccagttcctccagccctaccttgttctttcgtcctacgggganaaacgcgcctacctctaccgtgaccgacgggcctagtcacggtaagttacgttaaacaacttacgttcgggaccttacggtaccaagtaacgaaacgtcggccgtaaggtcctaccgaggtacctccgtacattcctagtactagtntacacgtaccaacggtcgggtaccacgtacggaccacgtacccgacgtacccgtaggtacctacggtacggtacggtacgttacgggtacgtacgggtaaacgtagtttaaccctacgtaacccttacgtaacccgaaaccgtcgttaacccggaccggtacccgtaaccgtacgggtactaccgggttaacggtacggttactttacggtaccgtttacggttttaactttacggttaacgtttaccgggttccgggtacggttaacgtacccgttaaggttaccccgtcccgtttacccgggtttacgttaacccggttttaccggggtacccggtaaccgggttaaccggttaacgtaccgggtacgtaacggttactaaccgtaagggtaaacccttaggggttaccctacggttaccgtaccgttacccgaccgtttaccgtaaccgggtttccgtttactacccggttaacccg

SEQ ID NO: 278146 - DNA, 597 bp, Homo sapiens
  misc_feature: GYAE6OF02GDV4U.29.35.D02.1.454.CMB.1.raw
  modified_base (306)..(306): a, c, t, g, unknown or other
  misc_feature (306)..(306): n is a, c, g, or t
  modified_base (385)..(385): a, c, t, g, unknown or other
  misc_feature (385)..(385): n is a, c, g, or t
  modified_base (556)..(556): a, c, t, g, unknown or other
  misc_feature (556)..(556): n is a, c, g, or t
  modified_base (566)..(566): a, c, t, g, unknown or other
  misc_feature (566)..(566): n is a, c, g, or t
  modified_base (576)..(576): a, c, t, g, unknown or other
  misc_feature (576)..(576): n is a, c, g, or t
  modified_base (584)..(584): a, c, t, g, unknown or other
  misc_feature (584)..(584): n is a, c, g, or t
tcagatagagtactcacgaccggtgctcgatttagcacacgatagttgggtttgggggaggaactgctcagttaggacccagacggaaccatggaagccccagctcagcttctcttcctcctgctactctggcctcccagataccagcggagagattgtgttgacacagtctccagccaccctgtctctgtctccgggagaaagacgccaccctctcctgcgacgggccagtcagagtactaacaacttacttggcctggttaccaacgaacgaaaccgtggaccaggtcctcccgacgcttcccnctactctatgatgcactaccaacgacggccacgtggaccactcccacgaccgtaggtctaggcgtctagggtggtccgngggactagtaaccttcgacctctaccgaactcgtacaccgtccgtaccgtagacgtccgtagagtcttcgtacgttaccgtttatttacgttcgtttggtcggtagtacgacctaccggtccgtacccgtccgttcgttaccgttcgggacgtacggacctaagcgtaggngctagacgancggtagcgtntcgcgctntcgtcttacgtcg

SEQ ID NO: 278147 - DNA, 750 bp, Homo sapiens
  misc_feature: GYAE6OF02IP65U.29.35.D02.1.454.CMB.1.raw
  modified_base (207)..(207): a, c, t, g, unknown or other
  misc_feature (207)..(207): n is a, c, g, or t
tcagatagagtactcacgaccggtgctcgatttagcacacgatagttggggtttggggggaggaactgctcagttaggacccagacggaaccatggaagccccagctcagcttctcttcctcctgctactctggctccagatacccagcggagagatttggtgttgacacagtctccagcccacctgtctttgctccgggagaaagngcccaccctctcctgcagggcccagtcagagtacgttaacaacgtcttcgggcctcggttacccaaacacgaaacctcggaccacggcctaccccgaggcctcctctacgtctacgtggatgctactaccgaacgacgggtacctaaccgtcggacctaccgtacccacggtccgtacgggtttacaggttacggacgtacggggttgggtcggtacgggaacgtaacgtacttactacgttaccaccgaacctacgtaccgacggtcccgtaccgtaacgggtcgtaccgtgggtaacgtacgtttaccgttcggttaccgtttttagtttagtttcgggtttcggtttacggggtaccgtacggttaccgtacgttaccgggtcccgtttacccgttaccggtttacgtttccggggtaccggtaaccggggtaccggaacgtccgggttggaacgttacgtacgaacggtacgtaacggttgggttcgtacgtaccggtacgtaccgttacgttaccggttacggtttccttcggtaccc

SEQ ID NO: 278148 - DNA, 848 bp, Homo sapiens
  misc_feature: GYAE6OF02JRSXD.29.35.D02.1.454.CMB.1.raw
tcagatagagtactcacgaccggtgctcgatttagcacacgatagttgggtttcgggggaggaactgctcagttaggacccgagacggaaccgatggaagccccagctcagcttctcttcctcctgctactctggcctccagataccagcggagagtagttcgtgttacgaacctacgtagttcctccacgccctaacccgttgttcctttaggtcccgtaccggggaagaaacgacgccctacccttcctcctaggccgacggggacctacgtagaggtacgttacgttaaaccaacttcgttcggtaccgttgtaccgaaacaacgtaaccgtcgccgtaacgcctcccgagtcctccatctctacgtgaacgtgacctaacgtacccgaacggcggaacccctcgcggtaccaccgtaccccgagttccggtaacgttcgtaagggccggtcgtaacggggttcggtaccggtaacgggcctaaccgtttccttaccgtacaccccgttaaccaccgttaacgtccgaaaccggtcccgtaaccggtaacgtacccgggacggtaccggtaaggttaccgtttaccggttacgtttaacccggttttatttaccggttacggtttccggttaccggggtcctaacggttaccgtaccgtttccggtaccccgttcccgtttaccgttcggttacccgggaccgggtaaaccgggtaaccgtacggtaccgttacgggtaagccgttaacggtaacccggttacggtaccggttccggtacggttccgtaccgtaacccgtacggttaaccgttcccggtaccgtttacccgttcccgttaaccgg

SEQ ID NO: 278149 - DNA, 792 bp, Homo sapiens
  misc_feature: GYAE6OF02INS89.29.35.D02.1.454.CMB.1.raw
  modified_base (114)..(114): a, c, t, g, unknown or other
  misc_feature (114)..(114): n is a, c, g, or t
  modified_base (152)..(152): a, c, t, g, unknown or other
  misc_feature (152)..(152): n is a, c, g, or t
  modified_base (247)..(247): a, c, t, g, unknown or other
  misc_feature (247)..(247): n is a, c, g, or t
  modified_base (278)..(278): a, c, t, g, unknown or other
  misc_feature (278)..(278): n is a, c, g, or t
tcagatagagtactcacgaccggtgctcgatttagcacacgatagttgggtttgggggaggaactgctcagttaggacccagacggaaccatggaagccccagctcagcttctnttcctcctgctactctggctccagataccagcggaganattgtgttgacacgagtcctccagcccacctgttactttgccgtccgggaagaaagacgccctaccctgtccctgacagggtccagtcagtagtnttaaacaacttcgttcggccttggtaccaanacgtaaacctggaccaaggcctacccgaggcctacctctaagttcctatcgtagtcgaccgaatacccgaaaggtaccgggcctacgttacgggaccaccgttaccctaccggacctacgggtttaccgaaggggttcggtacgttaacgggggtgggtaccgttacgggggaacttacggtaaacctttcctacgtcccgtaaccacgtacgttacccggacgtaccgtaccgtaagtaccggtaccgtacgggtaacggtttcgttaccggttacgttttaaccggttttacgttacgtttacgggttacgggttaccgggttacggttaaccgtaccgtaaaccggttccggttccccgttacccgtttaccgtttaccggtttaaccgggcccggttaaacgggaccgtaacggtacgtagggtaaccgttacgaacgtaacggtaacggttaccgtgggttaaccggtctaaccgtacctaccttaagttcctacgttctaccgtcccg

SEQ ID NO: 278150 - DNA, 743 bp, Homo sapiens
  misc_feature: GYAE6OF02JXV4X.29.35.D02.1.454.CMB.1.raw
  modified_base (97)..(97): a, c, t, g, unknown or other
  misc_feature (97)..(97): n is a, c, g, or t
tcagatagagtactcacgaccggtgctcgatttagcacacgatagttgggtttgggggaggaactgctcagttaggacccagacggaaccatggaanccccagctcagcttctcttcctcctgctactctggcctaccagataccagcggaagagacttgtgttgacactagtcctccagccctaccccgttgttcgttacgtccggaaggaaacgaacggccctaccctaccgttcctcgacgacggccgagtaccgagagttagttaactaacgtacttcggtcgtacgttaccgtaacaacgtaaccgtaggtccgacggtacctcccgtaacgcgtcctaccgtatcgtaactgtaccgtgacactaccgaacggaaccggccgtatcggaccactacgtaccctaggacgtttacgtacgaggtcgtacgttggggtccgtagaccggtacttctactaccgtaccttcacctaacgtcgtaacccgtccggcctaagcgtactacggtgtaccttacgttcggttacgtttactttaggttcttcgggttacgtacggtaccgtacgttaaccgtacgggttcccttacccggttaccgttccgtttaaccgggtaccggacggggtaaacccgtctacgggtagtacggtctacgggttacgaaccgggtctttagggctaaccggtccgtacgtaccgttacttccgtacgtttacctccggtaccctttacccg

SEQ ID NO: 278151 - DNA, 746 bp, Homo sapiens
  misc_feature: GYAE6OF02IJIWZ.29.35.D02.1.454.CMB.1.raw
  modified_base (203)..(203): a, c, t, g, unknown or other
  misc_feature (203)..(203): n is a, c, g, or t
  modified_base (675)..(675): a, c, t, g, unknown or other
  misc_feature (675)..(675): n is a, c, g, or t
tcagatagagtactcacgaccggtgctcgatttagcacacgatagttgggtttgggggaggaactgctcagttaggacccagacggaaccatggaagccccagctcagcttctcttcctcctgctactctggctcccagataccagcggagagattgtgttgactacagtctccagccacctgtctttgtctcgggagaaagngcccacctctccgtgcacgggccagtcagtacgtagttaaacaacttacgttcggccttggttaccaaacgacgaaacctggccaggcctaccgagcctcctcagtctacgtagactcgacgtaactacccgaaacgtccggggacctacgtcggtacgacctaccccgaggtacccgaggtttaccgaggttccggacgtagggtttacgggtcggttacggggaactcggttaacctttcgaaccgttacctaccgtaacccaacggtttccgaaaccggtccccgtaccgttaaccgaccggttacccgtaagggtaaacggtttccttttaccgggttaaccgttttacccggttttttaagttagtttcggttcgggttacgggtacggtacgtaaccgtaacggtccggttacccttccgttcttaccggtttcggaacccggtagggtaacccaagtccgggtanaggactcggtaaacgtcggtaactagggtcgtacgtacgacgtacttcgttacgtgtttccgtaacttccg

SEQ ID NO: 278152 - DNA, 115 bp, Homo sapiens
  misc_feature: GYAE6OF01B89I6.48.82.H05.1.454.CMB.1.raw
  modified_base (108)..(108): a, c, t, g, unknown or other
  misc_feature (108)..(108): n is a, c, g, or t
  modified_base (114)..(115): a, c, t, g, unknown or other
  misc_feature (114)..(115): n is a, c, g, or t
tcagagtatacatacacgaccggtgctcgatttagtcgagctctctcgcggcacgaccggtgctcgatttagtcgagctctctcgactctgagcgggctggcaaggcncatagnn

SEQ ID NO: 278153 - DNA, 292 bp, Homo sapiens
  misc_feature: GYAE6OF01CT9YE.48.82.H05.1.454.CMB.1.raw
  modified_base (288)..(292): a, c, t, g, unknown or other
  misc_feature (288)..(292): n is a, c, g, or t
tcagagtatacatacacgaccggtgctcgatttagtcgagctctctcgcgggcacgaccggtgctcgatttagtcgagctctctcgcggcacgaccgtgctcgatttagtagcatactgttgggttgggccaagggacaacggtcaccgtctcttcagcctcaccaaggcccatcggtcttcccctggcgccctgctccaggagcacctccgagagcacagcggccctgggctgcctggtcaaggctactcctctctcgactctgagcgggctggcaaggcgcatagnnnnn

SEQ ID NO: 278154 - DNA, 131 bp, Homo sapiens
  misc_feature: GYAE6OF01EPR6K.48.82.H05.1.454.CMB.1.raw
  modified_base (131)..(131): a, c, t, g, unknown or other
  misc_feature (131)..(131): n is a, c, g, or t
tcagagtatacatacacgaccggtgctcgatttagtcgagctctctcgcggcacgaccggtgctcgatttagagctcacgtattgggtttggggtttttaggtatctgagcgggctggcaaggcgcatagn

SEQ ID NO: 278155 - DNA, 519 bp, Homo sapiens
  misc_feature: GYAE6OF01C5WBC.48.82.H05.1.454.CMB.1.raw
  modified_base (223)..(223): a, c, t, g, unknown or other
  misc_feature (223)..(223): n is a, c, g, or t
tcagagtatacatacacgaccggtgctcgatttagtcgagctctctcgcgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccngcagtgatggttggtgttataactatgtctcctggtaccaacagcaccaaggcaaacgcccccaaactcatgatttatgatgtcagtaagcggcctgacggggtccctgactcgcttctctggctccaagtctggacaacgacggccctccctgacctatctcgtcgggctccgaggctgaggatgaggctgattatactgctgctcatatgcaggcagctacgtcgttgggtgttcgggcggagggaccaaggtccgtacggtaccgtcctaaggtcacggcccgtaagggtccc

SEQ ID NO: 278156 - DNA, 311 bp, Homo sapiens
  misc_feature: GYAE6OF01AKLE9.48.82.H05.1.454.CMB.1.raw
  modified_base (293)..(293): a, c, t, g, unknown or other
  misc_feature (293)..(293): n is a, c, g, or t
  modified_base (298)..(311): a, c, t, g, unknown or other
  misc_feature (298)..(311): n is a, c, g, or t
tcagagtatacatacacgaccggtgctcgatttagtcgagctctctcgcgggcacgaccggtgctcgatttagtcgagctctctcgcgggcacgaccgtgctcgatttagtagcatacctgttggggtttcgggccaagggacaaccggtcaccgtcctcttcagcctccaccaaggcccatcggtcttcccctggccgccctgctccaggagccacctccgagacgcacagcggccctgggctgcctggtcaaggactacttcctatgtatactctgagcggctggcaggcncatgnnnnnnnnnnnnnn

SEQ ID NO: 278157 - DNA, 299 bp, Homo sapiens
  misc_feature: GYAE6OF01EOKSH.48.82.H05.1.454.CMB.1.raw
  modified_base (294)..(299): a, c, t, g, unknown or other
  misc_feature (294)..(299): n is a, c, g, or t
tcagagtatacatacacgaccggtgctcgatttagtcgagctctctcgcgggcacgaccggtgctcgatttagtcgagctctctcgcgggcacgaccggtgctcgatttagtagcatactgttgggttgggccaagggacaacggtcaccgtctcttcagcctccaccaagggcccatcggtcttcccctggccgccctgctccaggagcacctccgagagcacagcggccctgggctgcctggtcaaggctacttcctatgtatactctgagcgggctggcaaggcgcatagnnnnnn

SEQ ID NO: 278158 - DNA, 302 bp, Homo sapiens
  misc_feature: GYAE6OF01BP5C3.48.82.H05.1.454.CMB.1.raw
  modified_base (295)..(302): a, c, t, g, unknown or other
  misc_feature (295)..(302): n is a, c, g, or t
tcagagtatacatacacgaccggtgctcgatttagtcgagctctctcgcgggcacgaccggtgctcgatttagtcgagctctctcggcgggcacgaccggtgctcgatttagtagcatactgttgggttgggccaagggacaaccggtcaccgtctcttcagcctccaccaagggcccatcggtcttcccctggcgccctgctccaggagcacctccgagagcacagcggccctgggctgcctggtcaaggctacttcctatgtatactctgagcgggctggcaaggcgcatagnnnnnnnn

SEQ ID NO: 278159 - DNA, 310 bp, Homo sapiens
  misc_feature: GYAE6OF01BSS23.48.82.H05.1.454.CMB.1.raw
  modified_base (201)..(201): a, c, t, g, unknown or other
  misc_feature (201)..(201): n is a, c, g, or t
  modified_base (307)..(310): a, c, t, g, unknown or other
  misc_feature (307)..(310): n is a, c, g, or t
tcagagtatacatacacgaccggtgctcgatttagtcgagctctctcgcgggcacgaccggtgctcgatttagtcgagctctctcggcgggcacgaccggtgctcgatttagagtgagctcggttggggttcgggccaagggacaacggtcaccgtctcttcacgcctccaccgaagggcccagtccggtccttcccccgnggccgccctgcctccgaggacgccaccgtccgagagcacagccggcctgggctgcctggtcaaggctacttctatgtatactctgagcggctggcaaggcgcatgnnnn

SEQ ID NO: 278160 - DNA, 300 bp, Homo sapiens
  misc_feature: GYAE6OF01ELLQF.48.82.H05.1.454.CMB.1.raw
  modified_base (294)..(300): a, c, t, g, unknown or other
  misc_feature (294)..(300): n is a, c, g, or t
tcagagtatacatacacgaccggtgctcgatttagtcgagctctctcgcgggcacgaccggtgctcgatttagtcgagctctctcgcgggcacgaccggtgctcgatttagtagcatactgttgggttgggccaagggacaacggtcaccgtctcttcagcctccaccaagggcccatcggtcttcccctggccgccctgctccaggagcaacctccgagagcacagcggccctgggctgcctggtcaaggctacttcctatgtatactctgagcgggctggcaaggcgcatgnnnnnnn

SEQ ID NO: 278161 - DNA, 264 bp, Homo sapiens
  misc_feature: GYAE6OF01CRZ9P.48.82.H05.1.454.CMB.1.raw
  modified_base (259)..(264): a, c, t, g, unknown or other
  misc_feature (259)..(264): n is a, c, g, or t
tcagagtatacatacacgaccggtgctcgatttagtcgagctctctcgcgggcacgaccggtgctcgatttagtagcatactgttgggtttgaggccaagggacaacggtcaccgtctcttcagcctccaccaagggcccatcggtcttcccctggcgccctgctccaggagcacctccgagagcacagccggccctgggctgcctggtcaaggactacttcctatgtatactctgagcgggctggcaaggcgcatagnnnnnn

SEQ ID NO: 278162 - DNA, 261 bp, Homo sapiens
  misc_feature: GYAE6OF01ATJKK.48.82.H05.1.454.CMB.1.raw
  modified_base (258)..(261): a, c, t, g, unknown or other
  misc_feature (258)..(261): n is a, c, g, or t
tcagagtatacatacacgaccggtgctcgatttagtcgagctctctcgcgggcacgaccggtgctcgatttagtagcatactgttgggtttgggccaagggacaacggtcaccgtctcttcagcctccaccaagggcccatcggtcttcccctggcgccctgctccaggagcacctccgagagcacagcggccctgggctgcctggtcaaggactacttcctatgtatactctgagcgggctgggcaaggcgcatagnnnn

SEQ ID NO: 278163 - DNA, 106 bp, Homo sapiens
  misc_feature: GYAE6OF01BMHAJ.48.82.H05.1.454.CMB.1.raw
tcagagtatacatacacgaccggtgctcgatttagtcgagctctctcgcgggcacgaccggtgctcgatttagtcgagctctcgagcgggctggcaaggcgcatag

SEQ ID NO: 278164 - DNA, 790 bp, Homo sapiens
  misc_feature: GYAE6OF01C9O23.48.82.H05.1.454.CMB.1.raw
  modified_base (223)..(223): a, c, t, g, unknown or other
  misc_feature (223)..(223): n is a, c, g, or t
tcagagtatacatacacgaccggtgctcgatttagtcgagctctctcgcggggggggtctcaggaggcagcgctctcgggacgtctccaccatggcctgggctctgctcctcctcagcctcctcactcagggcacaggatcctgggctcagtctgccctgactcagcctcgctcagtgtccggtctcctggacagtcggtcaccatcgcctgcactggaaccngcagtgatattggtgcttacaactttgtctcctggtaccaacatcaccagcaaacgtccccaaggtcattattatgtatgtcactaagcggcccgtcggggtccctgactcgtcttctcgtcggtcctaccaagtccgtcgggacctaaaccgaccggtccccttccccgtacggaacccctacgtttcccgttccggttcgggggtcccttacccggacgggtccttaacggtaaacgtaacgttaccggaacgggtccgttaggtaactttttaacgttttaaccgttcggttaccgttttacggttttaacctttaacgtttttttacccgtttaaacggttttttttccccgttttttttacggttacccgtttttaaccggggttaaccgttaccgggggttaaaccccggttacgggttaccccgttaaccccggtttacccggttaacgggttacccgtaacccggtaccccccggtaaaccgggtaccccccctaaacccccgtaccgtttaccggttacccttaaccccgttcccgtttccccggtttaacccccccc

SEQ ID NO: 278165 - DNA, 284 bp, Homo sapiens
  misc_feature: GYAE6OF01C7CHZ.48.82.H05.1.454.CMB.1.raw
  modified_base (283)..(284): a, c, t, g, unknown or other
  misc_feature (283)..(284): n is a, c, g, or t
tcagagtatacatacacgaccggtgctcgatttagtcgagctctctcgcgggcacgaccggtgctcgatttagatcgtctgtgttgggtttgggggtgtggtggtctccactcccgccttgacgaggctgattactactgtcagtcttttgataacaacaatcacgtggtcttcggcggagggaccagcctgaccgtcctaggtcagcccaaggctgccccctggtcactctgttcccaccctcctctatgtatactctgagcgggctggcaaggcgcatagnn

SEQ ID NO: 278166 - DNA, 258 bp, Homo sapiens
  misc_feature: GYAE6OF01EZSFW.48.82.H05.1.454.CMB.1.raw
  modified_base (257)..(258): a, c, t, g, unknown or other
  misc_feature (257)..(258): n is a, c, g, or t
tcagagtatacatacacgaccggtgctcgatttagtcgagctctctcgcgggcacgaccggtgctcgatttagtagcatactgttgggtttggggccaagggacaacggtcaccgtctcttcagcctccaccaagggcccatcggtcttcccctggcgccctgctccaggagcacctccgagagcacagcggccctgggctgcctggtcaaggctacttcctatgtatactctgagcgggctggcaaggcgcatagnn

SEQ ID NO: 278167 - DNA, 264 bp, Homo sapiens
  misc_feature: GYAE6OF01C6OPT.48.82.H05.1.454.CMB.1.raw
  modified_base (259)..(264): a, c, t, g, unknown or other
  misc_feature (259)..(264): n is a, c, g, or t
tcagagtatacatacacgaccggtgctcgatttagtcgagctctctcgcgggcacgaccggtgctcgatttagtagcatactgttgggtttggggccaagggacaacggtcaccgtctcttcagcctccaccaagggcccatcggtcttccccctggcgccctgctccaggagcacctccgagagcacagcggccctgggctgcctggtcaaggactacttcctctctcgactctgagcgggctggcaaggcgcatagnnnnnn

SEQ ID NO: 278168 - DNA, 286 bp, Homo sapiens
  misc_feature: GYAE6OF01C63ZF.48.82.H05.1.454.CMB.1.raw
  modified_base (284)..(286): a, c, t, g, unknown or other
  misc_feature (284)..(286): n is a, c, g, or t
tcagagtatacatacacgaccggtgctcgatttagtcgagctctctcgcgggcacgaccggtgctcgatttagatcgtctgtgttgggtttgggggtgtggtggtctccactcccgcttgacgaggctgattactactgtcagtcttttgataacaacaatcacgtggtcttcggcggaggaccagcctgaccgtcctaggtcagcccaaggctcgccccctggtcactctcgttccccgccctcctctatgtatactctgagcgggctggcaaggcgcatagnnn

SEQ ID NO: 278169 - DNA, 335 bp, Homo sapiens
  misc_feature: GYAE6OF01DHKMH.48.82.H05.1.454.CMB.1.raw
  modified_base (319)..(319): a, c, t, g, unknown or other
  misc_feature (319)..(319): n is a, c, g, or t
  modified_base (325)..(335): a, c, t, g, unknown or other
  misc_feature (325)..(335): n is a, c, g, or t
tcagagtatacatacacgaccggtgctcgatttagtcgagctctctcgcgggcacgaccggtgctcgatttagtcgagctctctcgcgggcacgaccggtgctcgatttagtagcatactggttggggtttggggccaagggacaacggtcaccgtctcttcagcctccaccaacgggcccatcggtcttcccctggccgccctgctccaggagccaccgtccgagacgcacaggccggcccgtggggctcggccctgggtaccaaagggaccttaccttcctcctcgtccgacttcgtggagcgggctggcaagggcncatagnnnnnnnnnnn

SEQ ID NO: 278170 - DNA, 148 bp, Homo sapiens
  misc_feature: GYAE6OF01C8MY9.48.82.H05.1.454.CMB.1.raw
  modified_base (145)..(148): a, c, t, g, unknown or other
  misc_feature (145)..(148): n is a, c, g, or t
tcagagtatacatacacgaccggtgctcgatttagtcgagctctctcgcgggcacgaccggtgctcgatttagtcgagctctctcgcgggcacgaccggtgctcgatttagtcgagctctcgagcgggctggcaaggcgcatagnnnn

SEQ ID NO: 278171 - DNA, 312 bp, Homo sapiens
  misc_feature: GYAE6OF01DV2LJ.48.82.H05.1.454.CMB.1.raw
  modified_base (294)..(312): a, c, t, g, unknown or other
  misc_feature (294)..(312): n is a, c, g, or t
tcagagtatacatacacgaccggtgctcgatttagtcgagctctctcgcgggcacgaccggtgctcgatttagatcgtctgtgttgggtttggggggtgtggtggtctccactcccgccttgacgaggctgattactactgtcagtcttttgataacaacaatcacgtggtcttcggcggagggaccagccctgaccgtcctaggtcagcccaaggcctcgcccccctcggtcactctcgttccccaccctcctctatgtatactctgaggcgggctggacaaggcgacatagnnnnnnnnnnnnnnnnnnn

SEQ ID NO: 278172 - DNA, 169 bp, Homo sapiens
  misc_feature: GYAE6OF01ERSY5.48.82.H05.1.454.CMB.1.raw
  modified_base (169)..(169): a, c, t, g, unknown or other
  misc_feature (169)..(169): n is a, c, g, or t
tcagagtatacatacacgaccggtgctcgatttagtcgagctctctcgcgggcacgaccggtgctcgatttagtcgagctctctcgcgggacgaccggtgctcgatttagagctcacgtattgggtttgggggtttttagtatctgagcgggctggcaaggcgcatagn

SEQ ID NO: 278173 - DNA, 299 bp, Homo sapiens
  misc_feature: GYAE6OF01AILVI.48.82.H05.1.454.CMB.1.raw
  modified_base (292)..(299): a, c, t, g, unknown or other
  misc_feature (292)..(299): n is a, c, g, or t
tcagagtatacatacacgaccggtgctcgatttagtcgagctctctcgcgggcacgaccggtgctcgatttagtcgagctctctcgcgggcacgaccggtgctcgatttagtagcatactgttgggtttgggccaagggacaacggtcaccgtctcttcagcctccaccaagggcccatcggtcttcccctggcgccctgctccaggagcacctcgagagcacagcgcctgggctgcctggtcaaggactacttcctatgtatactctgagcgggctggcaaggcgcatagnnnnnnnn

SEQ ID NO: 278174 - DNA, 727 bp, Homo sapiens
  misc_feature: GYAE6OF01DKLIF.48.82.H05.1.454.CMB.1.raw
  modified_base (224)..(224): a, c, t, g, unknown or other
  misc_feature (224)..(224): n is a, c, g, or t
tcagagtatacatacacgaccggtgctcgatttagtcgagctctctcgcggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccngcagtgacgttggtgttataactatgtctcctggtaccaacaacaccaggcaaagccccaaatcatgatttatgatgtcagtaatcggccctcgagggtttctaatcgcttctctggctaccaagtctgctaacacggtccctcccgtcgaacctactaccttcgtacgggccttcccgaagggtacttacgggaacgggtaccggaacgggtcttacggtaatttaacgtttaccgtacggtaccctaacccttactaacttaacgtaacctaaacggacctaaacggaccgtaacgggacctaccgtttaccttacgggttagggtttaaaccggtttccgggggacggggaaacgggggtaaaccctaaaaccggggtacccgttaccgggtaaacccccgggtttacccggttaaacggggtttacccgaaaccggggtaaccccccggtaaaggggtaccccgttccccgggtcccccccccggtttaaaccccgggg

SEQ ID NO: 278175 - DNA, 540 bp, Homo sapiens
  misc_feature: GYAE6OF01CFHMF.48.82.H05.1.454.CMB.1.raw
  modified_base (355)..(355): a, c, t, g, unknown or other
  misc_feature (355)..(355): n is a, c, g, or t
  modified_base (432)..(432): a, c, t, g, unknown or other
  misc_feature (432)..(432): n is a, c, g, or t
  modified_base (496)..(496): a, c, t, g, unknown or other
  misc_feature (496)..(496): n is a, c, g, or t
  modified_base (512)..(512): a, c, t, g, unknown or other
  misc_feature (512)..(512): n is a, c, g, or t
  modified_base (520)..(540): a, c, t, g, unknown or other
  misc_feature (520)..(540): n is a, c, g, or t
tcagagtatacatacacgaccggtgctcgatttagtcgagctctctcgcgggcacgaccggtgctcgatttagtcgagctctctggcgggcacggaccggtgctcgattttagtcgagcttctctcgggtcgggcacggaccggtcgctcggtacttttagcgacgcttcctcgtacgggtccgggacaacgggtacccgttacgcgtccgtacttttaggccgacggccttacgtccgtacggggtccggggacctaaccgggtaccgttcgcgttaccggtacttttaggacgcgtacgttacgtcggtaacggggtccggactacgggtactaccgtcgaccgtctcgtacncggcctcggaccaacggccagtccgctcccgtgccgcctgctccgaggtcaccaacgtcaacgtagtcagcggtccncccgtggcctcggccttagggaccaaacggtctaacctttccgaagttcgaatctcgtggacgnggcgtaggccaggccngactgacnnnnnnnnnnnnnnnnnnnnn

SEQ ID NO: 278176 - DNA, 503 bp, Homo sapiens
  misc_feature: GYAE6OF01CLNIM.48.82.H05.1.454.CMB.1.raw
  modified_base (224)..(224): a, c, t, g, unknown or other
  misc_feature (224)..(224): n is a, c, g, or t
  modified_base (448)..(448): a, c, t, g, unknown or other
  misc_feature (448)..(448): n is a, c, g, or t
  modified_base (493)..(493): a, c, t, g, unknown or other
  misc_feature (493)..(493): n is a, c, g, or t
tcagagtatacatacacgaccggtgctcgatttagtcgagctctctcgcggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccngcagtgacgttggtgttataactatgtctctggtaccaacaacacccaggcaaagcccccaaatcatgatttatgatgtcagtaatcggcctcgagggtttcaatcgcttctctgctcaagtctggcacacggcctcctgaccatctctcgggcctccgaggctggacggacgaggctggatttattactgactacctcaatataacaagtacagcagcactcncgtgtatcggcggaggacagctgccgtccaggtcacgccaaggcncgcccctcgg

SEQ ID NO: 278177 - DNA, 305 bp, Homo sapiens
  misc_feature: GYAE6OF01CCESM.48.82.H05.1.454.CMB.1.raw
  modified_base (209)..(209): a, c, t, g, unknown or other
  misc_feature (209)..(209): n is a, c, g, or t
  modified_base (293)..(293): a, c, t, g, unknown or other
  misc_feature (293)..(293): n is a, c, g, or t
  modified_base (296)..(305): a, c, t, g, unknown or other
  misc_feature (296)..(305): n is a, c, g, or t
tcagagtatacatacacgaccggtgctcgatttagtcgagctctctcgcgggcacgaccggtgctcgatttagtcgagctctctcgcgggcacgaccggtgctcgatttagtagcatactgttgggtttgggccaagggacaaccggtcaccgtctcttcagcctccaccaagggcccatcggtcttcccctggcgccctgctccaggngcacctcgagagcacagccgccctgggctgcctggtcaaggactacttcctatgtatactctgagcgggctggacaaggcgcanagnnnnnnnnnn

SEQ ID NO: 278178 - DNA, 322 bp, Homo sapiens
  misc_feature: GYAE6OF01B7PAX.48.82.H05.1.454.CMB.1.raw
  modified_base (306)..(322): a, c, t, g, unknown or other
  misc_feature (306)..(322): n is a, c, g, or t
tcagagtatacatacacgaccggtgctcgatttagtcgagctctctcgcgggcacgaccggtgctcgatttagtcgagctctctcgcgggcacgaccggtgctcgatttagtagcatactggttgggtttggggccaagggacaaccggtcaccgtctcttcagcctccaccaagggcccatcggtcttccccctggccgccctgctccgaggagcaccgtccgagagcacgagccggccctgggctgcctggtacaaggacctacttccatgtatactctgagcggggctggcaaggcgcatagnnnnnnnnnnnnnnnnn

SEQ ID NO: 278179 - DNA, 555 bp, Homo sapiens
  misc_feature: GYAE6OF01DKFT7.48.82.H05.1.454.CMB.1.raw
  modified_base (72)..(72): a, c, t, g, unknown or other
  misc_feature (72)..(72): n is a, c, g, or t
  modified_base (448)..(448): a, c, t, g, unknown or other
  misc_feature (448)..(448): n is a, c, g, or t
  modified_base (452)..(452): a, c, t, g, unknown or other
  misc_feature (452)..(452): n is a, c, g, or t
tcagagtatacatacacgaccggtgctcgatttagtcgagctctctcgcggggggggtctcaggaggcagcnctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacggttggtaggttataactatgtctcctggtaaccaacaaccacccaggacaaacgacccccaaactcatgatttatgatgtcagtaatccggcctcgtaggggtttctaaatcgtcttctctgctacagtctgacaacacggcctcctcgacatctcgtggcctccgaggctagaggacgacggctgtattattactgcactacatatacaagcancganacactcgttcgtgttacgtcgggacggacggaccgaagccgtcggtacccgtaccgtaggttaccgaccgacccgaacggccgtaccggtccccgttacccgg

SEQ ID NO: 278180 - DNA, 265 bp, Homo sapiens
  misc_feature: GYAE6OF01B0JA2.48.82.H05.1.454.CMB.1.raw
  modified_base (259)..(265): a, c, t, g, unknown or other
  misc_feature (259)..(265): n is a, c, g, or t
tcagagtatacatacacgaccggtgctcgatttagtcgagctctctcgcgggcacgaccggtgctcgatttagtagcatactgttgggtttggggccaagggacaacggtcaccgtctcttcagcctccaccaagggcccatcggtcttccccctggcgccctgctccaggagcacctccgagagcacagcggccctgggctgcctggtcaaggactacttcctatgtatactctgagcgggctggcaaggcgcatagnnnnnnn

SEQ ID NO: 278181 - DNA, 167 bp, Homo sapiens
  misc_feature: GYAE6OF01DZO68.48.82.H05.1.454.CMB.1.raw
  modified_base (164)..(167): a, c, t, g, unknown or other
  misc_feature (164)..(167): n is a, c, g, or t
tcagagtatacatacacgaccggtgctcgatttagtcgagctctctcgcgggcacgacgctcgtttagtcgagctctctcgcgggcacgaccggtgctcgatttagagctcacgtattgggtttgggggtttttagatctgagcgggctggcaaggcgcatagnnnn

SEQ ID NO: 278182 - DNA, 322 bp, Homo sapiens
  misc_feature: GYAE6OF01BL09Y.48.82.H05.1.454.CMB.1.raw
  modified_base (305)..(322): a, c, t, g, unknown or other
  misc_feature (305)..(322): n is a, c, g, or t
tcagagtatacatacacgaccggtgctcgatttagtcgagctctctcgcgggcacgaccggtgctcgatttagtcgagctctctcggcgggcacggaccggtgctcgatttagtagcatactgttggggttcgggccaagggacaaccggtcaccgtctctcagcctccaccaacgggcccatcggtctcccctggcgccctgctccgaggagcaccgtccgagagcacagccggccctgggcctggcctgggtcaaggctacttcctatgtatactctggagcgggctggcaaggccgcatagnnnnnnnnnnnnnnnnnn

SEQ ID NO: 278183 - DNA, 700 bp, Homo sapiens
  misc_feature: GYAE6OF01ER0L1.48.82.H05.1.454.CMB.1.raw
tcagagtatacatacacgaccggtgctcgatttagtcgagctctctcgcggggggggtctcaggaggcagcgctctcgggacgtctccaccatggcctgggctctgctattcctcaccctcctcactcgagggcacagggtcctcgggcccagtctcgccctgactcagcctgcctccgtgtctgggtctctggacagtcgatcaccatcctcctgcactcggaaccagcgagtcggtacgttgggttagtttaataactattcggtccttccgtacggtaaccaaacaaccacccgaggaccaaacgccccctaaatcatagtaacttatgtagtcgtacacgttacgtccggacccttggttacgggtttactacgtccggttacttctcgtcggtacctaccgtaacgtcgtacgaccgaacccgtccggtcccctcctaacggtacctacgttcctccgggttcgggacccttacccggacgggtaccgtcggggtaaaccgggacgtacgggtaccgttagtaacttttcttaacccgtacggtccctaacccgtacttaacctaactaacgaacaccgtacgcctaaagtcctacgtacgtcggtagtacggttcgggaccggacggtaaccgtacggtgtacccggtacgtccgtagcccgaccgacggaacggtcctcccgtcccggtaccg

SEQ ID NO: 278184 - DNA, 656 bp, Homo sapiens
  misc_feature: GYAE6OF01EULXX.48.82.H05.1.454.CMB.1.raw
tcagagtatacatacacgaccggtgctcgatttagtcgagctctctcgcggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtgttaataactatgtctcctggtaccaacaacaccaggacaaacgcccccaaactcatgtatttatgtatgtcaagtaactccggtccctcgtagggtttctaagtcgtcttctctcggctaccgaagtctggaccaacgaccggtccctccctcgacctactctcgtcgggccttaccgaggtcgtacgggaacggacggaggtactaggtaatttacgttaacgtcgacctaccctacaattaactaacgaacgtacacgactaacgacctacgttccgttacggttacggttacggttaccggggacgggtaaccggggtaaccaacggtcccggttaccggacccggttacccgtaacgggacccgtaaccggaccccgtaacgggtccccttacccggccccccggttacccgg

SEQ ID NO: 278185 - DNA, 804 bp, Homo sapiens
  misc_feature: GYAE6OF01DSBXY.48.82.H05.1.454.CMB.1.raw
tcagagtatacatacacgaccggtgctcgatttagtcgagctctctcgcggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctctgcactggaaccagcagtgacgttggtgttataactatgtctctgtaccaacaacaccaggacaaacgaccccaaactcatgtaatttactgtatcgtacaagttaacgtccggtacccgtacgtaggggtttactaacgtcgtcttctcgtcggtacctaccgtaacgttcgttacggacctaaccgtaacccgggtccccttaccccgtacggtaaccctacgttacccgttccggttcggggtacccttacccggaacgggtaccgttacggggaacgggacggtaacgggtaccgttaggttaacgttttaacgtttaaccgttacgtaccgtaacccctttactaactttaaacctaaccgtaaaacgtaccgaacggacctaacgtacccgttaaccgtttaccgttaccgggtttaagggtttaccggttaccggggtacccgggggtaacggggtaaacccggtaaaccggtacccgggttaacccgggttaaccccggttaaccccgggttaaccgggttacccgaacccgggtaacccccggtaacgggtacccccggtccccggtccccccggttaccccggg

SEQ ID NO: 278186 - DNA, 302 bp, Homo sapiens
  misc_feature: GYAE6OF01D82WJ.48.82.H05.1.454.CMB.1.raw
  modified_base (188)..(188): a, c, t, g, unknown or other
  misc_feature (188)..(188): n is a, c, g, or t
  modified_base (277)..(277): a, c, t, g, unknown or other
  misc_feature (277)..(277): n is a, c, g, or t
  modified_base (294)..(302): a, c, t, g, unknown or other
  misc_feature (294)..(302): n is a, c, g, or t
tcagagtatacatacacgaccggtgctcgatttagtcgagctctctcgcgggcacgaccggtgctcgatttagtcgagctctctcgcgggcacgaccggtgctcgatttagtagcatactgttgggttgggccaagggacaacggtcaccgtctcttcagcctccaccaaggcccatcgtcttccccnggcgccctgctcaggagcacctcgagagcacagcggccctgggctgccgtggtacaaggacttacttcctatgtatactctgagcgggntggacaaggcgcatagnnnnnnnnn

SEQ ID NO: 278187 - DNA, 727 bp, Homo sapiens
  misc_feature: GYAE6OF01BLNN0.48.82.H05.1.454.CMB.1.raw
  modified_base (229)..(229): a, c, t, g, unknown or other
  misc_feature (229)..(229): n is a, c, g, or t
  modified_base (258)..(258): a, c, t, g, unknown or other
  misc_feature (258)..(258): n is a, c, g, or t
tcagagtatacatacacgaccggtgctcgatttagtcgagctctctcgcggggggggtctcaggaggcagcgctctcgggacgtctccaccatggcctgggctctgctattcctcaccctcctcactcagggcacgagggtcctgggcccagtctcgccctgactcagcctgcctccgtgtcgtggtctccgtggacagtcgatcaccatctcctgccacgtggaaccngcctagtgacgtttggtagttaataactntgtctccgtggtaaccaaccaacacccgaggaccaaaccgacccccaaactcatgtaatttatagatgtacaagtaacgtccggtaccctcggtagggtttactaacttcgtcttactcgtggtacctaccgtaagtcctcggtaccaacgcccggtacccttccctacggaccctacttccgtccggttggcctcccgaggtccgtaggaacgggaccggtaggtcttaagtactttaacgttaccgcgacccttaccgtactaattaacgtaacgtaacggactaacggtactaacgtcccgttacttcggttaccgggttaacggttacgggttacccggggacggggtaaaccggtaacccgacggttacccgttaacccgggtacccggttaccccgtaagggtaaccccgtaccgggtaacccgtaaccgggtccccttccccgggtcccccggttaccccgg

SEQ ID NO: 278188 - DNA, 303 bp, Homo sapiens
  misc_feature: GYAE6OF01ERZKW.48.82.H05.1.454.CMB.1.raw
  modified_base (195)..(195): a, c, t, g, unknown or other
  misc_feature (195)..(195): n is a, c, g, or t
  modified_base (265)..(265): a, c, t, g, unknown or other
  misc_feature (265)..(265): n is a, c, g, or t
  modified_base (294)..(303): a, c, t, g, unknown or other
  misc_feature (294)..(303): n is a, c, g, or t
tcagagtatacatacacgaccggtgctcgatttagtcgagctctctcgcgggcacgaccggtgctcgatttagtcgagctctctcgcgggcacgaccggtgctcgatttagtagcatactgtgggttgggccaagggacaacggtcaccgtctcttcagcctccaccaagggcccatcggtcctccccctggccnccctgctccaggagccacctcgagagcacagccggccctgggctgcctgggtcaaggctacttcatgtanactctgagcgggctggcaaggcgcatagnnnnnnnnnn

SEQ ID NO: 278189 - DNA, 604 bp, Homo sapiens
  misc_feature: GYAE6OF01EGGY1.48.82.H05.1.454.CMB.1.raw
  modified_base (175)..(175): a, c, t, g, unknown or other
  misc_feature (175)..(175): n is a, c, g, or t
  modified_base (220)..(220): a, c, t, g, unknown or other
  misc_feature (220)..(220): n is a, c, g, or t
  modified_base (227)..(227): a, c, t, g, unknown or other
  misc_feature (227)..(227): n is a, c, g, or t
  modified_base (297)..(297): a, c, t, g, unknown or other
  misc_feature (297)..(297): n is a, c, g, or t
tcagagtatacatacacgaccggtgctcgatttagtcgagctctctcgcggggggggtctcaggagcagcgctctcgggactctccaccatggcctggctctgctattcctcaccctcctcactcgagggcacagggtcctgggcccagtctgccctgactcagcctgcctcgtntctgggtctctggacagtcgatcacatcgtctgcacgtggaaccngcaggtntacggttggtagttataactatgtctctgtaccaacaacaccgagacaacgcccaaactcagtgactttnagatgtcaagtatcgtctctagggtttactaaagtctcttcgtacgtcggtcctacctaaggtctacggactaaccgtaacggccctaccgtacgtaacccattcccgtactacgggtcctacccggaacgtcgtaacggaacgaccggacggtctaggtaactttaacttaacgtcgtaccacctcgtaattaacgtaacgtaaacgacaacgtacgacgtaccaacgttcgtacgtaggtacgttcggacgggtacggactaagtcgacgtacgtccgtagcgtacgccgagtcgtcgccctcgg

SEQ ID NO: 278190 - DNA, 312 bp, Homo sapiens
  misc_feature: GYAE6OF01D8UEI.48.82.H05.1.454.CMB.1.raw
  modified_base (78)..(78): a, c, t, g, unknown or other
  misc_feature (78)..(78): n is a, c, g, or t
  modified_base (204)..(204): a, c, t, g, unknown or other
  misc_feature (204)..(204): n is a, c, g, or t
  modified_base (222)..(222): a, c, t, g, unknown or other
  misc_feature (222)..(222): n is a, c, g, or t
  modified_base (232)..(232): a, c, t, g, unknown or other
  misc_feature (232)..(232): n is a, c, g, or t
  modified_base (237)..(237): a, c, t, g, unknown or other
  misc_feature (237)..(237): n is a, c, g, or t
  modified_base (280)..(280): a, c, t, g, unknown or other
  misc_feature (280)..(280): n is a, c, g, or t
  modified_base (298)..(298): a, c, t, g, unknown or other
  misc_feature (298)..(298): n is a, c, g, or t
  modified_base (303)..(312): a, c, t, g, unknown or other
  misc_feature (303)..(312): n is a, c, g, or t
tcagagtatacatacacgaccggtgctcgatttagtcgagctctctcgcgggcacgaccggtgctcgatttagtcganctctctcggcgggcacgaccggtgctcgtatttagtagcatactggttggggttcgggccaagggacctaaccggtcaccgtcctcttcacgcctccaccaacgggcccagtcggtccttccccgnggccgccctgctccaggngcacctcgangcacngcgcctgggctgcctggacaaggtctacttccatgtatactcngagcggctggacaaggcnatagnnnnnnnnnn

SEQ ID NO: 278191 - DNA, 716 bp, Homo sapiens
  misc_feature: GYAE6OF01B5R4P.48.82.H05.1.454.CMB.1.raw
tcagagtatacatacacgaccggtgctcgatttagtcgagctctctcgcggggggggtctcaggaggcagcgctctcgggacgtctccaccatggcctgggctctgctattcctcaccctcctcactcagggcacgagggtcctgggcccagtctgccctgactcagcctgcctccgtgtcgtggtcctctggacagtcgatccaccatcctcctgcacgtcggaaccagcagtgtacggttggtagttatactatcgtactccgtcggtaacccaaacaacctacccgaacggccgaacggaccccccaaactacgactacgtattttatggtatcgttacaagttacgtcccggtcccttcggtaacggggtttactaagtccgttctttactccgttcggtccctaccgtaacgttccgttacggaaccgtaaaccggtaccggtacccccgttacccgtaccggtaaccctaaccgtttcccggttccggttccgggggtaacccctccggacggggtcgtacggggaacgggtacggacggtcgtaggttaacgttttacttagtaccgtaccgtaacccgtataactaactaacgaacgtacgacacgacactactccggttagtcggtaggttccgggaggaaccgggaccacggcctcggtacccgtacgtagtacccgacgtaccgagtcccgtccgtcccgtcccg

SEQ ID NO: 278192 - DNA, 832 bp, Homo sapiens
  misc_feature: GYAE6OF01DV9GW.48.82.H05.1.454.CMB.1.raw
  modified_base (231)..(231): a, c, t, g, unknown or other
  misc_feature (231)..(231): n is a, c, g, or t
  modified_base (278)..(278): a, c, t, g, unknown or other
  misc_feature (278)..(278): n is a, c, g, or t
tcagagtatacatacacgaccggtgctcgatttagtcgagctctctcgcggggggggtctcaggaggcagcgctctcgggacgtctccaccatggcctgggctctgctattcctcaccctcctcactcagggcacgagggtcctgggcccagtctgccctgactcagcctgcctccgtgtctgggtctcctggacagtcgatcaccatcctcctgaccacgtacggaaccngtactaggttcgtacggtttgggttaggtttaacttaaacgtagttnttacccttccgttacggtaaaccccaaaccaaaccacccgaacggaccaaaacccgtacccccaaaactctaacgttagttaactttagtagtacgttcgttacgtaacggttaacgtcccggtaccccttacgggttacggggttttacctaaacgttcgtaccgtttcctacgtccggtacctaccggtaacgttccgtacggacctaaaacccgtcccggtccccttaccccgtacgtaaccctaacgttccgtcccggtccggtcccgtaccggacgtcggtacgggaaacgggaccggtacggtacgttagttaacttttacttacggtacctaccttaaccctactaacttaaccgtaactaaccggtaacgaccggtaactccggtaaccttcccgttaaccgggttcggttacggttaccgggttacggggaaccgggtaacgggtaaccgtaaccgtaccgggtaccgtaacccggttacggtacccggtaccgtaacccggtacccggaaacggtcccccgtacccggtcccccgttacccggg

SEQ ID NO: 278193 - DNA, 736 bp, Homo sapiens
  misc_feature: GYAE6OF01DLKKC.48.82.H05.1.454.CMB.1.raw
  modified_base (510)..(510): a, c, t, g, unknown or other
  misc_feature (510)..(510): n is a, c, g, or t
  modified_base (525)..(525): a, c, t, g, unknown or other
  misc_feature (525)..(525): n is a, c, g, or t
  modified_base (542)..(542): a, c, t, g, unknown or other
  misc_feature (542)..(542): n is a, c, g, or t
  modified_base (554)..(554): a, c, t, g, unknown or other
  misc_feature (554)..(554): n is a, c, g, or t
  modified_base (578)..(578): a, c, t, g, unknown or other
  misc_feature (578)..(578): n is a, c, g, or t
  modified_base (580)..(580): a, c, t, g, unknown or other
  misc_feature (580)..(580): n is a, c, g, or t
  modified_base (587)..(587): a, c, t, g, unknown or other
  misc_feature (587)..(587): n is a, c, g, or t
  modified_base (591)..(591): a, c, t, g, unknown or other
  misc_feature (591)..(591): n is a, c, g, or t
  modified_base (596)..(597): a, c, t, g, unknown or other
  misc_feature (596)..(597): n is a, c, g, or t
  modified_base (615)..(615): a, c, t, g, unknown or other
  misc_feature (615)..(615): n is a, c, g, or t
  modified_base (617)..(617): a, c, t, g, unknown or other
  misc_feature (617)..(617): n is a, c, g, or t
  modified_base (628)..(628): a, c, t, g, unknown or other
  misc_feature (628)..(628): n is a, c, g, or t
  modified_base (630)..(630): a, c, t, g, unknown or other
  misc_feature (630)..(630): n is a, c, g, or t
tcagagtatacatacacgaccggtgctcgatttagtcgagctctctcgcgggcaacgaccggtgctcgattttagtcgagctctctcggcgggcacgaccggtgctcgatttagtagcattactggttaggggtttcgggcaagggacaaaccggtcaccgtctcttcacgcctaccaaccgaacgggcccaagttccgggttcctttaccccccgtgggcccgcccttggcccttacccggaaggggtaccgccaaccccgttaccgggaaagtacggaccaaaccgaacggggtccccgggacccccggttaagggggcccgttacggtcccccggttacggggtttaacccggaaaaacgggggttaacccctttaaaccggttttaccccttaagttacggttaaactttaccggttacggggaaaccgggtccggggttaaccgttaggggaaccccggtaaaaaggggccccggaaaattaaccggttaaagggctagaacggntaggccagaatttgnggaaccctttgaccaanagacactagtanatatagacacgagatacgagagananatgaganaganactannacgacgtacacagtatangngtacgtcgtanantagatactagaacgagagtagtagctagtactcgactacgtacagtaaggagtaacgtacgtaacgtacgaagtgtacgtacgaacggtaacgacgtgtcgtaacg

SEQ ID NO: 278194 - DNA, 132 bp, Homo sapiens
  misc_feature: GYAE6OF02HQYSI.48.82.H05.1.454.CMB.1.raw
  modified_base (132)..(132): a, c, t, g, unknown or other
  misc_feature (132)..(132): n is a, c, g, or t
tcagagtatacatacacgaccggtgctcgatttagtcgagctctctcgcgggcacgaccggtgctcgatttagagtgagctcgttgggtttggggtttttaggtatctgagcgggctggcaaggcgcatagn

SEQ ID NO: 278195 - DNA, 261 bp, Homo sapiens
  misc_feature: GYAE6OF02F6EMF.48.82.H05.1.454.CMB.1.raw
  modified_base (259)..(261): a, c, t, g, unknown or other
  misc_feature (259)..(261): n is a, c, g, or t
tcagagtatacatacacgaccggtgctcgatttagtcgagctctctcgcgggcacgaccggtgctcgatttagtagcatactgttgggtttggggccaagggacaacggtcaccgtctcttcagcctccaccaagggcccatcggtcttccccctggcgccctgctccaggagcacctccgagagcacagcggccctgggctgcctggtcaaggactacttcctatgtatactctgagcgggctggcaaggcgcatagnnn

SEQ ID NO: 278196 - DNA, 260 bp, Homo sapiens
  misc_feature: GYAE6OF02F8ITS.48.82.H05.1.454.CMB.1.raw
  modified_base (257)..(260): a, c, t, g, unknown or other
  misc_feature (257)..(260): n is a, c, g, or t
tcagagtatacatacacgaccggtgctcgatttagtcgagctctctcgcgggcacgaccggtgctcgatttagtagcatactgttgggtttgggccaagggacaacggtcaccgtctcttcagcctccaccaagggcccatcggtcttcccctggcgccctgctccaggagcacctccgagagcacagcggccctgggctgcctggtcaaggactacttcctatgtatactctgagcgggctggcaaggcgcatagnnnn

SEQ ID NO: 278197 - DNA, 166 bp, Homo sapiens
  misc_feature: GYAE6OF02HBPFI.48.82.H05.1.454.CMB.1.raw
  modified_base (166)..(166): a, c, t, g, unknown or other
  misc_feature (166)..(166): n is a, c, g, or t
tcagagtatacatacacgaccggtgctcgatttagtcgagctctctcgcgggcacgaccggtgctcgatttagtcacgcgagaaagggaaagggggctggccctgacgtgtttctgttcccgccctcctctatgtatactctgagcgggctggcaaggcgcatagn

SEQ ID NO: 278198 - DNA, 263 bp, Homo sapiens
  misc_feature: GYAE6OF02IMGMA.48.82.H05.1.454.CMB.1.raw
  modified_base (260)..(263): a, c, t, g, unknown or other
  misc_feature (260)..(263): n is a, c, g, or t
tcagagtatacatacacgaccggtgctcgatttagtcgagctctctcgcgggcacgaccggtgctcgatttagtagcatactgttgggtttgggccgaagggacaacggtcaccgtctcttcagcctccaccaagggcccatcggtcttccccctggccgccctgctccaggagcacctccgagagcacagcggccctgggctgcctggtcaaggactacttcctatgtatactctgagcgggctggcaaggcgcatagnnnn

SEQ ID NO: 278199 - DNA, 232 bp, Homo sapiens
  misc_feature: GYAE6OF02FIG4V.48.82.H05.1.454.CMB.1.raw
  modified_base (220)..(232): a, c, t, g, unknown or other
  misc_feature (220)..(232): n is a, c, g, or t
tcagagtatacatacacgaccggtgctcgatttagtcgagctctctcgcggcacgaccggtgctcgatttagtcgagctctctcgcggcacgaccggtgctcgatttagtcgagctctctcgcggcacgaccggtgctcgatttagcgagctctctcgcggcacgaccggtgctcgatttagcgagctctctcgctctgagcggctggcaaggcgcatgnnnnnnnnnnnnn

SEQ ID NO: 278200 - DNA, 284 bp, Homo sapiens
  misc_feature: GYAE6OF02GYBSR.48.82.H05.1.454.CMB.1.raw
  modified_base (283)..(284): a, c, t, g, unknown or other
  misc_feature (283)..(284): n is a, c, g, or t
tcagagtatacatacacgaccggtgctcgatttagtcgagctctctcgcgggcacgaccggtgctcgatttagacgcgatcgaagggtttgggggtgtggtggtctccactcccgccttgacgaggctgattactactgtcagtcttttgataacaacaatcacgtggtcttcggcggagggaccagcctgaccgtcctaggtcagcccaaggctgccccctcggtcactctgttcccaccctcctctatgtatactctgagcgggctggcaaggcgcatagnn

SEQ ID NO: 278201 - DNA, 269 bp, Homo sapiens
  misc_feature: GYAE6OF02F9OQQ.48.82.H05.1.454.CMB.1.raw
  modified_base (262)..(269): a, c, t, g, unknown or other
  misc_feature (262)..(269): n is a, c, g, or t
tcagagtatacatacacgaccggtgctcgatttagtcgagctctctcgcgggcacgaccggtgctcgatttagtagcatactgttgggtttggggccaagggacaacggtcaccgtctcttcagcctccaccaagggcccatcggtcttccccctggcgccctgctccaggagcacctccgagagcacagcggccctgggctgccgtggtacaaggactacttcctatgtatactctgagcggctggacgaaggcgcatagnnnnnnnn

SEQ ID NO: 278202 - DNA, 298 bp, Homo sapiens
  misc_feature: GYAE6OF02G6XQ8.48.82.H05.1.454.CMB.1.raw
  modified_base (294)..(298): a, c, t, g, unknown or other
  misc_feature (294)..(298): n is a, c, g, or t
tcagagtatacatacacgaccggtgctcgatttagtcgagctctctcgcgggcacgaccggtgctcgatttagtcgagctctctcgcgggcacgaccggtgctcgatttagtagcatactgttgggtttgggccaagggacaacggtcaccgtctcttcagcctccaccaagggcccatcggtcttcccctggcgccctgctccaggagcacctccgagagcacagcggccctgggctgcctggtcaaggctacttcctctctcgactctgagcgggctggcaaggcgcatagnnnnn

SEQ ID NO: 278203 - DNA, 262 bp, Homo sapiens
  misc_feature: GYAE6OF02FWJNY.48.82.H05.1.454.CMB.1.raw
  modified_base (257)..(262): a, c, t, g, unknown or other
  misc_feature (257)..(262): n is a, c, g, or t
tcagagtatacatacacgaccggtgctcgatttagtcgagctctctcgcgggcacgaccggtgctcgatttagtagcatactgttgggtttgggccaagggacaacggtcaccgtctcttcagcctccaccaagggcccatcggtcttcccctggcgccctgctccaggagcacctccgagagcacagcggccctgggctgcctggtcaaggactacttcctatgtatactctgagcgggctggcaaggcgcatagnnnnnn

SEQ ID NO: 278204 - DNA, 504 bp, Homo sapiens
  misc_feature: GYAE6OF02G2C2H.48.82.H05.1.454.CMB.1.raw
  modified_base (459)..(459): a, c, t, g, unknown or other
  misc_feature (459)..(459): n is a, c, g, or t
tcagagtatacatacacgaccggtgctcgatttagtcgagctctctcgcggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtgttataactatgtctcctggtaccaacaacacccaggcaaacgcccccaaactcatgatttatgatgtcagtaatcggccctcgagggtttctaatcgcttctctggctcaagtctgcaacacggcctccctgaccatctctgggcctccgaggctgaggacgaggctgtattattactgccacctcatatacaagcagcagcactctcgtgtacttcggnggacggacagctgaccgtctaggcacgccgaagctcgcccctcgg

SEQ ID NO: 278205 - DNA, 519 bp, Homo sapiens
  misc_feature: GYAE6OF02G4NJN.48.82.H05.1.454.CMB.1.raw
  modified_base (425)..(425): a, c, t, g, unknown or other
  misc_feature (425)..(425): n is a, c, g, or t
tcagagtatacatacacgaccggtgctcgatttagtcgagctctctcgcggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacaacaccaggcaaacgcccccaaactcatgatttatgatgtcagtaactcgcctcgtagggtttctaatcgcttctctgctcagtctgacacacgcctcctgacctatctcgtcgggcctcgaggctggacggacgaggctagatttattacttcacctnatatacaagcagcagcactcgtcgtgtacgttcggacggacggaccagcgtcgaccgtacgtacggtcacgaccgagtcctcgtccccgtgtcc

SEQ ID NO: 278206 - DNA, 259 bp, Homo sapiens
  misc_feature: GYAE6OF02GE2J2.48.82.H05.1.454.CMB.1.raw
  modified_base (259)..(259): a, c, t, g, unknown or other
  misc_feature (259)..(259): n is a, c, g, or t
tcagagtatacatacacgaccggtgctcgatttagtcgagctctctcgcgggcacgaccggtgctcgatttagtagcatactgttgggtttggggccaagggacaacggtcaccgtctcttcagcctccaccaagggcccatcggtcttccccctggcgccctgctccaggagcacctccgagagcacagcggccctgggctgcctggtcaaggactacttcctatgtatactctgagcgggctggcaaggcgcatagn

SEQ ID NO: 278207 - DNA, 347 bp, Homo sapiens
  misc_feature: GYAE6OF02GD8ID.48.82.H05.1.454.CMB.1.raw
  modified_base (305)..(309): a, c, t, g, unknown or other
  misc_feature (305)..(309): n is a, c, g, or t
  modified_base (311)..(311): a, c, t, g, unknown or other
  misc_feature (311)..(311): n is a, c, g, or t
  modified_base (313)..(347): a, c, t, g, unknown or other
  misc_feature (313)..(347): n is a, c, g, or t
tcagagtatacatacacgaccggtgctcgatttagtcgagctctctcgcgggggcacgaccggtgctcgatttagtcgagctctctcgcgggcacgaccggtgctcgatttagtagcatactgttcgggtttcgggccaagggacaacggtcaccgtctcttcacgcctccaccgaagggcccatcggtcttccccctggccgccctgctccaggagccaccgtccgagagcacagcggccctgggctgcctggtacaaggctacttcctatgtatactctgagcgggctggcaaggcgcatagnnnnncntnnnnnnnnnnnnnnnnnnnnnnnnnnnnnnnnnnn

SEQ ID NO: 278208 - DNA, 502 bp, Homo sapiens
  misc_feature: GYAE6OF02I8GFW.48.82.H05.1.454.CMB.1.raw
  modified_base (249)..(249): a, c, t, g, unknown or other
  misc_feature (249)..(249): n is a, c, g, or t
  modified_base (373)..(373): a, c, t, g, unknown or other
  misc_feature (373)..(373): n is a, c, g, or t
tcagagtatacatacacgaccggtgctcgatttagtcgagctctctcgcggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactntgtctcctggtaccaacaacacccaggcaaacgcccccaaactcatgatttatgatgtcagtaactcggcctcgtaggggtttctaatcgcttctctgctcagtctgcacacgcctcctgaccntctctggctcaggctgaggacgaggctgattattactgcactcatatacagcagcagcactcgtcgtggtacttcgggcggaggaccaagctacgaccgtcgtaggcacgccgaggcctcgcccctcgg

SEQ ID NO: 278209 - DNA, 262 bp, Homo sapiens
  misc_feature: GYAE6OF02I3D2W.48.82.H05.1.454.CMB.1.raw
  modified_base (257)..(262): a, c, t, g, unknown or other
  misc_feature (257)..(262): n is a, c, g, or t
tcagagtatacatacacgaccggtgctcgatttagtcgagctctctcgcgggcacgaccggtgctcgatttagtagcatactgttgggtttgggccaagggacaacggtcaccgtctcttcagcctccaccaaggcccatcggtcttccccctggcgccctgctccaggagcacctccgagagcacagcggccctgggctgcctggtcaaggactacttcctatgtatactctgagcgggctggcaaggcgcatagnnnnnn

SEQ ID NO: 278210 - DNA, 800 bp, Homo sapiens
  misc_feature: GYAE6OF02J1KE1.48.82.H05.1.454.CMB.1.raw
tcagagtatacatacacgaccggtgctcgatttagtcgagctctctcgcgggggggtctcaggaggcagcgctctcgggacgtctccaccatggcctgggctctgctattcctcaccctcctcactcagggcacagggtcctgggcccagtctgccctgactcagcctgcctccgtgtctgggtctccgtggacagtcgatcaccatctcctgcactggaaccagcagtgacgttggtgttataactatgtctcctggtaccaacaacaccaggcaaacgcccccaaactcactgattatgtatgtactagtaagtccggtccctacgtaggggttttacctaagttccgtcttctcgttcgggtacctaccgtaacgttccgtacggacctaacgtaccggtccccttcccgtacggtaacccacgtttccttccggtacggggtcccttacccggaacgggtccctaggggaaccgggtaccggacgggttaccttagggtacttttaagtttaacccgagttcccgtaacccttaccgtaattaacgttaacccgtaaacggacccgtaaacggtcccaaacggtacccttaacccgtttcccggtttacgggttaaccgggttttacggggttaccccggggtacggggaaccgggggtttaaacccccgaaacgggttaccggttacccgggggttaacccccgtttaaccgggttaacccgggttacggtaaacccccgggtccccggtaaaacggggtcccttaccccgggtacccccccgggtttacccggg

SEQ ID NO: 278211 - DNA, 549 bp, Homo sapiens
  misc_feature: GYAE6OF02G2U87.48.82.H05.1.454.CMB.1.raw
  modified_base (223)..(223): a, c, t, g, unknown or other
  misc_feature (223)..(223): n is a, c, g, or t
  modified_base (376)..(376): a, c, t, g, unknown or other
  misc_feature (376)..(376): n is a, c, g, or t
  modified_base (415)..(415): a, c, t, g, unknown or other
  misc_feature (415)..(415): n is a, c, g, or t
  modified_base (441)..(441): a, c, t, g, unknown or other
  misc_feature (441)..(441): n is a, c, g, or t
tcagagtatacatacacgaccggtgctcgatttagtcgagctctctcgcggggggggtctcaggaggcagcgctctcgggacgtctccaccatggcctgggctctgctattcctcaccctctcactcaggcacagggtcctgggcccagtctgccctgactcagcctgcctccgtgtctgggtctcctggacagtcgatccaccatctcctgcactggaaccngcagtgacgttggtgttataactatgtctcctggtaccaacaacacccaggcaaacgcccccaaactcatgatttatgatgtcagtaatccggcctcgtaggggtttctaatcgcttctctggctcaagtctggacaacgacggccctcccgngacctactctcgtgggcctccgaggtctaggacggacgnggctagtatttattacgtgacacctnatactacaagcagcagctacttctcggtgttagtcggagggtacggaccacggactcggaccgttaccgtaggtccacggacccgtacggcctccgcccccgttacgg

SEQ ID NO: 278212 - DNA, 639 bp, Homo sapiens
  misc_feature: GYAE6OF02H3DXQ.48.82.H05.1.454.CMB.1.raw
  modified_base (196)..(196): a, c, t, g, unknown or other
  misc_feature (196)..(196): n is a, c, g, or t
  modified_base (228)..(228): a, c, t, g, unknown or other
  misc_feature (228)..(228): n is a, c, g, or t
  modified_base (256)..(256): a, c, t, g, unknown or other
  misc_feature (256)..(256): n is a, c, g, or t
  modified_base (329)..(329): a, c, t, g, unknown or other
  misc_feature (329)..(329): n is a, c, g, or t
  modified_base (424)..(424): a, c, t, g, unknown or other
  misc_feature (424)..(424): n is a, c, g, or t
tcagagtatacatacacgaccggtgctcgattttagtcgagctctctcgcggggggggtcggtcaggaggcagcgctctcgggacgtctccaccatggcctgggctctgctattcctcaccctcctcactcaggcacagggtcctgggcccagtctgccctgactcagcctgcctcgtgtctgggtctcctggacngtcgatcacatcctcctgctacgtcggaaccnggaccagtcgtacggttggtggtttaanaacgttatgtctccgtcggtaaccaaccaactacccaggccaaacgcccccaaactcaatacgtaattttagngatcgtacgtaagtaacgtcccgaccttcggtaggttttacagttccgtacttcgtcgtcgactcagttccgtagactaacccgcgtccctaccncgacctctttccgcgtcggcctccgaggtcgtaggacgtagtcggagtcttagttaatttactcgtcgcttcgactcaagttcgacgcgtaagcttaacgtcgttaaaccggtcggttacggggtcgttacggacgggtaccggtacgtacgccgttacggacccgttcggtaaggtccaccgggtcctaaggttccctacccggcccctttcgg

SEQ ID NO: 278213 - DNA, 302 bp, Homo sapiens
  misc_feature: GYAE6OF02JB8CM.48.82.H05.1.454.CMB.1.raw
  modified_base (295)..(302): a, c, t, g, unknown or other
  misc_feature (295)..(302): n is a, c, g, or t
tcagagtatacatacacgaccggtgctcgatttagtcgagctctctcgcgggcacgaccggtgctcgatttagtcgagctctctcgcgggcacgaccggtgctcgatttagtagcatactgttgggtttgggccaagggacaacggtcaccgtctcttcagcctccaccaagggcccatcggtcttccccctggcgccctgctccaggagcacctccgagagcacagcggccctgggctgcctggtcaaggctacttcctatgtatactctgagcgggctggcaaggcgcatagnnnnnnnn

SEQ ID NO: 278214 - DNA, 699 bp, Homo sapiens
  misc_feature: GYAE6OF02G2ARW.48.82.H05.1.454.CMB.1.raw
  modified_base (194)..(194): a, c, t, g, unknown or other
  misc_feature (194)..(194): n is a, c, g, or t
  modified_base (229)..(229): a, c, t, g, unknown or other
  misc_feature (229)..(229): n is a, c, g, or t
tcagagtatacatacacgaccggtgctcgatttagtcgagctctctcgcgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacngtcgatccactatcctctgactacgtacggaaccngcgagtgtacggttggttagttaataactgtgtcctcgtacggtaaccaacaaccaccgagacaaccgacccctaactcatgtatttagtagtatcgtacgaagtaacgtcccggtccctacgggttacgggtttactaacgtccgttctttccgtacgtcggtcctacgtaacgttcgtacggaccaaccggaccggtccccttcccgtacgtaaccctacgtttcctcgggttccggtccctaccggtaggtccgtagggacggtacggacggtcgttagttaatttacgttacgtcgtacctacctataatactaacgtaacgacgacgacgacgaccgtcttaccggtacggttaggtacggttccggggacgggtacggaaccgtaacggtccgtaccggtacccgttaccggttaagtcccggaccgtacccggacggtcccgtaccccggtccccgttaccgg

SEQ ID NO: 278215 - DNA, 304 bp, Homo sapiens
  misc_feature: GYAE6OF02FGYS9.48.82.H05.1.454.CMB.1.raw
  modified_base (297)..(304): a, c, t, g, unknown or other
  misc_feature (297)..(304): n is a, c, g, or t
tcagagtatacatacacgaccggtgctcgatttagtcgagctctctcgcgggcacgaccggtgctcgatttagtcgagctctctcgcgggcacgaccggtgctcgatttagtagcatactgttgggtttggggccaagggacaacggtcaccgtctcttcagcctccaccaagggcccatcggtcttccccctggcgccctgctccaggagcacctccgagagcacagcggccctgggctgcctggtcaaggactacttcctatgtatactctgagcgggctggcaaggcgcatagnnnnnnnn

SEQ ID NO: 278216 - DNA, 546 bp, Homo sapiens
  misc_feature: GYAE6OF02GOS4O.48.82.H05.1.454.CMB.1.raw
  modified_base (244)..(244): a, c, t, g, unknown or other
  misc_feature (244)..(244): n is a, c, g, or t
  modified_base (302)..(302): a, c, t, g, unknown or other
  misc_feature (302)..(302): n is a, c, g, or t
tcagagtatacatacacgaccggtgctcgatttagtcgagctctctcgcggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttanaactatgtctcctggtaccaacaacacccaggcaaacgcccccaaactcatgatttangagatcactaagcggccctcaggtcgtttctaatcgcttctctggctccaagtctggcaacacggcctcctgacaatctctggctccaggctgagacgaggctgattattattgctgctcatatgcgtaggttggtacttacgttggggtgttcggcgtaggacgggaaccgaaggtcgtacggtacccgtaccgttaggtaccgacggacccaacgggtcctccggccccccgttacggtccc

SEQ ID NO: 278217 - DNA, 464 bp, Homo sapiens
  misc_feature: GYAE6OF02I52U6.48.82.H05.1.454.CMB.1.raw
  modified_base (258)..(258): a, c, t, g, unknown or other
  misc_feature (258)..(258): n is a, c, g, or t
  modified_base (417)..(417): a, c, t, g, unknown or other
  misc_feature (417)..(417): n is a, c, g, or t
  modified_base (428)..(428): a, c, t, g, unknown or other
  misc_feature (428)..(428): n is a, c, g, or t
  modified_base (434)..(464): a, c, t, g, unknown or other
  misc_feature (434)..(464): n is a, c, g, or t
tcagagtatacatacacgaccggtgctcgatttagtcgagctctctcgcgggcacgaccggtgctcgatttagtcgagctctctcgcgggcacgaccggtgctcgatttagtcgagctctctcgcggcacggaccggtgctcgatttacgtgtcgagtagtcccgcggggcacgaccgggtcgctcgatttagctgcgtcacgatctctcttcgggcccagcctcctgtcccacacccgcggtcaccgatggccaccncctctcttcgccagccctccaccaaggcccgatcgtcttccccctgtccgtaccctcctccaaggtagaccgaccgtccgtacgggggtccacgacgccggtccctgggcctgccgtggtacaaggacctaccttacctctcgtcgactctgagcgggntcggcaaggcncatagnnnnnnnnnnnnnnnnnnnnnnnnnnnnnnn

SEQ ID NO: 278218 - DNA, 304 bp, Homo sapiens
  misc_feature: GYAE6OF02H1DZ0.48.82.H05.1.454.CMB.1.raw
  modified_base (193)..(193): a, c, t, g, unknown or other
  misc_feature (193)..(193): n is a, c, g, or t
  modified_base (298)..(304): a, c, t, g, unknown or other
  misc_feature (298)..(304): n is a, c, g, or t
tcagagtatacatacacgaccggtgctcgatttagtcgagctctctcgcgggcacgaccggtgctcgatttagtcgagctctctcggcgggcacgaccggtgctcgatttagtagcatactgttgggtttgggccaagggacaacggtcaccgtctcttcagcctccaccaagggcccatcggtccttccccnggccgccctgctccaggagcacctccgagacgcacagcgccctgggctgcctggtcaaggctacttcctatgtatactctgagcgggctggacaaggcgcatagnnnnnnn

SEQ ID NO: 278219 - DNA, 314 bp, Homo sapiens
  misc_feature: GYAE6OF02HGOKJ.48.82.H05.1.454.CMB.1.raw
  modified_base (198)..(198): a, c, t, g, unknown or other
  misc_feature (198)..(198): n is a, c, g, or t
  modified_base (215)..(215): a, c, t, g, unknown or other
  misc_feature (215)..(215): n is a, c, g, or t
  modified_base (230)..(230): a, c, t, g, unknown or other
  misc_feature (230)..(230): n is a, c, g, or t
  modified_base (249)..(249): a, c, t, g, unknown or other
  misc_feature (249)..(249): n is a, c, g, or t
  modified_base (273)..(273): a, c, t, g, unknown or other
  misc_feature (273)..(273): n is a, c, g, or t
  modified_base (277)..(277): a, c, t, g, unknown or other
  misc_feature (277)..(277): n is a, c, g, or t
  modified_base (299)..(299): a, c, t, g, unknown or other
  misc_feature (299)..(299): n is a, c, g, or t
  modified_base (301)..(301): a, c, t, g, unknown or other
  misc_feature (301)..(301): n is a, c, g, or t
  modified_base (303)..(314): a, c, t, g, unknown or other
  misc_feature (303)..(314): n is a, c, g, or t
tcagagtatacatacacgaccggtgctcgatttagtcgagctctctcgcgggcacgaccggtgctcgatttagtcgagctctctcggcgggcacggaccggtagctcgatttagtagcatactgttgggttcgggaccaagggacaaccggtcaccgtcctctcagcctccaccaacgggcccatcggtccttccccnggccgccctgcctccgnggagcaacctccgangcacagccggccctgggcngcctggcaaggctactctatgtanactntgagcggatggacaaggcgtanangnnnnnnnnnnnn

SEQ ID NO: 278220 - DNA, 230 bp, Homo sapiens
  misc_feature: GYAE6OF02GJ7CV.48.82.H05.1.454.CMB.1.raw
  modified_base (225)..(230): a, c, t, g, unknown or other
  misc_feature (225)..(230): n is a, c, g, or t
tcagagtatacatacacgaccggtgctcgatttagtcgagctctctcgcgggcacgaccggtgctcgatttagcgagacgcgcagggcacgaccggtgctcgatttagtatctgatagttgggttgggaccaaggtggaagtcaaacgaactgtggctgcaccatctgtcttcatcttcccgcatctgatatgtatactctgagcgggctggcaaggcgcatagnnnnnn

SEQ ID NO: 278221 - DNA, 303 bp, Homo sapiens
  misc_feature: GYAE6OF02GR8K8.48.82.H05.1.454.CMB.1.raw
  modified_base (296)..(303): a, c, t, g, unknown or other
  misc_feature (296)..(303): n is a, c, g, or t
tcagagtatacatacacgaccggtgctcgatttagtcgagctctctcgcgggcacgaccggtgctcgatttagtcgagctctctcgcgggcacgaccggtgctcgatttagtagcatactgttgggtttggggccaagggacaaccggtcaccgtctcttcagcctccaccaagggcccatcggtcttcccctggcgccctgctccaggagcacctccgagagcacagcggccctgggctgcctggtcaaggctacttcctatgtatactctgagcgggctggcaaggcgcatagnnnnnnnn

SEQ ID NO: 278222 - DNA, 285 bp, Homo sapiens
  misc_feature: GYAE6OF02FIZIG.48.82.H05.1.454.CMB.1.raw
  modified_base (271)..(285): a, c, t, g, unknown or other
  misc_feature (271)..(285): n is a, c, g, or t
tcagagtatacatacacgaccggtgctcgatttagtcgagctctctcgcgggcacgaccggtgctcgatttagtagcatactgttgggtttggggccaagggacaacggtcaccgtctcttcagcctccaccaagggcccatcggtcttccccctggcgccctgctccaggagcacctccgagagcacagcggcccctgggctcgccgtggtacgaaggacttaccttcctctcctcgactctgacggcgggctggacgaaggcacatagnnnnnnnnnnnnnnn

SEQ ID NO: 278223 - DNA, 308 bp, Homo sapiens
  misc_feature: GYAE6OF02FUCPQ.48.82.H05.1.454.CMB.1.raw
  modified_base (263)..(263): a, c, t, g, unknown or other
  misc_feature (263)..(263): n is a, c, g, or t
  modified_base (290)..(290): a, c, t, g, unknown or other
  misc_feature (290)..(290): n is a, c, g, or t
  modified_base (295)..(308): a, c, t, g, unknown or other
  misc_feature (295)..(308): n is a, c, g, or t
tcagagtatacatacacgaccggtgctcgatttagtcgagctctctcgcgggcacgaccggtgctcgatttagtcgagctctctcgcgggcacgaccggtgctcgatttagtagcatactgttagggtttcgggccaagggacaaccggtcaccgtctcttcagccgtccaccaagggcccatcggtcttcccctggcgccctgctccaggagcacgtccgagagcacagcggccctgggctgcctggtcaaggctactctcnctcgactctgagcggctggcaaggcgnatagnnnnnnnnnnnnnn

SEQ ID NO: 278224 - DNA, 665 bp, Homo sapiens
  misc_feature: GYAE6OF02HOMOV.48.82.H05.1.454.CMB.1.raw
  modified_base (247)..(247): a, c, t, g, unknown or other
  misc_feature (247)..(247): n is a, c, g, or t
tcagagtatacatacacgaccggtgctcgatttagtcgagctctctcgcggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctctgcactggaaccagcagtgacgttggtagttatactntgtctctgtaccaacaacaccaggacaacgccccaaactcatgtactttatgtatgtactagtaatccggtccctcgtagggtttctaacgtccgtcttctcgtcgctacctaagtcgtggaccaaccgaccggtccctaccctcgaccctacttccgtacgtcgggtccctccggaaggcgtacggacgggtacgacgggtctagtactttaacttaccgtcgtaccctaaccctactaacttaactaacgaacgtacaacgtacacgtacctaaccttcgttacggttacggttacgtttaccgggacgggtaacggtaacccgtaaggtcccgttaacggtaaccccggttaccgtacgggtaccgtaaccggaccccgtaacggtcccgttaccccggtcccccgttaacccgg

SEQ ID NO: 278225 - DNA, 673 bp, Homo sapiens
  misc_feature: GYAE6OF02HETMO.48.82.H05.1.454.CMB.1.raw
  modified_base (271)..(271): a, c, t, g, unknown or other
  misc_feature (271)..(271): n is a, c, g, or t
tcagagtatacatacacgaccggtgctcgatttagtcgagctctctcgcgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcacgtggaaccagcagtcgacgtttggtacgttataacgtatcgtctctggtaccaacngcaccaggcaaacgcccccaaagtcatcgtatttactgaggtcaagtaacgcggccctcgtacggggtccctagactccggtcttccgtcgtcggacctccgaaggttccgtacggacgaaacgaccgtccctacccgtcgaccgtcgtcgtacgggtcctccgaggtccttaggaacggtacgtacggtaacggtctaggtaacttttacgttaaccgtcgacgtaactccgttacagttaacgtcgacgacggaccacggtaaccaacgtaagtcgggttagtacgttcggggaacgggacgggtaaccgtaaacggtccgtaacgggttaccccgttaccggttacgggtaccgtaacccggtaccccggaaacgggtcccgtacccggtccccccggg

SEQ ID NO: 278226 - DNA, 286 bp, Homo sapiens
  misc_feature: GYAE6OF02H2T2R.48.82.H05.1.454.CMB.1.raw
  modified_base (285)..(286): a, c, t, g, unknown or other
  misc_feature (285)..(286): n is a, c, g, or t
tcagagtatacatacacgaccggtgctcgatttagtcgagctctctcgcgggcacgaccggtgctcgatttagacgcgatcgaagggtttggggggtgtggtggtctccactcccgccttgacgaggctgattactactgtcagtcttttgataacaacaatcacgtggtcttcggcggagggaccagcctgaccgtcctaggtcagcccaaggctcgccccctcggtcactctgttcccgccctcctctatgtatactctgagcgggctggcaaggcgcatagnn

SEQ ID NO: 278227 - DNA, 303 bp, Homo sapiens
  misc_feature: GYAE6OF02F4F01.48.82.H05.1.454.CMB.1.raw
  modified_base (222)..(222): a, c, t, g, unknown or other
  misc_feature (222)..(222): n is a, c, g, or t
  modified_base (292)..(292): a, c, t, g, unknown or other
  misc_feature (292)..(292): n is a, c, g, or t
  modified_base (297)..(303): a, c, t, g, unknown or other
  misc_feature (297)..(303): n is a, c, g, or t
tcagagtatacatacacgaccggtgctcgatttagtcgagctctctcgcgggcacgaccggtgctcgatttagtcgagctctctcgcgggcacgaccggtgctcgatttagtagcatactgttgggtttggggccaagggacaacggtcaccgtctcttcagcctccaccaagggcccatcggtcttcccctggccgccctgctccaggagcacctccgagngcacagccggccctgggctggcctggcaaggctactcctatgtatactcgtgagcgggctggcaaggcgnatagnnnnnnn

SEQ ID NO: 278228 - DNA, 605 bp, Homo sapiens
  misc_feature: GYAE6OF02HXT7B.48.82.H05.1.454.CMB.1.raw
  modified_base (224)..(224): a, c, t, g, unknown or other
  misc_feature (224)..(224): n is a, c, g, or t
tcagagtatacatacacgaccggtgctcgatttagtcgagctctctcgcggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccngcagtgacgttggtgttataactatgtctcctgtaccaacaacaccaggacaaacgcccccaaactcatgtatttatgatgtctagtaactccggccctcgtagggtttactaagtcgtcttctctcggtctaccgtaagtcgtacggacaaccgccggtccctcccgtacgacctactctcgtcggcctccgaggcgtggacggacgagctagtaacttattacgtcgactacctatactaacacaacgacacgaccacgacctacgttccgtcggttaggttacgtccgggtacgggaacggaccgaacgtccgtaccggacccgttaccgtacggtcgaccggtacccgtaacggtcccgtacccggtccccgtccgg

SEQ ID NO: 278229 - DNA, 754 bp, Homo sapiens
  misc_feature: GYAE6OF02GCRC6.48.82.H05.1.454.CMB.1.raw
  modified_base (224)..(224): a, c, t, g, unknown or other
  misc_feature (224)..(224): n is a, c, g, or t
  modified_base (248)..(248): a, c, t, g, unknown or other
  misc_feature (248)..(248): n is a, c, g, or t
  modified_base (266)..(266): a, c, t, g, unknown or other
  misc_feature (266)..(266): n is a, c, g, or t
  modified_base (300)..(300): a, c, t, g, unknown or other
  misc_feature (300)..(300): n is a, c, g, or t
tcagagtatacatacacgaccggtgctcgatttagtcgagctctctcgcggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccngcagtgacgttggtgttataactntgtctcctggtaccaacngcaccaggcaaacgcccccaaagtcatgatttangaggtcagtaagccggccctcgacggggtccctgatcgtctttctcgtcggcctaccgaaggttctcgggtacaaaccgaccggtccccttcccgtacggtacccgtttccgtacggtcggggtccctaccgagggtccgtagggagggtacgtacgggaacgggtccgtaggttaacgttttaacgttaaccgttcggtacgtacggtaccttacgtaatttaacggtaccggtaccggagggttaccgaacggtaaccgtaaaacgtaacggtttacgggttaacggggtttaaccggtttaccggggggaaccgggtaaaccggggtaacccgtaaaccgggttccgggttaacccggtaacccgggtttacccggttaacgggttccccggaaacccggttaccccggtaaaccgggttcccccgttaccccggggttaaccccccccgg

SEQ ID NO: 278230 - DNA, 106 bp, Homo sapiens
  misc_feature: GYAE6OF02I644Y.48.82.H05.1.454.CMB.1.raw
  modified_base (106)..(106): a, c, t, g, unknown or other
  misc_feature (106)..(106): n is a, c, g, or t
tcagagtatacatacacgaccggtgctcgatttagtcgagctctctcgcgggcacgaccggtgctcgatttagtcgagctctctgcgggctggcaaggcgcatagn

SEQ ID NO: 278231 - DNA, 674 bp, Homo sapiens
  misc_feature: GYAE6OF02FQKFR.48.82.H05.1.454.CMB.1.raw
  modified_base (195)..(195): a, c, t, g, unknown or other
  misc_feature (195)..(195): n is a, c, g, or t
tcagagtatacatacacgaccggtgctcgatttagtcgagctctctcgcggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacngtcgatcaccattcctccgtgcacgtcggaaccagctaggtgtacggttgggtagttaataactatgtcctccgtaggtaccaacaaccacccaggaccaaaccgacccccaactcatgtatttagtagatgtactaagttaacgtccggccctacgttacggggtttactaagtccgtcttctcgtcggtcctaccgaaggttctaggaccaaccggaccggtcccttaccctacgtacctacgttccgtacgtccgggtcctccggtacgtctagggtacggacggacggtcgtagtacgtttaacttacgtgtaccctactactataacgaacacgactacgtacgacgtacctacgtccgttacggttgtaccgtacgggtacgggaacggtaccgtaacggtaccgtaccggtaacccgttaccgttacggaccgccggtaaccggtacggcccttcccggtccccgttaccgg

SEQ ID NO: 278232 - DNA, 730 bp, Homo sapiens
  misc_feature: GYAE6OF02IEAFV.48.82.H05.1.454.CMB.1.raw
  modified_base (192)..(192): a, c, t, g, unknown or other
  misc_feature (192)..(192): n is a, c, g, or t
  modified_base (211)..(211): a, c, t, g, unknown or other
  misc_feature (211)..(211): n is a, c, g, or t
  modified_base (218)..(218): a, c, t, g, unknown or other
  misc_feature (218)..(218): n is a, c, g, or t
  modified_base (549)..(549): a, c, t, g, unknown or other
  misc_feature (549)..(549): n is a, c, g, or t
tcagagtatacatacacgaccggtgctcgatttagtcgagctctctcgcggggggggtctcgaggaggcagcgctctcgggacgtctccaccatggcctgggctctgctattcctcaccctctcactcagggacacgaggtcctgggcccagtctcgccctgactcagtcctgccgtcgtgtcgtgggtccnccgtggactggtcatcacntcctccngctacgtacgaacctgcagtcgtcggttgtagttataactgtcgtctcgtacgtaacacaaccaccgaggaacaacccgaccctaactctactagtactttagagtacgtagactaacgtacggtccgtccgtaggttacgggtttacacggttctcttctacgtcgtctacgtacgtggtcgacaaccgtcgtccctaccgtacacctcgtccgttgccggttacccaaggtcggacgtgggaaccgggagtacggtacgtagtttacttaaccggttcttacgggacccttacgtaaccttataccgggtaactaaccgagtaacccgnggtaaccttacccgtaccgtttccggttacgggttcgttaaccggggttacccgggaaccggttaccgggtaaccgtcccgttaacggtcccgtaacccggttacggttaaccccgggttcgaacccggggtaaccgtaacccgggtcccggtttaccccgttcccgggtttaacccccgg

SEQ ID NO: 278233 - DNA, 718 bp, Homo sapiens
  misc_feature: GYAE6OF02HCJCG.48.82.H05.1.454.CMB.1.raw
  modified_base (280)..(280): a, c, t, g, unknown or other
  misc_feature (280)..(280): n is a, c, g, or t
  modified_base (571)..(571): a, c, t, g, unknown or other
  misc_feature (571)..(571): n is a, c, g, or t
tcagagtatacatacacgaccggtgctcgatttagtcgagctctctcgcgggggggtctcaggaggcagcgctcgtcgggacgtctccaccatggcctgggctctgctattcctcaccctctcactcagggcacgtagggtcctgggcccagtcgtcgccctgactcacgtcctcgccctcgtagtcgtgggtctaccgtggacacggttcgatcaccattcctcctgctaccgtaggaacctagctaacgtgtaccggttggtaggttaactaaacgtnttcgtacctccgtacggtaaccaacgaacaccgtaaggaccaaaccgtacccccaaactcgaatacgtactttaagcgtatcgataagtactccggtccttacggttagggtttactaacgttcgcttacgtactcgggactacgtaagttccgtggaacctaacgtcccgtccttaccgtacgaccgtactccgttacggcggtccgtacggacgcgttaggacggaggcgtgtacgttattaacgtctacgacctaccgtataacgtactaaccgtaacgccgttaacncgtaacggtcctaccgtttccggtacgttacgggtaccgttacggaccggggtacgtaacccggtagtaccggtacccgttaaccggtacggttacggtaccgtaacccgaccggttaaccggccgtttccccgacccgggtttccg

SEQ ID NO: 278234 - DNA, 260 bp, Homo sapiens
  misc_feature: GYAE6OF02H4EI8.48.82.H05.1.454.CMB.1.raw
  modified_base (204)..(260): a, c, t, g, unknown or other
  misc_feature (204)..(260): n is a, c, g, or t
tcagagtatacatacacgaccggtgctcgatttagtcgagctctctcgcggggggggtctcaggaggcagcgctctcgggacgtctccaccatggcctgggctctgctattcctcaccctcctcactcagggcacgagggtcctgggcccagtctgccctgactcagcctgcctcgtgtcgtgggtctccgtaggacctaggtnnnnnnnnnnnnnnnnnnnnnnnnnnnnnnnnnnnnnnnnnnnnnnnnnnnnnnnnn

SEQ ID NO: 278235 - DNA, 714 bp, Homo sapiens
  misc_feature: GYAE6OF02IXEKS.48.82.H05.1.454.CMB.1.raw
  modified_base (319)..(319): a, c, t, g, unknown or other
  misc_feature (319)..(319): n is a, c, g, or t
tcagagtatacatacacgaccggtgctcgatttagtcgagctctctcgcggggggggtctcaggaggcagcgctctcgggacgtctccaccatggcctgggctctgctattcctcaccctcctcactcagggcacagggtcctgggccaggtctgccctgactcagcctgcctccgtgtctgggtctcctggacagtcgatccacatctcctgcactggaaccagcaggtgacgttggtaggttatactagtagtctcctaggtacccaaacgaacctacccgaggaccaaacgcccccaaatccatggtattttaagngtattgtacgaggtaactccggtacctcgtaggggtttctaactcgtctttcgtcgtagtcttaccgagtcgtacgggactaacgacgggcccttccctagacctacgttccgtcggtacgggtccttaccggacgggcttagggaaccgggttacgggaacgtccgggttaataaccgtttaacgttaccggtacgtaccctaccttactaaactttaactaaccgaacggtacctaaggccgtaaacgccttaaccgttccggttcggttaaagggttaccgtttccggggacggggtaacgggaaccgtaagaccgtttccgggacccgtttaccggtacggtacgtaccggtaccccggtaagggtccctcccggtacccccgttaccggg

SEQ ID NO: 278236 - DNA, 297 bp, Homo sapiens
  misc_feature: GYAE6OF02IJTHU.48.82.H05.1.454.CMB.1.raw
  modified_base (267)..(267): a, c, t, g, unknown or other
  misc_feature (267)..(267): n is a, c, g, or t
  modified_base (273)..(273): a, c, t, g, unknown or other
  misc_feature (273)..(273): n is a, c, g, or t
  modified_base (275)..(278): a, c, t, g, unknown or other
  misc_feature (275)..(278): n is a, c, g, or t
  modified_base (280)..(297): a, c, t, g, unknown or other
  misc_feature (280)..(297): n is a, c, g, or t
tcagagtatacatacacgaccggtgctcgatttagtcgagctctctcgcgggcacgaccggtgctcgatttagtagcatactgttgggtttgggccaagggacaaggtcaccgtctcttcagcctccaccaagggcccatcggtcttccccctggcgccctgctccaggagcacctccgagacgcacagccggccctggggctgcctggtacaaggaccttacgttccctatgtatactcttgaggtcgggctggcctaagggccgnaactgnannnncnnnnnnnnnnnnnnnnnn

SEQ ID NO: 278237 - DNA, 628 bp, Homo sapiens
  misc_feature: GYAE6OF02GS0MU.48.82.H05.1.454.CMB.1.raw
  modified_base (202)..(202): a, c, t, g, unknown or other
  misc_feature (202)..(202): n is a, c, g, or t
  modified_base (456)..(456): a, c, t, g, unknown or other
  misc_feature (456)..(456): n is a, c, g, or t
  modified_base (461)..(461): a, c, t, g, unknown or other
  misc_feature (461)..(461): n is a, c, g, or t
  modified_base (488)..(488): a, c, t, g, unknown or other
  misc_feature (488)..(488): n is a, c, g, or t
tcagagtatacatacacgaccggtgctcgatttagtcgagctctctcgcgggggggtctcaggaggcagcgctctcgggacgtctccaccatggcctgggctctgctattcctcaccctcctcactcagggcacgagggtcctcgggcccagttctcgccctgactcacgcctgcctccggtgtcgtgggtcctcctggacngtcgatcaccatctcctgccacgtacggaaccagcaggtcggtacggtttgggtaggttaataacgttatcggttcctccgtacggtaccaaacaaccgaccgaaggacccaaaccgcccctaaaactcaacttagtattagtgagttgactacgtacgtccggccttggtacggtttacagtccgtcttcgtcgtcgctacgagtcgtacgacaacgtccgtactcccgagacctatcgcgtcggactccggngtcgnggacggcgacggtctagtattcgttcncgtacctacgctataacacgtacgctacgcacgcttacgtcggtagtacggtcggtacggaggtacgaccgtacgtccgtaccggtacgttaccgtagggacctaccggaccggtaccggtcgtacccgtccccggtacg

SEQ ID NO: 278238 - DNA, 180 bp, Homo sapiens
  misc_feature: GYAE6OF02GF7EW.48.82.H05.1.454.CMB.1.raw
  modified_base (167)..(180): a, c, t, g, unknown or other
  misc_feature (167)..(180): n is a, c, g, or t
tcagagtatacatacacgaccggtgctcgatttagtcgagctctctcgcgggcacgaccggtgctcgatttagtcacgcgagaaagggaagggggctggccctgacgtgtttctgttcccaccctcctctatgtatactctgagccgggctgggcaaggcgcatagnnnnnnnnnnnnnn

SEQ ID NO: 278239 - DNA, 607 bp, Homo sapiens
  misc_feature: GYAE6OF02I419C.48.82.H05.1.454.CMB.1.raw
  modified_base (194)..(194): a, c, t, g, unknown or other
  misc_feature (194)..(194): n is a, c, g, or t
  modified_base (251)..(251): a, c, t, g, unknown or other
  misc_feature (251)..(251): n is a, c, g, or t
  modified_base (308)..(308): a, c, t, g, unknown or other
  misc_feature (308)..(308): n is a, c, g, or t
  modified_base (348)..(348): a, c, t, g, unknown or other
  misc_feature (348)..(348): n is a, c, g, or t
  modified_base (371)..(371): a, c, t, g, unknown or other
  misc_feature (371)..(371): n is a, c, g, or t
  modified_base (379)..(379): a, c, t, g, unknown or other
  misc_feature (379)..(379): n is a, c, g, or t
  modified_base (409)..(409): a, c, t, g, unknown or other
  misc_feature (409)..(409): n is a, c, g, or t
  modified_base (414)..(414): a, c, t, g, unknown or other
  misc_feature (414)..(414): n is a, c, g, or t
tcagagtatacatacacgaccggtgctcgatttagtcgagctctctcgcgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacngtcgatcaccatctcctgacactggaaccagtcagtgacggttggtgttaataactntgtctcctggtaccaacaaccaccaggacaaacgccccccaaaatcaactgtattanagtatagtacagtaactcggcctcgagggtttctaatcgnttctctgctcaagtctgacaacncgacctcngaccatctacgtggctcgagctagagacgngctanagttatactgactcctagaacttacgtaacaaggaccacgcgaacgtaccaacttcgtacggttacggttaacgttccgggacgggtaacgggtaaccgtaaacggtccgtacggtaaccccgtaccggttaacggttccgaaccggtaccccgtaaacgggtcccgttacccggtaccccccgtttaccggg

SEQ ID NO: 278240 - DNA, 626 bp, Homo sapiens
  misc_feature: GYAE6OF02JTS01.48.82.H05.1.454.CMB.1.raw
  modified_base (117)..(117): a, c, t, g, unknown or other
  misc_feature (117)..(117): n is a, c, g, or t
  modified_base (146)..(146): a, c, t, g, unknown or other
  misc_feature (146)..(146): n is a, c, g, or t
  modified_base (178)..(178): a, c, t, g, unknown or other
  misc_feature (178)..(178): n is a, c, g, or t
  modified_base (182)..(182): a, c, t, g, unknown or other
  misc_feature (182)..(182): n is a, c, g, or t
  modified_base (194)..(194): a, c, t, g, unknown or other
  misc_feature (194)..(194): n is a, c, g, or t
  modified_base (224)..(224): a, c, t, g, unknown or other
  misc_feature (224)..(224): n is a, c, g, or t
  modified_base (234)..(234): a, c, t, g, unknown or other
  misc_feature (234)..(234): n is a, c, g, or t
  modified_base (238)..(238): a, c, t, g, unknown or other
  misc_feature (238)..(238): n is a, c, g, or t
  modified_base (243)..(243): a, c, t, g, unknown or other
  misc_feature (243)..(243): n is a, c, g, or t
  modified_base (346)..(346): a, c, t, g, unknown or other
  misc_feature (346)..(346): n is a, c, g, or t
  modified_base (516)..(517): a, c, t, g, unknown or other
  misc_feature (516)..(517): n is a, c, g, or t
  modified_base (533)..(533): a, c, t, g, unknown or other
  misc_feature (533)..(533): n is a, c, g, or t
  modified_base (539)..(539): a, c, t, g, unknown or other
  misc_feature (539)..(539): n is a, c, g, or t
  modified_base (586)..(586): a, c, t, g, unknown or other
  misc_feature (586)..(586): n is a, c, g, or t
  modified_base (620)..(620): a, c, t, g, unknown or other
  misc_feature (620)..(620): n is a, c, g, or t
tcagagtatacatacacgaccggtgctcgatttagtcgagctctctcgcgggcacgaccggtgctcgatttagtcgagctctctcgcgggcacggaccggtgctcgtatttgtcganctctcgtcggcgggcacggcgtgtctcgntttacgcgatctctcgacgggtcgacacggcncgtntacgttcttgcngtacgtctacggtcggcgacgtaccggtcncaggtttccngtancgacnctgtacggtccggagacggtctacgcgtcgctgtctacgccgactacgaacggaccgtacgtacgtaccgttccgtacgtcgtaccgtcgtacggtacggacnccgggggtacctacgggacctacggtacgtacgtaccgacggtaccgccgggtcggttacggcttaacgacgttacggcggttaacgtacgtacgtcggtttaacgtacgtacgtacggtcgtaccggacggttcgacgtcggtacatcgagtgtacgcgtcgacgtcgnncgtcgagtcgtcgtgngtacgngtcgagacgtgtagtcgtagtacgcgtaccgtcgacggtaactaccncgtacgtacgtagttacacgtacgtacgtacganacggta

SEQ ID NO: 278241 - DNA, 372 bp, Homo sapiens
  misc_feature: GYAE6OF02IPL15.48.82.H05.1.454.CMB.1.raw
  modified_base (229)..(229): a, c, t, g, unknown or other
  misc_feature (229)..(229): n is a, c, g, or t
  modified_base (239)..(239): a, c, t, g, unknown or other
  misc_feature (239)..(239): n is a, c, g, or t
  modified_base (248)..(248): a, c, t, g, unknown or other
  misc_feature (248)..(248): n is a, c, g, or t
  modified_base (315)..(315): a, c, t, g, unknown or other
  misc_feature (315)..(315): n is a, c, g, or t
  modified_base (339)..(372): a, c, t, g, unknown or other
  misc_feature (339)..(372): n is a, c, g, or t
tcagagtatacatacacgaccggtgctcgatttagtcgagctctctcgcgggcacgaccggtgctcgatttagtcgagctctctcggcgggcacggaccggtgctcgatttagtagcatactggttggggttcggggaccaagggacaaccggtcaccgtctcttcgacgcctccaccaacgggcccagtcggtccttccccctgggccgcccctggcctccgaggacnccaccgtcgngacgccaangccggtccgtgggcctgccgtcgggacgaagggtaccttacttcgtaagtcgtaactctcaggcggngggcctaggcaaggcctgaatgcnnnnnnnnnnnnnnnnnnnnnnnnnnnnnnnnnn

SEQ ID NO: 278242 - DNA, 730 bp, Homo sapiens
  misc_feature: GYAE6OF02HJ2IO.48.82.H05.1.454.CMB.1.raw
  modified_base (319)..(319): a, c, t, g, unknown or other
  misc_feature (319)..(319): n is a, c, g, or t
  modified_base (334)..(334): a, c, t, g, unknown or other
  misc_feature (334)..(334): n is a, c, g, or t
  modified_base (357)..(357): a, c, t, g, unknown or other
  misc_feature (357)..(357): n is a, c, g, or t
  modified_base (445)..(445): a, c, t, g, unknown or other
  misc_feature (445)..(445): n is a, c, g, or t
  modified_base (452)..(452): a, c, t, g, unknown or other
  misc_feature (452)..(452): n is a, c, g, or t
  modified_base (459)..(459): a, c, t, g, unknown or other
  misc_feature (459)..(459): n is a, c, g, or t
tcagagtatacatacacgaccggtgctcgatttagtcgagctctctcgcgggcacgaccggtgctcgatttagctctacgctcagggcacgaccggtgctcgatttagctctacgctcagggcacgacggtgctcgatttagctctacgctcgaggggatcgtcttttcgtagagtacgtcagtgggtattccgtactagttgtaggaccgaaaagtaaaagtcggaaacggtcctaaccgttgggttaccggtttccttcctccgtggtccggtcggtacggccggtcctaccgtagtacggtcggtcctcggtaccngtcctcgcgacgtcngtacggaggtacgtccggaccgnggtactggtacgacgtccgttaccggcgtacccgttccgtcccgacgtccgtcgcctacgtgttccgtcggtggtccgtacctcgacncgaccgngtacgtnttaccgttacgttacggtcggacggtccggtacgtaccgtcccgaccgacccggaccgggacggggtaacgggtcgagggtacgtaagggtagttacggtacttacgtacgtagacgggtacgacgttaccgacgttaacccaacccggttaacccgtccgttaaacggacgaccgtacgtaaccgtacgtacgttaccggtacgaccgtaaccgtaccgaaccgtaaccggtaaccttacggtccgtaaccgtacgttaggtccgtaacg

SEQ ID NO: 278243 - DNA, 506 bp, Homo sapiens
  misc_feature: GYAE6OF01AMVIG.19.71.G05.1.454.CMB.1.raw
tcagtactctcgtgcacgaccggtgctcgatttagtgtcgtcgcaagagagagggggaggtacaacaggcaggcagggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttatacagttccaacaatgaaaactacttagcttggtaccagcagagaccaggacagcctcctaggctgctcatttactgggcatctacccgggaatccggggtccctgaccgattcagtgcagcgggtctgggacagatttcactctcaccatcagcagcctgcaggctgaagatgtggcagtttattattgtcaactaatattattatacttcgtggacgtttcggccaagggtccaagggtggataagtcaagacgaactgtggctggacc

SEQ ID NO: 278244 - DNA, 565 bp, Homo sapiens
  misc_feature: GYAE6OF01BZMX1.19.71.G05.1.454.CMB.1.raw
tcagtactctcgtgcacgaccggtgctcgatttagtgtcgtcgcaagagagagggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttatacagttccaacaatgaaaactacttagcttggtaccagcagagaccaggacagcctcctaggctgctcatttactgggcatctacccgggaatccggggtccctgaccgattcagtggcagcgggtctgggacagatttcactctcaccatcgagcacgcctgcgaggtcgtaggaaagtagtggtcgacgttaagttttattagttagtacaaactaattatttaattaacttacttcggtacggtacggttccggaccggtaaacgggaccgtaagggtaggtattacgtacgaacggtaacgtaacgttggtcggtcgtgtaccc

SEQ ID NO: 278245 - DNA, 507 bp, Homo sapiens
  misc_feature: GYAE6OF01CBX4U.19.71.G05.1.454.CMB.1.raw
  modified_base (239)..(239): a, c, t, g, unknown or other
  misc_feature (239)..(239): n is a, c, g, or t
  modified_base (313)..(313): a, c, t, g, unknown or other
  misc_feature (313)..(313): n is a, c, g, or t
  modified_base (399)..(399): a, c, t, g, unknown or other
  misc_feature (399)..(399): n is a, c, g, or t
tcagtactctcgtgcacgaccggtgctcgatttagtgtcgtcgcaagagagaggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccgatacgaactgcaagtccagccacaatcttttanacagttccaacaatgaaaactacttagcttggtaccagcagagaccaggacagcctcctagctgctcatttacngggcatctacccgggaatccggggtccctgaccgattcagtggcagcgggtctgggacagatttcactctcaccatcagcagctgnaggctgaagatgtggcagtttataattgtcaactaattattattatacttcgtggtaacttggaccaaggggtaccaaggtggatagtcagacgaactagtgctgacc

SEQ ID NO: 278246 - DNA, 508 bp, Homo sapiens
  misc_feature: GYAE6OF01CH9MV.19.71.G05.1.454.CMB.1.raw
  modified_base (237)..(237): a, c, t, g, unknown or other
  misc_feature (237)..(237): n is a, c, g, or t
  modified_base (313)..(313): a, c, t, g, unknown or other
  misc_feature (313)..(313): n is a, c, g, or t
  modified_base (503)..(503): a, c, t, g, unknown or other
  misc_feature (503)..(503): n is a, c, g, or t
tcagtactctcgtgcacgaccggtgctcgatttagtgtcgtcgcaagagagagggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttanacagttccaacaatgaaaactacttaagcttggtaccagcagagaccaggacagcctcctaggctgctcatttacngggcatctacccggaatccggggtccctgaccgattcagtggcagcgggtctgggacagatttcactctcaccatcagcagcctgcaggctagaaagatgtggctaagttttattatgtacaaactaattattattatacttcgtgacgttcgaccaagggacccaaggtgatatcagacgaactgtggntgacc

SEQ ID NO: 278247 - DNA, 528 bp, Homo sapiens
  misc_feature: GYAE6OF01CNXLF.19.71.G05.1.454.CMB.1.raw
  modified_base (240)..(240): a, c, t, g, unknown or other
  misc_feature (240)..(240): n is a, c, g, or t
  modified_base (403)..(403): a, c, t, g, unknown or other
  misc_feature (403)..(403): n is a, c, g, or t
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccacgatacgaactgacaagtccagccacaatctttanacagttccaacaatgaaaactcttagcttaggtaccagcagagaccaggacagcctcctaaaggtgctcatttcctgggcatctacccgggaatccgggtcctgaccgattcagtggcaggcggtctgggacaggatttcattctcagcatcagcgctgacgngcgtgagagtgtgtcgtagtttattcttcgtactagtactatattatatactactcctccgtacgtccggaccggacggacgacggtacggtaacgtacgaacgtaacgtacgtagcgtcgcgac

SEQ ID NO: 278248 - DNA, 523 bp, Homo sapiens
  misc_feature: GYAE6OF01DU9O0.19.71.G05.1.454.CMB.1.raw
  modified_base (237)..(237): a, c, t, g, unknown or other
  misc_feature (237)..(237): n is a, c, g, or t
tcagtactctcgtgcacgaccggtgctcgatttagtgtcgtcgcaagagagagggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttanacagttccaacaatgaaaactacttagcttggtaccagcagagaccaggacagcctcctaggctgctcatttactgggcatctacccgggaatccggggtccctgaccgattcagtggcagcgggtctgggacagatttcactctcaccatcagcagcctgcaggctgaagatgtggctagtttattattgtacaactaattattattatacttcgtggacgtttcggacctaaagggacctaaagggtggtaatagttcaaggtacgaaactgtacggctggacc

SEQ ID NO: 278249 - DNA, 566 bp, Homo sapiens
  misc_feature: GYAE6OF01DV1XV.19.71.G05.1.454.CMB.1.raw
  modified_base (320)..(320): a, c, t, g, unknown or other
  misc_feature (320)..(320): n is a, c, g, or t
  modified_base (394)..(394): a, c, t, g, unknown or other
  misc_feature (394)..(394): n is a, c, g, or t
  modified_base (418)..(418): a, c, t, g, unknown or other
  misc_feature (418)..(418): n is a, c, g, or t
tcagtactctcgtgcacgaccggtgctcgatttagtgtcgtcgcaagagagagggggaggtactaacaggcaggctaggggcagcaagatggtgttgcagacccaggtcttcagtttctctgttgctcgtggatctctggtcgcccacggggacatcgtgatgacccagtctccagacctccctggctgtgtctctgggcgagcgggccaccgatcaactgcaaggtccagccacaatctttatacagttccaacaatgaaaactacttaagcttaggtaccagcagagaccaggacagcctctaggctgctcatttacnggcatcaccggaatccgggtcctagaccgattcagtcgcagcggtctgggaactagtatttcactcgtacactntcagcagcctgacaggctagaagntgtggactaggtttattacgtagtacaacgtaagttactttaattacttacttcggtacgtaccggtttccgaccgtaaagggtacccgtaaggttcggaacttaccgtacgacgtaaccgtaaacctggtacgggctcggtaacccg

SEQ ID NO: 278250 - DNA, 507 bp, Homo sapiens
  misc_feature: GYAE6OF01BKE9Q.19.71.G05.1.454.CMB.1.raw
  modified_base (236)..(236): a, c, t, g, unknown or other
  misc_feature (236)..(236): n is a, c, g, or t
tcagtactctcgtgcacgaccggtgctcgatttagtgtcgtcgcaagagagagggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccacatcaactgcaagtccagccacaatcttttanacagttccaacaatgaaaactacttagcttggtaccagcagagaccaggacagcctcctaggctgctcatttactgggcatctacccgggaatccggggtcctgaccgattcagtggcagcgggtctgggacagatttcactctcaccatcagcagcctgcaggctgaagatgtggcagtttattattgtcaactaattatttattatacttcgtggacgtttcggaccaagggacctaagggtggatatcgagacgaactgtggctgacc

SEQ ID NO: 278251 - DNA, 511 bp, Homo sapiens
  misc_feature: GYAE6OF01ATTJX.19.71.G05.1.454.CMB.1.raw
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttatacagttccaacaatgaaaactacttagcttggtaccagcagagaccaggacagcctcctaggctgctcatttactgggcatctacccgggaatccggggtccctgaccgattcagtggcagcgggtctgggacagatttcactctcaccatcagcagcctgcaggctgaagatgtggcagtttattattgtcaaactaattattattatacttcgtggtacgttcggccaaagggaccctaagggtggatatcaagacgaactgtcggctgac

SEQ ID NO: 278252 - DNA, 585 bp, Homo sapiens
  misc_feature: GYAE6OF01BRKS7.19.71.G05.1.454.CMB.1.raw
  modified_base (211)..(211): a, c, t, g, unknown or other
  misc_feature (211)..(211): n is a, c, g, or t
  modified_base (231)..(231): a, c, t, g, unknown or other
  misc_feature (231)..(231): n is a, c, g, or t
  modified_base (238)..(238): a, c, t, g, unknown or other
  misc_feature (238)..(238): n is a, c, g, or t
  modified_base (247)..(247): a, c, t, g, unknown or other
  misc_feature (247)..(247): n is a, c, g, or t
  modified_base (259)..(259): a, c, t, g, unknown or other
  misc_feature (259)..(259): n is a, c, g, or t
tcagtactctcgtgcacgaccggtgctcgatttagtgtcgtcgcaagagagaggggtcaggctggaactgaggagcaggcagggcagcaagatggtgttgcagacccaggtcttcatttctctgttgctctggatctctggtgcccacggggacatcgtgatgacccagtctccagactccctggctgtgtctctgggcgagcgggcacgntacgactgactaagcagcanatcttanacagtcaanatagaatatatntgtacagacagagacagacacgcctctacgctcgctactacttacgtcggacgtacgtacgtaccggtaacgtaccgggtacccgtacgtacgtacgtacgtacgtacggacgacggtcggtcgtacggacgagtacttactactctactactactacacgacgacgccgtcgacgacggtacgtagaagtagtagtacgtacgtagtttattagttagttactaactaacttaattaattaacttacgttacgttacggtacggttacggtacggtaacggtaacggtaacggtacggtacgtactagaacgtacgtaacgtacg

SEQ ID NO: 278253 - DNA, 520 bp, Homo sapiens
  misc_feature: GYAE6OF01DAGDE.19.71.G05.1.454.CMB.1.raw
  modified_base (240)..(240): a, c, t, g, unknown or other
  misc_feature (240)..(240): n is a, c, g, or t
  modified_base (317)..(317): a, c, t, g, unknown or other
  misc_feature (317)..(317): n is a, c, g, or t
  modified_base (426)..(426): a, c, t, g, unknown or other
  misc_feature (426)..(426): n is a, c, g, or t
  modified_base (514)..(514): a, c, t, g, unknown or other
  misc_feature (514)..(514): n is a, c, g, or t
tcagtactctcgtgcacgaccggtgctcgatttagtgtcgtcgcaagagagagggggaggtacaacaggcaggcaggggcagcaagatggtgttgcagacccaggtcttcatttctctgttgctctggatctctggtgcccacggggacatcgtgatgacccagtctccagactccctggctgtgtctcgtgggcgaggcgggccaccatcaactgcaagtccagccacaattcttttanacagttaccaaacaatagaaaactacttaagcttggtaccagcagagaccaggacagcctcaggctgctcatttacnggcatcgtacccggaatccggggtcctgaccgtattcgagtggcaggcgggtctgggaacaggtactttcgactctacaccatcagcagcctgcaggctagaagtatgngtactagtttattatgtacaataattattattatacttgtggtacgttcggactaagggacctaggtgatatacagtacgactgtcgngtgacc

SEQ ID NO: 278254 - DNA, 513 bp, Homo sapiens
  misc_feature: GYAE6OF01BARFH.19.71.G05.1.454.CMB.1.raw
tcagtactctcgtgcacgaccggtgctcgatttagtgtcgtcgcaagagagagggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttatacagttccaacaatgaaaactacttagcttggtaccagcagagaccaggacagcctcctaggctgctcatttactgggcatctacccgggaatccggggtccctgaccgattcagtggcagcgggtctgggacagatttcactctcaccatcagcagcctgcaggctgaagatgtggctagtttatattgtacaactaattattattatacttcgtggtacgttcggacctaagggacctaagggtggatagtcaagacgtaactgtggctgaccc

SEQ ID NO: 278255 - DNA, 561 bp, Homo sapiens
  misc_feature: GYAE6OF01EEHP6.19.71.G05.1.454.CMB.1.raw
  modified_base (230)..(230): a, c, t, g, unknown or other
  misc_feature (230)..(230): n is a, c, g, or t
  modified_base (239)..(239): a, c, t, g, unknown or other
  misc_feature (239)..(239): n is a, c, g, or t
  modified_base (313)..(313): a, c, t, g, unknown or other
  misc_feature (313)..(313): n is a, c, g, or t
  modified_base (460)..(460): a, c, t, g, unknown or other
  misc_feature (460)..(460): n is a, c, g, or t
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgaggcggccaccagtcaactgacaagtccagccanaatctttanacagttccaacaatgaaaactcttagcttaggaccagcagagaccaggacagcctcctaggctgctcatttacnggcatccgtacccgggaatccggggtccctgaccgattcagtggcaggcgggtctgggacagtatttcgacttctacacctatccagcacgcctgactaggctagaagattggtggacttagtttattgttagtaccaagtaaattnttaattaatacttcggtagtaccgttcggaaccgaagggtaccctaaagggttggaacttagtccgaaaggtacgaaacgttggtcgggacttcggaaccc

SEQ ID NO: 278256 - DNA, 559 bp, Homo sapiens
  misc_feature: GYAE6OF01AFRU7.19.71.G05.1.454.CMB.1.raw
  modified_base (229)..(229): a, c, t, g, unknown or other
  misc_feature (229)..(229): n is a, c, g, or t
  modified_base (239)..(239): a, c, t, g, unknown or other
  misc_feature (239)..(239): n is a, c, g, or t
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccgatcaactgcaagtccagccanaatcttttanacagttccaacaatagaaaactacttagcttggtaccagcagagaccaggacagcctctaggctgctcatttactgggcatctacccgggatccggggtcctgaccgattcagtggcaggcgggtctgggacagtactttcactctcaccatcacgcacgcctgacacggctagaagagtggtggtactagttttacttagtttcgtactaactaattatttaattaacttacgttacggtggtacggtttccggaccgtaaacgggtaccgtaagggttggacttagtacaggtaactaacgttaggtcggctggaccc

SEQ ID NO: 278257 - DNA, 605 bp, Homo sapiens
  misc_feature: GYAE6OF01CJY9C.19.71.G05.1.454.CMB.1.raw
  modified_base (206)..(206): a, c, t, g, unknown or other
  misc_feature (206)..(206): n is a, c, g, or t
  modified_base (229)..(229): a, c, t, g, unknown or other
  misc_feature (229)..(229): n is a, c, g, or t
  modified_base (238)..(238): a, c, t, g, unknown or other
  misc_feature (238)..(238): n is a, c, g, or t
  modified_base (313)..(313): a, c, t, g, unknown or other
  misc_feature (313)..(313): n is a, c, g, or t
tcagtactctcgtgcacgaccggtgctcgatttagtgtcgtcgcaagagagaggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccacgntacgactgactaagtccagccanaatctttanacagttccaacaatgaaaactacttagcttggtaccagcagagaccaggacagcctccaggctgctcatttacgnggcatcgtacccggatcccggggtcctagaccgtattcgaggtcggacaggccgggtcgtagggactaggtactttccactctaccaacctatcagcacgccgtcgacgacgacgtagaagagtaggtggtacgtagtttaagtttattagttacgtaaactaattaatttaatttaattacgttacggttacggttacggttaccggtaccggtaaacgggtaaccggtaacgggttaaggtaacgttaacgtacgtaacgtaacgtaacgttaggtacggtcgtcgtacg

SEQ ID NO: 278258 - DNA, 546 bp, Homo sapiens
  misc_feature: GYAE6OF01A4Z2P.19.71.G05.1.454.CMB.1.raw
  modified_base (316)..(316): a, c, t, g, unknown or other
  misc_feature (316)..(316): n is a, c, g, or t
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcgaactgacaagtccagccacaatcttttatacagttccaacaatagaaaactacttagcttggtaccagcagagaccaggacagcctcctaggctgctcatttacngggcatctaccgggaatccggggtccctgacccgattcagtggcagcgggtctgggacagatttcactctcaccatcagcagcctgcagggctgaagatgtggctaagtttattattgactaactaattatttattaattacgttcgtaggtacgtttcggaccgtaagggtacccaaggtggaactagtaccgaacgtaaccgaaacgttggtacggccgttgtacccg

SEQ ID NO: 278259 - DNA, 525 bp, Homo sapiens
  misc_feature: GYAE6OF01BGJYN.19.71.G05.1.454.CMB.1.raw
  modified_base (237)..(237): a, c, t, g, unknown or other
  misc_feature (237)..(237): n is a, c, g, or t
  modified_base (311)..(311): a, c, t, g, unknown or other
  misc_feature (311)..(311): n is a, c, g, or t
tcagtactctcgtgcacgaccggtgctcgatttagtgtcgtcgcaagagagagggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttanacagttccaacaatgaaactacttagcttggtaccagcagagaccaggacagcctcctaggctgctcatttacngggcatctaccggaatccggggtcctgaccgattcagtgcagcgggtctgggacagatttcactctcaccatcagcagcctgcagctgagatgtgcagttatatgtcaactaattattattatacttcgtggtacgtttcggaccgtaagggtaccctaagggtggtacttaagtcaaggaaccgtaaaccgttggttacgggctggtaacccg

SEQ ID NO: 278260 - DNA, 598 bp, Homo sapiens
  misc_feature: GYAE6OF01DPWXO.19.71.G05.1.454.CMB.1.raw
  modified_base (239)..(239): a, c, t, g, unknown or other
  misc_feature (239)..(239): n is a, c, g, or t
  modified_base (319)..(319): a, c, t, g, unknown or other
  misc_feature (319)..(319): n is a, c, g, or t
  modified_base (438)..(438): a, c, t, g, unknown or other
  misc_feature (438)..(438): n is a, c, g, or t
tcagtactctcgtgcacgaccggtgctcgatttagtgtcgtcgcaagagagaggggggaggtacaacaggcaggcaggggcagcaagatggtgttgcagaaccaggtcttcatttctctgttgctctggatctctggtgcccacggggacatcgtgatgacccagtctccagactccctggctgtgtctcgtgggcgaggcgggccaccatcaactgcaagtccagccacaatctttanacagttaccaaacaatagaaaactacttagctttggaccagcagagaccaggacagcctcctaggctgcctcatttacgngggcagtccgtaacccgggaagtcccggggtccctgaccgtattcgagtcggcaggcgggtctgggacaggtactttcgactcctcaccatcagtccagcctgcgagggtctaggaagntaggtggacttaaggttttattacgttagtactaaacttaattaagtttaatttacttacgttcggtagggtaccgttaccggaaccgtaaacgggtaccgtaagggtacggtatacttacggaacgtaacggtaaccttaggtcggtacgtgtaacccg

SEQ ID NO: 278261 - DNA, 552 bp, Homo sapiens
  misc_feature: GYAE6OF01CS42J.19.71.G05.1.454.CMB.1.raw
  modified_base (238)..(238): a, c, t, g, unknown or other
  misc_feature (238)..(238): n is a, c, g, or t
  modified_base (420)..(420): a, c, t, g, unknown or other
  misc_feature (420)..(420): n is a, c, g, or t
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttanacagttccaacaatagaaaactacttagcttaggtaccagcagagaccaggacagcctcctaggctgctcatttactgggcatcgtacccgggaatccggggtccctggacccgtattcagtggcaggtcgggtctgggacagtatttcactctcaccatcagcagcctgcaggctagaagntgtgctagtttattattgtacaactaattattaattatactttcggtggtaccgttccgggacctaaaggggaccctaagggtaggtaacttacgtacgaacgtaacggtaactggtacggcctggtaaccc

SEQ ID NO: 278262 - DNA, 620 bp, Homo sapiens
  misc_feature: GYAE6OF01A6UG6.19.71.G05.1.454.CMB.1.raw
  modified_base (203)..(203): a, c, t, g, unknown or other
  misc_feature (203)..(203): n is a, c, g, or t
  modified_base (207)..(207): a, c, t, g, unknown or other
  misc_feature (207)..(207): n is a, c, g, or t
  modified_base (227)..(227): a, c, t, g, unknown or other
  misc_feature (227)..(227): n is a, c, g, or t
  modified_base (235)..(235): a, c, t, g, unknown or other
  misc_feature (235)..(235): n is a, c, g, or t
  modified_base (244)..(244): a, c, t, g, unknown or other
  misc_feature (244)..(244): n is a, c, g, or t
tcagtactctcgtgcacgaccggtgctcgatttagtgtcgtcgcaagagagagggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggcncganacgactgactaagcagccanatctttanacatccaanatagaaactactagcttagaccagcagacgaccaggacacgccttaccgtaggctgctactattacgtacggtactactacgtacccggtacgtccgggtccgtacgaccgtactacgtacgtcggcgacggcgggtcgtcggacgagtattactactctacactactacacgacgacgacgtcgacgacgacgtagaagagtagtacggtacgtagtttattattacgtactaactaattaattaacttaacttacgttacggttacggttaccggttaccggtaaccggtaaaccgggtaaccggtaacgggtaacggtaacgttaacgtacgtaacggtaaccggtaacgtaggttacggtcgtacggtaccg

SEQ ID NO: 278263 - DNA, 498 bp, Homo sapiens
  misc_feature: GYAE6OF01CZF0R.19.71.G05.1.454.CMB.1.raw
  modified_base (235)..(235): a, c, t, g, unknown or other
  misc_feature (235)..(235): n is a, c, g, or t
  modified_base (495)..(495): a, c, t, g, unknown or other
  misc_feature (495)..(495): n is a, c, g, or t
tcagtactctcgtgcacgaccggtgctcgatttagtgtcgtcgcaagagagagggggaggtacaacaggcaggcagggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatctttanacagttccaacaatgaaaactacttagcttggtaccagcagagaccaggacagcctcataggctgctcatttactgggcatctacccgggaatccgggtccctgaccgattcagtggcagcgggtctgggacagatttcactctcaccatcagcagcctgcaggctgaagatgtgctagtttattattgtacaactaatattattatacttcgtggacgttggaccgtaagggaccaagggtgatatcagacgatgtggntcg

SEQ ID NO: 278264 - DNA, 541 bp, Homo sapiens
  misc_feature: GYAE6OF01DHSM1.19.71.G05.1.454.CMB.1.raw
  modified_base (238)..(238): a, c, t, g, unknown or other
  misc_feature (238)..(238): n is a, c, g, or t
  modified_base (411)..(411): a, c, t, g, unknown or other
  misc_feature (411)..(411): n is a, c, g, or t
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttanacagttccaacaatgaaaactacttagcttggtaccagcagagaccaggacagcctcctaggctgctcatttactgggcatcctacccgggaatccggggtcctgaccgattcagtggcaggcgggtctgggacagattcactctcaccatcagcagcctgcaggctaggaantggtggctagtttatagttgactaactaattatttaattacttacttcggtacggtaccgtttcggccgtaaaggggtaccgtaagggttggaacttagtcgaagtaccgtaactggtcggcttggaccc

SEQ ID NO: 278265 - DNA, 527 bp, Homo sapiens
  misc_feature: GYAE6OF01B16GO.19.71.G05.1.454.CMB.1.raw
  modified_base (234)..(234): a, c, t, g, unknown or other
  misc_feature (234)..(234): n is a, c, g, or t
tcagtactctcgtgcacgaccggtgctcgatttagtgtcgtcgcaagagagagggggtcaggctggaactgaggagcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccanaatcttttatacagttccaacaatgaaaactacttagcttggtaccagcagagaccaggacagcctcctaggctgctcatttactgggcatctacccgggaatccggggtccctgaccgattcagtggcagcgggtctgggacagatttcactctcaccatcagcagcctgcaggctgaagatgtggctagtttattattgtacaactatattattattacgttcgtaggtaccgttcggacccgtaaaggggaccctaaagggtggtaatagtacagtaacgaacgttcggg

SEQ ID NO: 278266 - DNA, 518 bp, Homo sapiens
  misc_feature: GYAE6OF01BKGGV.19.71.G05.1.454.CMB.1.raw
  modified_base (238)..(238): a, c, t, g, unknown or other
  misc_feature (238)..(238): n is a, c, g, or t
tcagtactctcgtgcacgaccggtgctcgatttagtgtcgtcgcaagagagaggggggaggtacaacaggcaggcaagggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttanacagttccaacaatgaaaactacttagcttggtaccagcagagaccaggacagcctcctaggctgctcatttactgggcatctacccgggaatccgggggtccctgaccgattcagtggcagcgggtctgggacagatttcactctcaccatcagcagcctgcaggctgaagatgtggctagtttattattgtacaactaattattattatacgttcgtggtacgttcggaccaagggacctaagggtggattagtcagtacgaactaggtggctgtacc

SEQ ID NO: 278267 - DNA, 634 bp, Homo sapiens
  misc_feature: GYAE6OF01DOI5G.19.71.G05.1.454.CMB.1.raw
  modified_base (244)..(244): a, c, t, g, unknown or other
  misc_feature (244)..(244): n is a, c, g, or t
  modified_base (324)..(324): a, c, t, g, unknown or other
  misc_feature (324)..(324): n is a, c, g, or t
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctcgtggggcgagcggggcctacgatacgacgtgacaagtccagccacaatctttanacagttccaacaatgaaaactacttagctttaggaccagcagacgaccaggacagcctcctaggctggctcagtttacgnggcatccgtaccggagtcccgggtcctagaccgtatcgaggtcggcgacggtcgggtcgtacgggactaggttactttcacctcctaccacctactacgagacctacgtccgtacggaccgacggtactaggaacgtagtcggtacggtacttaagttttacttacgttagtaactaaacttaattaacgtttaatttacgttacgttacggttacggttaccggttaccggaacgtaaacgggaaccgtaagggtacggtaacttacgtacgtaacggtaacgtaacggtggttacggtcgtcgtaccg

SEQ ID NO: 278268 - DNA, 510 bp, Homo sapiens
  misc_feature: GYAE6OF01BCM0X.19.71.G05.1.454.CMB.1.raw
  modified_base (310)..(310): a, c, t, g, unknown or other
  misc_feature (310)..(310): n is a, c, g, or t
tcagtactctcgtgcacgaccggtgctcgatttagtgtcgtcgcaagagagagggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcggccaccagtcaactgcaagtccagccacaatcttttaacagttccaacaatgaaactacttagcttggtaccagcagagaccaggacagcctcctaggctgctcatttacngggcatctacccgggaatccggggtcctgaccgattcagtggcagcgggtctgggacagatttcactctcaccatcagcagcctgcaggctgaacgatgtggctagtttattattgtacaactaattattaattatacttcgtgacgtttcggaccgtaagggacctaaggtggatatcacgacgaactgtcggctgacc

SEQ ID NO: 278269 - DNA, 513 bp, Homo sapiens
  misc_feature: GYAE6OF01A1TQ7.19.71.G05.1.454.CMB.1.raw
  modified_base (237)..(237): a, c, t, g, unknown or other
  misc_feature (237)..(237): n is a, c, g, or t
tcagtactctcgtgcacgaccggtgctcgatttagtgtcgtcgcaagagagagggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttanacagttccaacaatgaaaactacttagcttggtaccagcagagaccaggacagcctcctaggctgctcatttactgggcatctacccgggaatcccgggggtccctgaccgattcagtggcagcgggtctgggacagatttcactctcaccatcagcagcctgcaggctgaagatgtggctagtttattattgtcaactaattatttattatacttcgtgtacgttcggaccgaagggaccaaggtggatagtcagacgaacgtgtggtcgtgacc

SEQ ID NO: 278270 - DNA, 497 bp, Homo sapiens
  misc_feature: GYAE6OF01DEG08.19.71.G05.1.454.CMB.1.raw
  modified_base (408)..(408): a, c, t, g, unknown or other
  misc_feature (408)..(408): n is a, c, g, or t
  modified_base (478)..(478): a, c, t, g, unknown or other
  misc_feature (478)..(478): n is a, c, g, or t
  modified_base (492)..(492): a, c, t, g, unknown or other
  misc_feature (492)..(492): n is a, c, g, or t
tcagtactctcgtgcacgaccggtgctcgatttagtgtcgtcgcaagagagagggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatctttatacagttccaacaatgaaaactacttagcttggtaccagcagagaccaggacagcctcctaggctgctcatttactgggcatctacccgggaatccggggtccctgaccgattcagtgcagcgggtctgggacagatttcactctcacccatcagcagcctgcaggctgaagntgtgcagtttatattgtcaacatattattatacttgtggacgttcggccaagggccaaaggtggatagtnagtacaactgtggntgacc

SEQ ID NO: 278271 - DNA, 525 bp, Homo sapiens
  misc_feature: GYAE6OF01D0P06.19.71.G05.1.454.CMB.1.raw
  modified_base (412)..(412): a, c, t, g, unknown or other
  misc_feature (412)..(412): n is a, c, g, or t
  modified_base (414)..(414): a, c, t, g, unknown or other
  misc_feature (414)..(414): n is a, c, g, or t
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttatacagttccaacaatgaaaactacttagcttggtaccagcagagaccaggacagcctctaggctgctcatttactggcatcgtacccgggaatccggggtccctgaccgattcgagtggcagcgggtctgggacagtattcactctcacctatcagcagcctgcagctgagatgngntagttatattagactaataattattattattacttcgtggtacgttcggactaagggacctaaggttcggattactacgaaggtacgtaacgtggtacggtcgtcgtaccg

SEQ ID NO: 278272 - DNA, 533 bp, Homo sapiens
  misc_feature: GYAE6OF01CI54C.19.71.G05.1.454.CMB.1.raw
  modified_base (240)..(240): a, c, t, g, unknown or other
  misc_feature (240)..(240): n is a, c, g, or t
  modified_base (247)..(247): a, c, t, g, unknown or other
  misc_feature (247)..(247): n is a, c, g, or t
  modified_base (250)..(250): a, c, t, g, unknown or other
  misc_feature (250)..(250): n is a, c, g, or t
  modified_base (260)..(260): a, c, t, g, unknown or other
  misc_feature (260)..(260): n is a, c, g, or t
  modified_base (264)..(264): a, c, t, g, unknown or other
  misc_feature (264)..(264): n is a, c, g, or t
  modified_base (306)..(306): a, c, t, g, unknown or other
  misc_feature (306)..(306): n is a, c, g, or t
  modified_base (310)..(310): a, c, t, g, unknown or other
  misc_feature (310)..(310): n is a, c, g, or t
  modified_base (319)..(319): a, c, t, g, unknown or other
  misc_feature (319)..(319): n is a, c, g, or t
  modified_base (406)..(406): a, c, t, g, unknown or other
  misc_feature (406)..(406): n is a, c, g, or t
  modified_base (514)..(514): a, c, t, g, unknown or other
  misc_feature (514)..(514): n is a, c, g, or t
  modified_base (526)..(526): a, c, t, g, unknown or other
  misc_feature (526)..(526): n is a, c, g, or t
tcagtactctcgtgcacgaccggtgctcgatttagtgtcgtcgcaagagagagggggacggtacaacaggcaggcaggggcagcaagatggtgttgcagacccaggtcttcatttctctgttgctctggatctcctggtgcccaggggactagtcgtgatcgacccagtctccagactccctggctgtgtactcctgggcagtcgggtactacggacacgacgtgacgtacgcaggtcanatcttanacngtcacaagtnaacnctaagctcgtactcagtcagacgacctagcgtgctcgagcgngctntattatgtnactacgtacgtacgtacgtacgtacgacgacgtacgtagtacggtcgcggacgtacgtagacgacgtacgtactactcacacacgcncgcgtcgtctcgtcgtcgtactacgtacgtagtacgtacgtactacgtagtagtacgtacgtacgtatagtactactagtagtgtacgtagacgacgagagtgagtanacgtacgagagngtgtgtc

SEQ ID NO: 278273 - DNA, 594 bp, Homo sapiens
  misc_feature: GYAE6OF01BVMGS.19.71.G05.1.454.CMB.1.raw
  modified_base (207)..(207): a, c, t, g, unknown or other
  misc_feature (207)..(207): n is a, c, g, or t
  modified_base (214)..(214): a, c, t, g, unknown or other
  misc_feature (214)..(214): n is a, c, g, or t
  modified_base (235)..(235): a, c, t, g, unknown or other
  misc_feature (235)..(235): n is a, c, g, or t
  modified_base (244)..(244): a, c, t, g, unknown or other
  misc_feature (244)..(244): n is a, c, g, or t
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggcacgntacgacncgactagcagcatatctttanacatacaanaatacgaactcgtagctcgacagacagacgacagacacgtcctacgtacgctcgtactactacttacgtacggtacgtacgtaccgtaccggtacgtccggtccgtcgtacgtacgtacgtagcgcgacgtcggtcgtacggtacgtacgtacttactactactactactactacgacgtacgacgcgtacgacgacgacgtagacgtagtagtagtacgttagttagttagttactactaactaattattacttattacgttacgtacggtacggttacggtacggtaacggtaacgtaaggtaggtacgtacgtacgtaacgtaacgtacgtagtacgtcgtcgtacg

SEQ ID NO: 278274 - DNA, 505 bp, Homo sapiens
  misc_feature: GYAE6OF01AVXFV.19.71.G05.1.454.CMB.1.raw
  modified_base (238)..(238): a, c, t, g, unknown or other
  misc_feature (238)..(238): n is a, c, g, or t
  modified_base (371)..(371): a, c, t, g, unknown or other
  misc_feature (371)..(371): n is a, c, g, or t
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttanacagttccaacaatgaaaactacttagcttggtaccagcagagaccaggacagcctcctaggctgctcatttactgggcatctacccgggatccggggtcctgaccgattcagtgcagcgggtctgggacagntttcactctcaccatcagcagctgcaggctgaagatgtggctagtttatattgtacaataattattattattacttcgtggtacgttcggaccgtaagggacctaaggtgatatcacgacacgtgtggctgacc

SEQ ID NO: 278275 - DNA, 538 bp, Homo sapiens
  misc_feature: GYAE6OF01CQTFG.19.71.G05.1.454.CMB.1.raw
  modified_base (240)..(240): a, c, t, g, unknown or other
  misc_feature (240)..(240): n is a, c, g, or t
  modified_base (314)..(314): a, c, t, g, unknown or other
  misc_feature (314)..(314): n is a, c, g, or t
  modified_base (421)..(421): a, c, t, g, unknown or other
  misc_feature (421)..(421): n is a, c, g, or t
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccacgatacgaactgacaagtccagccacaatctttanacagttccaaacaatgaaaactcttagcttggtaccagcagagaccaggacagcctctaggctgctcaatttcnggcatcgtaccggatccggggtcctgaccgattcagtgcagcgggtctgggacagtattcactctcacatcagcagcctgcaggctagagatgtggctagtttattntgtacaactaattattattatattcgttagtacgttccggtacgaacgggtaccgtaaggtcgggtaattacgttaacgaacggtaccggtaaacgttcggtaggccgttaggaccc

SEQ ID NO: 278276 - DNA, 501 bp, Homo sapiens
  misc_feature: GYAE6OF01CO5EE.19.71.G05.1.454.CMB.1.raw
  modified_base (236)..(236): a, c, t, g, unknown or other
  misc_feature (236)..(236): n is a, c, g, or t
tcagtactctcgtgcacgaccggtgctcgatttagtgtcgtcgcaagagagagggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatctttanacagttccaacaatgaaaactacttagcttggtaccagcagagaccaggacagcctcctaggctgctcatttactgggcatctacccgggaatccggggtccctgaccgattcagtggcagcgggtctgggacagatttcactctcacatcagcagcctgcaggctgaagatgtgcagtttatattgtcaactaatattattatacttcgtggacttcggccaaagggtaccaagggtggaatatcagacgaactgtggctgacc

SEQ ID NO: 278277 - DNA, 508 bp, Homo sapiens
  misc_feature: GYAE6OF01B9R47.19.71.G05.1.454.CMB.1.raw
  modified_base (238)..(238): a, c, t, g, unknown or other
  misc_feature (238)..(238): n is a, c, g, or t
  modified_base (503)..(503): a, c, t, g, unknown or other
  misc_feature (503)..(503): n is a, c, g, or t
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttanacagttccaacaatgaaaactacttagcttggtaccagcagagaccaggacagcctcctaggctgctcatttactgggcatctacccgggaatccggggtccctgaccgattcagtggcagcgggtctgggacagatttcactctcaccatcagcagcctgcagctgaagatgtgctagtttatattgtcaactaattattattatacttcgtggtacgttcggaccaagggtaccaagggtggatatcgagacgaactggtcgntgacc

SEQ ID NO: 278278 - DNA, 559 bp, Homo sapiens
  misc_feature: GYAE6OF01C6U0V.19.71.G05.1.454.CMB.1.raw
  modified_base (239)..(239): a, c, t, g, unknown or other
  misc_feature (239)..(239): n is a, c, g, or t
  modified_base (386)..(386): a, c, t, g, unknown or other
  misc_feature (386)..(386): n is a, c, g, or t
  modified_base (434)..(434): a, c, t, g, unknown or other
  misc_feature (434)..(434): n is a, c, g, or t
  modified_base (446)..(446): a, c, t, g, unknown or other
  misc_feature (446)..(446): n is a, c, g, or t
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccactaattctttanacagttaccaacaatagaaaactacttagcttggaccagcagagacaggacagcctctaggctgctcatttacgtgggctagtccgtacccgggaagttcccggggtaccctggacccgtattccgaggtcggcaggtccgggttcngggacagtatttccgactctcacatcagcagcctgcagctagagatgngtctagtttatntgtactaataattattattatacgttggtcgtacgttccggaccgaagggtaccgtaagggtaggtattacgtacgtaacgtaaccgtaacgttggtacggtctacggtaacc

SEQ ID NO: 278279 - DNA, 510 bp, Homo sapiens
  misc_feature: GYAE6OF01D7NGW.19.71.G05.1.454.CMB.1.raw
  modified_base (238)..(238): a, c, t, g, unknown or other
  misc_feature (238)..(238): n is a, c, g, or t
  modified_base (316)..(316): a, c, t, g, unknown or other
  misc_feature (316)..(316): n is a, c, g, or t
  modified_base (418)..(418): a, c, t, g, unknown or other
  misc_feature (418)..(418): n is a, c, g, or t
  modified_base (421)..(421): a, c, t, g, unknown or other
  misc_feature (421)..(421): n is a, c, g, or t
  modified_base (434)..(434): a, c, t, g, unknown or other
  misc_feature (434)..(434): n is a, c, g, or t
  modified_base (504)..(504): a, c, t, g, unknown or other
  misc_feature (504)..(504): n is a, c, g, or t
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttanacagttccaacaatgaaaactacttaagcttaggtaccagcagagaccaggacagcctccgtaggctgctcatttacngggcatccgtacccgggaatccggggtccctgaccgattcagtggcaggcgggtctgggacagtatttcactctcaccatcagcagcctgacaggctagaantgngctagtttatatnacaataattattattatacgttgtacggtcttacggacgaaggtaccaaggtgatatcgagtacaactgngctgac

SEQ ID NO: 278280 - DNA, 536 bp, Homo sapiens
  misc_feature: GYAE6OF01BEG52.19.71.G05.1.454.CMB.1.raw
  modified_base (236)..(236): a, c, t, g, unknown or other
  misc_feature (236)..(236): n is a, c, g, or t
  modified_base (311)..(311): a, c, t, g, unknown or other
  misc_feature (311)..(311): n is a, c, g, or t
tcagtactctcgtgcacgaccggtgctcgatttagtgtcgtcgcaagagagagggggaggtacaacaggcaggcaggggcagcaagatggtgttgcagacccaggtcttcatttctctgttgctctggatctctggtgcccacggggacatcgtgatgacccagtctccagactccctggctgtgtctctgggcagcgggccaccatcaactgcaagtccagccacaatcttttanacagttccaacaatgaaaactacttagcttggtaccagcagagaccaggacagcctcctaggctgctcatttacngggcatctacccgggaatccggggtcctgaccgattcagtggcagcgggtctgggacagatttcactctcaccatcagcaagcctgcaggctgaagatgtggctagtttattattgtacaactaattatttaattatactttcgtaggtacgtttcggaccgtaaagggtaccctaagggttggtattagtacgaagtaaccgtaacgttggtcggtctgacccg

SEQ ID NO: 278281 - DNA, 536 bp, Homo sapiens
  misc_feature: GYAE6OF01BTMFU.19.71.G05.1.454.CMB.1.raw
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacgggggacatcgtgatgacccacgtctccacgactccctcggctgtgtctctgggcgagcgggccaccatacaactgcaagtccacgccaccaatctttatacagtccaacaatgaaaactaacttagcttggtaccagcagagaccaggacagcctcctaggctgctcattacttgggcactctacccgggaatccggggtccctgaccgattcagtggcagcgggtcgtgggacagatttcactctcaccatcagcagcctgcagggctagaagatggtggactagttttattattgtacaaactaattacttattatacttcggtggacgtttcggaccgtaaaggggacctaagggtggtatatcgaagacgaactggtcggctgaccc

SEQ ID NO: 278282 - DNA, 513 bp, Homo sapiens
  misc_feature: GYAE6OF01C71JS.19.71.G05.1.454.CMB.1.raw
  modified_base (237)..(237): a, c, t, g, unknown or other
  misc_feature (237)..(237): n is a, c, g, or t
  modified_base (500)..(500): a, c, t, g, unknown or other
  misc_feature (500)..(500): n is a, c, g, or t
  modified_base (509)..(509): a, c, t, g, unknown or other
  misc_feature (509)..(509): n is a, c, g, or t
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaggtccagccagaacatttcnccacctcaagaacaaaaacttctagcctaggtaccaacagagaccaggacagcctcctaagttgctcatttactggcttctacgcgcgaattccggggtccctgaccgagttccggggcaggcgggtctgggacagatttcactctcaccatcagcagcctgcaggctagaagatgtgctagtttatactgtcagctaattctttttctatcctcgtggacgttcggcctaaagggccagggtacgaaatgaagacgaactgngctagcacntctg

SEQ ID NO: 278283 - DNA, 510 bp, Homo sapiens
  misc_feature: GYAE6OF01E2NYC.19.71.G05.1.454.CMB.1.raw
  modified_base (244)..(244): a, c, t, g, unknown or other
  misc_feature (244)..(244): n is a, c, g, or t
  modified_base (319)..(319): a, c, t, g, unknown or other
  misc_feature (319)..(319): n is a, c, g, or t
  modified_base (500)..(500): a, c, t, g, unknown or other
  misc_feature (500)..(500): n is a, c, g, or t
tcagtactctcgtgcacgaccggtgctcgatttagtgtcgtcgcaagagagagggggtcaggctggaactgaggagcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttanacagttccaacaatgaaaactacttagcttggtaccagcagagaccaggacagcctcctaggctgctcatttacngggcatctacccgggaatcccggggtccctgaccgattcagtggcagcgggtctgggacagatttcactctcaccatcagcagcctgcaggctgaagatgtggctagtttattattgtacaactaattattaattattacttcgtggtacgttcggacctaagggaccaaggtggatatanagacgaatgg

SEQ ID NO: 278284 - DNA, 513 bp, Homo sapiens
  misc_feature: GYAE6OF01EASSW.19.71.G05.1.454.CMB.1.raw
  modified_base (253)..(253): a, c, t, g, unknown or other
  misc_feature (253)..(253): n is a, c, g, or t
  modified_base (327)..(327): a, c, t, g, unknown or other
  misc_feature (327)..(327): n is a, c, g, or t
  modified_base (429)..(429): a, c, t, g, unknown or other
  misc_feature (429)..(429): n is a, c, g, or t
tcagtactctcgtgcacgaccggtgctcgatttagtgtcgtcgcaagagagagggggtcaggctggaactgaggaggtacaacaggcaggcaggggcagcaagatggtgttgcagacccaggtcttcatttctctgttgctctggatctctggtgcccacggggacatcgtgatgacccagtctccagactccctggctgtgtctctgggcagccgggccaccatcaactgcaagtccagccacaatctttanacagttaccaacaatagaaaactacttagcttggtaccagcagagaccaggacagcctcaggctgctcattacnggcatccgtaccggaatcccgggtccctgaccgtattcgagtggcaggcgggtctgggacagtactttcgactctacaccatcagcagcctgcagcagaagntgtgtctagtttatagtagtacaaatattattattatacttgtaggtcgttacggacgaaggtaccaaggtagatagtcgtaag

SEQ ID NO: 278285 - DNA, 678 bp, Homo sapiens
  misc_feature: GYAE6OF01DG1KL.19.71.G05.1.454.CMB.1.raw
  modified_base (236)..(236): a, c, t, g, unknown or other
  misc_feature (236)..(236): n is a, c, g, or t
  modified_base (281)..(281): a, c, t, g, unknown or other
  misc_feature (281)..(281): n is a, c, g, or t
  modified_base (314)..(314): a, c, t, g, unknown or other
  misc_feature (314)..(314): n is a, c, g, or t
tcagtactctcgtgcacgaccggtgctcgatttagtgtcgtcgcaagagagagggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatctttanacagttccaaacaatagaaaactacttagcttaggaccagcaganaccaggacagccctcaggctgctctatttacgnggcacgtccgaacccggagtcccgggtcctagaccgtattcgaggtcggcgaggtcgggtctagggactagtactttaccgacttcctaccgacctataccgacgacaccgtcctaggacgacgggtctaaggaaacgtgttgggtcgtacttttaaggttttaatttacgttacggtaacctaaaagttaaatttaacttttaaatttaacgttaccggtttcgggttacggttaacccggtttacccgggaaacccgtaaaacgggggtaacccgttaaagggggttacggtaactttaacgaccggtaaaacggtaaacccggttaaacgttggggtaccggtacccgttagggaaccccc

SEQ ID NO: 278286 - DNA, 502 bp, Homo sapiens
  misc_feature: GYAE6OF01EYTE6.19.71.G05.1.454.CMB.1.raw
  modified_base (313)..(313): a, c, t, g, unknown or other
  misc_feature (313)..(313): n is a, c, g, or t
  modified_base (407)..(407): a, c, t, g, unknown or other
  misc_feature (407)..(407): n is a, c, g, or t
  modified_base (410)..(410): a, c, t, g, unknown or other
  misc_feature (410)..(410): n is a, c, g, or t
  modified_base (498)..(498): a, c, t, g, unknown or other
  misc_feature (498)..(498): n is a, c, g, or t
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttatacagttccaacaatgaaaactacttagcttggtaccagcagagaccaggacagcctcctaggctgctcatttacnggcatctaccgggaatccggggtccctgaccgattcagtggcaggcggtctgggacagatttcactctcaccatcagcagcctgcagctgaagntgngctagtttatattgacaactaatattattatacttcgtaggtacgttcggacctaagggacctaagggtgatatcagtacgatgtggntgac

SEQ ID NO: 278287 - DNA, 501 bp, Homo sapiens
  misc_feature: GYAE6OF01EHSBH.19.71.G05.1.454.CMB.1.raw
  modified_base (408)..(408): a, c, t, g, unknown or other
  misc_feature (408)..(408): n is a, c, g, or t
  modified_base (482)..(482): a, c, t, g, unknown or other
  misc_feature (482)..(482): n is a, c, g, or t
  modified_base (496)..(496): a, c, t, g, unknown or other
  misc_feature (496)..(496): n is a, c, g, or t
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttatacagttccaacaatgaaaactacttagcttggtaccagcagagaccaggacagcctcctaggctgctcatttactgggcatctacccgggaatccggggtcctgaccgattcagtgcagcgggtctgggacagatttcactctcaccatcagcagcctgcaggctgaagntgtggctagtttattattgtcaactaattattattatacttgtgtacgttcggacaagggaccaaggtgatatnagtacgactgtcgntgacc

SEQ ID NO: 278288 - DNA, 441 bp, Homo sapiens
  misc_feature: GYAE6OF01BT5O6.19.71.G05.1.454.CMB.1.raw
  modified_base (434)..(441): a, c, t, g, unknown or other
  misc_feature (434)..(441): n is a, c, g, or t
tcagtactctcgtgcacgaccggtgctcgatttagtgtcgtcgcaagagagaggtctagagtggctgggaaggacatatttcatgtccaacacgtggaatacaaattatgcaccatctgttgagagtcgactgacaatcaacgtagacacatcgaagaaccagttctccctgcagctgacctctgtgactcccgaggacacgggtgtatattactgtggaagaggcccccatagacatgccacctcgtctctggtgctatattggggccagggaaccccatgtcaccgtctcctcggcctccaccaagggcccatcggtcttccccctggccgccctgctccaggacgcacctccgagagcacagcggccctgggctgcctggtcaaggactacttcccacgagagtactgagcgggctggcaaggcgcatagnnnnnnnn

SEQ ID NO: 278289 - DNA, 632 bp, Homo sapiens
  misc_feature: GYAE6OF01EXIIR.19.71.G05.1.454.CMB.1.raw
  modified_base (238)..(238): a, c, t, g, unknown or other
  misc_feature (238)..(238): n is a, c, g, or t
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttanacagttccaacaatgaaaactacttagcttggtaccagcagagaccaggacagcctctaggctgctcatttactgggcatctacccgggaatccggggtccctgaccgattcagtggcagcggtctggacagatttcactctcaccactcagcacgtccgtgacgacggtacgtagaaagtacgtcggtcggtacttaagttttaagtttagttacgtaacctaaactaaagtttaatttaacgttaacttaccgtttacgggtacggttaaccgggtttaccggaaacccggtaaacggggtaacccgtaaaggggttacggtaaacgttaactaccggtaaacggtaaacccggttaacggttacggttacgggtaccgtacggtaaccccg

SEQ ID NO: 278290 - DNA, 583 bp, Homo sapiens
  misc_feature: GYAE6OF01AN0H5.19.71.G05.1.454.CMB.1.raw
  modified_base (243)..(243): a, c, t, g, unknown or other
  misc_feature (243)..(243): n is a, c, g, or t
  modified_base (319)..(319): a, c, t, g, unknown or other
  misc_feature (319)..(319): n is a, c, g, or t
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccacggactacgacgtcgactaagccagccacaatctttanacattaccaacaatgaaactacttagcttggtaccagcagagaccaggacagcctcctaggctgctctatttacgnggcagtcgtacccgggaagtccggggtaccctgaccgattccgagtggcaggtcgggtctgggacagtactttcgacttctcaccatcaacgcagccctgacgacggactaggaagtagtggttcggtacttaagttttattacttagtacctaaacgttaaattatttattaactacgttcggttacggtacgttacggaccgtaaaggggtaacctagggtcgtaagtacgtacgtaacgacgtaacgtgcggtctggaccc

SEQ ID NO: 278291 - DNA, 539 bp, Homo sapiens
  misc_feature: GYAE6OF01CTJGZ.19.71.G05.1.454.CMB.1.raw
  modified_base (236)..(236): a, c, t, g, unknown or other
  misc_feature (236)..(236): n is a, c, g, or t
tcagtactctcgtgcacgaccggtgctcgatttagtgtcgtcgcaagagagagggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatctttanacagttccaacaatgaaaactacttagcttggtaccagcagagaccaggacagcctcctaggctgctcatttactgggcatctacccgggaatccggggtcctgaccgattcagtggcagcgggtctgggacagtattcactctcacatcagcagcctgcagctagaagatggtgctagtttattattagtactaaactaattattaattattacttcggtaggtacgtttccggacctaaaggggtaccaagggtagggtactaagtacgaagaacggtaaactggtacggcgttggaaccc

SEQ ID NO: 278292 - DNA, 451 bp, Homo sapiens
  misc_feature: GYAE6OF01BJQOW.19.71.G05.1.454.CMB.1.raw
  modified_base (444)..(451): a, c, t, g, unknown or other
  misc_feature (444)..(451): n is a, c, g, or t
tcagtactctcgtgcacgaccggtgctcgatttagtgtcgtcgcaagagagaggtctagagtggctgggaaggacatatttcatgtccaacacgtggaatacaaattatgcaccatctgttgagagtcgactgacaatcaacgtagacacatcgaagaaccagttctccctgcagctgacctctgtgactcccgaggacacgggtgtatattactgtggaagaggcccccatagacatgccacctcgtctctggtgctatattggggccagggaacccatgtcaccgtctcctcggcctccaccaagggcccatccggtccttccccctggccgcccctgcctccaggacgccaccctccgagacgccacacgccggcccctgggctgcctggtcaaggactacttcccacgagagtactgagcgggctggcaaggcgcatagnnnnnnnn

SEQ ID NO: 278293 - DNA, 616 bp, Homo sapiens
  misc_feature: GYAE6OF01BB9MD.19.71.G05.1.454.CMB.1.raw
  modified_base (196)..(196): a, c, t, g, unknown or other
  misc_feature (196)..(196): n is a, c, g, or t
  modified_base (211)..(211): a, c, t, g, unknown or other
  misc_feature (211)..(211): n is a, c, g, or t
  modified_base (213)..(213): a, c, t, g, unknown or other
  misc_feature (213)..(213): n is a, c, g, or t
  modified_base (224)..(224): a, c, t, g, unknown or other
  misc_feature (224)..(224): n is a, c, g, or t
  modified_base (228)..(228): a, c, t, g, unknown or other
  misc_feature (228)..(228): n is a, c, g, or t
  modified_base (234)..(234): a, c, t, g, unknown or other
  misc_feature (234)..(234): n is a, c, g, or t
  modified_base (243)..(243): a, c, t, g, unknown or other
  misc_feature (243)..(243): n is a, c, g, or t
  modified_base (260)..(260): a, c, t, g, unknown or other
  misc_feature (260)..(260): n is a, c, g, or t
  modified_base (286)..(286): a, c, t, g, unknown or other
  misc_feature (286)..(286): n is a, c, g, or t
  modified_base (295)..(295): a, c, t, g, unknown or other
  misc_feature (295)..(295): n is a, c, g, or t
  modified_base (329)..(329): a, c, t, g, unknown or other
  misc_feature (329)..(329): n is a, c, g, or t
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctggcgnggcggcgcagcgacnanagcagcacatnttancatcanatgaaactntagcttgaccagcaganaccaggacagcctcctaggctgcctntagttacgnggacataccgaccgggagtccgggtcctgacgtnttacgagtcggcgacggcgggtcgtacggacgtacgtacttactactctcctacctactacacgacgacgtccgtacgacgacgacgtacgaagtagtacgtcggtacgttagtttattagttacgttactaacttaattaatttaactttaacttacgttttttttttttttttttttttacggttacggttaccggttacggtaaccggtaaacgggtaaccggtaagggtaggtacgttaacgtacgaacggtaaccggtaacgtaggtacggtcgtacgtacg

SEQ ID NO: 278294 - DNA, 346 bp, Homo sapiens
  misc_feature: GYAE6OF01EUCCX.19.71.G05.1.454.CMB.1.raw
  modified_base (339)..(346): a, c, t, g, unknown or other
  misc_feature (339)..(346): n is a, c, g, or t
tcagtactctcgtgcacgaccggtgctcgatttagtgtcgtcgcaagagagagggggagagtctgctgaattctggctgaccagggcagtcaccagagctccagacaatgtctgtctccttcctcttctcccagcccccatagacatgccacctcgtctctggtgctatattggggccagggaacccatgtcaccgtctcctcggcctccaccaagggcccatcggtctccccctggcgccctgctccaggagcacctccgagagcacagcggccctgggctgcctggtcaaggactacttcccacgagagtactgagcgggctggcaaggcgcatagnnnnnnnn

SEQ ID NO: 278295 - DNA, 155 bp, Homo sapiens
  misc_feature: GYAE6OF01CTPUO.19.71.G05.1.454.CMB.1.raw
  modified_base (152)..(155): a, c, t, g, unknown or other
  misc_feature (152)..(155): n is a, c, g, or t
tcagtactctcgtgcacgaccggtgctcgatttagtgtcgtcgcaagagagaggggaagaggaagactgacggtcctgccacagcggccctgggctgcctggtcaagactacttcccacgagagtactgagcgggctggcaaggcgcatagnnnn

SEQ ID NO: 278296 - DNA, 230 bp, Homo sapiens
  misc_feature: GYAE6OF01CKKAP.19.71.G05.1.454.CMB.1.raw
  modified_base (219)..(230): a, c, t, g, unknown or other
  misc_feature (219)..(230): n is a, c, g, or t
tcagtactctcgtgcacgaccggtgctcgatttagtgtcgtcgcaagagagagggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggctggcaaggcgcagtagnnnnnnnnnnnn

SEQ ID NO: 278297 - DNA, 228 bp, Homo sapiens
  misc_feature: GYAE6OF01CMX92.19.71.G05.1.454.CMB.1.raw
  modified_base (214)..(214): a, c, t, g, unknown or other
  misc_feature (214)..(214): n is a, c, g, or t
  modified_base (219)..(228): a, c, t, g, unknown or other
  misc_feature (219)..(228): n is a, c, g, or t
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggctggcaaggcgnatagnnnnnnnnnn

SEQ ID NO: 278298 - DNA, 569 bp, Homo sapiens
  misc_feature: GYAE6OF01D7ADJ.19.71.G05.1.454.CMB.1.raw
  modified_base (233)..(233): a, c, t, g, unknown or other
  misc_feature (233)..(233): n is a, c, g, or t
  modified_base (241)..(241): a, c, t, g, unknown or other
  misc_feature (241)..(241): n is a, c, g, or t
  modified_base (310)..(310): a, c, t, g, unknown or other
  misc_feature (310)..(310): n is a, c, g, or t
  modified_base (360)..(360): a, c, t, g, unknown or other
  misc_feature (360)..(360): n is a, c, g, or t
  modified_base (369)..(369): a, c, t, g, unknown or other
  misc_feature (369)..(369): n is a, c, g, or t
  modified_base (411)..(411): a, c, t, g, unknown or other
  misc_feature (411)..(411): n is a, c, g, or t
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagacctccctggctgtgtctcgtgggcgacggcgggccaccagtcaactgacagtccagccanatctttanacattcaacaatagaaaactctagcttggaaccagcagagaccagcagcctcgagctgctcatttacgnggcatccgaccgggatccgggtcctgacgtattcgagtcgcaggcggtcngggacagtnttcactctaccacatcagcacgcctgacgaagctagaaagtntcggtgtacttaaggtttacttacgttacgtaactaaacttaattactttaattacgttaaccgttggtacgggtaaccgtttcgggaaccgtaaaggaccgtaagggtcgtaaacgttacgtacgaacgtaacgaacgtggtacggtctaggtaccc

SEQ ID NO: 278299 - DNA, 542 bp, Homo sapiens
  misc_feature: GYAE6OF01C2Q5T.19.71.G05.1.454.CMB.1.raw
  modified_base (238)..(238): a, c, t, g, unknown or other
  misc_feature (238)..(238): n is a, c, g, or t
  modified_base (408)..(408): a, c, t, g, unknown or other
  misc_feature (408)..(408): n is a, c, g, or t
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaattctttanacagttccaacaatgaaaactacttagcttggtaccagcagagaccaggacagcctcctagctgctcatttactgggcatctacccgggaatccggggtcctgaccgtatcagtgcagcgggtctggacagtattcgactctcaccatcgagcagcctgcagctgaacgntgtgctagtttatagttgactaaactatattatttactacttcgttaggtaccgttcggaccgaaaggggtacctaaagggttcggaaattaacgtacgaagtaaccgtaacgttggtacggtcctggtaaccc

SEQ ID NO: 278300 - DNA, 516 bp, Homo sapiens
  misc_feature: GYAE6OF01BYTYL.19.71.G05.1.454.CMB.1.raw
  modified_base (237)..(237): a, c, t, g, unknown or other
  misc_feature (237)..(237): n is a, c, g, or t
tcagtactctcgtgcacgaccggtgctcgatttagtgtcgtcgcaagagagagggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttanacagttccaacaatgaaaactacttagcttggtaccagcagagaccaggacagcctcctaggctgctcatttactgggcatctacccgggaatccggggtccctgaccgattcagtggcagcgggtctgggacagatttcactctcaccatcagcagcctagcctaggctgaacgatggtggctagtttattattagtcaaactaattattattatacttcgtgtacgttcgccgtaagggcctaagggtgatatcagacgaactggtaggctggtacc

SEQ ID NO: 278301 - DNA, 547 bp, Homo sapiens
  misc_feature: GYAE6OF01CZ0RE.19.71.G05.1.454.CMB.1.raw
  modified_base (532)..(532): a, c, t, g, unknown or other
  misc_feature (532)..(532): n is a, c, g, or t
tcagtactctcgtgcacgaccggtgctcgatttagtgtcgtcgcaagagagagggggtcaggctggaactgaggagcaggcaggggcagcaagatggtgttgcagacccaggtcttcatttctctgttgctctggatctctggtgcccacggggacatcgtgatgacccagtctccagacctccctggctgtgtctctgggcgagccgggccaccatcaactgcaagtccagccacaatcttttaatacagttaccaacaatagaaaactacttagcttggtaccagcagagaccaggacagcctcaggctgctcattacgtggcactccgtacccgggaacgtcccggggtccctggaaccgtattcgaggtcgcgaggtcggtcgtgggactagtacttcactctacactatcagcacgtcctcgcaggctagaagtgtgtgactagtttattatagtactaactattaatttattatacgttagtggtacgttcggaccgaagggtaccgtaaagggttgaatacgtanaacgaacgtaagtgg

SEQ ID NO: 278302 - DNA, 569 bp, Homo sapiens
  misc_feature: GYAE6OF01CQHOZ.19.71.G05.1.454.CMB.1.raw
  modified_base (238)..(238): a, c, t, g, unknown or other
  misc_feature (238)..(238): n is a, c, g, or t
  modified_base (316)..(316): a, c, t, g, unknown or other
  misc_feature (316)..(316): n is a, c, g, or t
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaattctttanacagttccaacaatagaaaactacttaagcttaggtaccagcagagaccaggacagcctcctaggctgctcatttacngggcatccgtacccgggaatcccggggtcctgaccgattcagtggcaggcgggtctgggacagtactttcactctcacctatcagcagcctgcaggctagaagatgtggctagtttattattagtactaaacgtaattatttaattattacgtttacggtggtaaccgttccggaccgtaaaaggggtaccctaaaggggttggtaattagtacgaaggtaaccgtaaaccgttgggtacggtcgtggtaccc

SEQ ID NO: 278303 - DNA, 517 bp, Homo sapiens
  misc_feature: GYAE6OF01CW35L.19.71.G05.1.454.CMB.1.raw
  modified_base (242)..(242): a, c, t, g, unknown or other
  misc_feature (242)..(242): n is a, c, g, or t
  modified_base (324)..(324): a, c, t, g, unknown or other
  misc_feature (324)..(324): n is a, c, g, or t
  modified_base (429)..(429): a, c, t, g, unknown or other
  misc_feature (429)..(429): n is a, c, g, or t
  modified_base (512)..(512): a, c, t, g, unknown or other
  misc_feature (512)..(512): n is a, c, g, or t
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccgacggggacatcgtgatcgacccagtctccagacctccctggctgtgtctctgggcgagcgggccaccatcaactgcaagtccagccactaattctttanacagttaccaaactaatagaaaactacttaagcttaggtaccagcagacgaccaggacagcctcctaggctgctcatttacnggcatccgtaacccgggatcccggggtcctgaccgtatcaggtggcaggcgggtctgggacagtactttcactctaccactatcagcagccctgcaggctgaagntggtgctagtttattatgtacaataatattatatactgtgtacgtcgacgaaggacaggtgatacgacaggacaactggcgtntgacc

SEQ ID NO: 278304 - DNA, 616 bp, Homo sapiens
  misc_feature: GYAE6OF01BHK0Z.19.71.G05.1.454.CMB.1.raw
  modified_base (238)..(238): a, c, t, g, unknown or other
  misc_feature (238)..(238): n is a, c, g, or t
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttanacagttaccaacaatagaaaactacttagcttggtaccagacagagaccaggacacgcctcctaggctgctctatttactgggcatcctacccgggaactccggggtccctgaccgattcgagtcggcaggccgggtctcgggacaggtactttcaccgttcctcaccatccgaagccacgcctgacgacggctacgaagattggtaggtactagttttattagttacgtactaaacgtaattatttaattaacttacgtttcggtaggtaaccgtttcgggtaaacccgtaaacggggtaacccgtaaagggttacggtaacgttaacgtaccgaaacggtaaccggtaaacgtttggtacgggtcctagggtaccc

SEQ ID NO: 278305 - DNA, 530 bp, Homo sapiens
  misc_feature: GYAE6OF01DELT3.19.71.G05.1.454.CMB.1.raw
  modified_base (316)..(316): a, c, t, g, unknown or other
  misc_feature (316)..(316): n is a, c, g, or t
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaattctttatacagttaccaaacaatagaaaactacttagcttaggtaccagcagagaccaggacagcctctaggctgctcatttacngggcatcgtacccgggaatccggggtcctgaccgattcaggtggcaggcgggtctgggacagtatttcactctcaccatcagcagcctgcagctagaatagtgtgactagttttatattgtacaaactaattatttaattagtacgttcggtaggtaccgttacggacgaaagggacctaagggtgatatcgaagtacgtaactggtgctgacc

SEQ ID NO: 278306 - DNA, 572 bp, Homo sapiens
  misc_feature: GYAE6OF01AXH68.19.71.G05.1.454.CMB.1.raw
  modified_base (239)..(239): a, c, t, g, unknown or other
  misc_feature (239)..(239): n is a, c, g, or t
  modified_base (323)..(323): a, c, t, g, unknown or other
  misc_feature (323)..(323): n is a, c, g, or t
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaattcttttanacagttccaaataatagaaaacttacttagcttaggtaccagcagagaccaggacacgcctaccgtaggctgctctatttacgngggcatcgtacccgggaatccggggtccctgaccgtatcgagtcggcaggcgggtctagggacagtactttcactctacacatcagcagcctgcaggctagaagtatggtgtactagttttaatagttagtactaaactaattatttaattattacgttcggtaggtaaccggttcggaacccgaaaggggtaccgtaaagggtcggtaatacgtacgaacggtaccgtaactggtcggcgttgacccg

SEQ ID NO: 278307 - DNA, 519 bp, Homo sapiens
  misc_feature: GYAE6OF01BJJA2.19.71.G05.1.454.CMB.1.raw
  modified_base (237)..(237): a, c, t, g, unknown or other
  misc_feature (237)..(237): n is a, c, g, or t
  modified_base (407)..(407): a, c, t, g, unknown or other
  misc_feature (407)..(407): n is a, c, g, or t
  modified_base (410)..(410): a, c, t, g, unknown or other
  misc_feature (410)..(410): n is a, c, g, or t
tcagtactctcgtgcacgaccggtgctcgatttagtgtcgtcgcaagagagagggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttanacagttccaacaatgaaaactacttagcttggtaccagcagagaccaggacagcctcctagctgctcatttactgggcatctacccgggaatccggggtccctgaccgattcagtggcagcgggtctgggacagatttcactctcaccatcagcagcctgcagctgaacntgnggctagtttatattagtacaataattatttaattactacttcgtaggtacgttacggaccgtaagggacctaaggtaggtatagtcaagtacgaacttggtgcgtgacc

SEQ ID NO: 278308 - DNA, 520 bp, Homo sapiens
  misc_feature: GYAE6OF01DHRPR.19.71.G05.1.454.CMB.1.raw
  modified_base (236)..(236): a, c, t, g, unknown or other
  misc_feature (236)..(236): n is a, c, g, or t
  modified_base (373)..(373): a, c, t, g, unknown or other
  misc_feature (373)..(373): n is a, c, g, or t
  modified_base (414)..(414): a, c, t, g, unknown or other
  misc_feature (414)..(414): n is a, c, g, or t
  modified_base (500)..(500): a, c, t, g, unknown or other
  misc_feature (500)..(500): n is a, c, g, or t
tcagtactctcgtgcacgaccggtgctcgatttagtgtcgtcgcaagagagagggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatctttanacagttccaacaatagaaaactacttagcttggtaccagcagagaccaggacagcctcctaggctgctcatttactgggcatccgtacccgggaatccggggtccctgaccgattcagtggcagcgggtctgggacngtatttcactctccacatcagcagcctgcagctagaacgtntgtggctagttttattattagtacaaactaattatttattattacttcgtgtaccgttcggactaagggacctaagggtgatacgnaacgacgaactgtgctgacc

SEQ ID NO: 278309 - DNA, 541 bp, Homo sapiens
  misc_feature: GYAE6OF01ES2B3.19.71.G05.1.454.CMB.1.raw
  modified_base (317)..(317): a, c, t, g, unknown or other
  misc_feature (317)..(317): n is a, c, g, or t
  modified_base (370)..(370): a, c, t, g, unknown or other
  misc_feature (370)..(370): n is a, c, g, or t
  modified_base (416)..(416): a, c, t, g, unknown or other
  misc_feature (416)..(416): n is a, c, g, or t
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttatacagttccaacaatagaaaactacttagcttaggtaccagcaagagaccaggacacgcctcctaggctgctcatttacnggctatccgtacccgggaatccgggtccctgaccgattcagtgcaggcggtcngggacagtatttcactctcaccatcagcagcctgcagctagaagtntgtgtctagtttatagttagtactaataattatttattactacgttcgtaggtacgttcggaccgtaaagggtacctaagggtcggaattactacgaagtacgtaacgtggtacggcgtgacccg

SEQ ID NO: 278310 - DNA, 502 bp, Homo sapiens
  misc_feature: GYAE6OF01BTUZB.19.71.G05.1.454.CMB.1.raw
  modified_base (221)..(221): a, c, t, g, unknown or other
  misc_feature (221)..(221): n is a, c, g, or t
  modified_base (467)..(467): a, c, t, g, unknown or other
  misc_feature (467)..(467): n is a, c, g, or t
tcagtactctcgtgcacgaccggtgctcgatttagtgtcgtcgcaagagagagggggagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaagccctcgcagaccctntcgctcacctgtgccatctcaggggacagagtcgctagcgacagtgtgcttggcactggtcaggcagtccccatcgagaggtctagagtggctgggaagacatatttcatgtaccaacacgtaggaataacaaattatcgacaccatctgttgagagtcgactgacaatacaacgtagacacatacgaagaaccagttcctaccctcgcagcctgacctctgtcgactcccgacggactacgggtntacttattacgtgtaggaagacggccccagtaacg

SEQ ID NO: 278311 - DNA, 528 bp, Homo sapiens
  misc_feature: GYAE6OF01D4ML4.19.71.G05.1.454.CMB.1.raw
  modified_base (361)..(361): a, c, t, g, unknown or other
  misc_feature (361)..(361): n is a, c, g, or t
tcagtactctcgtgcacgaccggtgctcgatttagtgtcgtcgcaagagagagggggagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaagccctcgcagaccctctcgctcacctgtgccatctccggggacagagtcgctagcgacagtgttgcttggcacgtgggtcaggcacgtcccatcgagaggtctagagtggcgtggggaaggactatattcatgtccaacacgtgaatacaaattangcacatctgtgagagtcgactgacaatacaacgtagacacatacgaacgaacacgttacctcccgtgacacgtctcgaccttcgtcgtcgaccgtcccggacggtaccgtacgggttagtacttacgttacgtaggtacggaacggaccggaccccagtacgtaacg

SEQ ID NO: 278312 - DNA, 592 bp, Homo sapiens
  misc_feature: GYAE6OF01BGYMB.19.71.G05.1.454.CMB.1.raw
  modified_base (315)..(315): a, c, t, g, unknown or other
  misc_feature (315)..(315): n is a, c, g, or t
tcagtactctcgtgcacgaccggtgctcgatttagtgtcgtcgcaagagagagggggaggtacaacaggcaggcaggggcagcaagatggtgttgcagacccaggtcttcatttctctgttgctctggatctctggtgcccgacggggacatcgtgatcgacccagtctccagactccctggctgtgtctctgggcgagcgggccacatcaactgcaacgtccagccacaattctttaacagttaccaacaatagaaaactcttagcttaggtaccagcagagaccaggacagcctctaggctgctcatttacgnggcatccgtaacccgggatccggggtcctgaccgtattcgagtcgcaggcggtctcgggatagtactttcgactctaccacatcaagcagccctgcgaggctaggaagtatgtcggacttagttttatatttacggtactaaacgtaaatttaagtttattaacttacgtttaggtagggttacccgttcgggaacccgtaaacggggtaacctaaggggttcggtaaagttacttacggagttaaaccggtaacttgggtacgcgttacggtaccc

SEQ ID NO: 278313 - DNA, 515 bp, Homo sapiens
  misc_feature: GYAE6OF01DA9QQ.19.71.G05.1.454.CMB.1.raw
  modified_base (415)..(415): a, c, t, g, unknown or other
  misc_feature (415)..(415): n is a, c, g, or t
  modified_base (510)..(510): a, c, t, g, unknown or other
  misc_feature (510)..(510): n is a, c, g, or t
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttatacagttccaaacaatagaaaactacttaagcttggtaccagcagagaccagacagcctcctaggctgctcattactgggcatcgtacccgggaagtccggggtccctgaccgattcagtggcagcgggtctgggacagtattcactctcacatcagcacgcctgacgagctagaagntggtggactagtttattattgtacaaactattattattatacttgtggtacgtcggacaagggaccgtaaggtgatatcgagtacgactggtcgntgacc

SEQ ID NO: 278314 - DNA, 509 bp, Homo sapiens
  misc_feature: GYAE6OF01CASBD.19.71.G05.1.454.CMB.1.raw
  modified_base (237)..(237): a, c, t, g, unknown or other
  misc_feature (237)..(237): n is a, c, g, or t
tcagtactctcgtgcacgaccggtgctcgatttagtgtcgtcgcaagagagagggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttanacagttccaacaatgaaaactacttagcttggtaccagcagagaccaggacagcctcctaggctgctcatttactgggcatctacccgggaatccggggtcctgaccgattcagtggcagcgggtctgggacagatttcactctcaccatcagcagcctgcaggctgaagatgtggctagtttattattgtcaaactaattatttattatacttcgtggtacgttcggacctaagggaccaagggtggatatcagtacgaatgtggctgacc

SEQ ID NO: 278315 - DNA, 560 bp, Homo sapiens
  misc_feature: GYAE6OF01DWUOM.19.71.G05.1.454.CMB.1.raw
  modified_base (236)..(236): a, c, t, g, unknown or other
  misc_feature (236)..(236): n is a, c, g, or t
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcggccaccatcaactgcaagtccagccacaatctttanacagttccaacaatgaaaactacttagcttggtaccagcagacgaccaggacagcctcctaggctgctcatttactggcatctacccggatcccgggtcctgaccgattcagtggcagcggtctgggacagatttcactctcacatcagcagcctgcagggctagaagatgtggactagtttattattgtacaaactaattatttaattactacgttcgtaggtaacggtttccggacccgtaaaggggtacctaaaggggtcggtaaagttacgtaccgaaggtaaacccggttaacgtaggttacgggtcctaggtaacccg

SEQ ID NO: 278316 - DNA, 536 bp, Homo sapiens
  misc_feature: GYAE6OF01C2ME5.19.71.G05.1.454.CMB.1.raw
  modified_base (238)..(238): a, c, t, g, unknown or other
  misc_feature (238)..(238): n is a, c, g, or t
  modified_base (315)..(315): a, c, t, g, unknown or other
  misc_feature (315)..(315): n is a, c, g, or t
  modified_base (416)..(416): a, c, t, g, unknown or other
  misc_feature (416)..(416): n is a, c, g, or t
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagccgggccaccatcaactgcaagtccagccacaatctttanacagttccaaacaatagaaaactacttagcttggtaccagcagagaccaggacagcctcctaggctgctcatttacngggcatcctacccgggaatccggggtcctgaccgattcgagtggcaggcgggtctgggacagtatttcactctcaccatcagcagcctgcaggctagaagntgtggctagttttatattgtacaaactaattatttattattacgttcgtggtacgttccggaccgaaaggggtaccaagggttggaattacgtcgaagacgtaactggtacggctgaccc

SEQ ID NO: 278317 - DNA, 550 bp, Homo sapiens
  misc_feature: GYAE6OF01DJD5M.19.71.G05.1.454.CMB.1.raw
  modified_base (372)..(372): a, c, t, g, unknown or other
  misc_feature (372)..(372): n is a, c, g, or t
tcagtactctcgtgcacgaccggtgctcgatttagtgtcgtcgcaagagagagggggagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactgggtgaacgccctcgcagaccctctcgctcacctgtgccatcgtccggggacagagtcgctagcgacagtgttgcttggcacgtgggtcaggcacgtcccagtcgagaggtctagagtggcgtagggaaggactatatttcatgtaccaacgacgtaggaatacaaaatttanacgacacctatctagttgagtagtcgaactagaactaatacaacgtagacacactacgaagtaacctacgttcctaccctgtacacgtcgtacgtacctctgtacgaccgtaccggacggacgtacgggttagtagttacgttacgtaggtacggaacgaccggaccccagtcgtaac

SEQ ID NO: 278318 - DNA, 504 bp, Homo sapiens
  misc_feature: GYAE6OF01B22OX.19.71.G05.1.454.CMB.1.raw
  modified_base (237)..(237): a, c, t, g, unknown or other
  misc_feature (237)..(237): n is a, c, g, or t
  modified_base (498)..(498): a, c, t, g, unknown or other
  misc_feature (498)..(498): n is a, c, g, or t
tcagtactctcgtgcacgaccggtgctcgatttagtgtcgtcgcaagagagagggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttanacagttccaacaatgaaaactacttagcttggtaccagcagagaccaggacagcctcctaggctgctcattactgggcatctacccgggaatccggggtccctgaccgattcagtggcaggcgggtctgggacagtatttcactctcaccatcagcagcctgcaggctgaagtatgtgctagtttattattagtacaataattattattatacttcgtgtacgttcgaccgtaagggcctaaggtgatatcagacgactgngctgcc

SEQ ID NO: 278319 - DNA, 502 bp, Homo sapiens
  misc_feature: GYAE6OF01ARW0W.19.71.G05.1.454.CMB.1.raw
  modified_base (238)..(238): a, c, t, g, unknown or other
  misc_feature (238)..(238): n is a, c, g, or t
  modified_base (312)..(312): a, c, t, g, unknown or other
  misc_feature (312)..(312): n is a, c, g, or t
  modified_base (410)..(410): a, c, t, g, unknown or other
  misc_feature (410)..(410): n is a, c, g, or t
  modified_base (498)..(498): a, c, t, g, unknown or other
  misc_feature (498)..(498): n is a, c, g, or t
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacgggaacatcgtgatgacccagtacccagactcactggctgtgtctctgggcgagacggccacaatcaactgcaggtccagccagaacattttcnccacctccaagaacaaaacttcttagcctggtaccaacagagaccaggacagcctcctaagttgctcatttacngggcttctacgcgcgaattcggggtccctgaccgagttccggggcaggcgggtctgggacagatttcactctcaccatcagcagcctgcagctgaagntgtgctagtttattctgtcagtcaattattttctatcctcgtggcttcggcaaggccagggtgaatcgagacgactgtggctgacacntctg

SEQ ID NO: 278320 - DNA, 569 bp, Homo sapiens
  misc_feature: GYAE6OF01BMR2H.19.71.G05.1.454.CMB.1.raw
  modified_base (238)..(238): a, c, t, g, unknown or other
  misc_feature (238)..(238): n is a, c, g, or t
  modified_base (314)..(314): a, c, t, g, unknown or other
  misc_feature (314)..(314): n is a, c, g, or t
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttanacagttccaaacaatagaaaactacttagcttggtaccagcagagaccaggacagcctctaggctgctcatttacngggctatcctacccgggaatccggggtccctgaccgtattcagtggcaggcgggtcgtgggactaggactttcactctcacctatcagtcagcctgcaggctagaacgatgtggtactagtttatattgtacaactaattatttaattactacgttcgtacggtacgttaccggaaccgtaacggggtaacctaagggtacggtaattaacgttacgaaacggtacgtaaacgttggtacggtctcgggtaaccc

SEQ ID NO: 278321 - DNA, 550 bp, Homo sapiens
  misc_feature: GYAE6OF01CG42U.19.71.G05.1.454.CMB.1.raw
  modified_base (229)..(229): a, c, t, g, unknown or other
  misc_feature (229)..(229): n is a, c, g, or t
  modified_base (239)..(239): a, c, t, g, unknown or other
  misc_feature (239)..(239): n is a, c, g, or t
  modified_base (377)..(377): a, c, t, g, unknown or other
  misc_feature (377)..(377): n is a, c, g, or t
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctcgtgggcgagcgggccaccatcaactgcaagtccagccanaatcttttanacagttcaacaatagaaactacttagcttggtaccagcagagaccgaggacagcctcctaggctgctctatttacgtgggcatacgtacccgggaagtcccggggtccctggaccgtatcgagtgcgaggtcgggtcngggactagtacttcactcgtaccacctatcaagcaacgcctgcacggtctaggaagatggtgtctagtttacttattagtactaactaattattattatacttgtaggtacgttcggaccgaagggtaccgtaaggtggtaatagtacgaagtacgaactgcggtctgtaccg

SEQ ID NO: 278322 - DNA, 517 bp, Homo sapiens
  misc_feature: GYAE6OF01DNWN3.19.71.G05.1.454.CMB.1.raw
  modified_base (238)..(238): a, c, t, g, unknown or other
  misc_feature (238)..(238): n is a, c, g, or t
  modified_base (315)..(315): a, c, t, g, unknown or other
  misc_feature (315)..(315): n is a, c, g, or t
  modified_base (396)..(396): a, c, t, g, unknown or other
  misc_feature (396)..(396): n is a, c, g, or t
  modified_base (417)..(417): a, c, t, g, unknown or other
  misc_feature (417)..(417): n is a, c, g, or t
  modified_base (433)..(433): a, c, t, g, unknown or other
  misc_feature (433)..(433): n is a, c, g, or t
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttanacagttccaacaatagaaaactacttagcttaggtaccagcagagaccaggacagcctcctaggctgctcatttcgnggcatccgtacccgggaatcccggggtccctgaccgtattcgagtggcaggcgggtctgggacagtatttcactctcaccntcagcagcctgcagctagaantgtgacttagtttatnttgtactaataattattaattatacttcgtgtacgttcgacgtaagggcctaaggtgatagtcgaagtacgactgtgctgtacc

SEQ ID NO: 278323 - DNA, 528 bp, Homo sapiens
  misc_feature: GYAE6OF01EVMZC.19.71.G05.1.454.CMB.1.raw
  modified_base (314)..(314): a, c, t, g, unknown or other
  misc_feature (314)..(314): n is a, c, g, or t
  modified_base (418)..(418): a, c, t, g, unknown or other
  misc_feature (418)..(418): n is a, c, g, or t
  modified_base (521)..(521): a, c, t, g, unknown or other
  misc_feature (521)..(521): n is a, c, g, or t
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttatacagttccaacaatagaaaactacttagcttggtaccagcagagaccaggacagcctcctaggctgctcatttacngggcatccgtacccgggaactcccggggtccctgaccgattcagtggcaggcgggtctgggacagatttcactctacaccatcagcagcctgcaggctagaagntggtggactagtttattattgtacaaactaattatttattattacttcgtaggtacgttcggaccgtaagggtaccaagggtgatagtcaagtacgaactggngctgacc

SEQ ID NO: 278324 - DNA, 566 bp, Homo sapiens
  misc_feature: GYAE6OF01EEVVN.19.71.G05.1.454.CMB.1.raw
  modified_base (242)..(242): a, c, t, g, unknown or other
  misc_feature (242)..(242): n is a, c, g, or t
  modified_base (330)..(330): a, c, t, g, unknown or other
  misc_feature (330)..(330): n is a, c, g, or t
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtcgcccacggggacatcgtgatgacccagtctccagactccctggctgtgtctcgtgggcgaggcgggccacatacaactgacaagtccagccacaattctttanactacgttccaaactaatacgaaaaccttacttagtcttaggtaccagacagacgaccaggacacgcctcgtaggctgctctattacnggcatccgtaccggacgtccgggtcctagaccgtattcgaggtcgcgaggcggtcgtgggacagtattcactctacacatcacgcacgcctgcaggtctagaagatgtcgtacttagtttatatgtactaaactaattaattattacttacgttacgtacggtacgttccggaaccgtaagggtacctaagggtggtaactaacgtacgaacggtacgtaacgtggtcgcgtgacc

SEQ ID NO: 278325 - DNA, 509 bp, Homo sapiens
  misc_feature: GYAE6OF01EQW01.19.71.G05.1.454.CMB.1.raw
  modified_base (320)..(320): a, c, t, g, unknown or other
  misc_feature (320)..(320): n is a, c, g, or t
  modified_base (413)..(413): a, c, t, g, unknown or other
  misc_feature (413)..(413): n is a, c, g, or t
  modified_base (421)..(421): a, c, t, g, unknown or other
  misc_feature (421)..(421): n is a, c, g, or t
  modified_base (424)..(424): a, c, t, g, unknown or other
  misc_feature (424)..(424): n is a, c, g, or t
  modified_base (438)..(438): a, c, t, g, unknown or other
  misc_feature (438)..(438): n is a, c, g, or t
tcagtactctcgtgcacgaccggtgctcgatttagtgtcgtcgcaagagagagggggtcaggctggaactgaggagcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgacaagtccagccacaatctttatacagttccaacaatgaaaactacttaagcttggtaccagcagagaccaggacagcctcctaggctgctcatttacngggcagtcgtacccgggaatcccgggtccctgaccgattcagtggcaggcgggtctgggacagtatttccactctcaccatcagcagcctgcngctgaagntgngctagtttattatntacaatatattattatacttgtggtacgttcggactaagggaccaaggtcggtatatacagacgtagtagg

SEQ ID NO: 278326 - DNA, 597 bp, Homo sapiens
  misc_feature: GYAE6OF01C5GD5.19.71.G05.1.454.CMB.1.raw
  modified_base (243)..(243): a, c, t, g, unknown or other
  misc_feature (243)..(243): n is a, c, g, or t
  modified_base (323)..(323): a, c, t, g, unknown or other
  misc_feature (323)..(323): n is a, c, g, or t
  modified_base (450)..(450): a, c, t, g, unknown or other
  misc_feature (450)..(450): n is a, c, g, or t
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagacctccctggctgtgtctcgtgggcgagcgggccaccatcaactgacaagtccagccactaattcttttanacagttaccaaacaatagaaaactacttagcttaggtaccagacagagaccaggacagcctctaggctgctcatttacgnggcagtaccgtacccgggaacgtcccggggtccctgaccgtattcgagtcggacaggcgggtcacggggactaggtactttccactcctaccgacctatccgagcacgcctgcacggctagaacgtntggtggacttaagttttattagttacgtacaaactaattactttaattaacttacgttcggtaggtacgttccggaccgaaacggggtacctaagggtagattacgtacgaacggtaaccgtaacgttggtcggtcgtcgtaacccg

SEQ ID NO: 278327 - DNA, 666 bp, Homo sapiens
  misc_feature: GYAE6OF01C7A8Z.19.71.G05.1.454.CMB.1.raw
  modified_base (243)..(243): a, c, t, g, unknown or other
  misc_feature (243)..(243): n is a, c, g, or t
  modified_base (289)..(289): a, c, t, g, unknown or other
  misc_feature (289)..(289): n is a, c, g, or t
  modified_base (325)..(325): a, c, t, g, unknown or other
  misc_feature (325)..(325): n is a, c, g, or t
  modified_base (457)..(457): a, c, t, g, unknown or other
  misc_feature (457)..(457): n is a, c, g, or t
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccgacggggacatcgtgatgacccagtctccagacctccctggctgtgtctcgtgggcgaggccgggccaccatcaactgacaagtccagccacattctttanacagttaccaaacaatagaaaactcttagcttggtaccagacaganaccaggacacgcctcgtaggctgcctactattacgngggactacgtaccgtaacccgggaagtccccgggggtcctagaccgtatcgagtcggcaggtcgggtctgggactagtactttcgactcctacaccgatacgacgctacgcctgacgaggactacggaaagngttggtacggtacgttacgtttagttaacgttcgtactagttactaagttttacttttttaccgtacttcccgttaccggttacggtaacccggttttaccggaacccgggttaaacggggtacccggtaaacggggttaacgggtaaactttaccgggaaacggtaaccggttaaaccggttggtaacgggacccgttcggtaacccg

SEQ ID NO: 278328 - DNA, 723 bp, Homo sapiens
  misc_feature: GYAE6OF01C81X2.19.71.G05.1.454.CMB.1.raw
  modified_base (246)..(246): a, c, t, g, unknown or other
  misc_feature (246)..(246): n is a, c, g, or t
  modified_base (332)..(332): a, c, t, g, unknown or other
  misc_feature (332)..(332): n is a, c, g, or t
tcagtactctcgtgcacgaccggtgctcgatttagtgtcgtcgcaagagagaggggggaggtacaacaggcaggcaggggcagcaagatggtgttgcagacccaggtcttcattttctctgttgctctggatctctggtgcccacggggacatcgtgatgacccagtctccagacctccctggctgtgtctcgtgggcgaggcggccaccatcaactgacaagtccagccaactaattcttttaanactacgttaccaaactaatagaaaactacttagcttaggtaccagcagagaccgaggacagcctacgtaggctgctacatttacgngggactacgtccgtaacccgggaacgttcccgggggtccctaggaaccgtagttcgaagggttcggacccgagggtcggggttccgtaggggtaaccgtacggtaacttttcccaaccgttccttaccgaaccctaataccgacggacaacggtccctacggccgtaacgggtccgttaggaaaacgtcgttaggttacgggtactttaaggtttttaacttaagtttaccgttacaaaacgttaaatttaattttaacgttaacttaccgtttacggttaggtaccggtttacccgggaaccgttaaacggggaaccggttaaagggtacggttaactaacgtaccggaaagttaaccggtaaacgttaggttacggcgtcgtaaccccg

SEQ ID NO: 278329 - DNA, 505 bp, Homo sapiens
  misc_feature: GYAE6OF01BZMO8.19.71.G05.1.454.CMB.1.raw
  modified_base (423)..(423): a, c, t, g, unknown or other
  misc_feature (423)..(423): n is a, c, g, or t
  modified_base (499)..(499): a, c, t, g, unknown or other
  misc_feature (499)..(499): n is a, c, g, or t
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttatacagttccaacaatgaaaactacttagcttggtaccagcagagaccaggacagcctcctaggctgctcatttactgggcatctacccgggaatccggggtccctgaccgattcagtggcagcgggtctgggacagattcactctcaccatcagcagcctgcaggctgagatgtgctagtttattnttagtcaactaatattattatacttcgtggtacgttcgccgtaagggcctaaggtggatatcagtacgaactgtgngtgacc

SEQ ID NO: 278330 - DNA, 618 bp, Homo sapiens
  misc_feature: GYAE6OF01CI4OE.19.71.G05.1.454.CMB.1.raw
  modified_base (377)..(377): a, c, t, g, unknown or other
  misc_feature (377)..(377): n is a, c, g, or t
tcagtactctcgtgcacgaccggtgctcgatttagtgtcgtcgcaagagagagggggagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaagccctcgcagacccctctcgctcacctgtcgccatccgtccggggacaggagtcgctagcgacagtgttgcttggcacgtgggtcaggcacgtcccagtcgagagtcagaggtggcgtagggaagactattacttcagtcgtaccaacgtacggtagaaactaactaaattntacgaccacctatcgttgttagaggtacggtacgtacgtacgaactaataaccgtaaacgtacgaacctaactaacgtaaccggaaacgtaaccgttacgttaccctaccgtacgtacgtacgtccttacgtacccttcgtcggtacgtacccgtacccgggaacggtaccggtacgggttagttacgttacgttaacgttcgggtaacgggacggacccggacccctagtaacgtaaccg

SEQ ID NO: 278331 - DNA, 553 bp, Homo sapiens
  misc_feature: GYAE6OF01DTQHI.19.71.G05.1.454.CMB.1.raw
  modified_base (237)..(237): a, c, t, g, unknown or other
  misc_feature (237)..(237): n is a, c, g, or t
  modified_base (315)..(315): a, c, t, g, unknown or other
  misc_feature (315)..(315): n is a, c, g, or t
  modified_base (545)..(545): a, c, t, g, unknown or other
  misc_feature (545)..(545): n is a, c, g, or t
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcggccacatcaactgcaagtccagccacaattctttaanacagttccaacaatagaaaactacttagcttggtaccagcagagaccaggacagcctcctaggctgctctatttacgngggcactaccgtacccgggaactccgggggtccctaggaccgtacttcgaggtcggacaggccgggtcgtgggactaggtactttcgactcctacaccatcacgcagcctgcaggctagagatggtgctagtttatattgtacaactaattattattatacttcgtagtacgttccggacgtaacgggtaccaaggtcgatacgtcgaacggtacgaacgttggacggtntgtacccg

SEQ ID NO: 278332 - DNA, 662 bp, Homo sapiens
  misc_feature: GYAE6OF01BQNXH.19.71.G05.1.454.CMB.1.raw
  modified_base (91)..(91): a, c, t, g, unknown or other
  misc_feature (91)..(91): n is a, c, g, or t
  modified_base (137)..(137): a, c, t, g, unknown or other
  misc_feature (137)..(137): n is a, c, g, or t
  modified_base (223)..(223): a, c, t, g, unknown or other
  misc_feature (223)..(223): n is a, c, g, or t
  modified_base (231)..(231): a, c, t, g, unknown or other
  misc_feature (231)..(231): n is a, c, g, or t
  modified_base (242)..(242): a, c, t, g, unknown or other
  misc_feature (242)..(242): n is a, c, g, or t
  modified_base (262)..(262): a, c, t, g, unknown or other
  misc_feature (262)..(262): n is a, c, g, or t
  modified_base (277)..(277): a, c, t, g, unknown or other
  misc_feature (277)..(277): n is a, c, g, or t
  modified_base (303)..(303): a, c, t, g, unknown or other
  misc_feature (303)..(303): n is a, c, g, or t
tcagtactctcgtgcacgaccggtgctcgatttagtgtcgtcgcaagagagagggggaggtacaacaggcaggcagggcagcaagatggtnttgcagacccaggtcttcatttctctgttgctctggatctctggtncccaggggcatcgtgatgacccagtctcagactcctggctgtgtctctgggcgagcgggccacgatcgaactgcaagtccagccanatctttanacagttccaanatgaaactctagcttggacngcagacgacaggacngtcctctaggctgctactatttacgnggtacatccgtaccggatccgggtacctggaccgtattcgaggtcggacctaggtcggttactagggtaacctaggtacgttttaccgacgttcgtaccgtaccgtagtccgtaacgtccgtaacggtcccgttaggtaccgtacgggtaccttacgggaacgttacgttaccggtaggttaccgttaacgttttagttcccggttaagttacccgaacgttaacgtttacgtttacgtaaccttacggttaccggttaggtaaccggtttccggaacgttaacggggtcctaagggttccggtaacttacggtaccgtaacggtaccgtacgttacggcggttaacctcggtaacccg

SEQ ID NO: 278333 - DNA, 794 bp, Homo sapiens
  misc_feature: GYAE6OF01AOEZ8.19.71.G05.1.454.CMB.1.raw
tcagtactctcgtgcacgaccggtgctcgatttagtgtcgtcgcaagagagagggggtcaggctggaactgaggagcaggcaggggcagcaagatggtgttgcagacccaggtcttcatttctctgttgctctggatctctggtcgcccgacggggacatcgtgatcgacccagtctccagacctccctggcttgtgtctcgtgggcgagccggccaccatacaactgacacgtccacgaccaactaactttacttttaactaacctaacgttaacccaaaactaaagtaacgtaaaaaccttacgtttaacgacgtttacggtaacccagacgaacggaacgaacccgaggaccacgtccctaccggtaggtcctgtccttacgttaacgttttaccggagggtacctaaccggttaccccggtaaccccggggtaaccgttccccggggtacccctacggtaccgtacgttacggacgggtcgggtccgagggtccgggtacgtacgggtaacttacgttactttacccaccttacctaccaacccgtacgtaccgacggaccgtaccggtccgtaggacccgtacgggtaccgtaggtaaggttcgtcggttacggtaactttaaggttttttaacttagttaacgtaaccttaaagttaacttttaactttaacgttacgtttaccggtttagggaccgggtttaacccgggttaccgggaaccggaaacgggttaacccggtaaggtacggttaacttaacgacgggtaaacgtaaccgtggttaccgg

SEQ ID NO: 278334 - DNA, 523 bp, Homo sapiens
  misc_feature: GYAE6OF01B6QKM.19.71.G05.1.454.CMB.1.raw
tcagtactctcgtgcacgaccggtgctcgatttagtgtcgtcgcaagagagagggggagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaagccctcgcagaccctctcgctcacctgtgccatctccggggacagagtcgctagcgacagtgttgcttggcacgtgggtcaggcacgtcccatcgagaggtctagagtggctggggaagacatatttcatgtccaacgacgtggaatacaaattatgcacatctgttgagtagtcgactagacaatacaacgtacgacacagtacgaacgaactacgttcctaccctgaccagtctacgacctcgtgtcgaccgtcccggacggacgtagggtagtagttacgttacgtgtacgggagaccggcccctagtacgaacg

SEQ ID NO: 278335 - DNA, 584 bp, Homo sapiens
  misc_feature: GYAE6OF01BM9XQ.19.71.G05.1.454.CMB.1.raw
  modified_base (237)..(237): a, c, t, g, unknown or other
  misc_feature (237)..(237): n is a, c, g, or t
  modified_base (313)..(313): a, c, t, g, unknown or other
  misc_feature (313)..(313): n is a, c, g, or t
tcagtactctcgtgcacgaccggtgctcgatttagtgtcgtcgcaagagagagggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttanacagttccaacaatagaaaactacttagacttggtaccagcagagaccaggacagcctctaggctgctcatttacnggcatccgtaaccggaatccggggtcctgaccgattcagtgcagcggtctgggacagtactttcactctcacatcagcagcctgcaggctagaagtagtgtggtactagttttaattattacgtactaaactaaattaactttaagtttaactaaccgtttcggtaggtacccgtttcgggaacccgtaaacggggtaccctaaagggtcggtaattaacgtaccgtaaacgtaaccggtaaacgttaggtcgggtaccgttaggaacccg

SEQ ID NO: 278336 - DNA, 704 bp, Homo sapiens
  misc_feature: GYAE6OF01CWULD.19.71.G05.1.454.CMB.1.raw
  modified_base (244)..(244): a, c, t, g, unknown or other
  misc_feature (244)..(244): n is a, c, g, or t
  modified_base (333)..(333): a, c, t, g, unknown or other
  misc_feature (333)..(333): n is a, c, g, or t
tcagtactctcgtgcacgaccggtgctcgatttagtgtcgtcgcaagagagagggggaggtacaacaggcaggcaggggcagcaagatggtgttgcagacccaggtcttcatttctctgttgctctggatctctggtgcccgacggggacatcgtgatgacccagtctccagactccctggctgtgtctcgtgggcgaggccgggccaccatcaactgacaagtccagccaactaattctttanactagttaccaacaatacgaaaactacttagcttaggtaccagcaaggacgaccgaggaccacgcctacgaggctgctactatttacgnggactacgtaccgtaacccgggaagttccccggggtccctaggaaccgtagttccgaggtcggaccgaggtccggggttacaggggactaaggtactttccaccgttcctaccgacctactccgacggctacggccctaggaccgagggtactagggaacgtagttgggtacggtactttaacgttttagtttaagtacgttaacctaaaacgttaatttaatttaacgtttaacgttaccgttacggttaccgggttaaccggtttaccggaaccggtaaaaccggggtaccgttaaaggggttacgtaaacttacgtaaccggtaacggtaacccgtaaagttcgggtacggtccgttaggtaaccccg

SEQ ID NO: 278337 - DNA, 551 bp, Homo sapiens
  misc_feature: GYAE6OF01CNJX1.19.71.G05.1.454.CMB.1.raw
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagacctccctggctgtgtctctgggcgagccgggccaccatcaactgcaagtccagccacaattctttaatacacgttaccaaacaatagaaaactacttagtcttaggtaccagacagagacagacagcctctaggctgctcatttactgggcagtccgtaccccgggaagtcccggggtccctgaccgtattccagtcggcaggcggggtactgggactaggtactttcgacttctaccactactcagcacgctgcgagctggagatgtgctagtttatagtgtacaatattattattacttactgttaggtacgttcggaccgtaagggtaccgtaaggtcggacttagtacgaagtacgtaacgtgtggctcggacc

SEQ ID NO: 278338 - DNA, 583 bp, Homo sapiens
  misc_feature: GYAE6OF01DYQWW.19.71.G05.1.454.CMB.1.raw
  modified_base (238)..(238): a, c, t, g, unknown or other
  misc_feature (238)..(238): n is a, c, g, or t
  modified_base (428)..(428): a, c, t, g, unknown or other
  misc_feature (428)..(428): n is a, c, g, or t
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttanacagttccaacaatagaaaaaccttacttagcttaggtaccagcagagaccaggacagcctcctaggctgctctatttactggcatccgtacccgggaatccggggtccctgaccgtattcagtggcaggcgggtcgtgggacagtactttcactctaccaccatcagcacgcctgcgaggctagaacgntgtggtctaagttttattagttgtactaaacgtattaactttattaagttacttacggtaggtaccgttacgggtacccaaggggtaaaccctaaggggttaggtaataacgttcgaaacggtaccggtaaacttgggtagggccttggaacccg

SEQ ID NO: 278339 - DNA, 542 bp, Homo sapiens
  misc_feature: GYAE6OF01DVQMG.19.71.G05.1.454.CMB.1.raw
  modified_base (239)..(239): a, c, t, g, unknown or other
  misc_feature (239)..(239): n is a, c, g, or t
  modified_base (316)..(316): a, c, t, g, unknown or other
  misc_feature (316)..(316): n is a, c, g, or t
  modified_base (426)..(426): a, c, t, g, unknown or other
  misc_feature (426)..(426): n is a, c, g, or t
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagattccctggctgtgtctctgggcgagcgggccaccatcaactgcaagtccagccacaattcttttanacagttccaaacaatagaaaactacttagcttggtaccagcagagaccaggacagcctcctaggctgctcatttacngggcatccgtacccgggaatcccggggtccctggaccgtattcgagtggcaggcgggtcgtgggacagtatttccactctcaccatcagcacgcctgcaggctagaagtntgtgctagtttattattgtacaactaattattattattacgttcgtacggtacgttcggaccgaagggaacctaagggtggatactcgaagtaacgtaacgtggtcggcgtgaccc

SEQ ID NO: 278340 - DNA, 516 bp, Homo sapiens
  misc_feature: GYAE6OF01E2N3M.19.71.G05.1.454.CMB.1.raw
  modified_base (238)..(238): a, c, t, g, unknown or other
  misc_feature (238)..(238): n is a, c, g, or t
  modified_base (313)..(313): a, c, t, g, unknown or other
  misc_feature (313)..(313): n is a, c, g, or t
  modified_base (384)..(384): a, c, t, g, unknown or other
  misc_feature (384)..(384): n is a, c, g, or t
  modified_base (511)..(511): a, c, t, g, unknown or other
  misc_feature (511)..(511): n is a, c, g, or t
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttanacagttccaacaatgaaaactacttagcttggtaccagcagagaccaggacagcctcctaggctgctcatttacngggcatctacccgggaatccggggtccctgaccgattcagtggcaggcgggtctgggacagatttcactcncaccatcagcagcctgcaggctgaagatgtggctagtttattattgtacaactaattattaattatacttcgtggaccgttcggaccaagggaccaagggtggatatacaagacgaactggtcggtntgacc

SEQ ID NO: 278341 - DNA, 531 bp, Homo sapiens
  misc_feature: GYAE6OF01AJQMN.19.71.G05.1.454.CMB.1.raw
  modified_base (247)..(247): a, c, t, g, unknown or other
  misc_feature (247)..(247): n is a, c, g, or t
  modified_base (258)..(258): a, c, t, g, unknown or other
  misc_feature (258)..(258): n is a, c, g, or t
  modified_base (320)..(320): a, c, t, g, unknown or other
  misc_feature (320)..(320): n is a, c, g, or t
  modified_base (376)..(376): a, c, t, g, unknown or other
  misc_feature (376)..(376): n is a, c, g, or t
  modified_base (414)..(414): a, c, t, g, unknown or other
  misc_feature (414)..(414): n is a, c, g, or t
  modified_base (456)..(456): a, c, t, g, unknown or other
  misc_feature (456)..(456): n is a, c, g, or t
tcagtactctcgtgcacgaccggtgctcgatttagtgtcgtcgcaagagagagggggtcaggctggaactgaggagcaggcaggggcagcaagatggtgttgcagacccaggtcttcatttctctgttgctctggatctctggtgcccacggggacatcgtgatgacccagtctccagactccctggctgtgtccctcgtgggcgagcgggccaccatcaactgcaagtccagccacaatcttttanacagttccaanaatgaaaactctagcttggtaccagcagagaccaggacagcctcctaggctgctcatttacnggcatctacccgggatccgggtccctgaccgattcagtcgcaggcggtctgggacngtacttcgactctcacatcagcagcctgcagctgaagntggtgctagttttatagttcgactaacgtaattagttaattnttaccttacggtggtaacgttcgaaccgtaagggaacctaagggtcgaacgttatacgacggtaccgtaatcggg

SEQ ID NO: 278342 - DNA, 517 bp, Homo sapiens
  misc_feature: GYAE6OF01DMA02.19.71.G05.1.454.CMB.1.raw
  modified_base (233)..(233): a, c, t, g, unknown or other
  misc_feature (233)..(233): n is a, c, g, or t
  modified_base (242)..(242): a, c, t, g, unknown or other
  misc_feature (242)..(242): n is a, c, g, or t
  modified_base (262)..(262): a, c, t, g, unknown or other
  misc_feature (262)..(262): n is a, c, g, or t
  modified_base (306)..(306): a, c, t, g, unknown or other
  misc_feature (306)..(306): n is a, c, g, or t
  modified_base (346)..(346): a, c, t, g, unknown or other
  misc_feature (346)..(346): n is a, c, g, or t
  modified_base (378)..(378): a, c, t, g, unknown or other
  misc_feature (378)..(378): n is a, c, g, or t
  modified_base (388)..(388): a, c, t, g, unknown or other
  misc_feature (388)..(388): n is a, c, g, or t
  modified_base (392)..(392): a, c, t, g, unknown or other
  misc_feature (392)..(392): n is a, c, g, or t
  modified_base (395)..(395): a, c, t, g, unknown or other
  misc_feature (395)..(395): n is a, c, g, or t
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatcgacccagtctccagacctccctggctgtgtctcgtgggcgaggcgggccacgatacgacgtgactagcagccanaatctttanacagtccaacatagaaactnttagcttggaccagcagagacaggacagcctcagctgctcattnggcatcgaccggatccgggacctgaccgatcgagtggacnggcggtctgggacagtatttcacttcacacancagcagccgngcgngtnagagtgtgtcgtatagttatatacgtactaataattattattatacgtgtacgtacgtacggaacgaacggtcgtaagtagtactacgtacgacggtacgtacgtaggtacgtcgtacgacg

SEQ ID NO: 278343 - DNA, 520 bp, Homo sapiens
  misc_feature: GYAE6OF01ACBOK.19.71.G05.1.454.CMB.1.raw
  modified_base (409)..(409): a, c, t, g, unknown or other
  misc_feature (409)..(409): n is a, c, g, or t
tcagtactctcgtgcacgaccggtgctcgatttagtgtcgtcgcaagagagagggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttatacagttccaacaatgaaaactacttagcttggtaccagcagagaccaggacagcctcctaggctgctcatttactgggcatctacccgggaatccggggtccctgaccgattcagtggcagcgggtctgggacagatttcactctcaccatcagcagcctgcaggctgaagntgtggactagtttattattgtacaacgtaattattattatacttcggtagtacgttcggaccaagggtacctaagggtggattagtacaggacgtaactgtcggtctgacc

SEQ ID NO: 278344 - DNA, 217 bp, Homo sapiens
  misc_feature: GYAE6OF01DNB67.19.71.G05.1.454.CMB.1.raw
  modified_base (214)..(217): a, c, t, g, unknown or other
  misc_feature (214)..(217): n is a, c, g, or t
tcagtactctcgtgcacgaccggtgctcgatttagtgtcgtcgcaagagagagggggaggtacaacaggcaggcaggggcagcaagatggtgttgcagacccaggtcttcatttctctgttgctctggatctctggtgcccacggggacatcgtgatgacccagtctccagactccctggctgtgtctctgagcgggctggcaaggcgcatagnnnn

SEQ ID NO: 278345 - DNA, 706 bp, Homo sapiens
  misc_feature: GYAE6OF01AEQ40.19.71.G05.1.454.CMB.1.raw
tcagtactctcgtgcacgaccggtgctcgatttagtgtcgtcgcaagagagagggggaggtacaacaggcaggcaggggcagcaagatggtgttgcagacccaggtcttcatttctctgttgctctggatctctggtgcccgacggggacatcgtgatcgacccagtcctccagacctccctggctgtgtctcgtgggcgagcggccacatcaactgacagtcagccactattctttacactacgttaccaaactaatacgtaaaacttacgttacgtcgttacggtaccagacgaacggacgaccgacggacctaccgtccctaccgtaggctcgtcttactacgtttacgcggtacctacgtacccggtaacccgggtacggttccccggggtacctacggaccgtagttcggacgggtcggaccggtacgggtccggggtacgtacgggaactacgttactttaccaccttccgtacaccgtagtccgacgccgtacgtccgtaggacgtacggtactaggtaagtcggttacggtacgttaaccgttttaatttaacgttacgttaaccgtaacttaaacgtttagtttaacttttaacgttacgttacggtacgggtacggtaccggttaccggaacggtaacggtaccgtagggtactactaccgacgtaacggtacgtacgtcggcgtcgtcgtacccg

SEQ ID NO: 278346 - DNA, 586 bp, Homo sapiens
  misc_feature: GYAE6OF01DU527.19.71.G05.1.454.CMB.1.raw
  modified_base (220)..(220): a, c, t, g, unknown or other
  misc_feature (220)..(220): n is a, c, g, or t
  modified_base (365)..(365): a, c, t, g, unknown or other
  misc_feature (365)..(365): n is a, c, g, or t
tcagtactctcgtgcacgaccggtgctcgatttagtgtcgtcgcaagagagagggggagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaagccctgcagaccctntcgctcacctgtcgccatcgtccggggacagagtcgctagcgacagtgtgcttggcacgtgggtcaggcacgtcccagtcgagaggtctaggagtggcgtgggaagacatattcatcgtaccaagtacgtagaataacaaattancgtacacctatcgtgttgacgtagtacgactagaactaatcgaaacgtacgaacacaacgtacgaaacgtaacctacgttacctaccccgtagtaccacggtaccttacggacccttcgtcggtaccgtacccgttacccggaacgggtaccgtacggggttattaacgttacgttacgtaggttaacggaacggtacccggacccctagtacggtaaccg

SEQ ID NO: 278347 - DNA, 507 bp, Homo sapiens
  misc_feature: GYAE6OF01CO1Q7.19.71.G05.1.454.CMB.1.raw
  modified_base (237)..(237): a, c, t, g, unknown or other
  misc_feature (237)..(237): n is a, c, g, or t
  modified_base (411)..(411): a, c, t, g, unknown or other
  misc_feature (411)..(411): n is a, c, g, or t
  modified_base (486)..(486): a, c, t, g, unknown or other
  misc_feature (486)..(486): n is a, c, g, or t
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatctttanacagttccaacaatagaaaactacttagcttggtaaccagcagagaccaggacagcctctaggctgctcatttactggcatcgtacccggaatccggggtccctgaccgtattcagtgcagcgggtctgggacagtatttcactctcaccatcagcagcctgcagctagaacgngtgtggctagtttattattgtacaaacgtatattattatacttcgtgtacgttcgacgtaaggcaaggtgatatnagtacgaactgtagctgaccg

SEQ ID NO: 278348 - DNA, 518 bp, Homo sapiens
  misc_feature: GYAE6OF01EFBXW.19.71.G05.1.454.CMB.1.raw
  modified_base (411)..(411): a, c, t, g, unknown or other
  misc_feature (411)..(411): n is a, c, g, or t
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttatacagttccaacaatgaaaactacttagcttggtaccagcagagaccaggacagcctcctaggctgctcatttactgggcatctacccgggaatccggggtccctgaccgattcagtggcaggcgggtctgggacagatttcactctcaccatcagcagcctgcaggctgaagntggtgctagtttattattgtacaactaattatttattatactttcgtggacgttcggccaaaggggcctaagggtggatatcgaagacgtaacgtgtggtcctgacc

SEQ ID NO: 278349 - DNA, 549 bp, Homo sapiens
  misc_feature: GYAE6OF01C2OH9.19.71.G05.1.454.CMB.1.raw
  modified_base (247)..(247): a, c, t, g, unknown or other
  misc_feature (247)..(247): n is a, c, g, or t
  modified_base (325)..(325): a, c, t, g, unknown or other
  misc_feature (325)..(325): n is a, c, g, or t
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtcgcccgacggggacatcgtgatcgacccagtctccagactccctggctgtgtctcgtgggcgagccgggccaccatcaactgacaagtcccagccacaattcttttaanacagttaccaaacaatagaaaactacttagcttggtaccagcagacgaccaggacacgcctcaggctgctcattacgngggcatcgtaccgggatccggggtcctgaccgtatcgagtggcaggtcggtcgtgggactagtattcactctacacatcgagcagcctgcaggctagaagtgtgtgctagtttattattagacaactaattattattacgtacttcggtaggtaccgttcggacctaaggggtacctaaggtggaatacgtacgaggtaaccgaacgtggtacgcgttcgaccg

SEQ ID NO: 278350 - DNA, 555 bp, Homo sapiens
  misc_feature: GYAE6OF01BXU38.19.71.G05.1.454.CMB.1.raw
  modified_base (240)..(240): a, c, t, g, unknown or other
  misc_feature (240)..(240): n is a, c, g, or t
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagccgggccaccatcaactgcaagtccagccacaatcttttaanacagttaccaacaatagaaaactacttagcttggtaccagcagacgaccaggacacgcctctaggctgctcattactgggcatccgtaacccgggaacgttccgggggtccctacggaccgtattccgaggtcggacgaggcgggtcgtgggacagtactttcgacctctcaaccatcagcacgcctgccgaggctagaagtatgtagcttagtttattattagtacaaactaattattattatacttcgtggtaacgttcggacgtaacgggacctaagggtcggtatatcgtagtacgaatggtcgctggacc

SEQ ID NO: 278351 - DNA, 526 bp, Homo sapiens
  misc_feature: GYAE6OF01E11R0.19.71.G05.1.454.CMB.1.raw
  modified_base (413)..(413): a, c, t, g, unknown or other
  misc_feature (413)..(413): n is a, c, g, or t
  modified_base (416)..(416): a, c, t, g, unknown or other
  misc_feature (416)..(416): n is a, c, g, or t
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttatacagttccaacaatgaaaactacttagcttggtaccagcagagaccaggacagcctcctaggctgctcatttactgggcatccgtacccgggaactccggggtccctgaccgattcagtgcagcgggtctgggacagtatttcactcacaccatcagcagcctgcaggctgaagntgngctagtttatattgtacaactaattattaattattacgttggtacggtacgttcggaccgtaagggtacctaagggtggtaatagtcaagtaacgatggtggtctgaccc

SEQ ID NO: 278352 - DNA, 543 bp, Homo sapiens
  misc_feature: GYAE6OF01EMPIZ.19.71.G05.1.454.CMB.1.raw
  modified_base (238)..(238): a, c, t, g, unknown or other
  misc_feature (238)..(238): n is a, c, g, or t
  modified_base (317)..(317): a, c, t, g, unknown or other
  misc_feature (317)..(317): n is a, c, g, or t
  modified_base (430)..(430): a, c, t, g, unknown or other
  misc_feature (430)..(430): n is a, c, g, or t
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccgatcaactgcaagtccagccacatcttttanacagttccaacaatagaaaactacttagcttggtaccagcagagaccaggacagcctccgtaggctgctctatttacgngggcatccgtacccgggaactcccggggtccctggaccgtattcgaggtggcgaggcgggtctgggactagtatttccactctcaccatcagcacgcctgcaggctagaagtntgtggactagtttatagttagtactaactaattattattatacttcggtagtacggttcggaccgtaagggtacctaaggtggtatatcgagtacgtaactggtcgtctgacc

SEQ ID NO: 278353 - DNA, 528 bp, Homo sapiens
  misc_feature: GYAE6OF01BCZKB.19.71.G05.1.454.CMB.1.raw
  modified_base (240)..(240): a, c, t, g, unknown or other
  misc_feature (240)..(240): n is a, c, g, or t
  modified_base (317)..(317): a, c, t, g, unknown or other
  misc_feature (317)..(317): n is a, c, g, or t
  modified_base (370)..(370): a, c, t, g, unknown or other
  misc_feature (370)..(370): n is a, c, g, or t
  modified_base (522)..(522): a, c, t, g, unknown or other
  misc_feature (522)..(522): n is a, c, g, or t
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccacgatacgaactgcaagtccagccacaatcttttanacagttccaacaatagaaaactacttagcttggtaccagcagagaccaggacagcctcctaggctgctcatttacgngggcatctacccgggaatccggggtccctgaccgattcagtggcagcgggtcngggacagtactttcactctcaccatcagcagctgcaggctagagatcgtggtctagtttattagttgtacaaactattaattattattacttagtcgtacgttcggaccgaagggcctaaggtaggatagtacaggtactaacgtggtacgngtgacc

SEQ ID NO: 278354 - DNA, 442 bp, Homo sapiens
  misc_feature: GYAE6OF01CE178.19.71.G05.1.454.CMB.1.raw
  modified_base (332)..(332): a, c, t, g, unknown or other
  misc_feature (332)..(332): n is a, c, g, or t
  modified_base (427)..(442): a, c, t, g, unknown or other
  misc_feature (427)..(442): n is a, c, g, or t
tcagtactctcgtgcacgaccggtgctcgatttagtgtcgtcgcaagagagaggtctagagtggctgggaaggacatatttcatgtccaacacgtggaatacaaattatgcaccatctgttgagagtcgactgacaatcaacgtagacacatcgaagaaccagttctccctgcagctgacctctgtgactcccgaggacacgggtgtatattactgtggaagaggcccccatagacatgccacctcgtctctggtgctatattggggccagggaacccatgtcaccgtctcctcggcctccaccaagggcccatcggtcttccccctggccnccctgctccaggagcacctccgagcgcacagcgcctggctgcctggtcaaggcctactcccacgagagtactgagcgggctggcaggcgcatagnnnnnnnnnnnnnnnn

SEQ ID NO: 278355 - DNA, 637 bp, Homo sapiens
  misc_feature: GYAE6OF01DT6K7.19.71.G05.1.454.CMB.1.raw
  modified_base (164)..(164): a, c, t, g, unknown or other
  misc_feature (164)..(164): n is a, c, g, or t
  modified_base (200)..(200): a, c, t, g, unknown or other
  misc_feature (200)..(200): n is a, c, g, or t
  modified_base (226)..(226): a, c, t, g, unknown or other
  misc_feature (226)..(226): n is a, c, g, or t
  modified_base (572)..(572): a, c, t, g, unknown or other
  misc_feature (572)..(572): n is a, c, g, or t
  modified_base (608)..(608): a, c, t, g, unknown or other
  misc_feature (608)..(608): n is a, c, g, or t
  modified_base (617)..(617): a, c, t, g, unknown or other
  misc_feature (617)..(617): n is a, c, g, or t
  modified_base (624)..(624): a, c, t, g, unknown or other
  misc_feature (624)..(624): n is a, c, g, or t
  modified_base (629)..(629): a, c, t, g, unknown or other
  misc_feature (629)..(629): n is a, c, g, or t
tcagtactctcgtgcacgaccggtgctcgatttagtgtcgtcgcaagagagaggtctagggagtggcgtgggaaggacatatttcagtgtccaacacgtggaatacaaagttatgcaccattcctgttcgacgagtcgactggacaaatcgaacgttagaccanattcgaacgaaccagttctccctgccagctgacctntgtgaccgtcccggaggacacgggtntatattactgttgaagacgccccagtacgacagtgccactcgttcttcgtgtgctatagttgggaccaaggaaaccccatcgtccaaccccgtctcccgtcggcccttcgacgaacgggccctagtccggtcgttcccccgtgccgtaccgtgcctcgaggacgcctaaccgttccgaagacgtccaacgacggcccggtacccgtcggggacctcgggaccccgttacggtaaccgaaacggtcccttaccgttccccggaaacgtacgtaagttaacgtaggacggtaccgggtacgttacggacgtaaacgggtccgtactaaagttacggtatacgaccgtntacctgagtcgttcgcgcgactcgagcgtcgcgtgngcacggtcncgtcgcncgtcncgtcgtcg

SEQ ID NO: 278356 - DNA, 598 bp, Homo sapiens
  misc_feature: GYAE6OF01BT8RD.19.71.G05.1.454.CMB.1.raw
  modified_base (459)..(459): a, c, t, g, unknown or other
  misc_feature (459)..(459): n is a, c, g, or t
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccacgaccaacaattacttttaatactacgttaccaaacaaatagtaaaactaacttagcttaggtaccagacagacgaaccaggacacgccctccgtacggctgctctaactttacgtgggcataccgtaacccgggaacgtcccggggtccctgaaccgacttcgagtggcaggcgggtcgtgggacagtattcactctccaccatcagccaagcctgaccgaggccgtagaaacgnttggtggtactaagttttattagttgtacaaactaaattatttaattaattacttcggtaggtaacgttcggaaccgaagggaccgtaaagggtggattaacgtacgaagtaacggaacttgggtacggcttgaacccg

SEQ ID NO: 278357 - DNA, 584 bp, Homo sapiens
  misc_feature: GYAE6OF01BJUYI.19.71.G05.1.454.CMB.1.raw
  modified_base (241)..(241): a, c, t, g, unknown or other
  misc_feature (241)..(241): n is a, c, g, or t
  modified_base (371)..(371): a, c, t, g, unknown or other
  misc_feature (371)..(371): n is a, c, g, or t
tcagtactctcgtgcacgaccggtgctcgatttagtgtcgtcgcaagagagagggggaggtacaacaggcaggcaggggcagcaagatggtgttgcagacccaggtcttcatttctctgttgctctggatctctggtgcccacggggacatcgtgatgacccagtctccagacctccctggctgtgtctcgtgggcgagcgggccacatcaactgacaagtccagccactaattcttttanactagttaccaataatagaaaactacttagcttaggtaccagcagacgaccaggacacgcctacctaggctgcttctatttacgtggacctagtaccgtacccgggaacgtcccggggtcctgacccgtnttcgagtggacaggcggtcgtagggacaggtactttccacgtctacacctatcagccagtcctagcacgctagaacgagtggagtctagtttactacgtgtcagtacttaatttattttccgttactccgttaccggtacggtaccgttccggaccgacgggtaccgtagggtacgaaagtcgaacgtacgtaagtggtacgtgtcggtaacc

SEQ ID NO: 278358 - DNA, 549 bp, Homo sapiens
  misc_feature: GYAE6OF01CQTN6.19.71.G05.1.454.CMB.1.raw
  modified_base (397)..(397): a, c, t, g, unknown or other
  misc_feature (397)..(397): n is a, c, g, or t
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatctttatacagttccaacaatagaaaactacttagcttaggtaccagcagacgaccaggacagcctcctaggctgctcatttacgtgggctatccgtacccgggaactcccgggggtccctggacccgtattcgaggtggcgaggcgggtcgtgggacagtatttcnctctcacatcagcagcctgcagctagagatgtgctagtttattagttgtacaaatattattattatacgttcgtggtacgttcggacgtaagggaaccgtaagggttgaattaactcgaaacgtaccgtaaacttggtacgcgtgtaacccg

SEQ ID NO: 278359 - DNA, 603 bp, Homo sapiens
  misc_feature: GYAE6OF01ALZKR.19.71.G05.1.454.CMB.1.raw
  modified_base (229)..(229): a, c, t, g, unknown or other
  misc_feature (229)..(229): n is a, c, g, or t
  modified_base (238)..(238): a, c, t, g, unknown or other
  misc_feature (238)..(238): n is a, c, g, or t
  modified_base (318)..(318): a, c, t, g, unknown or other
  misc_feature (318)..(318): n is a, c, g, or t
  modified_base (416)..(416): a, c, t, g, unknown or other
  misc_feature (416)..(416): n is a, c, g, or t
tcagtactctcgtgcacgaccggtgctcgatttagtgtcgtcgcaagagagaggggggagggtacaacaggcaggcaggggcagcaagatggtgttgcagacccaggtcttcatttctctgttgctctggatatctggtgcccacggggacatcgtgatgacccagtctccagacctccctggctgtgtctctgggcgagcggccaccatcaactgcaagtccagccanattctttanacagttccaacaatagaaaacttacttagcttcggtaccagcagagaccaggacagcctcctaggctgctctatttacgnggcactcgtacccgggacgtccggggtccctcgaccgattccgagtcggcaggcgggtctagggacaggtactttcactctaccaacctatccacgcncgcctgccgaggtctaggaagagtggtacggtactaggttttattattcgtacctaaattaattatttaactttacgtaacgtttcgggtaggttaccggttaccggaccggtaaacggggtaccgtaagggttacggtaagtaacgttcaacggtaacgtaacgttaggtcggtactgggtaaccc

SEQ ID NO: 278360 - DNA, 693 bp, Homo sapiens
  misc_feature: GYAE6OF01C8W7Z.19.71.G05.1.454.CMB.1.raw
  modified_base (249)..(249): a, c, t, g, unknown or other
  misc_feature (249)..(249): n is a, c, g, or t
tcagtactctcgtgcacgaccggtgctcgatttagtgtcgtcgcaagagagagggggaggtacaacaggcaggcaggggcagcaagatggtgttgcagacccaggtcttcatttctctgttgctctggatctctggtgcccacggggacatcgtgatgacccagtctccagactcctggctgtgtctctgggcgaggccggcctaccatacaactcgactaacgtccacgccaactaatttcttttaanactacgttaccaaactaataacgtaaaaccttacttacgtcgtttacggaaccagaccaaggacgaccgaggacacgccctaccgtaggctgcctactactttacgtgggactactaccgtaacccgggtacgtcccggggtcctacggaccgtattcgaggtcggacgacggtcgggtcgtagggactagtactttccactctaccgacctactacgacgacgacgtccgtagccgacgggtctaggaagtagtggtacgtacttaagttttattaacgtttagtaacctaaattatttacgtttaatttactttaccgttacgttacgggtaccggttaccggaaccggtaaacgggtaacccggttaagggttaacggtaacgttaacgttacggtaacggtaacccggttaaacggttggttacgggcgttcgtaacccg

SEQ ID NO: 278361 - DNA, 833 bp, Homo sapiens
  misc_feature: GYAE6OF01D670I.19.71.G05.1.454.CMB.1.raw
  modified_base (335)..(335): a, c, t, g, unknown or other
  misc_feature (335)..(335): n is a, c, g, or t
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagcccaactaattcttttaatacctacgttaccaaactaaatagaaaaacttacttagcttaggtaccagcagacgaccgagacacgccctcgtaggctgctactatttacgngggctacgtccgtaacccgggtaagtcccggggtccctcggtacccgtattccgaggtcggacgacgggtcggggttccgtaggggtaacctaggttacttttccgaaccttccgtacccaaacccgtacgttaccgaacggtacccgtaaccggtcccgttaggacccggtaacggggtaccgttaaacggggaaagttaacggtttcggggttacgggtaaccctttttaaagggttttttaacgtttaacggttttaaccggttaaacccttaaaaaccttttaaaagtttttaaaccgtttttaaactttttaaaccggttttaaccgtttaccgggggttaaccgggttaaaccccgggttttaccccggggaaacccgggttaaaaccgggggtaaacccgttaaagggggttacggttaaacgttaaacgtaaccgggaaacgggttaacccgttaaagggttcgggttaccggtccgtacggtaaccccg

SEQ ID NO: 278362 - DNA, 615 bp, Homo sapiens
  misc_feature: GYAE6OF01CAKJC.19.71.G05.1.454.CMB.1.raw
  modified_base (238)..(238): a, c, t, g, unknown or other
  misc_feature (238)..(238): n is a, c, g, or t
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttanacagttaccaacaatagaaaactacttagcttggtaccagcagagaccaggacacgcctctaggctgctcatttactgggcagtccgtaacccgggacgtcccggggtccctgaccgtattcaggtcggcaggtcggggtctagggactagtatttccactcctacaccatcagcacgcctagcgaggctagaagtagtggtacggacgttagttttatttagttagtaacctaaattaattatttaaagttacttaccgttacgttacgggtacctttacgacgtaacccggtaaacggggtaaccctaaaggggttggtaacttaagttaccgtaacgggtaaaccggtaaacgttcggtgggtaccgttacggg

SEQ ID NO: 278363 - DNA, 574 bp, Homo sapiens
  misc_feature: GYAE6OF01D1L3V.19.71.G05.1.454.CMB.1.raw
  modified_base (239)..(239): a, c, t, g, unknown or other
  misc_feature (239)..(239): n is a, c, g, or t
  modified_base (321)..(321): a, c, t, g, unknown or other
  misc_feature (321)..(321): n is a, c, g, or t
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccacatcaactgcaagtccagccaacaattcttttanacagttccaacaatagaaaacttacttagcttaggtaccagcaagagaccaggacacgcctcctaggctgctctatttacgnggcatccgtaacccgggaacgtcccggggtccctgaccgtattcgaggtcggcaggcgggtctggggacagtactttcactctaccaccatcacgcacgcctgcgagtctagaagtagtcggtgtacttagtttattagttagtactaaactaattaagtttattaatacgtttcggtaggttaccgttaccggacgtaacgggtacctaagggtgtatatacgaaggtaccgtaacgtggtcgtcgtcgacc

SEQ ID NO: 278364 - DNA, 443 bp, Homo sapiens
  misc_feature: GYAE6OF01CYNJ1.19.71.G05.1.454.CMB.1.raw
  modified_base (348)..(348): a, c, t, g, unknown or other
  misc_feature (348)..(348): n is a, c, g, or t
  modified_base (436)..(443): a, c, t, g, unknown or other
  misc_feature (436)..(443): n is a, c, g, or t
tcagtactctcgtgcacgaccggtgctcgatttagtgtcgtcgcaagagagaggtctagagtggctgggaaggacatatttcatgtccaacacgtggaatacaaattatgcaccatctgttgagagtcgactgacaatcaacgtagacacatcgaagaaccagttctccctgcagctgacctctgtgactcccgaggacacgggtgtatattactgtggaagaggcccccatagacatgccacctcgtctctggtgctatattggggccagggaacccatgtcaccgtctcctcggcctccaccaagggcccatccggtcttcccctggccgccctgcctccaggacncaccctccgagacgcacagcggcctgggctgcctggtcaaggcctaccttcccacgagagtactgagcgggctggcaaggcgcatagnnnnnnnn

SEQ ID NO: 278365 - DNA, 441 bp, Homo sapiens
  misc_feature: GYAE6OF01CLZSH.19.71.G05.1.454.CMB.1.raw
  modified_base (342)..(342): a, c, t, g, unknown or other
  misc_feature (342)..(342): n is a, c, g, or t
  modified_base (431)..(441): a, c, t, g, unknown or other
  misc_feature (431)..(441): n is a, c, g, or t
tcagtactctcgtgcacgaccggtgctcgatttagtgtcgtcgcaagagagaggtctagagtggctgggaaggacatatttcatgtccaacatgtggaatacaaattatgcaccatctgttgagagtcgactgacaatcaacgtagacacatcgaagaaccagttctccctgcagctgacctctgtgactcccgaggacacgggtgtatattactgtggaagaggcccccatagacatgccacctcgtctctggtgctatattggggccagggaacccatgtcaccgtctcctcggcctccaccaagggcccatcggtcttcccctggcgccctgctcaggngcacctccgagagcacagcggccctgggctgcctggtcaaggactacttcccacgagagtactgagcgggctgggcaaggcgcagtagnnnnnnnnnnn

SEQ ID NO: 278366 - DNA, 618 bp, Homo sapiens
  misc_feature: GYAE6OF01DA4K6.19.71.G05.1.454.CMB.1.raw
  modified_base (237)..(237): a, c, t, g, unknown or other
  misc_feature (237)..(237): n is a, c, g, or t
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcggccacatcaactgcaagtccagccacaattcttttanacagttccaaacaatagaaaactacttagcttggtaccagcagagaccaggacacgcctctaggctgctactattacgtgggacactccgtaacccgggaagttccggggtccctggaccgattcgagtcggcagcgggtcgtgggacagtattcactctacaccactcagcacgcctgcgaggctaggaagtagttggtcggtacgttaagtttttaattaagtttacggtaacctaaactaattaagttttaatttaacgttacgtttcggttacgggttaaccggttaccgggaaccgtaaacgggggtaccgtaaaggggtacggtaattaacgtacgaacggtaaccgtaaacgttggtaacggtcgttgaacccg

SEQ ID NO: 278367 - DNA, 566 bp, Homo sapiens
  misc_feature: GYAE6OF01A9BXQ.19.71.G05.1.454.CMB.1.raw
  modified_base (238)..(238): a, c, t, g, unknown or other
  misc_feature (238)..(238): n is a, c, g, or t
  modified_base (249)..(249): a, c, t, g, unknown or other
  misc_feature (249)..(249): n is a, c, g, or t
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttanacagttccaanaatagaaaactacttagcttggtaccagcagagaccaggacagcctcctaggctgctcatttactgggctatccgtacccgggaatcccggggtccctgacccgtattcgagtcggcacggcgggtctgggactagtatttccactcgtacaccatcagcagcctgcgaggctagaagatgtggtatagtttattagttacgtacaaactaattattaattactacgttacggtaggtaccgttcgggaccgtaaagggaccgtaaggtaggtaatacgtaccgaagtaccgaacgttggtacggtcgtggtacccg

SEQ ID NO: 278368 - DNA, 546 bp, Homo sapiens
  misc_feature: GYAE6OF01AW7UT.19.71.G05.1.454.CMB.1.raw
  modified_base (238)..(238): a, c, t, g, unknown or other
  misc_feature (238)..(238): n is a, c, g, or t
  modified_base (312)..(312): a, c, t, g, unknown or other
  misc_feature (312)..(312): n is a, c, g, or t
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttanacagttccaacaatgaaaactacttagcttggtaccagcagagaccaggacagcctctaggctgctcatttacngggcatcgtacccgggaatccggggtaccctgaccgattcagtggcaggcggtctgggacagatttcactctcaccatcagcagcctgcaggctagaagatgtggactagttttatattgtacaaatattattattaactacgttcgtaggtacgttccggaccgtaaagggtaccgtaagggtggtaattaacgtagaacggtaacgtaacgttggtacggcttcggaacccg

SEQ ID NO: 278369 - DNA, 669 bp, Homo sapiens
  misc_feature: GYAE6OF01BD8ET.19.71.G05.1.454.CMB.1.raw
  modified_base (249)..(249): a, c, t, g, unknown or other
  misc_feature (249)..(249): n is a, c, g, or t
  modified_base (311)..(311): a, c, t, g, unknown or other
  misc_feature (311)..(311): n is a, c, g, or t
  modified_base (336)..(336): a, c, t, g, unknown or other
  misc_feature (336)..(336): n is a, c, g, or t
  modified_base (472)..(472): a, c, t, g, unknown or other
  misc_feature (472)..(472): n is a, c, g, or t
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccgacggggacatcgtgatcgacccagtctcagacctccctggctgtgtctcgtgggcgaggccgggccaccatccaactcgacaacgtccagccaactaattctttanactacgttaccaaacaatacgaaaacttcttagcttaggtaccagacagacgaccgagacancctctaggctagctactatttacgnggacactaccgtaacccgggaacgtcccggggtccctacggaaccgtagttcgaaggtcggacgtacggtcgggtctacggggactacgtacgttacgtacctccgtacgacctactcgacgcacggcctagacgngaccgtaggaagtgtcggtaggacttaagggtttttactaagttacgaaccgtaaattacttaactttagtttacgtaccgtttcgggtacgtaacgggttacccggaaccggtaaaggggtaacccgtaaggggtgtaaactacggttaaccgacggtaaaccggttaagtccgggttagtcccgtggtaaacccc

SEQ ID NO: 278370 - DNA, 534 bp, Homo sapiens
  misc_feature: GYAE6OF01BE4DZ.19.71.G05.1.454.CMB.1.raw
  modified_base (244)..(244): a, c, t, g, unknown or other
  misc_feature (244)..(244): n is a, c, g, or t
  modified_base (426)..(426): a, c, t, g, unknown or other
  misc_feature (426)..(426): n is a, c, g, or t
  modified_base (430)..(430): a, c, t, g, unknown or other
  misc_feature (430)..(430): n is a, c, g, or t
tcagtactctcgtgcacgaccggtgctcgatttagtgtcgtcgcaagagagagggggtcaggctggaactgaggagcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttanacagttccaacaatagaaaactacttagcttggtaccagcagagaccaggacagcctctaggctgctcatttacgtgggcagtccgtaacccgggaatcccggggtcctgaccgtattcgagtggcaggcgggtctgggacagtattcactctcaccatcagcagcctgcaggctgaaacgntggngacttagtttattagttgacaactaattagttattatactttcggtaggtaccgttaggaccgtaaagggacctaaggtgtaactatacgagtacgtaacgtgg

SEQ ID NO: 278371 - DNA, 547 bp, Homo sapiens
  misc_feature: GYAE6OF01BPXD0.19.71.G05.1.454.CMB.1.raw
  modified_base (237)..(237): a, c, t, g, unknown or other
  misc_feature (237)..(237): n is a, c, g, or t
  modified_base (312)..(312): a, c, t, g, unknown or other
  misc_feature (312)..(312): n is a, c, g, or t
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccacatcaactgcaagtccagccacaatcttttanacagttccaacaatgaaaactacttagcttaggtaccagcagagaccaggacagcctctaggctgctcatttacngggcatcctacccgggaactccggggtccctgaccgattcgagtcggcaggcggtctgggacagtactttcacttctaccacctatccagtcacgcctgcaggctaggaacgtgtgtggactagttttacttagttgtacaataattattattatacttcgtaggaccgtttggacccgtaagggacctaagggtcggaattagtacgaacgtacgaacttggtcgtcgtcgacc

SEQ ID NO: 278372 - DNA, 544 bp, Homo sapiens
  misc_feature: GYAE6OF01EAA2W.19.71.G05.1.454.CMB.1.raw
  modified_base (203)..(203): a, c, t, g, unknown or other
  misc_feature (203)..(203): n is a, c, g, or t
  modified_base (303)..(303): a, c, t, g, unknown or other
  misc_feature (303)..(303): n is a, c, g, or t
tcagtactctcgtgcacgaccggtgctcgatttagtgtcgtcgcaagagagagggggagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtnaagccctcgcagaccctctcgctcacctgtgccatctccggggacagagtcgctagcgacagtgttgcttggcacgtgggtcaggcacgtcccatcgagnggtctagagtggctggggaagactatatttcatcgtaccaacgacggtaggaaactacaaatttatgaccaccatctgttgagtagtcgactgacaatacaacgtagacacatacgaacgaacctacgttcctcctgacacgtctacgtacctctcgtacgaccgtacccgacggtaccgtagggttacgttacgttacgttacgtaggtacggaacgaccggtaccccagtacgtaaccg

SEQ ID NO: 278373 - DNA, 555 bp, Homo sapiens
  misc_feature: GYAE6OF01BS9KW.19.71.G05.1.454.CMB.1.raw
  modified_base (241)..(241): a, c, t, g, unknown or other
  misc_feature (241)..(241): n is a, c, g, or t
  modified_base (371)..(371): a, c, t, g, unknown or other
  misc_feature (371)..(371): n is a, c, g, or t
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagccgggccacatcaactgacaagtccagccactaattcttttanactagttccaaacaatagaaaactacttagcttaggtaccagacagagaccaggacacgcctcgtagctgctcattctggcatccgtaccggatccggggcctgaccgtatcagtcggcacggcgggtcngggacagtacttcactctcaccatcagcagcctgcgaggctagaagtagtggtaggtcttagttttacttattacgtacaaacttaattatttaattacgtacttacggtggtaccgttacggaccgtaacgggacctaagggtggtaatacgtacgaagtaccggattggtacggcgtgtacc

SEQ ID NO: 278374 - DNA, 517 bp, Homo sapiens
  misc_feature: GYAE6OF01BNN6M.19.71.G05.1.454.CMB.1.raw
  modified_base (239)..(239): a, c, t, g, unknown or other
  misc_feature (239)..(239): n is a, c, g, or t
  modified_base (315)..(315): a, c, t, g, unknown or other
  misc_feature (315)..(315): n is a, c, g, or t
  modified_base (409)..(409): a, c, t, g, unknown or other
  misc_feature (409)..(409): n is a, c, g, or t
  modified_base (508)..(508): a, c, t, g, unknown or other
  misc_feature (508)..(508): n is a, c, g, or t
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagcctacaatcttttanacagttccaacaatagaaaactacttagcttggtaccagcagagaccaggacagcctcctaggctgctcatttacnggcatctacccgggaatccggggtccctgaccgattcagtggcagcggtctgggacagatttcactctcaccatcagcagcctgcaggctgganatgtgctagtttatattgtacaactaattattattatacttacgtggtacgttcggacctaaagggacctaagggtggattagtcaagtacgaacttgnggcttgacc

SEQ ID NO: 278375 - DNA, 824 bp, Homo sapiens
  misc_feature: GYAE6OF01D2TVV.19.71.G05.1.454.CMB.1.raw
  modified_base (249)..(249): a, c, t, g, unknown or other
  misc_feature (249)..(249): n is a, c, g, or t
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccgacggggacatcgtgatcgacccagtctccagacctccctggctgtgtctcgtgggcgaggccgggccaccatcaactgacaagtccagccaactaattcttttaanactacgttaccaaacaatacgaaaaccttacttagtcttacggtaccagcaagacgaccgaggacacgcctctaggctgctactatttacgcggactacgtaccgtaacccgggtaacgtcccggggtaccctacggaccgtacgttacgaggttcggacgtacgggtcggggtaccgtacgggggaacctacggtttaactttccgaaccttccgtaccctaacccgtagttacccgaacggcccgtaacggtcccgtagggaccggaacggggtaccgttaaggaaagggttacggtttagggtacgggttaacgttttaaagggttttttaacttttaacgtttaacggttaaacccgttaaaacttaaaagtttaacgttttaattttaaaccgtttaccggttttacgggtaccggggtttaaacccggtttacccgggggaaaccgttaaacgggggttaactttaacggggaaacggggtttcgggtaaacgtttaacggttaacccgtaaacggggttaaaccccgggtaaaggtttccggggttaacgggtacccgtttaaccggg

SEQ ID NO: 278376 - DNA, 579 bp, Homo sapiens
  misc_feature: GYAE6OF01CEVST.19.71.G05.1.454.CMB.1.raw
tcagtactctcgtgcacgaccggtgctcgatttagtgtcgtcgcaagagagagggggagagtctgctgaattctggctgaccagggcagtcaccagagctccagacaatgtctgtctccttcctctttttcctgcccgtgctgggcctcccacaaggtgtcctgtcacaagtacagctgcagcagtcaggtccaggactggtgaagccctgcagaccctctcgctcacctgtgccatctccggggacagagtcgctagcgacagtgttgcttggcactgggtcaggcagtccccatcgagaggtctagagtggcgtgggaagactatatttcattcgtaccaacacgtaggaaataactaaaattatagactacattctgttagagagtcgactagaacaatacaacgtagacacatacgaagaacctacgttcctacccttgaccgtagtccgtacgtacccttcgtacggtacgacccgtacccggaagggtaaccgtacggggttagttaacgttacgtttaccgttaggtacgggtaaacggacccggtacccccgaagtaaccggactaaccgg

SEQ ID NO: 278377 - DNA, 522 bp, Homo sapiens
  misc_feature: GYAE6OF01BNSOC.19.71.G05.1.454.CMB.1.raw
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttatacagttccaacaatgaaaactacttagcttggtaccagcagagaccaggacagcctcctaggctgctcatttactgggcatcctacccgggaatccgggggtccctgaccgattcagtggcagcgggtctgggacagatttcactctcaccatcagcagcctgcaggctgagatgtggctagtttattattgtacaactaattattattataccttcgtggacgttcggacctaaggggtaccaagggtggtatacgtcgagacgtaactggtggtcgtgaccc

SEQ ID NO: 278378 - DNA, 505 bp, Homo sapiens
  misc_feature: GYAE6OF01AD4LS.19.71.G05.1.454.CMB.1.raw
  modified_base (386)..(386): a, c, t, g, unknown or other
  misc_feature (386)..(386): n is a, c, g, or t
  modified_base (422)..(422): a, c, t, g, unknown or other
  misc_feature (422)..(422): n is a, c, g, or t
  modified_base (425)..(425): a, c, t, g, unknown or other
  misc_feature (425)..(425): n is a, c, g, or t
  modified_base (494)..(494): a, c, t, g, unknown or other
  misc_feature (494)..(494): n is a, c, g, or t
tcagtactctcgtgcacgaccggtgctcgatttagtgtcgtcgcaagagagagggggtcaggctggaactgaggagcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttatacagttccgacaatgaaaactacttagcttggtaccagcagagaccaggacagcctcctaggctgctcatttactgggctacgtcgtaccccgggaatcccggggtccctgaccgtattcgagtggcaggcggtctgggacngtattcactctcaccatcagcagcctgcagctgaantgngactagtttatatgtacaatattattatatacgtgtacggacgttcgacaagggaccaaggtgaatacnagacgaagtgg

SEQ ID NO: 278379 - DNA, 615 bp, Homo sapiens
  misc_feature: GYAE6OF01DJXUR.19.71.G05.1.454.CMB.1.raw
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccactaattctttatacagttaccaacaatagaaaactacttagcttaggtaccagcagagaccaggacacgcctcctaggctgctactatttacgtggctactaccgtacccgggtaatcccggggtccctagaccgtattcgagtcggcaggtcgggtctagggacagtactttcactctacacctatcagcacgccgtgtacgacggactagaacgtagtcggtaggtacttaagtttaatttagtagttacctaaacgttaaattaactttaattaacgttacgttacggttacggttaccgttaccgggaaccgtaaacggggtaccgtaagggtacggtaacgttagtaccgaaacggtacgtaactggtacggtcgtcgtaccg

SEQ ID NO: 278380 - DNA, 602 bp, Homo sapiens
  misc_feature: GYAE6OF01DJRUO.19.71.G05.1.454.CMB.1.raw
  modified_base (243)..(243): a, c, t, g, unknown or other
  misc_feature (243)..(243): n is a, c, g, or t
  modified_base (321)..(321): a, c, t, g, unknown or other
  misc_feature (321)..(321): n is a, c, g, or t
  modified_base (357)..(357): a, c, t, g, unknown or other
  misc_feature (357)..(357): n is a, c, g, or t
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtcgcccgacggggacatcgtgatgacccagtctccagacctccctggctgtgtctcgtgggcgagcgggccaccatcaactgcaagtccagccactaatcttttanactagttccaacaatagaaaactacttagcttggaccagcagagaccaggacacgcctccgtaggctgctcatttcgnggcatccgtacccgggatcccggggtcctgaccgtntcgagtcgcaggcgggtctgggacagtactttccgactctaccaccgatacacgcacgtcccgtagccgagggcctaggaacgtagttgggtacggtcttaaggttttataagttacgtaacctaaattaattatttaattattaccgttaggtcggtaacgttcccggaacgtaaacggggtaccgtaaggttacggacttacgtacgaacggtaacggtaacttgggcggtctacggtacccg

SEQ ID NO: 278381 - DNA, 657 bp, Homo sapiens
  misc_feature: GYAE6OF01CHFZG.19.71.G05.1.454.CMB.1.raw
  modified_base (242)..(242): a, c, t, g, unknown or other
  misc_feature (242)..(242): n is a, c, g, or t
  modified_base (327)..(327): a, c, t, g, unknown or other
  misc_feature (327)..(327): n is a, c, g, or t
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatacaactgacaagtccagccactaattcttttanactagttccaacaatagaaaactacttagcttaggtaccagacagacgaccaggacacgcctccgtaggctgctactatttacgngggctatccgtaacccgggtaagtcccggggtccctagaaccgtattcgaggtcggcgaggtcgggtcgtgggactaggtactttccgactcctccacctatacacgactacgccgtgcgaggctaggaagtagttggtacggtacttaagtttttattacgttacgtaactaaacgttaaatttaagttttaactttaacgttaccgtttacgggttacgggttaaccggtttaccgggaacccgtaaacggggtaccgtaagggttaggtaacttaccggtacgtaacgggtaaaccgtacggttaggtacgggtctacgggtaaccc

SEQ ID NO: 278382 - DNA, 656 bp, Homo sapiens
  misc_feature: GYAE6OF01EVECM.19.71.G05.1.454.CMB.1.raw
tcagtactctcgtgcacgaccggtgctcgatttagtgtcgtcgcaagagagagggggaggtacaacaggcaggcaggggcagcaaagatggtgttgcagacccaggtcttcatttctctgttgctctggatctctggtgcccacggggacatcgtgatgacccagtctccagactccctggctgtgtctctgggcgaggcggccacgatacaactcgactaacgtccagaccactaattctttacactacgttaccaaataagtaactaaaaccttacttacgtcgttacggtaccagacagaacgaaccgacgacacgccttaccgtaggctcgctactatttacgtcggactacgttaccgtaacccggggtaacgtcccggggtccctacggtaccgtattaccgaggtcggacgtacggtccggggtcgtagggaactacgttactttcaccttctaccaaccgtactacgacgaccgtacgcctggacaggtacgtagaagtcgtgtcggtacttagtttacttatacgtaactaaattaatttatttaagttaccttacgttacggtacggtaccggttaccgacggtaaaacgggtccgtaagggtggttactacgtagaacgtaacgtacgttaggtcggctggaacc

SEQ ID NO: 278383 - DNA, 578 bp, Homo sapiens
  misc_feature: GYAE6OF01A9JFY.19.71.G05.1.454.CMB.1.raw
  modified_base (321)..(321): a, c, t, g, unknown or other
  misc_feature (321)..(321): n is a, c, g, or t
tcagtactctcgtgcacgaccggtgctcgatttagtgtcgtcgcaagagagagggggtcaggctggaactgaggagcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaattctttatacagttccaacaatagaaaactacttagcttaggtaccagcagagaccaggacagcctctaggctgctcatttacgnggctagtccgtacccgggaactcccggggtccctgaccgtattcgagtcggcgaggtcggtcgtaggactagtacttacactcctaccacgtatcgacgcacgtccgtagacgacgtcgtagaagtacgttggacgtacgttagtttattagttactaactaactaattatttattacttacgttacggtacggtacgttacggaacggaacggtaccgtaagggtacgtaacgtactacgaacgacgtacgtacgg

SEQ ID NO: 278384 - DNA, 538 bp, Homo sapiens
  misc_feature: GYAE6OF01D30CB.19.71.G05.1.454.CMB.1.raw
  modified_base (238)..(238): a, c, t, g, unknown or other
  misc_feature (238)..(238): n is a, c, g, or t
  modified_base (318)..(318): a, c, t, g, unknown or other
  misc_feature (318)..(318): n is a, c, g, or t
  modified_base (421)..(421): a, c, t, g, unknown or other
  misc_feature (421)..(421): n is a, c, g, or t
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcggccaccatcaactgcaagtccagccacaattcttttanacagttaccaaacaatagaaaactacttagcttaggtaccagcagacgaccaggacagcctcctaggctgctcatttacnggcatccgtacccgggaactccggggtcctgaccgattcgagtggcgagcgggtctgggacagtatttcactctcaccatcagcagcctgccagctagaagtntgtgctagtttattatgtacaatattattatatacgttcgtaggtacgttcggacgtaagggaccgtaagggtcgtaatactacgaagtaacgtaaacttggtacggctggtaaccc

SEQ ID NO: 278385 - DNA, 548 bp, Homo sapiens
  misc_feature: GYAE6OF01EFN8J.19.71.G05.1.454.CMB.1.raw
  modified_base (314)..(314): a, c, t, g, unknown or other
  misc_feature (314)..(314): n is a, c, g, or t
  modified_base (418)..(418): a, c, t, g, unknown or other
  misc_feature (418)..(418): n is a, c, g, or t
  modified_base (433)..(433): a, c, t, g, unknown or other
  misc_feature (433)..(433): n is a, c, g, or t
  modified_base (543)..(543): a, c, t, g, unknown or other
  misc_feature (543)..(543): n is a, c, g, or t
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttatacagttccaacaatagaaaactacttagcttggtaccagcagagaccaggacagcctcctaggctgctcatttacnggcatcgtacccgggaatccggggtccctgaccgattccgagtggcaggcgggtctgggacagtatttcgactcctcaccatcagcagcctgcaggctagaagntggtggctaggtttnttattagtactaacgtaaatttatttaatttaattacgttcggttaggtacgtttccggaaccaaaggggtacccaagggttggaatagtcaagtacgacgtagtggtcngtacc

SEQ ID NO: 278386 - DNA, 617 bp, Homo sapiens
  misc_feature: GYAE6OF01DQT8P.19.71.G05.1.454.CMB.1.raw
  modified_base (239)..(239): a, c, t, g, unknown or other
  misc_feature (239)..(239): n is a, c, g, or t
  modified_base (318)..(318): a, c, t, g, unknown or other
  misc_feature (318)..(318): n is a, c, g, or t
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccaacaatcttttanacagttaccaacaatagaaaactacttagcttggaccagcagagaccagacacgcctccgtaggctgctctatttacgngggacataccgtacccgggaacgtccggggtccctagaccgtattcgagtggcaggtcgggtcgtgggacagtatttcgactctaccacctatcacgcacgcctgcgaggtcctaggaagatcggtggtacttaggttttattaacgttgtaaccgaaataatttaatttaatttaactacgtttcggtaacgggttaccggttcgggtaacccgtaaaggggtaaccctaaaggggttacggtaaagttaacgttacgaaacggtaaccgaaacgttggtcgggccttggtaaccccg

SEQ ID NO: 278387 - DNA, 533 bp, Homo sapiens
  misc_feature: GYAE6OF01AHQKT.19.71.G05.1.454.CMB.1.raw
  modified_base (254)..(254): a, c, t, g, unknown or other
  misc_feature (254)..(254): n is a, c, g, or t
  modified_base (385)..(385): a, c, t, g, unknown or other
  misc_feature (385)..(385): n is a, c, g, or t
  modified_base (394)..(394): a, c, t, g, unknown or other
  misc_feature (394)..(394): n is a, c, g, or t
  modified_base (402)..(402): a, c, t, g, unknown or other
  misc_feature (402)..(402): n is a, c, g, or t
  modified_base (435)..(435): a, c, t, g, unknown or other
  misc_feature (435)..(435): n is a, c, g, or t
tcagtactctcgtgcacgaccggtgctcgatttagtgtcgtcgcaagagagagggggtcaggctggaactgaggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttanacagttccaacaatgaaaactacttagcttggtaccagcagagaccaggacagcctcgtaggctgctcatttactggcactctacccgggaatcccgggtcctcgaccgtattcgagtggcaggcgggtcngggacagtnttcactcncacatcagcagcctgcaggctagaagtatgtgntagtttattagtcgtacaacaattattaattatacgtttacggtaggtaccgttcggaaccgtaacgggtacccgaagggtaggaatagtcgtaacgg

SEQ ID NO: 278388 - DNA, 586 bp, Homo sapiens
  misc_feature: GYAE6OF01C9HCV.19.71.G05.1.454.CMB.1.raw
tcagtactctcgtgcacgaccggtgctcgatttagtgtcgtcgcaagagagagggggagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaacgccctcgcagaccctctcgctcacctgtgccatcgtccggggacagagtcgctagcgacagtgtgcttggcacgtgggtcaggcacgtcccatcgagaggtctagagtggctggggaagacattattcatgtccaacacgtaggaaattaacaaattatcgacacctatctgttagagagtcgactagaacaatacaaacgtagacaactactacgaacgaaccgtacgttaccgtcccgtagtaccgtacgtccgttacgtacccttacgttcggtacgtacccgtacccggaacgggtaccgtacggggttagttaacgttacgtttaccgttaggttacgggaaacggtaccggtaccccctaagtacgtaaacccg

SEQ ID NO: 278389 - DNA, 557 bp, Homo sapiens
  misc_feature: GYAE6OF01A1PLW.19.71.G05.1.454.CMB.1.raw
  modified_base (438)..(438): a, c, t, g, unknown or other
  misc_feature (438)..(438): n is a, c, g, or t
  modified_base (450)..(450): a, c, t, g, unknown or other
  misc_feature (450)..(450): n is a, c, g, or t
  modified_base (507)..(507): a, c, t, g, unknown or other
  misc_feature (507)..(507): n is a, c, g, or t
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaagccctgcagaccctctcgctcacctgtgccatcgtccggggacagagtcgctagcgacagtgtgcttggcacgtgggtcaggcacgtccccagtcgagaggtctaggagtggcgtagggaagactatatttcagtcgtaccaacgtacggtaggaaataactaaatttactacgaccacctattcgtagttgagtagtcgactagacaatacaacgtagacacatacgaanaacctagttccncccgtagcacgtctacgtacctcgtcgtacgaccgtccggacggtacggacgggttnttaacgttagttacgtaggtacgggaaacgccggaccccgtagtaaccgg

SEQ ID NO: 278390 - DNA, 590 bp, Homo sapiens
  misc_feature: GYAE6OF01BNJDM.19.71.G05.1.454.CMB.1.raw
  modified_base (228)..(228): a, c, t, g, unknown or other
  misc_feature (228)..(228): n is a, c, g, or t
  modified_base (238)..(238): a, c, t, g, unknown or other
  misc_feature (238)..(238): n is a, c, g, or t
  modified_base (316)..(316): a, c, t, g, unknown or other
  misc_feature (316)..(316): n is a, c, g, or t
tcagtactctcgtgcacgaccggtgctcgatttagtgtcgtcgcaagagagagggggaggtacaacaggcaggcaggggcagcaagatggtgttgcagacccaggtcttcatttctctgttgctctggatctctggtgcccacggggacatcgtgatgacccagtctccagacctccctggctgtgtctctgggcgagcgggccaccatcaactgcaagtccagccanaattctttanacagttccaactaatagaaaactacttagcttggtaccagcagagaccaggacagcctcctaggctgctcatttacgngggcacgtcgtaacccgggaacgtccggggtccctggacccgtattcgagtcggcgaggccgggtctagggactaggtatttcactcctcaccatcagtcacgcctgacaggctaggaagtgtgtggtactagtttaattgtagtactaaactaattagtttattactacgtttcggtaggttacggttaccggaccgtaaacggggtacctaaagggttggaacttaacgtacgaacggtaaccgtaacgtgggtacgtccgtacggaacccg

SEQ ID NO: 278391 - DNA, 840 bp, Homo sapiens
  misc_feature: GYAE6OF01D5O9C.19.71.G05.1.454.CMB.1.raw
  modified_base (239)..(239): a, c, t, g, unknown or other
  misc_feature (239)..(239): n is a, c, g, or t
  modified_base (318)..(318): a, c, t, g, unknown or other
  misc_feature (318)..(318): n is a, c, g, or t
tcagtactctcgtgcacgaccggtgctcgatttagtgtcgtcgcaagagagagggggaggtacaacaggcaggcaggggcagcaagatggtgttgcagacccaggtcttcatttctctgttgctctggatctctggtgcccacggggacatcgtgatgacccagtctccagactccctggctgtgtctcgtgggcgagcgggccaccatcaactgacaagtccagccacaattctttanacagttccaaacaatagaaaactacttagcttaggtaccagacagagaccaggacagcctcaggctgctctatttacgngggctacgtaccgtaacccggggaacttcccgggggtacccctaggaaccgtacgtttcgacggtcggaccgagggtccggggttacgtaggggaacctaggttaacttttcccgaaccgtttcctacccgtaaacctacgttaccgaacggacccgtaacggtccccgttagggacccgtaacggggtcccgttaaaggaaaggttaaacggttcgggttacggggtaaccttttaacgggttttttaaactttaagggttttaacggttaaacccctaaaagtttaaaagtttttaaactttttaacgtttaaacgtttaacccgggttttaccgggttaacgggggttaaaccccggtttttacccgggggaaacccgttaaaaaaccgggggggtaccccggttaaaaagggggttaccggtttaaaacgtttaaccggttaaacccggtaaacgggtaaacccggttaaacggtttaaacgggtttccgggaacccgtttaacgggtaaacccccgg

SEQ ID NO: 278392 - DNA, 728 bp, Homo sapiens
  misc_feature: GYAE6OF01C9KS3.19.71.G05.1.454.CMB.1.raw
tcagtactctcgtgcacgaccggtgctcgatttagtgtcgtcgcaagagagaggggggaggtacaacaggcaggcaggggcagcaagatggtgttgcagacccaggtcttcatttatctgttgctctggatctctggtcgcccacggggacatcgtgatcgacccagtctccagactccctggctgtgtctcgtgggcgaggcgggccaccatcaactgacaagtccaagccaactaattctttatacagttaccaacaatagaaaactacttagcttggaccagcagacgacaggacacgcctctagctgctctattacgtggctataccgtacccgggaacgttcccggggtaccctacggaaccgtacgttccgacgggttcggaccgaacggtccggggtcgtaggggaacctaggttactttccgaaccttccgtacccaacctacgttaccgaacgtaccgtaacggtcccgtacggaccgaacgggtccgtaagggaaagtacgttcgggtcggttaacgtttaacggttttttaactttaacgtttacggtaacctaaaacgttaaactttaagttttaactttaacttaccgtttcgggttaacgggtacccggtttaccgggaaccgttaaaacgggggtaaccgtaaaggggttacgtaaacggttactaacggaaccggtaacgtaacgttacgggtacggtccgtacggtaaccc

SEQ ID NO: 278393 - DNA, 591 bp, Homo sapiens
  misc_feature: GYAE6OF01ECO6W.19.71.G05.1.454.CMB.1.raw
  modified_base (239)..(239): a, c, t, g, unknown or other
  misc_feature (239)..(239): n is a, c, g, or t
  modified_base (316)..(316): a, c, t, g, unknown or other
  misc_feature (316)..(316): n is a, c, g, or t
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctcgtgggcgagcgggccaccatcaactgcaagtccagccacaatcttttanacagttccaacaatagaaaactacttagcttggtaccagcagagaccaggacagcctccgtaggctgctcatttacnggcatcgtaacccgggatcccggggtcctgaccgtattcagtggcaggcgggtctgggacaggtactttcactctacaccatcacgcagcctgcaggctagaagtatcggtggtacttagttttattagttacgtactaaactaattatttaacttacgttaccgtttcggtacggtacggtttaccgggacccgtaaaggggtaacccgtaaaggggttggaactttaagtacgaaacggtaaccggtaacgttaggtggtccgttggaacccc

SEQ ID NO: 278394 - DNA, 790 bp, Homo sapiens
  misc_feature: GYAE6OF01D8C3S.19.71.G05.1.454.CMB.1.raw
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatcgacccagtctccagactccctggctgtgtctcgtgggcgaggcgggccaccatcaactcgacaacgtccacgaccaactaattctttttaataccacgtttacccaaaactaaactaacgtaaaaaaccttaactttaagtaccgtttacggtaacccaggacaacggaacggaacccgaagggaaccaacggtccccttacccgtaagggtccttacggccttactaacgttttaccgtggggtacctaacgttaccccggttaacccggggtaacgttccccgggggttcccctaggtaacccggtatttaccggaaggtcgggaccgtacggggtccgggggttacgtacggggaactacggttacttttcccgacctttccgtaccctaaccctactaccgaacgtcgtaaccgtccgttcggacgtacgggctaacggaagtacgttcgggtaggtaccttagttttaactttacgttacgttaaccaaacttaatttaactttaactttaacttaccggttcggtacggttaccggttccggaaccggtaaacggggtacccgtaaagggtacggtaattacgtacgtaaacggtaacgtaacgtaggttcggaccgtgaacccg

SEQ ID NO: 278395 - DNA, 573 bp, Homo sapiens
  misc_feature: GYAE6OF01AVHEY.19.71.G05.1.454.CMB.1.raw
  modified_base (239)..(239): a, c, t, g, unknown or other
  misc_feature (239)..(239): n is a, c, g, or t
  modified_base (430)..(430): a, c, t, g, unknown or other
  misc_feature (430)..(430): n is a, c, g, or t
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaattcttttanacagttccaacaatagaaaactacttagcttaggtaccagcagagaccaggacagcctcctagctcgctcattactgggcatcctaccgggaactccggggtccctgaccgtattcgagtcggcgaggcgggtctgggactaggtactttcactctacacctatcagcagtcctgcacggctgaagtatgnggtctagtttattattagtactaactaattatttattacttacttacggtaggtaccgttccgggaaccgtaaacggggtaaccgtaagggtggaacttacgtacgaacggtaacgtaacgtaggttacggtctggtaacccg

SEQ ID NO: 278396 - DNA, 553 bp, Homo sapiens
  misc_feature: GYAE6OF01C8R41.19.71.G05.1.454.CMB.1.raw
  modified_base (229)..(229): a, c, t, g, unknown or other
  misc_feature (229)..(229): n is a, c, g, or t
  modified_base (239)..(239): a, c, t, g, unknown or other
  misc_feature (239)..(239): n is a, c, g, or t
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgaggcgggccaccatcaactgcaagtccagccanaatcttttanacagttccaacaatagaaaactacttagcttggtaccagcagagaccaggacagcctcctaggctgctcatttactgggcatcgtacccgggaatccggggtccctgaccgattcagtggcaggcgggtctgggacagtattcgactcctacaccatcagcacgcctggcaggctaggaacgagtgtggtactaggtttattagttgtactaaactaaattattactttagttacttcgtggtacgttcggaccgaaacgggtacctaaaggtggattactacgaacggacgtaacgtgtcggtctggtacccg

SEQ ID NO: 278397 - DNA, 622 bp, Homo sapiens
  misc_feature: GYAE6OF01CMGB0.19.71.G05.1.454.CMB.1.raw
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaagccctcgcagacccctctcgctcacctgtcgccatcgtccggggacagagtcgctagcgacagtgttgcttggcacgtgggtcaggcacgtcccatcgagaggtctagagtggcgtagggaagactatatttcattcgtaccaacgacgtaggaaactaactaaatttatcgaccaacctattcgttagttaggaagtacgtcgtaactagaacaaagttaccgaaacgtacgaaccaactaacgtaaccgaaacgtaaacccgtaacggttaccctacccgtagacctacgtacctacgtaacccgttcgttacggtaccgtacccgtacccggaacggtaccgtacggggttacttaacgttacgtttacgtacggtaacgggaacggtaacccggccccgtaaagtaaccgg

SEQ ID NO: 278398 - DNA, 605 bp, Homo sapiens
  misc_feature: GYAE6OF01A38UT.19.71.G05.1.454.CMB.1.raw
  modified_base (235)..(235): a, c, t, g, unknown or other
  misc_feature (235)..(235): n is a, c, g, or t
tcagtactctcgtgcacgaccggtgctcgatttagtgtcgtcgcaagagagagggggtcaggctggaactgaggagcaggcaggggcagcaagatggtgttgcagacccaggtcttcatttctctgttgctctggatctctggtgcccacggggacatcgtgatgacccagtctccagactccctggctgtgtctcgtgggcgagcgggccaccatcaactgcaagtccagccanaatctttatacagttccaacaatagaaaactacttagcttggtaccagcagacgaccaggacacgcctcctaggctgctcatttactgggcacgtccgtaacccgggaacgtcccggggtccctggacccgtattcgaggtcggcgaggcgggtcgtagggacaggtactttaccgacttcctctaacccatccgaacgtccacgtccgtgccgacggctaggaagtgtggttacggtacgttagtttacgtttaagttcgttacaaacgtaattagtttaattacttacgtttcggttacggtaccggtttaccggaccgtaacgggaccgtaaggtacgtacttaactacgaaggtaacgtaagtcgg

SEQ ID NO: 278399 - DNA, 575 bp, Homo sapiens
  misc_feature: GYAE6OF01BO1QV.19.71.G05.1.454.CMB.1.raw
tcagtactctcgtgcacgaccggtgctcgatttagtgtcgtcgcaagagagagggggagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaagccctgcagaccctctcgctcacctgtcgccatcgtccgggacagagtcgctagcgacagtgttgcttggcacgtggtcaggcagtcccatcgagagtctagagtggctgggaagacagtattcagtcgtaccaagacgtaggaactaacgaaattatagacaaccgtatctagttagagtagtacgactagacaatacaacgtagacacactacgaacgtaaccagttacctccgtgacgacgtctacgtacccttcgtacgtacgtaccgttacccggaacggaccgtaacgggttacgttaacgttaacgtttaacgttacgggttaacgggaaacgtaccgggtaccccctaagttaacgaaaccg

SEQ ID NO: 278400 - DNA, 531 bp, Homo sapiens
  misc_feature: GYAE6OF01ESXKY.19.71.G05.1.454.CMB.1.raw
  modified_base (236)..(236): a, c, t, g, unknown or other
  misc_feature (236)..(236): n is a, c, g, or t
  modified_base (315)..(315): a, c, t, g, unknown or other
  misc_feature (315)..(315): n is a, c, g, or t
  modified_base (339)..(339): a, c, t, g, unknown or other
  misc_feature (339)..(339): n is a, c, g, or t
  modified_base (384)..(384): a, c, t, g, unknown or other
  misc_feature (384)..(384): n is a, c, g, or t
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacatctttanacattccaacaatagaaaactactagtcttaggtaccagcagagaccaggacacgcctccgtaggctgctctatttacnggcatcgaccggaatccgggtccngaccattcagtgcaggcggtctgggacagtatttcactctcaccntcagcagcctgccaggctagaagtgtgtgtctagtttacttattacgtacaactaattattaacttatactttcgttaggtaccgttacggaccgtaacgggacctaagggtcgtatacgacgagtaacaacgtgtacggctgtacc

SEQ ID NO: 278401 - DNA, 532 bp, Homo sapiens
  misc_feature: GYAE6OF01CRPQV.19.71.G05.1.454.CMB.1.raw
  modified_base (415)..(415): a, c, t, g, unknown or other
  misc_feature (415)..(415): n is a, c, g, or t
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatctttatacagttccaacaatagaaaactacttagcttaggtaccagcagagaccaggacagcctcctaggctgctcatttactgggcatcctacccgggaatccggggtccctggaccgattcagtggcaggcgggtctgggacagtattcactctcaccatcagcagcctgcaggctagaagntgtgctagtttatattgtactaaatattattattatacttcgtggtacgttcgggacctaaaggggcctaagggtggaattacgtcgaagtaccgtaactggtacggtctggtaccc

SEQ ID NO: 278402 - DNA, 782 bp, Homo sapiens
  misc_feature: GYAE6OF01BWDH5.19.71.G05.1.454.CMB.1.raw
  modified_base (408)..(408): a, c, t, g, unknown or other
  misc_feature (408)..(408): n is a, c, g, or t
tcagtactctcgtgcacgaccggtgctcgatttagtgtcgtcgcaagagagaggggggaggtacaacaggcaggcaggggcagcaagatggtgttgcagacccaggtcttcatttctctgttgctctgatctcgtggtcgcccggacgggactagtcgtagagtcgacccagtcctccgagacctccgtggctgtcgtctcgtgggcgaggccggacccacgtatacaactcgacgtaacgtccgacgaccctaactaacttttacttttaacgtaaccgtaacgtttaacccaaaacgtaaattaacgtaaaaaccttacgttaacgtaccgtttacggtaacccagacgaagaccgaaccgacggacacgtcccctacgtacggctcgtccttactaatttacggngggactacgtaccggtaacccgggtaaccgttcccggggtccctaggaacccttagttaccgaggtcggacgacgggtccggggttacgacgggtacaagttacgtttccgacttaccgtaccgtacctaacgttaccgacgaccgtaacgtcccgtaggaccgtagtccgtaaggaaacgtcgttaggtcggtaccgtttaagtttttagttacgtttacgtaactaaaccttaagtttaattttacttaacgtttaccgttttacgggacggttacccggttcgggaacccggtaaagggtaccggttaaggggtagtaagttaaccgtcgaaacggtacggttaagttcggccggttagccggtaaacccg

SEQ ID NO: 278403 - DNA, 533 bp, Homo sapiens
  misc_feature: GYAE6OF01A63KG.19.71.G05.1.454.CMB.1.raw
  modified_base (239)..(239): a, c, t, g, unknown or other
  misc_feature (239)..(239): n is a, c, g, or t
  modified_base (314)..(314): a, c, t, g, unknown or other
  misc_feature (314)..(314): n is a, c, g, or t
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccgatcaactgcaagtccagccacaatcttttanacagttccaacaatgaaaactacttagcttggtaccagcagagaccaggacagcctcctaggctgctcatttacngggcatccgtacccgggaatccggggtccctggaccattcagtggcagcgggtctgggacagtactttcactctacaccatcagcagcctgcaggctagagatgtgctaagtttattattgtacaactagttaattattaatacttcgtaggtacgttcggaccgtaagggacctaagggtggactagtacaaggtacgtaacgtgtcggtcgtgaccg

SEQ ID NO: 278404 - DNA, 713 bp, Homo sapiens
  misc_feature: GYAE6OF01DD9B2.19.71.G05.1.454.CMB.1.raw
  modified_base (247)..(247): a, c, t, g, unknown or other
  misc_feature (247)..(247): n is a, c, g, or t
  modified_base (336)..(336): a, c, t, g, unknown or other
  misc_feature (336)..(336): n is a, c, g, or t
  modified_base (344)..(344): a, c, t, g, unknown or other
  misc_feature (344)..(344): n is a, c, g, or t
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccgacggggacatcgtgatgacccagtctccagctccctggctgtgtctcgtgggcgaggcgggccaccatcaactgacaacgtccagccaactaatttcttttaanactacgttaccaaacaataagtaaaacctacttagctttacggtaccagccaagacgaccaggaaccacgtcctacgtaggctgccttnatttacgngggtacagtaccgtacccgggagttcccggggtccctggaaccgtattccgaggtacggccgaggtccggggtcgtagggactacgttacttacccgacttcctaccaaccgtataccgacggtccaacggtccgtacggcgaacggtcgttaacggaaagtcgttagggttggtaacctttaagttttttaacttagttaccggttaactaaaccttaaagtttaacttttaagtttaaccgtttaccgtttacgggttaacggtaccgggtttacccggaaacccgtaaaggggttaacccgaaggggttagtaacgttacttacggaaacggtaacgttaacgttgggtacgtccgtagtaacccg

SEQ ID NO: 278405 - DNA, 667 bp, Homo sapiens
  misc_feature: GYAE6OF01CJ4WB.19.71.G05.1.454.CMB.1.raw
  modified_base (245)..(245): a, c, t, g, unknown or other
  misc_feature (245)..(245): n is a, c, g, or t
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccgacggggacatcgtgatcgacccagtctccagacctccctggctgtgtctcgtgggcgaggccgggccaccatcaactgacaagtccagccactaatctttanactagttaccaacaatagaaaacttacttagcttaggtaaccagacaagacgaaccgaggacagccctccgtaggctgctctatttcgtgggcacgtaccgtaacccggggattccccggggtccctaggacccgtattccgaggtcggacgtacgggtcgggtacgtacggggactacggtatttccgaccttcctaccacctaacgtccgaacggtccaacggtccccgttaggaccgtacgggaccgttaaggaaagtacgttgggtacggtactttaaggtttttatacgtttagtaacctaaattaatttaatttaacgttaattaccgttggtacggtacgttaccggacgtaaacggggacctaaagggtcggtaacttacgtacgaacggtacgaacgtggtacggcttcgaac

SEQ ID NO: 278406 - DNA, 522 bp, Homo sapiens
  misc_feature: GYAE6OF01BZF7U.19.71.G05.1.454.CMB.1.raw
  modified_base (313)..(313): a, c, t, g, unknown or other
  misc_feature (313)..(313): n is a, c, g, or t
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttatacagttccaacaatgaaaactacttagcttggtaccagcagagaccaggacagcctcctaggctgctcatttacngggcatctacccgggaatccggggtccctgaccgattcagtggcagcgggtctgggacagatttcactctcaccatcagcagcctgcaggctagaagtagtgtggctagttttatattgtacaataattattattattacttcgtggtacgttcggaccaaagggacctaagggtggatagtcacgtacgaacgttgcggtctgtaccg

SEQ ID NO: 278407 - DNA, 716 bp, Homo sapiens
  misc_feature: GYAE6OF01AIUZ1.19.71.G05.1.454.CMB.1.raw
  modified_base (237)..(237): a, c, t, g, unknown or other
  misc_feature (237)..(237): n is a, c, g, or t
  modified_base (315)..(315): a, c, t, g, unknown or other
  misc_feature (315)..(315): n is a, c, g, or t
tcagtactctcgtgcacgaccggtgctcgatttagtgtcgtcgcaagagagagggggaggtacaacaggcaggcaggggcagcaagatggtgttgcagacccaggtcttcatttctctgttgctctggatctctggtgcccacggggacatcgtgatcgacccagtctccagactccctggctgtgtctcgtgggcgagcggccaccatcaactgcagtccagccacaattctttanacagttaccaacaatgaaaactcttagcttggtaccagcagacgaccaggacagccctcgtagctgctctatttacgngggctactccgtaacccgggaacgtcccggggtccctaggacctattcgagtcggcgaggccgggtcgtacgggactaggttactttcccgacttcctaccacctactaccgagtccgacgtcctggaccgacgggtcctaaggaacgtacgttggtcggtaccgttaagtttttaacgtttagttaccggtaaccttaaaccttaaatttaaacgttttaacgttttaacgtttaacccggttttacgggttaaccgggttaacccgggtttaaccccgggaaacccggttaaaacggggtaaaccccggtaaagggggtttacggtaaacgttaaccgtaaccggaaacgggttaaaccggttaacgttacgggtccggttacgtacggttaaaccccg

SEQ ID NO: 278408 - DNA, 571 bp, Homo sapiens
  misc_feature: GYAE6OF01AJT06.19.71.G05.1.454.CMB.1.raw
  modified_base (238)..(238): a, c, t, g, unknown or other
  misc_feature (238)..(238): n is a, c, g, or t
  modified_base (314)..(314): a, c, t, g, unknown or other
  misc_feature (314)..(314): n is a, c, g, or t
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttanacagttccaacaatgaaaactacttagcttggtaccagcagacgaccaggacagcctctaggctgctcatttacgngggactatcctacccgggaattcccggggtccctgaccgtattcgagtgcaggtcgggtctgggacagtatttcactcctcaccatcagcacgcctgcaggctagaacgtagtcggtcgtctaagttttattagttacgtacaaactattattattactacttcgttagggtaccgttacggaccgtaaacggggtaccctaagggtggtaacttacgtaccgaaggtaccgtaaaccttgggtcggtctggtaccc

SEQ ID NO: 278409 - DNA, 529 bp, Homo sapiens
  misc_feature: GYAE6OF01AE9BJ.19.71.G05.1.454.CMB.1.raw
  modified_base (238)..(238): a, c, t, g, unknown or other
  misc_feature (238)..(238): n is a, c, g, or t
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttanacagttccaacaatgaaaactacttagcttggtaccagcagagaccaggacagcctcctaggctgctcatttactgggcatcctacccgggactccggggtccctgaccgattcagtggcagcgggtcgtgggacagtatttcactctccaccatcacgcacgcctgcaggctgaagatggtggctagtttattagttgtacaataattatttattattacttcgtggtacgttcggaccgaagggtaccgtagggtaggtatagtacagacgaacgtggtgcgtgtaccg

SEQ ID NO: 278410 - DNA, 511 bp, Homo sapiens
  misc_feature: GYAE6OF01DLQC8.19.71.G05.1.454.CMB.1.raw
  modified_base (238)..(238): a, c, t, g, unknown or other
  misc_feature (238)..(238): n is a, c, g, or t
  modified_base (417)..(417): a, c, t, g, unknown or other
  misc_feature (417)..(417): n is a, c, g, or t
  modified_base (491)..(491): a, c, t, g, unknown or other
  misc_feature (491)..(491): n is a, c, g, or t
  modified_base (506)..(506): a, c, t, g, unknown or other
  misc_feature (506)..(506): n is a, c, g, or t
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaattctttanacagttaccaacaatagaaaactacttagcttggtaccagcagagaccaggacacgcctcctaggctgctcatttactgggcatccgtacccgggaatccggggtcctgaccgattcagtggcagcgggtctgggacagtatttcactctacaccatcagcagcctgcaggctagaagntgtggctagtttatattgtactaatatattattatcgttcgtgtacgttcggacgaacggactaagggtgatancagtacgaactgtgntgacc

SEQ ID NO: 278411 - DNA, 702 bp, Homo sapiens
  misc_feature: GYAE6OF01EDSR0.19.71.G05.1.454.CMB.1.raw
  modified_base (342)..(342): a, c, t, g, unknown or other
  misc_feature (342)..(342): n is a, c, g, or t
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacgggacatcgtgatgacccagtctccagactccctggctgtgtctcgtgggcgagcgggccacgatcaactgacaacgtccagccactaattcttttaataccagttaccaaactaatacgaaaaaccttacttaacgctttacggtaaccagaccagacgaccgaggacacgcctaccgtaggctgctctatttacgngggctacgtaccgtacccgggtaacgtcccggggtaccctggaaccgtagttcgaggtcggacgtaggtcggggtcgtagggtaactaggttactttccgacttccgtacaccctatcgacggtcacgcccgtagccgaggtctagaaacggtgttcggtacggtacttaaggtttttaattaacgttacgttaacctaaacgttaattttaacgtttaactttaacgtttaccgtttacggtacgggttaaccggtttccgggaaccgttaaacggggtaaccgtaaagggttacggtaacttaaacggttaccgaaacggttaaccggtaacgtttgggtacggtcctacggtaaccc

SEQ ID NO: 278412 - DNA, 616 bp, Homo sapiens
  misc_feature: GYAE6OF01D1LIA.19.71.G05.1.454.CMB.1.raw
  modified_base (228)..(228): a, c, t, g, unknown or other
  misc_feature (228)..(228): n is a, c, g, or t
  modified_base (238)..(238): a, c, t, g, unknown or other
  misc_feature (238)..(238): n is a, c, g, or t
  modified_base (294)..(294): a, c, t, g, unknown or other
  misc_feature (294)..(294): n is a, c, g, or t
  modified_base (319)..(319): a, c, t, g, unknown or other
  misc_feature (319)..(319): n is a, c, g, or t
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccanaattctttanacagttccaaacaatagaaaaactacttagcttggtaccagcagacgaccaggacngcctactaggctgctacatttacgngggcagtccgtaacccgggaatcccgggggtacctggaccgtattcgaggtggcaggcgggtctgggacagtactttcactctcactatcagcagcctgcaggtctagaacgattcggtgtactagttttattagttactactaaacgttaattaacgtttaattaacgttacgtttacgggtacggttaaccggttaccgggaacccgtaaaggggtacccgttaaaggggtacggtaaactacgttaaccggaacggtaaacccggttacgtagggttcggtaccgtgggtaccc

SEQ ID NO: 278413 - DNA, 831 bp, Homo sapiens
  misc_feature: GYAE6OF01BIB7Z.19.71.G05.1.454.CMB.1.raw
  modified_base (240)..(240): a, c, t, g, unknown or other
  misc_feature (240)..(240): n is a, c, g, or t
  modified_base (251)..(251): a, c, t, g, unknown or other
  misc_feature (251)..(251): n is a, c, g, or t
  modified_base (328)..(328): a, c, t, g, unknown or other
  misc_feature (328)..(328): n is a, c, g, or t
tcagtactctcgtgcacgaccggtgctcgatttagtgtcgtcgcaagagagaggggggaggtacaacaggcaggcaggggcagcaagatggtgttgcagacccaggtcttcattttctctgttgctctggatctctggtgcccacggggacatcgtgatgacccagtctccagactccctggctgtgtctctgggcgagcgggccaccgatcaactgacaagtccagccacatcttttanacagttccaanaatagaaaactcttagcttggtaccagcagacgaccaggacacgccctccgtaggcctgccttacgtattttaccgngggcctacgttacccgtaacccggggtaacgttcccggggggttacccccttaggaaccccgtagttttacccgaacgggtttcggggacccgaaggggttcccgggggttaccgtacggggggaaccttaacgggttactttttacccgaacccgtttacccttaccccgtaaacccgtaacttccgtaaacggcccgtaaaccggtccccgttacggaccggtaaccgggtaccgttaacgggaaaggttaacgttcggttacgggttaccgttaaagtttttaacgttttaacgtttaacggtttaaccctaaaacgtttaaagtttaaactttttaacttttaaccgtttaaccggttttaccgggttaacgggttacccggttttaccgggtaaacccggtaaaccgggggtaaacccgttaaaggggttacggtaacgttaactaaccgtaacgggtaaccgtaacggtttacggtacgggtaccgttccggaaccg

SEQ ID NO: 278414 - DNA, 563 bp, Homo sapiens
  misc_feature: GYAE6OF01EFRGK.19.71.G05.1.454.CMB.1.raw
  modified_base (237)..(237): a, c, t, g, unknown or other
  misc_feature (237)..(237): n is a, c, g, or t
  modified_base (316)..(316): a, c, t, g, unknown or other
  misc_feature (316)..(316): n is a, c, g, or t
tcagtactctcgtgcacgaccggtgctcgatttagtgtcgtcgcaagagagagggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttanacagttccaacaatagaaaactacttagcttaggtaccagcagagaccaggacagcctccgtaggctgctcatttacgnggcatcctacccgggactccggggtccctgaccgattcgagtggcaggcgggtctgggacagtactttacactcctacaccatcacgccacgcctggaccaggcgtagaagtacgtggtaggtcttagtttattagttgtacaaactaattaattattatacgttggtacggtacggttccggaccgtaacgggacctaagggtagtaactagtacgaaagtaacgtaacgtggtcggcgtcgaccg

SEQ ID NO: 278415 - DNA, 536 bp, Homo sapiens
  misc_feature: GYAE6OF01D470G.19.71.G05.1.454.CMB.1.raw
tcagtactctcgtgcacgaccggtgctcgatttagtgtcgtcgcaagagagagggggagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaagccctgcagaccctctcgctcacctgtgccatctccggggacagagtcgctagcgacagtgttgcttggcacgtgggtcaggcacgtccccatcgagaggtctagagtggctgggaagacatatttcatcgtaccaacacgtaggaataacaaattatgacacctatctgttgagagtcgactgacatacaacgtagacacatacgaacgacagttcctcccgtagaccagtcctagtacctcgtcgtcgaccgtacccggaaggaccgtacgggtagttacgtacttacgtacgggtacggaacggaccggaccccctagtacgtaaccg

SEQ ID NO: 278416 - DNA, 524 bp, Homo sapiens
  misc_feature: GYAE6OF01A5VWP.19.71.G05.1.454.CMB.1.raw
  modified_base (238)..(238): a, c, t, g, unknown or other
  misc_feature (238)..(238): n is a, c, g, or t
  modified_base (313)..(313): a, c, t, g, unknown or other
  misc_feature (313)..(313): n is a, c, g, or t
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccacatcaactgcaagtccagccacaattcttttanacagttccaacaatgaaaactacttagcttggtaccagcagagaccaggacagcctcctaggctgctcatttacngggcatcctacccgggaatccggggtccctgacccgattcagtggcagcgggtctgggacagtatttcactctcaccatcagcagcctgcagctgaagatgtggctagtttattattgtacaaactaattattaattatacgttgtacggtacgttcggacctaacgggacctaagggtgatagtacagaacgtacgtggtcggcgtgacc

SEQ ID NO: 278417 - DNA, 655 bp, Homo sapiens
  misc_feature: GYAE6OF01E5T9X.19.71.G05.1.454.CMB.1.raw
  modified_base (239)..(239): a, c, t, g, unknown or other
  misc_feature (239)..(239): n is a, c, g, or t
  modified_base (417)..(417): a, c, t, g, unknown or other
  misc_feature (417)..(417): n is a, c, g, or t
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccactaattctttanactagttaccaaacaatagaaaacttacttagcttacgaccagacagacgaccaggacacgcctcgtaggctgctctatttacgtggctacgtccgtacccgggtaacgtcccggggtaccctgaccgtatcgaggtcggcgtaggtcggtcgtgggactacgtactttaccactccnccaacctagtacacgccacgtccctaggacgacggtctaaggaagtagttgggtacgtactttaagtttaatttacgttaacgtaactaaacgttaaatttaacgtttaacgttaacgtttaccgttcgggtaacgggttacccggtttaccgggaaccggtaaacgggtacccgtaaagggttacgtaagttacgtacgaacggtaaccgtaggtacggtcgggtcctgtaaccccg

SEQ ID NO: 278418 - DNA, 558 bp, Homo sapiens
  misc_feature: GYAE6OF01AM9LJ.19.71.G05.1.454.CMB.1.raw
  modified_base (239)..(239): a, c, t, g, unknown or other
  misc_feature (239)..(239): n is a, c, g, or t
  modified_base (548)..(548): a, c, t, g, unknown or other
  misc_feature (548)..(548): n is a, c, g, or t
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctcgtgggcgagcgggccaccatcaactgcaagtccagccacaatcttttanacagttccaacaatagaaaactacttagcttaggtaccagcagagaccaggacagcctcctaggctgctctatttactggcatccgtacccgggaacttcccggggtccctgaccgtattcgaggtcggcgaggccgggttcgtcgggacagtacttttccacttcctacaccatcagcacgcctgcgaggctagaagatggtgctaagtttattattgtacaataattatttattacttacgttcggttggtacgttacggaccgaagggtaccgaaggtaggtactagtacgaagtacgaacttggngtcgtgtacc

SEQ ID NO: 278419 - DNA, 686 bp, Homo sapiens
  misc_feature: GYAE6OF01DA7PT.19.71.G05.1.454.CMB.1.raw
  modified_base (256)..(256): a, c, t, g, unknown or other
  misc_feature (256)..(256): n is a, c, g, or t
  modified_base (390)..(390): a, c, t, g, unknown or other
  misc_feature (390)..(390): n is a, c, g, or t
  modified_base (451)..(451): a, c, t, g, unknown or other
  misc_feature (451)..(451): n is a, c, g, or t
  modified_base (516)..(516): a, c, t, g, unknown or other
  misc_feature (516)..(516): n is a, c, g, or t
  modified_base (526)..(526): a, c, t, g, unknown or other
  misc_feature (526)..(526): n is a, c, g, or t
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctcgtggtgcccacggggacatcgtgatcgaccagtctccgagacctcccgtggctgtgtctcgtgggcgacggccggccaccataccaactcgacaacgtccacgaccaactaattcttttaanactacgttaccaaaactaagtaacgtaaaaaccttacgttaacgtccgtttacgggtaaccaggaccaaaggaacgacccgaagggaaccacggtcccgtaccgtagggcctcgtaccttactacgttttacgngggacctacgtaccggtaacccgggacgtcccggggtcctacggacgtattcgagtcggcngggtcggtcgtagggaactagttacttccgactctaccacctatcacgcacgtctacgcgtacgngtacggaagngttggtcggtactttaggttttacttagtctaacgtaaacttattaacgtttatttacgttacgttcggttacggtaccggttaccggtaacggaaaccgggtacgtaagggttcggaattacgtacgaacgttaacggtacttgggtacgctcggaacc

SEQ ID NO: 278420 - DNA, 644 bp, Homo sapiens
  misc_feature: GYAE6OF01ALHE0.19.71.G05.1.454.CMB.1.raw
  modified_base (236)..(236): a, c, t, g, unknown or other
  misc_feature (236)..(236): n is a, c, g, or t
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcggccaccatcaactgcaagtccagccacaatctttanacagttaccaacaatagaaaactacttagcttaggtaccagcagagaccaggacagcctcctaggctgctctatttacgtgggcacgtccgtacccgggaacttcccgggggtccctaggacccgtattccgaggtcggcgacggtcgggtcgtgggaactagtactttccacttcctaccgtaccactaccgacgcaacgtccgtgaccgacggctaggaagtacgtggtcggtacgttaagttttaacgttacgtttacgtacctaaacttaatttaagtttaatttaacttacgtttacggtacgggtaaccgtttaccggaacccggtaaaggggtacccgtaaaggggttagtaacgttaacgtacgaaggtaacgtaacgttagggtacggtcgtggtaccc

SEQ ID NO: 278421 - DNA, 779 bp, Homo sapiens
  misc_feature: GYAE6OF01DIZES.19.71.G05.1.454.CMB.1.raw
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctcgtggtcgcccgacggggacatcgtgatcgacccagtcctccagacctcccgtggctgtgtctcgtgggcgaggccggaccacctatacaactgacaacgtccacgtaccaactaattcttttaacacctacgttaccaaactaataagtaaaaaccttacgttagtcgttacggtacccagacaaggaaccgaaccgaggaccacgtaccctccgtacggctcgtcctacgtactttacgtcggacctacgtccggtaacccgggtacgttccccggggtaccctaggaacccgttagttaccggtagggcggtaccgtacgggtccgggggttaccgtacggggtaacctaacggtttacttacccgtacccgttaccctacccgaacccgttacgaccgacgtacgaaccgtcccgtagaccggacggtacggtaacggaagtacgttacgggtaggtactttaagttttaacttacgttacgttaaacctaactttaaagtttactttaacgtttaccgttacggttcggttaacgggttaccggttaacccgggaccgtaaaacggggtacccgtaaggggttactaacgttacgtaaccgaacggtaaccgttaacgtaggtacggtcgtcggtaacccg

SEQ ID NO: 278422 - DNA, 526 bp, Homo sapiens
  misc_feature: GYAE6OF01AYG10.19.71.G05.1.454.CMB.1.raw
  modified_base (237)..(237): a, c, t, g, unknown or other
  misc_feature (237)..(237): n is a, c, g, or t
  modified_base (312)..(312): a, c, t, g, unknown or other
  misc_feature (312)..(312): n is a, c, g, or t
  modified_base (520)..(520): a, c, t, g, unknown or other
  misc_feature (520)..(520): n is a, c, g, or t
tcagtactctcgtgcacgaccggtgctcgatttagtgtcgtcgcaagagagagggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttanacagttccaacaatagaaaactacttagcttggtaccagcagagaccaggacagcctctaggctgctcatttacnggcatcgtacccgggaactccggggtccctgaccgtattcgagtgcagcgggtctggacagatttcactctcaccatcagcagcctgcgagctagaagtatggtggtactaggttttattacgttgtacaaactaattatttattatacgttcgtgtacgttcggacgtaagggtactaaggtgatagtacgagtacgtaatggtcgngtgacc

SEQ ID NO: 278423 - DNA, 762 bp, Homo sapiens
  misc_feature: GYAE6OF01D2NWS.19.71.G05.1.454.CMB.1.raw
  modified_base (243)..(243): a, c, t, g, unknown or other
  misc_feature (243)..(243): n is a, c, g, or t
  modified_base (330)..(330): a, c, t, g, unknown or other
  misc_feature (330)..(330): n is a, c, g, or t
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccaggggacatcgtgatgacccagtctccagactccctggctgtgtctctgggcgaggcgggccaccgatcaactgcaagtccagccaactaattcttttaanacagttaccaaacaattagaaaacttcttagcttaggtaccagccagacgaccaggacagcctcgtaggctcgctactagtttacgnggactacgtaccgtacccgggtaacgtcccggggtcccagaccgtattccgaggtcggacgacggtcgggtacgtagggaactagtactttaccaccgttcctaccgaacctactccgaacggtacccgtacggtccccgtaggacccggtacgggtacgtaacggtaaacggtcgttacgggttacggtaacctttaaggtttttaacgttttacgttaacggttaacccttaaaacgtttaaagttttaacgtttttaacgttaacgttttaccggtttacggggttaccggtttaacccgggtttacccgggaaaccggttaaaaccgggggtaaccggttaaggggttaacggttaacgttaaccgtaacggtaaccggttaaaccggtaaccgtttaggggtaccggtaaccgttcggtaaaccccg

SEQ ID NO: 278424 - DNA, 587 bp, Homo sapiens
  misc_feature: GYAE6OF01AGG2H.19.71.G05.1.454.CMB.1.raw
  modified_base (246)..(246): a, c, t, g, unknown or other
  misc_feature (246)..(246): n is a, c, g, or t
  modified_base (346)..(346): a, c, t, g, unknown or other
  misc_feature (346)..(346): n is a, c, g, or t
  modified_base (469)..(469): a, c, t, g, unknown or other
  misc_feature (469)..(469): n is a, c, g, or t
  modified_base (553)..(553): a, c, t, g, unknown or other
  misc_feature (553)..(553): n is a, c, g, or t
  modified_base (573)..(573): a, c, t, g, unknown or other
  misc_feature (573)..(573): n is a, c, g, or t
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagacctccctggctgtgtctcgtgggcgagccgggccaccgatacaactgacaagtccagccactaattcttttanactagttaccaacaatagaaaaccttacgttacgtcgttaggtaccagccaagaacgacccaaggaccacgccctccgtaggctacgctactatttacgnggcacgtccgtaacccgggacgtcccggggtcctgaccgtatcgaggtcggcacggtcgggtcgtcgggtacagtcgttacacttctaccaccactacgacgacacgtccgagtccgacggtntagaagtagtgtagtacttagtttattgttatacgtaatagttattattatcgttggtacgtcgttcgacgaacggtctaaggngtatactacgagtacgtacnggactcgagtaccg

SEQ ID NO: 278425 - DNA, 534 bp, Homo sapiens
  misc_feature: GYAE6OF01DMOAT.19.71.G05.1.454.CMB.1.raw
  modified_base (362)..(362): a, c, t, g, unknown or other
  misc_feature (362)..(362): n is a, c, g, or t
tcagtactctcgtgcacgaccggtgctcgatttagtgtcgtcgcaagagagagggggagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaagccctcgcagaccctctcgctcacctgtgccatctccggggacagagtcgctagcgacagtgttgcttggcacgtgggtcaggcacgtcccatcgagaggtctagagtggctgggaaggacattattcatgtccaacacgtaggaaatacaaattangacaccatctgttagagagtcgactagacaatacaacgtagacaacactacgaacgaacctacgttacctaccctgaccagtctacgtacctctcggtcgacctacccggacggaccgtacgggttagttactattacgtaggtacggaacgacggaccccagtacgtaacg

SEQ ID NO: 278426 - DNA, 610 bp, Homo sapiens
  misc_feature: GYAE6OF01AMQM9.19.71.G05.1.454.CMB.1.raw
  modified_base (238)..(238): a, c, t, g, unknown or other
  misc_feature (238)..(238): n is a, c, g, or t
  modified_base (316)..(316): a, c, t, g, unknown or other
  misc_feature (316)..(316): n is a, c, g, or t
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttanacagttccaacaatgaaaactacttagcttggtaccagcagagaccaggacagcctccgtaggctgctctatttacgnggcatccgtacccgggaatcccggggtccctgaccgattcgagtcggcaggcgggtctgggacagtatttcactctcaccatcagcacgcctgcgaggctaggaagtatggtaggtactagttttatttacgttgttaccaaactaatttaactttatttaacgtttaccgtttacggttagggtaccggtttaccggggacccgtaaaacggggtaccgtaaaggggttaggtaacgttaacgttaccgaacggtaaccggtaaacgttagggttacggaccgttggaacccg

SEQ ID NO: 278427 - DNA, 780 bp, Homo sapiens
  misc_feature: GYAE6OF01CA5JN.19.71.G05.1.454.CMB.1.raw
  modified_base (255)..(255): a, c, t, g, unknown or other
  misc_feature (255)..(255): n is a, c, g, or t
tcagtactctcgtgcacgaccggtgctcgatttagtgtcgtcgcaagagagaggggggaggtacaacaggcgaggcgagggcagcaagatggtgttgcagacccaggtcttcatttctctgttgctctggatctctggtcgcccgacggggacatcgtgatcgacccagtctccagacctccctggctgtgtctcgtgggcgaggcgggccaccatacaactgacaacgtccacgaccaactaattctttttaanactacgttaccaaaactaataacgtaaaaccttacttacgtcgttacgggtaaccagacaaggaacgaccgaagggacacgccctccgtaggcctgcctactactttacgcgggacctagtacccggtaacccggggtaacgtccccgggggtaccctacggaacccgtacttacgacggtcgggacgtagggtccggggttcgtacggggaactaaagggtacttttaccacctttaccaccctaacctatacccgtacgacgaaccgtcccgtaggaccgacgggtccttaaggaaacggtagtcggttacgggtaactttaaggttttttaatttaacggtttacgtaacccgtaaaactttaaattttaaattttaactttaacgttacccggtttacgggttacgggttaaacccgggtttcccggaaaccggggtaaaccgggaacccggttaaagggtacggtaacttaacgtacgaacggtaaaccgtaacgttagggtcggtccgttacggaaccc

SEQ ID NO: 278428 - DNA, 528 bp, Homo sapiens
  misc_feature: GYAE6OF01E23Y9.19.71.G05.1.454.CMB.1.raw
  modified_base (389)..(389): a, c, t, g, unknown or other
  misc_feature (389)..(389): n is a, c, g, or t
  modified_base (419)..(419): a, c, t, g, unknown or other
  misc_feature (419)..(419): n is a, c, g, or t
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttatacagttccaacaatagaaaactacttagcttggtaccagcagagaccaggacagcctcctaggctgctcatttactgggcatccgtacccgggaatcccggggtccctgaccgattcagtggcaggcgggtctgggacagactttcactcncaccatcagcagcctgccaggctaggaagntgtggctagtttattagttagacaactaattattattattacgttcgtggaccgttcggaccgtaaagggtactaagggtgatagtcaagtacgaactggtgtctgacc

SEQ ID NO: 278429 - DNA, 571 bp, Homo sapiens
  misc_feature: GYAE6OF01APMEJ.19.71.G05.1.454.CMB.1.raw
  modified_base (241)..(241): a, c, t, g, unknown or other
  misc_feature (241)..(241): n is a, c, g, or t
  modified_base (319)..(319): a, c, t, g, unknown or other
  misc_feature (319)..(319): n is a, c, g, or t
  modified_base (366)..(366): a, c, t, g, unknown or other
  misc_feature (366)..(366): n is a, c, g, or t
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagacctccctggctgtgtctctgggcgagcgggccaccatcaactgacaagtccagccacaattcttttanacagttccaacaatgaaaactacttagcttaggtaccagcagacgaccaggacacgcctcctaggctgctcatttacnggacatcgtaccgggatccggggtcctgaccgatcagtgcagcggtngggacagtattcactctcaccatcagcagcctagcgaggctagaagctgcgtactaagtttattagttacgacaaacgtaattatttaattaacgttacttacggttcggtaccggtttcgacccggtaaaaggggtaccgtaaagggttcggaattaagttacgaaacggtaaccggtaacgttaggacggtctacgggtaccc

SEQ ID NO: 278430 - DNA, 656 bp, Homo sapiens
  misc_feature: GYAE6OF01BPFI3.19.71.G05.1.454.CMB.1.raw
  modified_base (240)..(240): a, c, t, g, unknown or other
  misc_feature (240)..(240): n is a, c, g, or t
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgacaagtccagccacaattcttttanacagttccaataatagaaaactacttagcttaggtaccagcagacgaccaggacacgcctccaggctgctctatttacgcgggctataccgtaacccgggaacgtcccgggggtaccctacggaccgtattccgagtcggcgtacggcggggttctaggggactaggtactttacgaccttctccaaccctatacgacgtccgaacgtcctagccgtagggccgtaaggaaacgtgtgggttcggtacttaaggttttaagttacgtttacgtaacctaaactaaagttttaactttaactttaacgtttactttaccgggttacggttaaccggttacccgggaaccggttaaacgggaacccgtaagggtacggtataacgtacaacggtaacgtaacgtgtcggtcgtcgacc

SEQ ID NO: 278431 - DNA, 536 bp, Homo sapiens
  misc_feature: GYAE6OF01AIR2Z.19.71.G05.1.454.CMB.1.raw
  modified_base (243)..(243): a, c, t, g, unknown or other
  misc_feature (243)..(243): n is a, c, g, or t
  modified_base (318)..(318): a, c, t, g, unknown or other
  misc_feature (318)..(318): n is a, c, g, or t
tcagtactctcgtgcacgaccggtgctcgatttagtgtcgtcgcaagagagagggggtcaggctggaactgaggagcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacatcttttanacagttccaacaatgaaaactacttagcttggtaccagcagagaccaggacagcctcctaggctgctcatttacngggcatcctacccggggaatcccggggtccctgaccgattcagtcggcaggcgggtctgggacagtattcactctcaccatcagtcagcctgcaggctagaagtcgtgtggactagtttattattgtacaactaattattaattacttacgttgtacggtacgttacggactaaaggggacctaagggttcgaattactagaagtaccgtaagtcggg

SEQ ID NO: 278432 - DNA, 570 bp, Homo sapiens
  misc_feature: GYAE6OF01AOA5C.19.71.G05.1.454.CMB.1.raw
  modified_base (372)..(372): a, c, t, g, unknown or other
  misc_feature (372)..(372): n is a, c, g, or t
tcagtactctcgtgcacgaccggtgctcgatttagtgtcgtcgcaagagagagggggtcaggctggaactgaggagcaggcaggggcagcaagatggtgttgcagacccaggtcttcatttctctgttgctctggatctctggtgcccacggggacatcgtgatgacccagtctccagactccctggctgtgtctcgtgggcgagcgggccaccatcaactgcaagtccagccacaattcttttatacagttccaacaatacgaaaactacttagcttaggtaccagacagacgaccagacacgcctcctaggctgcctctagtttactgggctacgtccgtacccgggaacgtcccggggccctgaccgtnttcgagtggcaggtcggtcgtggactagtacttcactctcacctatcagcacgcctgccgaggctagaagtagttggtcggtacttagtttattacttgtactaactaattaacttattattacgttcggtaggtaccgttaggaccgtaagggtaccgtaagggttacgtacttagtaccaggtacgtaacgttcgg

SEQ ID NO: 278433 - DNA, 734 bp, Homo sapiens
  misc_feature: GYAE6OF01DL8I9.19.71.G05.1.454.CMB.1.raw
  modified_base (242)..(242): a, c, t, g, unknown or other
  misc_feature (242)..(242): n is a, c, g, or t
  modified_base (336)..(336): a, c, t, g, unknown or other
  misc_feature (336)..(336): n is a, c, g, or t
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagacctccctggctgtgtctcgtgggcgagcgggccacatacaactgacaagtccagccactaattctttanaccagttaccaaacaatacgaaaacttacttagcctttaggtaaccagccaagacgaccaggacacgccctccgaggctggctactatttacgnggcctagtaccgtaacccgggaagtcccggggtacctcgaaccgtattccgaggtcgcgtaggccgggtacgtcgggacctagtacgtttccacgttacctaccgacctacgtcacgtcgtaacgtccttacggccgaacgggtccgttaagaacgtaaggtttcggacggttacgttttaacgttttaagtttaacgtttacgttaaccgtaaactttaaacgttaagtttttaacgttaacttttacccgggttaacggttaccggggttaacccggtttaacccgggtaaccgggtaaaaccggggtaacccggtaaaggggtttacggtaaactttaggtaaacccgtaaggtaacccggtaacgttagggtacggtaaccgtcggtaaacccg

SEQ ID NO: 278434 - DNA, 661 bp, Homo sapiens
  misc_feature: GYAE6OF01EATUF.19.71.G05.1.454.CMB.1.raw
  modified_base (334)..(334): a, c, t, g, unknown or other
  misc_feature (334)..(334): n is a, c, g, or t
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccaggggacatcgtgatgaccctagtctccagactcctggctgtcgtctcgtgggcgaggcggccacatcaactgacagtcagccacattcttttatactacgttaccaactaactacgtaaaaccttacttacgtacttacggtaccagtcagacgaccgaggacacgcctcgtacggctgctctatttacgnggactacgtccgtaacccgggagttcccggggtacctggaaccgtacgttcgaggtcggccgtaggccgggtacgtggggactaggttactttcgaacctccgtacaccatcgagctacgcctggccgacggtcgtagaacgtgtggtacggtctttagtttattacgttacgtactaaagtaactttagtttaactttacgttacgtttacgggtacggttaccggttaccgggtaaccggtaaacgggtaccggttaaagggtggttaaacttaacgttaccgaaaggtaaccggtaacgttgggtaccggtacgtccgtaaccg

SEQ ID NO: 278435 - DNA, 596 bp, Homo sapiens
  misc_feature: GYAE6OF01B3NWZ.19.71.G05.1.454.CMB.1.raw
  modified_base (238)..(238): a, c, t, g, unknown or other
  misc_feature (238)..(238): n is a, c, g, or t
  modified_base (314)..(314): a, c, t, g, unknown or other
  misc_feature (314)..(314): n is a, c, g, or t
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccacatcaactgcaagtccagccacaattcttttanacagttaccaacaatgaaaactacttagcttggtaccagcagagaccaggacagcctcctaggctgctcatttacngggcatcctacccgggaatccggggtccctgaccgattccgagtcggcaggcgggtctgggacagatttcactctcaccatcagcagcctgcaggctaggaagatggtggactaagttttaacttagtttacgtactaaacgtaaattatttaattaacttacgttacggttgggtaacggtttaccgggtacccgtaaaggggtaacccgtaaagggttacgggtagttaacgttcgaaacggtaaccggtaaactagggtacgggtcgttcggtaacccg

SEQ ID NO: 278436 - DNA, 709 bp, Homo sapiens
  misc_feature: GYAE6OF01DEERC.19.71.G05.1.454.CMB.1.raw
  modified_base (571)..(571): a, c, t, g, unknown or other
  misc_feature (571)..(571): n is a, c, g, or t
tcagtactctcgtgcacgaccggtgctcgatttagtgtcgtcgcaagagagagggggagagtctgctgaattctggctgaccagggcagtcaccagagctccagacaatgtctgtctccttctcttctcctgccgtgctcgggcctcccacaaggtgtcctgtcacaagtacagctgcagcagtcaggtccaggactggtgaacgcctcgcacgaccctctcgctcacctgcgccagtccgtaccggggacagacgtcgcgtacgcgtactagttgttcgcgttggctacgtcgggtacgacggtcctaccggtccctagtacggagtacggtcgttaaggaggttgggacggttaggggaaacggtactaagtttacgtttcgaacgttacgtaaccgaacggtaaccggttaaggtaaaactaaacttaaaatttacgtacgacctaacctagttacgttagggtttacggaacggttacgtaccgtaacgttaacggaactaaacgttacggaaaaccggttacgaactaaccgtaagtaaccggtaaacgtacccgttcgttacccncccgtagtacgacgtccgtacgtaccgtacgttcgacgtaccccgtacgggtaaacggtaccggtacgggttattacgtttaacgtttacggacgggttaaacgggacccgtacccgacccttaaaggtccgtaaccg

SEQ ID NO: 278437 - DNA, 536 bp, Homo sapiens
  misc_feature: GYAE6OF01A2ZDQ.19.71.G05.1.454.CMB.1.raw
  modified_base (248)..(248): a, c, t, g, unknown or other
  misc_feature (248)..(248): n is a, c, g, or t
  modified_base (444)..(444): a, c, t, g, unknown or other
  misc_feature (444)..(444): n is a, c, g, or t
  modified_base (523)..(523): a, c, t, g, unknown or other
  misc_feature (523)..(523): n is a, c, g, or t
tcagtactctcgtgcacgaccggtgctcgatttagtgtcgtcgcaagagagagggggtcaggctggaactgaggagcaggcaggggcagcaagatggtgttgcagacccaggtcttcatttctctgttgctctggatctctggtgcccacggggacatcgtgatgacccagtctccagactccctggctgtgtctcgtgggcgagcgggccaccatcaactgacaagtccagccactaattcttttanacagttaccaacaatagaaaacttacttagtcttggtaccagcagacaccaggacacgcctcctaggcctgcctctatttacgcggactacgtaccgtaacccgggaagtcccggggtccctagaccgtattcgagtcggctacggcggtcgtgggacagtattcactctacacatcagcagctgcgagctagagntgtgacttagttattatacgtacaagtattattattagttacgttgtacggtacgttcgacgaacggactaggtcgatnagatacgagtcgg

SEQ ID NO: 278438 - DNA, 576 bp, Homo sapiens
  misc_feature: GYAE6OF01EOZW6.19.71.G05.1.454.CMB.1.raw
  modified_base (238)..(238): a, c, t, g, unknown or other
  misc_feature (238)..(238): n is a, c, g, or t
  modified_base (283)..(283): a, c, t, g, unknown or other
  misc_feature (283)..(283): n is a, c, g, or t
  modified_base (315)..(315): a, c, t, g, unknown or other
  misc_feature (315)..(315): n is a, c, g, or t
  modified_base (370)..(370): a, c, t, g, unknown or other
  misc_feature (370)..(370): n is a, c, g, or t
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttanacagttaccaacaatagaaaactacttagcttggtaccagcaganaccaggacagcctcctaggctgctctattacnggcatccgtacccggaagtccgggtccctgaccgattcgagtggcaggcggtcgnggacagtattcactctcaccatcagcagcctgcgaggctagaagtagtgtggtacttagtttacttattcgtactaaactaatttatttattaagttactttacggtacggttaaccgttccgggaaccgtaaacggggtaaccgtaaagggtcggtaacttagtaccgaacggtaaccgtaaacgtggttcggccgtgtaacccg

SEQ ID NO: 278439 - DNA, 551 bp, Homo sapiens
  misc_feature: GYAE6OF01ETCYC.19.71.G05.1.454.CMB.1.raw
  modified_base (237)..(237): a, c, t, g, unknown or other
  misc_feature (237)..(237): n is a, c, g, or t
tcagtactctcgtgcacgaccggtgctcgatttagtgtcgtcgcaagagagagggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttanacagttaccaacaatagaaaactacttagcttggtaccagcagagaccaggacagccctccgtaggctcgctctatttactgggcatccgtacccgggaactccggggtccctgaccgattcgaggtggcaggcgggtcgtgggacagtactttcactctacaccatcagcagcctgcaggctagaagatgtgactagtttatattcgtacaactaattattaattactacttcgtggtaccgttcggaccgtaagggtaccgtaagggtacgattacgtacgaacgtacgtaactagggtcggtctgtacccg

SEQ ID NO: 278440 - DNA, 537 bp, Homo sapiens
  misc_feature: GYAE6OF01A8HQR.19.71.G05.1.454.CMB.1.raw
  modified_base (238)..(238): a, c, t, g, unknown or other
  misc_feature (238)..(238): n is a, c, g, or t
  modified_base (370)..(370): a, c, t, g, unknown or other
  misc_feature (370)..(370): n is a, c, g, or t
  modified_base (397)..(397): a, c, t, g, unknown or other
  misc_feature (397)..(397): n is a, c, g, or t
  modified_base (423)..(423): a, c, t, g, unknown or other
  misc_feature (423)..(423): n is a, c, g, or t
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttanacagttccaacaatagaaaactacttagcttaggtaccagcagagaccaggacagcctctaggctgctcatttactgggcatcgtacccgggagtcccggggtcctgaccgattcagtggcgaggcgggtcngggacagtactttcacttctacacctntacagcacgcctgcaggctagaagtntggtgcttaagtttatagttagactaaataattatttaattatacgttggacggtacgttacggaccgaaacgggactaaggtggatactcgaagaccgtagtgtcggctgacc

SEQ ID NO: 278441 - DNA, 560 bp, Homo sapiens
  misc_feature: GYAE6OF01A2GII.19.71.G05.1.454.CMB.1.raw
  modified_base (238)..(238): a, c, t, g, unknown or other
  misc_feature (238)..(238): n is a, c, g, or t
  modified_base (313)..(313): a, c, t, g, unknown or other
  misc_feature (313)..(313): n is a, c, g, or t
  modified_base (347)..(347): a, c, t, g, unknown or other
  misc_feature (347)..(347): n is a, c, g, or t
  modified_base (425)..(425): a, c, t, g, unknown or other
  misc_feature (425)..(425): n is a, c, g, or t
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttanacagttccaacaatgaaaactacttagcttggtaccagcagagaccaggacagcctcctaggctgctcatttacngggcatctacccgggaatccggggtcctgaccgnttcagtgcagcgggtctgggacagtattcactctcaccatcagcagcctgcaggctagaagatgtggctagtttattnttacgtacaaactaattatttaattaacttacgttcggtacggtaccggtttacggacccgtaaaggggtaccctaaagggttggtaacttagtacgaacggtaaccgtaacgttggtacggtcgtaggtacccg

SEQ ID NO: 278442 - DNA, 577 bp, Homo sapiens
  misc_feature: GYAE6OF01EYZ0H.19.71.G05.1.454.CMB.1.raw
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccacatcaactgcaagtccagccacaattctttatacagttccaacaatagaaaactacttagcttacggtacagcagagaccaggacagcctccgtaggctgctctatttactgggcataccgtacccgggtaactccggggtaccctgaccgtattcgagtcggcgtaggcgggtcgtgggaacagtatttcgacttctaccacctatacgacgcacgcctgcgagcgtagaacgtagtggtaggtctagttttattagttagtacaactaattaatttaattattacgttcgtacggtaccgttcggaacgtaacgggtaccgtaaggtacggtaactagtacgacgtaacgacttaggtaggtcgtgtacc

SEQ ID NO: 278443 - DNA, 791 bp, Homo sapiens
  misc_feature: GYAE6OF01C82QA.19.71.G05.1.454.CMB.1.raw
  modified_base (238)..(238): a, c, t, g, unknown or other
  misc_feature (238)..(238): n is a, c, g, or t
  modified_base (252)..(252): a, c, t, g, unknown or other
  misc_feature (252)..(252): n is a, c, g, or t
  modified_base (320)..(320): a, c, t, g, unknown or other
  misc_feature (320)..(320): n is a, c, g, or t
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccaggggacatcgtgatgacccagtctccagacctccctggctgtgtctcgtgggcgagcggccacatcaactgcaagtccagccaataattctttanacacgttaccaaanaatagaaaactcttagcttggaccagcagacgaccaggacacgcctcgtaggctgctactatttacgngggactagtaccgtaacccgggtacgttcccggggtcctagacccgtattccgaggttcggacgtacggtcgggttacgtacggggaactacgttaacgtttcccacgttaccttaccgaaccctagtaccgaacgtccaacggtcccgttacggaccggtacgggtaccttaagggtaaacgtcgttacgggtacggttaaccgtttaacggttttttaacgtttaacgtttacggttaaacccttaaaaagtttaaacgttttaaacgtttttaaacgttttaaccggttttacccggttttaccggggtttaaacccggggtttaccgggtttaaccccgggggtaaacccggtaaaacgggggttaaacccgtaaagggggtttaccgggttaaactttaaacgggtaacccgtaaacgggtaacccggttaaacggtttgggtaacggtcccgtttagtaaccccg

SEQ ID NO: 278444 - DNA, 886 bp, Homo sapiens
  misc_feature: GYAE6OF01AC70E.19.71.G05.1.454.CMB.1.raw
  modified_base (329)..(329): a, c, t, g, unknown or other
  misc_feature (329)..(329): n is a, c, g, or t
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgacaagtccagccactaattcttttatacagttaccaacaatagtaaaactacttagcttaggtaccagcagacgaccaggacacgccctccgtaggctgcctactactttacgngggctactccgtaacccgggaacgttcccgggggtccctaggacccgtagttcgacggtcggcgaggtccggggtacgtcggggaacctaggttacttaccgaaccttccgtaccaacccgtacgttaccgaacggtcccgtaacggtccccgttacggacccgtaacggggtaccttaacggggtaaaaacggtcggtttacggggttacgggtaacccgtttttaaagggttttttaaacgttttaacggttttaaccgggttaaacccttaaaaaccgtttaaactttttaaaccgtttttaaacggttttaaacccgttttaaccccgggtttttacccgggggttaaaccggggtttaaaccccggggttttaaccccgggggtaaaacccgggttaaaacccggggggttaaacccggttaaaagggggggttttccgttaaaaacgggtttaaacccggttaccgggtaaaaacccgggttaaacccgggtttaaaccgggtttagggggttaccccggggttacccgttaaccgggttaaaccccccgg

SEQ ID NO: 278445 - DNA, 680 bp, Homo sapiens
  misc_feature: GYAE6OF01CA0WE.19.71.G05.1.454.CMB.1.raw
  modified_base (243)..(243): a, c, t, g, unknown or other
  misc_feature (243)..(243): n is a, c, g, or t
  modified_base (325)..(325): a, c, t, g, unknown or other
  misc_feature (325)..(325): n is a, c, g, or t
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagacctccctggctgtgtctctgggcgagccgggccaccatcaactgacaagtccagccataattcttttaanactagttaccaacaatagaaaactacttagcttaggaccagcagacgaccaggacagccctactaggctgctctatttacgngggactacgtccgtaacccgggaagtcccggggtccctaggacccgtagttccgaggtcggaccgtacggtcggggttaccgtaggggaactacggttactttccgaccttcctaccgaacctattacccaaggccctaacggtcccgttaggaccgtaacggtccgttaaggaagtacgttgggtacggtactttaaggttttaattacgttagtaacctaacttaatttaattttaatttacgttacgtttacggtacggttaaccggttaccgaaccggtaaaggggtacccgtaaggggttagtaacttacgtaacgaacgtaacgtaacgtggtacggtccgtagacccg

SEQ ID NO: 278446 - DNA, 517 bp, Homo sapiens
  misc_feature: GYAE6OF01CKMUR.19.71.G05.1.454.CMB.1.raw
  modified_base (254)..(254): a, c, t, g, unknown or other
  misc_feature (254)..(254): n is a, c, g, or t
  modified_base (265)..(265): a, c, t, g, unknown or other
  misc_feature (265)..(265): n is a, c, g, or t
  modified_base (327)..(327): a, c, t, g, unknown or other
  misc_feature (327)..(327): n is a, c, g, or t
  modified_base (378)..(378): a, c, t, g, unknown or other
  misc_feature (378)..(378): n is a, c, g, or t
  modified_base (430)..(430): a, c, t, g, unknown or other
  misc_feature (430)..(430): n is a, c, g, or t
  modified_base (508)..(508): a, c, t, g, unknown or other
  misc_feature (508)..(508): n is a, c, g, or t
tcagtactctcgtgcacgaccggtgctcgatttagtgtcgtcgcaagagagagggggtcaggctggaactgaggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccacgatcaactgcaagtccagccacaatcttttanacagttccaanaatgaaaactcttagcttggaccagcagagaccaggacagcctcctaggctgctcatttacnggcatctacccgggaatcccgggtccctgaccgattcagtgcaggcgggtntgggacagtatttcacttctcaccatcagcacgcctgcaggctagaagatgnggctagtttatatgtacaactaattattattatacgttgtaggtacgttcggacccaaagggtacccaagggtgaatntcgaaacgg

SEQ ID NO: 278447 - DNA, 617 bp, Homo sapiens
  misc_feature: GYAE6OF01D9ODT.19.71.G05.1.454.CMB.1.raw
  modified_base (324)..(324): a, c, t, g, unknown or other
  misc_feature (324)..(324): n is a, c, g, or t
tcagtactctcgtgcacgaccggtgctcgatttagtgtcgtcgcaagagagagggggagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactgggtgaacgccctcgcacgaccctctcgctcacctgtcgccagtccgtccggggacaggacgtccgcgtacgcgacagttgttgcgttcggctacggtgggtcgaggccaccgtcccagtcgagnggtcagtaggtggacgtagggaagactattattcatcgaccgaacgtacggtagaaataacaaattatgacctactagttcgttagttaggaacgtacgtccgtaacgtacgaactaactaccgtaaacgtacgaaccatacgtaaccgaaacgtacctacggtttccctaccgcgactacgtccgtacgtaccttgtacgtaccggtaccgacccggtaagggtccgtacgggtatttaacgtaacgttacggtacggtacgggaacgtacccgtaccctaagtacgtaccg

SEQ ID NO: 278448 - DNA, 826 bp, Homo sapiens
  misc_feature: GYAE6OF01ETEZV.19.71.G05.1.454.CMB.1.raw
tcagtactctcgtgcacgaccggtgctcgatttagtgtcgtcgcaagagagagggggggaggtacaacaggcaggcaggggcagcaagatggtgttgcagacccaggtcttcatttctctgttgctctggatctctggtcgcccacggggacatcgtgatgacccagtctccagactccctggctgtgtctcgtgggcgaggccgggccaccatcaactcgacaacgtccacgccaactaattcttttataactacggttaccgaactaaactaacgtaaaaaccttactttaagtcctttacggtaaccagacaaggaacgaaccgaacggaaccacggccccttccgtaagggcttacggtaccttaccgttaagttttaccgcgggtacctacgttaccccgggtaacccggggtaaccggttccccgggggtacccctacggtaacccgtacgtttaccgacgggttacggaccgtacggggtacgggggttccgtacggggactaacggttactttacccgaccttacccgtaccgtaacctacgtaccgaacggaccgtaccggtccgttcggaccgtagggtaccgtaacggaaacgtaggttacggttacggttaccgtttaagtttttacgtttaacgtttacgtaaacctaaacgtttaaatttaaacttttaagtttaaccgtttaccggtttacgggttacgggtaaccggtttaccgggaacccggttaaacggggtaccgttaaagggtacggttaactaacggtacgtaaacggtaaccggtacgttagggtacggtcgtaccgtaacccg

SEQ ID NO: 278449 - DNA, 577 bp, Homo sapiens
  misc_feature: GYAE6OF01AJ9U6.19.71.G05.1.454.CMB.1.raw
  modified_base (238)..(238): a, c, t, g, unknown or other
  misc_feature (238)..(238): n is a, c, g, or t
  modified_base (315)..(315): a, c, t, g, unknown or other
  misc_feature (315)..(315): n is a, c, g, or t
  modified_base (391)..(391): a, c, t, g, unknown or other
  misc_feature (391)..(391): n is a, c, g, or t
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttanacagttccaacaatcgaaaaactcttaagcttggtaccagcagagaccaggacagcctcctaggctgctcatttacnggcatctaacccgggaatccggggtccctagaccgattcagtgcagcgggtctgggacagtctttcactctcaccntcagcagcctgcacgggctacgaagattgtggactagttttattagttacgtactaaagtaattattaattaactacgttacgttggacccgtttcggaccctaaaggggtacccgtaaagggttcggaattaaccgttacgaaacgggtaaccgtaaacttgggtaccgggcgttcggaaccccg

SEQ ID NO: 278450 - DNA, 584 bp, Homo sapiens
  misc_feature: GYAE6OF01C2Y2P.19.71.G05.1.454.CMB.1.raw
  modified_base (453)..(453): a, c, t, g, unknown or other
  misc_feature (453)..(453): n is a, c, g, or t
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagacctcctggctgtgtctcgtggggcgagccgggccaccatcaactgcaagtccagccactaattcttttaatacagttaccaaacaatagaaaactacttacgcgttaggtaccagcaagacgaccaggacacgcctccgtaggctgctctatttacgcgggactacgtaccgtacccggggaacgtcccggggtccctagaccgtacttcgaggtggcaggtcgggtcgtgggactagtactttccactctacactactcacgcacgcctgacgacggtntaggaagagtcgtggatttagttattattgaactaatattattattacttcgtcggtacggtacgtacggacgaaacgggtaccgtaggttggaactcgtaacgacgtaacgtaacttggacgcgtcgacc

SEQ ID NO: 278451 - DNA, 614 bp, Homo sapiens
  misc_feature: GYAE6OF01CADZE.19.71.G05.1.454.CMB.1.raw
  modified_base (228)..(228): a, c, t, g, unknown or other
  misc_feature (228)..(228): n is a, c, g, or t
  modified_base (239)..(239): a, c, t, g, unknown or other
  misc_feature (239)..(239): n is a, c, g, or t
  modified_base (313)..(313): a, c, t, g, unknown or other
  misc_feature (313)..(313): n is a, c, g, or t
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccanaattcttttanacagttccaacaatgaaaactacttagcttggtaccagcagagaccaggacagcctctaggctgctcatttacngggcatccgtacccgggaatcccggggtccctgaccgtattcgagtcggcaggcgggtctgggacagtatttcactctcacatcagtcacgtcctgccgaggcctaggaagtagtggtggacttaaggttttacttagtttagtactaaacttaaagttaactttaatttaacttacgtttcgggttaggtaccgtttacccggggtacgtaaacggggtaacccgtaaggggttacggaagttacgtaccgtaaaggtaaaccggtaacgttacgggtacgggtccttagggtaaccccg

SEQ ID NO: 278452 - DNA, 591 bp, Homo sapiens
  misc_feature: GYAE6OF01DOWUG.19.71.G05.1.454.CMB.1.raw
  modified_base (241)..(241): a, c, t, g, unknown or other
  misc_feature (241)..(241): n is a, c, g, or t
  modified_base (327)..(327): a, c, t, g, unknown or other
  misc_feature (327)..(327): n is a, c, g, or t
  modified_base (435)..(435): a, c, t, g, unknown or other
  misc_feature (435)..(435): n is a, c, g, or t
  modified_base (446)..(446): a, c, t, g, unknown or other
  misc_feature (446)..(446): n is a, c, g, or t
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctcgtgggcgagccggccaccatcaactgcaagtccagccacaattcttttaanacagttaccaaacaatagaaaacctacttagcttaggtaccagcaagacgaccaggacacgcctcctaggctgcctatatttacgngggactagtccgtacccgggaacgtccgggggtccctagaccgtattcgagtggcacggcgggtcgtagggactagtactttcacctctaccaccatcagcagctgcnggctagaagtntggtggtacttaggtttattagttcgtaactaactaatttatttaattacgttacgttacggtcgggtaccgttaccgggacggaaacgggtacctaagggtgtaactacgtacgaggtaaccgttaacgttggctcgctaaccg

SEQ ID NO: 278453 - DNA, 564 bp, Homo sapiens
  misc_feature: GYAE6OF01C6W0M.19.71.G05.1.454.CMB.1.raw
tcagtactctcgtgcacgaccggtgctcgatttagtgtcgtcgcaagagagagggggagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaacgccctcgcagaccctctcgctcacctgtgccatctccgggacagagtcgctagcgacagtgttgcttggcactgggtcaggcacgtccccatcgagaggtctagagtggcgtgggaaggactatatttcatcgtaccaacgtacgtaggaaataactaaattagtacgcaacctattctagttacgacgtagtcgacgtagaactaataccaacgtagacaacatacgaacgaaccgtaacgttcctccgtcgtacacgtcctacgacctcgtacgtacgaccgtacccggacggtaccgtacgggttagtacgttacgttacgtaggtacggaacgaccggaccccagtacgtaacg

SEQ ID NO: 278454 - DNA, 544 bp, Homo sapiens
  misc_feature: GYAE6OF01CIXYN.19.71.G05.1.454.CMB.1.raw
  modified_base (243)..(243): a, c, t, g, unknown or other
  misc_feature (243)..(243): n is a, c, g, or t
  modified_base (431)..(431): a, c, t, g, unknown or other
  misc_feature (431)..(431): n is a, c, g, or t
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagacctccctggctgtgtctcgtgggcgagcgggccaccatcaactgcaagtccagccaacaattcttttaanactagttaccaaacaatagaaaaactacttagcttaggtaccagcagagaccaggacagcctcctaggctgctcatttactgggcatccgtacccgggaatcccgggggtccctgaccgtattccgagtggcaggcgggtctgggacagtatttcactctccaccatcagcagcctgcagctagaagntgtgacttagtttattatgtacaaataattatttattaatctttcgtaggtaccgttacggaccgaaagggtaccaaggtggatatacaaggaccgtaatggcggctgaaccg

SEQ ID NO: 278455 - DNA, 625 bp, Homo sapiens
  misc_feature: GYAE6OF01A5LHX.19.71.G05.1.454.CMB.1.raw
  modified_base (239)..(239): a, c, t, g, unknown or other
  misc_feature (239)..(239): n is a, c, g, or t
  modified_base (318)..(318): a, c, t, g, unknown or other
  misc_feature (318)..(318): n is a, c, g, or t
tcagtactctcgtgcacgaccggtgctcgatttagtgtcgtcgcaagagagagggggaggtacaacaggcaggcaggggcagcaagatggtgttgcagacccaggtcttcatttctctgttgctctggatctctggtgcccacggggacatcgtgatgacccagtctccagactccctggctgtgtctctgggcgaggcgggccaccatcaactgcaagtccagccacaattcttttanacagttccaacaatagaaaactacttagcttggtaccagcagagaccaggacagcctcctaggctgcctctatttacgngggccatccgtaacccgggaagtcccgggggtccctaggacccgtattccgaggttcggcacggtccggggtcctaggggaccaggtactttccgactctcacccatcacgcacgcctacgacgtacggctacggaagtacgtggtacgggtacttaagttttattatttacggtactaaactaatttaactttaattactacgttcgtacgggtaaccgttccgggaaccgtaaacggggtacccgtaagggttacggaagttacgtacgaacggtaacgtacggttaggtcggtcgtcgtacccg

SEQ ID NO: 278456 - DNA, 448 bp, Homo sapiens
  misc_feature: GYAE6OF01E0HVA.19.71.G05.1.454.CMB.1.raw
  modified_base (333)..(333): a, c, t, g, unknown or other
  misc_feature (333)..(333): n is a, c, g, or t
  modified_base (421)..(421): a, c, t, g, unknown or other
  misc_feature (421)..(421): n is a, c, g, or t
  modified_base (437)..(448): a, c, t, g, unknown or other
  misc_feature (437)..(448): n is a, c, g, or t
tcagtactctcgtgcacgaccggtgctcgatttagtgtcgtcgcaagagagaggtctagagtggctgggaaggacatatttcatgtccaacacgtggaatacaaattatgcaccatctgttgagagtcgactgacaatcaacgtagacacatcgaagaaccagttctccctgcagctgacctctgtgactcccgaggacacgggtgtatattactgtggaagaggcccccatagacatgccacctcgtctctggtgctatattggggccagggaaccccatgtcaccgtctcctcggcctccaccaagggcccatcggtcttccccctggccnccctgcctccaggacgcacctccgagacgcacagccggccctgggctgcctggtcaaggactactcccacgagagtactgacgcgggntggcaaggcgcatagnnnnnnnnnnnn

SEQ ID NO: 278457 - DNA, 681 bp, Homo sapiens
  misc_feature: GYAE6OF01C3UIV.19.71.G05.1.454.CMB.1.raw
  modified_base (248)..(248): a, c, t, g, unknown or other
  misc_feature (248)..(248): n is a, c, g, or t
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtcgcccgacggggacatcgtgatgacccagtcctccagacctccctggctgtgtctcgtgggcgagccgggccaccatcaactgacaagtccagccaactaattcttttanactagttaccaaacaatagaaaacctacttagctttaggtaccagacagacgaccaaggacacgcctccgtaggcctgctctattttacgtggctatccgtacccgggaagttcccggggtccctgaccgtacttcgaggttcggcacggtcggggtctaggggactaagtactttccacttcctaccacctaatccagacctacgtcccgtaggacctagggtacctaggtaaacgagtttccgggtagggtacctttaaggtttttatttaacgttacggttaacctaaaacgttaattttaactttaatttaaccgttacgtttacggtacggggttacccggttaccgggtaaccgaaacgggggtaaccgtaagggttaggtaacttagtacggaagtaccgtaagttgggtacgtcgtacggtaccc

SEQ ID NO: 278458 - DNA, 659 bp, Homo sapiens
  misc_feature: GYAE6OF01ARR56.19.71.G05.1.454.CMB.1.raw
  modified_base (245)..(245): a, c, t, g, unknown or other
  misc_feature (245)..(245): n is a, c, g, or t
tcagtactctcgtgcacgaccggtgctcgatttagtgtcgtcgcaagagagagggggtcaggctggaactgaggagcaggcaggggcagcaagatggtgttgcagacccaggtcttcatttctctgttgctctggatctctggtgcccacggggacatcgtgatgacccagtctccagacctccctggctgtgtctcgtgggcagcggccaccatcaactgcaagtccagccactaatcttttanactagttaccaacaatagaaaactacttagtcgttacggtaccagcaagacgaccaggaccacggccctaccgtaggcctcgacttctatttacgcgggactacgttacccgaaccgggtaactccccgggggtaccctggaaccgtatttacgaggtcggcgtacggtccgggtcgtaggggacctaggttactttaccgacttctacccgtaaccctagtcgacgaccacgtcctaggccgaggtcctagaaggtagtggtcgtacgttaagtttattacgttagtactaaataagtttacttaagttacgtttaccgtacgggttaaggtaccggtttacgggaaccggttaaacgggtaccgaaaggttacggtaacttaaccgtagaacggtaaaccgtaacgttcggg

SEQ ID NO: 278459 - DNA, 683 bp, Homo sapiens
  misc_feature: GYAE6OF01A3F5R.19.71.G05.1.454.CMB.1.raw
  modified_base (238)..(238): a, c, t, g, unknown or other
  misc_feature (238)..(238): n is a, c, g, or t
  modified_base (316)..(316): a, c, t, g, unknown or other
  misc_feature (316)..(316): n is a, c, g, or t
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttanacagttaccaacaatagaaaactacttagcttggtaccagcagagaccaggacagccctcctaggctgctctattacnggcatcgtacccgggaactccggggtccctgaccgtattcgagtcggcaggtcgggtctacgggactaggtactttcgaccttcgtaccaacctatccgagtaccacgtccctggaccgacgggtcttaaggaagtcgttcggtacggtacttaaggttttttaacgtagtttacggtaacctaaaacgtaattttaagtttaaactttaccgtttaaccggtttcgggtaccggggttaaacccggtttacccgggaaaccccgggttaaaacggggtaacccggtaaagggttcggggtaaacttaacggttaccgaaacggggtaacctaaacgggttggtaacggggtcccgtaaggtaaccc

SEQ ID NO: 278460 - DNA, 632 bp, Homo sapiens
  misc_feature: GYAE6OF01AQZ2R.19.71.G05.1.454.CMB.1.raw
  modified_base (238)..(238): a, c, t, g, unknown or other
  misc_feature (238)..(238): n is a, c, g, or t
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctcgtgggcgagcgggccacatcaactgcaagtccagccacattcttttanacagttaccaacaatagaaaactacttagcttaggtaccagcagagaccaggacacgcctaccgtaggctgctctagtttacgtgggctactaccgtaacccgggaacgtcccggggtaccctagaacccgtattacgacggtcggcgaggtcggggtcgtggggaactacggtactttaccgacttcctaccacctatcacgaccacgtcctacgacgtacggtcctaggaacgtagtggtacggtacttaaggttttaacttgttacgtactaaactaatttatttaatttaacgtacgttacggtcggtaccgttccggaaccgtaagggtaccgtaagggtacgtagttacgtacgaacgtacggtaacgttggtcggtctggtaacccg

SEQ ID NO: 278461 - DNA, 726 bp, Homo sapiens
  misc_feature: GYAE6OF01CB2PX.19.71.G05.1.454.CMB.1.raw
tcagtactctcgtgcacgaccggtgctcgatttagtgtcgtcgcaagagagagggggagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaagccctacgcacgaccctctccgctcacctgtcgccagtccgtccggggacagacgtcgcgtagcgacagtgttgcttggcacgtgggtcaggcacgtcccagtcgagacggtctaaggaggtggcgtaggggaacggactagttatttcgagtcgtaccaacgtacggtacggtaaacttaacgtaaaatttactacggtactaacctacgttacgttagtttaggaacggtacgttaccggtacgtaacgtaacctaaacgtaaccgtaaaaccggttaacgaaccgtaaaccgtaaacgttaaccggtaaaacgttaacccgtaacggttttaccccgtaccccggttacgtaccgtaaccgttaccgttaacggtacccttaccgttacggttaccggtaaaccccggttacccgggtaacgggtaaccggttacggggttaacgttaacgttaacgttttacgtacgggttacgggaaacggaacccgggacccccgtaaaggtaaacggtaacccg

SEQ ID NO: 278462 - DNA, 735 bp, Homo sapiens
  misc_feature: GYAE6OF01CNDB7.19.71.G05.1.454.CMB.1.raw
  modified_base (254)..(254): a, c, t, g, unknown or other
  misc_feature (254)..(254): n is a, c, g, or t
  modified_base (366)..(366): a, c, t, g, unknown or other
  misc_feature (366)..(366): n is a, c, g, or t
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtcgcccgacggggacatcgtgatcgaccctagtcctccagacctccctggctgtgtctcgtgggcgagccgggccaccatacaactgactaagtccacgccaactaattcttttaanactacgttaccaaaataataagtaaaaccttattaacgtctttacggaacccagacaacggacgaccgaggtaaccacgtccctaccgtaggcctgaccttctagtttacgngggacctacgtaccggtaaccccgggagtccccggggtcctacgaccgttctacgaggtcggacgtgggtccgggttcgtacggggaacctaaggttcctttaccgacctaccgtccaaacccgtatccgaacgtacaccggtactacggggactagggtacctaaggtaaacgttgttacggggttaccgtaagttttaaggttttaacgtttacgtacgtaaacctaaagttaattttaagttaactttaacggtaccgtttaccgtacgggtaccgttaccgggtaacggtaaaccggtaacggtaaggtacgaattacgtaacgaagttaacccggaacgtttgggaaccggttcgcgtaacccg

SEQ ID NO: 278463 - DNA, 758 bp, Homo sapiens
  misc_feature: GYAE6OF01EUS8I.19.71.G05.1.454.CMB.1.raw
  modified_base (252)..(252): a, c, t, g, unknown or other
  misc_feature (252)..(252): n is a, c, g, or t
  modified_base (266)..(266): a, c, t, g, unknown or other
  misc_feature (266)..(266): n is a, c, g, or t
  modified_base (345)..(345): a, c, t, g, unknown or other
  misc_feature (345)..(345): n is a, c, g, or t
tcagtactctcgtgcacgaccggtgctcgatttagtgtcgtcgcaagagagagggggggaggtacaacaggcaggcaggggcagcaagatggtgttgcagacccaggtcttcatttctctgttgctctggatctctggtcgcccgacgggacatcgtgatcgacccagtctccagacctccctggctgtgtctcgtgggcgaggccgggaccacatcaactgacaacgtccacgaccaactaattctttaanactagttaccaaanaatagaaaacttactagtcttacggtaccagcaagacgaccgaggacacgtccctacgtaggctgcctactatttacgnggactacgtacccgtaacccggggtaacttccccggggtaccctacggtaacccgatttccgaggtcggacgacggtccggggttcgtacggggaactaggttactttaccacccgttctaccctaacctactaccgaacgaccgtaccgtacctggaccgaggtaccaggtaaacgtaggttaggtacggtaactttaagttttaatttacgttaacgtaaccgtaaaacctttaaagtttaacgttttaatttaaccgtttaacgtttaccgggtttacgggtaaccccgttttaccggggaaacccgtaaaacgggggtaaaccccggtaaaggggttacggttaaacttaacggtacccggaaaaggtaaacccgtaacggttaggttacggtccgtaccggtaacccg

SEQ ID NO: 278464 - DNA, 600 bp, Homo sapiens
  misc_feature: GYAE6OF01EXGOK.19.71.G05.1.454.CMB.1.raw
  modified_base (237)..(237): a, c, t, g, unknown or other
  misc_feature (237)..(237): n is a, c, g, or t
  modified_base (318)..(318): a, c, t, g, unknown or other
  misc_feature (318)..(318): n is a, c, g, or t
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccacatcaactgcaagtccagccacaattctttanacagttccaaacaatagaaaactacttagcttaggtaccagcagagaccaggacacgcctcctaggctgctctatttacgngggcagtccgtaccgggaactccggggtccctagaccgacttcgacggttggccgacggtcggggttcgtaggggactaggtactttccaccttcctaccacctactcacgcacgccgtgacgacggtctagaacgtagtcggtggtacttagtttattagttagtacaagtaacttatttaattacttacgttacggtaggttaccgttaccggaccgtaaacgggtacgtaagggtggtaataacgtacaacggtacgtaacgtagtacggtgcgtaccg

SEQ ID NO: 278465 - DNA, 725 bp, Homo sapiens
  misc_feature: GYAE6OF01DHQKG.19.71.G05.1.454.CMB.1.raw
  modified_base (248)..(248): a, c, t, g, unknown or other
  misc_feature (248)..(248): n is a, c, g, or t
  modified_base (349)..(349): a, c, t, g, unknown or other
  misc_feature (349)..(349): n is a, c, g, or t
tcagtactctcgtgcacgaccggtgctcgatttagtgtcgtcgcaagagagaggggggaggtacaacaggcaggcaggggcagcaagatggtgttgcagacccaggtcttcattttctctgttgctctggattctctggtgcccacggggactatcgtgatcgacccagtctccagacctcccgtggctgtgtctcgtgggcgagcggccaccatcaactgacaagtccagccactaattcttttaanacagttaccaacaaatacgtaaaacttacttagtccttaggtaccagtcaagacgaacccgaaggacacgcccttaccgtaggctcgactctagtttacgnggctacgttccgaacccgggtaagtcccggggtaccctcggaccgtagttaccgaggtcggaccgaggtcccgggttacgtacgggaactaggttactttccgaacgttccctaccgaacctactaccgaagtaacccgcgtacccgtacggtaccgtaacgggaccttagggaaaacgttaggttcgggtaacggttaaccgtttaaggttttaactttagttaacgttaacccttaaaagtttaaatttaacgttttaaagttaacgtttaccgttacgggtttaccggtaccgtttccggaaccgtaaacggggtaaccgtaggtaggtacttacgacgtaaacggacgttaacgtgtacggtcgtgtacccg

SEQ ID NO: 278466 - DNA, 561 bp, Homo sapiens
  misc_feature: GYAE6OF01AT24C.19.71.G05.1.454.CMB.1.raw
tcagtactctcgtgcacgaccggtgctcgatttagtgtcgtcgcaagagagagggggagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaagccctcgcagaccctctcgctcacctgtgccatctccggggacagagtcgctagcgacaggtgttgcttggcacgtgggtcaggcacgtccccatcggagaggtactaggagtgggctaggggaaggactattattcatcgtaccaacgacggtaggaaattaacaaatttagtcgaccacctattacgtagttaggaagtacgtacgactaggaacaatacaaacgtacgaacacatacgaacgaacctagttcctcctagcacgtctacgtacctcgtgtcgaccgtcccggagggtactacgggttatacgtacgttacgtacggtaggaacgaccggacccctagtacgacg

SEQ ID NO: 278467 - DNA, 514 bp, Homo sapiens
  misc_feature: GYAE6OF01CA1U3.19.71.G05.1.454.CMB.1.raw
  modified_base (238)..(238): a, c, t, g, unknown or other
  misc_feature (238)..(238): n is a, c, g, or t
  modified_base (312)..(312): a, c, t, g, unknown or other
  misc_feature (312)..(312): n is a, c, g, or t
  modified_base (363)..(363): a, c, t, g, unknown or other
  misc_feature (363)..(363): n is a, c, g, or t
  modified_base (504)..(504): a, c, t, g, unknown or other
  misc_feature (504)..(504): n is a, c, g, or t
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttanacagttcaacaatgaaaactacttagcttggtaccagcagagaccaggacagcctcctaggctgctcatttacngggcatctacccgggaatccggggtcctgaccgattcagtggcagcgggtntgggacagtatttcactctcacatcagtcagcctgcaggctagaagatgtggctagtttatattgtacaactaattattattatacttcgtagtacgttccgaccgaagggacctaagggtcgatatacgagaccgatggnggtctggacc

SEQ ID NO: 278468 - DNA, 627 bp, Homo sapiens
  misc_feature: GYAE6OF01BV994.19.71.G05.1.454.CMB.1.raw
  modified_base (239)..(239): a, c, t, g, unknown or other
  misc_feature (239)..(239): n is a, c, g, or t
  modified_base (322)..(322): a, c, t, g, unknown or other
  misc_feature (322)..(322): n is a, c, g, or t
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaattcttttanactagttaccaacaatagaaaactacttagcttaggtaccagcagacgaccaggacagcctccgtaggctgctctatttacgngggctactccgtaacccgggtacgtcccggggtccctcggtaccgtattcgaggtcggcacggtcgggtcgtagggactagtactttcgacttcctcgaccatcacgcacgcctgacgaggtctagaacgtagtgtcggtacttaagtttattagttacgtactaaacgtaatttatttaattaacgttacgttcggtacgggtaccgtttccgggaaccggtaacggggtacccgttaaggggttacggtaacttacgtacgtaaacggtaaccggtaacgttagggtcggtacgtcgaacccg

SEQ ID NO: 278469 - DNA, 685 bp, Homo sapiens
  misc_feature: GYAE6OF01DFB2B.19.71.G05.1.454.CMB.1.raw
tcagtactctcgtgcacgaccggtgctcgatttagtgtcgtcgcaagagagagggggagagtctgctgaattctgactgaccagggcagtcaccagagctccagacaatgtctgtctccttcctcttcttcctgcccgtgctgggccctcccacaaggtgtcctgtcacaagtacagctgcagcagtcaggtccaggactggtgaacgccctcgcacgaccctctcgctccacctgtcgccatccgtccggggacaggagtccgctagcgacagtgtgcgttggcacgtgggtcaggcacgtcccagtcgagcggtctagaggtggcgtggggaaggtactattatttcagttacgtacccaacgtacgtaggtaaattaaccgtaaaatttacgtacgtaccaacccttaagttccgtttaggttacgtaacgggtaacggttaccgtaaacgttacggaaacctaaacgttaccgtaaaaccggttaacgaaaccctaacgtaacgtaacccggaaaacgtaacccgttaacggtttaccccttacccgtacgtacctacgtccgttacgtacccgttcgtacggtacgacccgtacccggaacggtaccgtacggggttattaacgttacgttacggtacggttaacgggaacggtacccggtaccccaagtaacgtaaccg

SEQ ID NO: 278470 - DNA, 673 bp, Homo sapiens
  misc_feature: GYAE6OF01CYCVY.19.71.G05.1.454.CMB.1.raw
  modified_base (248)..(248): a, c, t, g, unknown or other
  misc_feature (248)..(248): n is a, c, g, or t
  modified_base (375)..(375): a, c, t, g, unknown or other
  misc_feature (375)..(375): n is a, c, g, or t
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtcgcccgacggggacatcgtgatcgacccagtctccagacctccctggctgtgtctcgtgggcgagccggccaccatcaactgacaagtccagccaactaattcttttaanactacgttaccaaaactaatacgtaaaaaccttacgttagacgtttacggtaaccagacaaggacgacccgaaggaaccacggtcccttaccgtaaggtccttacggaccttacgtaacttttacgngggacctacgttacccggtaacccgggagtccccggggtccctaggaccgtattccgaggtcggcaggtcgggtcgtagggacagtacttcgactactccactatcgagcacgtccgtgacgacggctaagaacgtgtaggtgtacttagttttacttaagttagtaacctaaataattactttaagtttacttaccggtttacggtacggttaccgtaccgggtaacgaaacgggtaccgtaagggtggtaaactacgtacgtaagtaaccggtaagttgggacgcgttcgaacccg

SEQ ID NO: 278471 - DNA, 623 bp, Homo sapiens
  misc_feature: GYAE6OF01EJNWF.19.71.G05.1.454.CMB.1.raw
  modified_base (212)..(212): a, c, t, g, unknown or other
  misc_feature (212)..(212): n is a, c, g, or t
  modified_base (232)..(232): a, c, t, g, unknown or other
  misc_feature (232)..(232): n is a, c, g, or t
  modified_base (241)..(241): a, c, t, g, unknown or other
  misc_feature (241)..(241): n is a, c, g, or t
  modified_base (294)..(294): a, c, t, g, unknown or other
  misc_feature (294)..(294): n is a, c, g, or t
  modified_base (319)..(319): a, c, t, g, unknown or other
  misc_feature (319)..(319): n is a, c, g, or t
  modified_base (510)..(510): a, c, t, g, unknown or other
  misc_feature (510)..(510): n is a, c, g, or t
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtcgcccgacggggacatcgtgatcgacccagtctccagacctccctggctgtgtctcgtgggcgagccggccacntcaactgacagtccagccanattctttanacattaccaacaatacgaaactacttagcttacggacagacagacgacagacncgcctcgagctgctactatttacgnggctacgtaccgtaccggacgtccgggtccctagacccgtattcgacggtcggacgtacggcgggttacgcgggtaactaggttactttccgacttacccgtctaccctagtcgacgcaccgtccgtagcgacgtctaagtaatcgttggtcggactttagtttaagttattacgtaactaacgttaattntttaacttacttaccgttcgtagggtacccgttcggaaacccgtaagggaccgttaagggtacgtacttaacgaacgtacggtaaaccgtcgtaggttacgcgtacgaacccg

SEQ ID NO: 278472 - DNA, 538 bp, Homo sapiens
  misc_feature: GYAE6OF01DZB5N.19.71.G05.1.454.CMB.1.raw
  modified_base (237)..(237): a, c, t, g, unknown or other
  misc_feature (237)..(237): n is a, c, g, or t
  modified_base (414)..(414): a, c, t, g, unknown or other
  misc_feature (414)..(414): n is a, c, g, or t
tcagtactctcgtgcacgaccggtgctcgatttagtgtcgtcgcaagagagagggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttanacagttccaacaatagaaaactactagcttggtaccagcagagaccaggacagcctcctaggctgctcatttactgggcatccgtacccgggaatccggggtccctgaccgattcagtggcaggtcgggtctgggacagtatttcactctcaccatcagcagcctgcaggctgaagngtggtggactaggttttattattagtacaaacgtaattatttaattacttacgtttcgtaggtaccgttcggaccgtaagggacctaaggtggatactcgaagtacgaactggtcgctgtaacc

SEQ ID NO: 278473 - DNA, 548 bp, Homo sapiens
  misc_feature: GYAE6OF01BABQO.19.71.G05.1.454.CMB.1.raw
  modified_base (238)..(238): a, c, t, g, unknown or other
  misc_feature (238)..(238): n is a, c, g, or t
  modified_base (535)..(535): a, c, t, g, unknown or other
  misc_feature (535)..(535): n is a, c, g, or t
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttanacagttaccaacaatagaaaactacttagcttaggtaccagcagagaccaggacagcctctaggctgctcattactgggcatccgtacccgggaatcccggggtccctgaccgattcagtggcaggcgggtctgggacagtatttcgactctaccaccatcgagcacgcctgccaggcctagaagatggtgctagtttattatgtactaataattatttattattacttcgtggtacgttcggaccgtaacgggtaccgtaagggtaggtattacgtagaacgtaacgacgttaggnggtcctgtaaccc

SEQ ID NO: 278474 - DNA, 671 bp, Homo sapiens
  misc_feature: GYAE6OF01EIJC5.19.71.G05.1.454.CMB.1.raw
  modified_base (247)..(247): a, c, t, g, unknown or other
  misc_feature (247)..(247): n is a, c, g, or t
  modified_base (341)..(341): a, c, t, g, unknown or other
  misc_feature (341)..(341): n is a, c, g, or t
  modified_base (632)..(632): a, c, t, g, unknown or other
  misc_feature (632)..(632): n is a, c, g, or t
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtcgcccgacggggacatcgtgatgactcagtctccagacctcctggctgtgtctcgtgggcgagccggccaccatacaactgaccaagtccacgccactaattcttttanactagttaccaacaatagaaaactacttagtcttaggtaccagcaagacgaccgaaggacacgtccctaccgtaggcctgctacgtatttacgngggactacgtaccggtacccgggaacgtcccgggtacctagaccgtcttacgacggtcggcgtacgggtcgggtcgtagggaactagtactttacgaccttcgacctaccataccgacgacgtacggtccctaggcccgtaagggtcctaaggtaacgtaggtggttacccgggtatttaagttttacttaggtttaactacgtaaaacttaactttaattttagttaaccgtttcggttacggttaagggtaccgttaaccggtaccggtaaacgggtaactaagggtanaacgttacgacgtaacggtaacgtaagttcggagctacg

SEQ ID NO: 278475 - DNA, 548 bp, Homo sapiens
  misc_feature: GYAE6OF01B2UQN.19.71.G05.1.454.CMB.1.raw
  modified_base (239)..(239): a, c, t, g, unknown or other
  misc_feature (239)..(239): n is a, c, g, or t
  modified_base (410)..(410): a, c, t, g, unknown or other
  misc_feature (410)..(410): n is a, c, g, or t
  modified_base (443)..(443): a, c, t, g, unknown or other
  misc_feature (443)..(443): n is a, c, g, or t
  modified_base (541)..(541): a, c, t, g, unknown or other
  misc_feature (541)..(541): n is a, c, g, or t
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaattcttttanacagttaccaaacaatagaaaactacttagcttaggtaccagcagagaccaggacacgcctcctaggctgctctactttacgtgggacacgtccgtacccgggaacgtcccgggggtccctagaccgtagtcgagtggcgacggcgggtctgggacagtactttcgactcncacctatcagcacgtcctgcgaggctagaagtntggtgtactagtttatattgtacaactattattattactacgttgtggtacgtcgacgaaggtccaaggtgatacgtacgaacgtacgaagtggtcgngtgtacc

SEQ ID NO: 278476 - DNA, 547 bp, Homo sapiens
  misc_feature: GYAE6OF01DA2R0.19.71.G05.1.454.CMB.1.raw
  modified_base (240)..(240): a, c, t, g, unknown or other
  misc_feature (240)..(240): n is a, c, g, or t
  modified_base (286)..(286): a, c, t, g, unknown or other
  misc_feature (286)..(286): n is a, c, g, or t
  modified_base (315)..(315): a, c, t, g, unknown or other
  misc_feature (315)..(315): n is a, c, g, or t
  modified_base (422)..(422): a, c, t, g, unknown or other
  misc_feature (422)..(422): n is a, c, g, or t
  modified_base (436)..(436): a, c, t, g, unknown or other
  misc_feature (436)..(436): n is a, c, g, or t
tcagtactctcgtgcacgaccggtgctcgatttagtgtcgtcgcaagagagaggggggaggtacaacaggcaggcaggggcagcaagatggtgttgcagacccaggtcttcattttctctgttgctctggatctctggtgcccacggggacatcgtgatgacccagtctccagactccctggctgtgtctctgggcagcgggccaccatcaactgacaagtccagccaacaattctttanacagttaccaaacaatagaaaactcttaagcttaggaccagcaganaccaggacagcctcagctgctcatttacnggctatccgtaacccgggaatccggggtcctagaccgtattccgagtcgcagcgggtactgggactaggtacttcgactcacacatcagcacgctgcagctagaagntgtgctagtttatntagtacaactaattattacttacttacgtcgtaggtacgttacggaccgaaagggtaccaagggtcgaatacgtacgaacgtacgtaacgttggtacgtcgtacgtaaccg

SEQ ID NO: 278477 - DNA, 601 bp, Homo sapiens
  misc_feature: GYAE6OF01CSVZL.19.71.G05.1.454.CMB.1.raw
  modified_base (242)..(242): a, c, t, g, unknown or other
  misc_feature (242)..(242): n is a, c, g, or t
  modified_base (325)..(325): a, c, t, g, unknown or other
  misc_feature (325)..(325): n is a, c, g, or t
  modified_base (349)..(349): a, c, t, g, unknown or other
  misc_feature (349)..(349): n is a, c, g, or t
  modified_base (355)..(355): a, c, t, g, unknown or other
  misc_feature (355)..(355): n is a, c, g, or t
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctcgtgggcgagcgggccaccatcaactgcaagtccagccaacaattcttttaanacagttaccaaacaatagaaaactacttagcttaggtaccagcagacgaccaaggacacgcctacctaggctgctcatttacnggcatcgaccgggatccgggtccngaccgntcgagtgcagcgggtcagggacagtactttcactctacaccgatcacgcaacgcctggcacggcttaaggaagtgtggtggtacttaagttttaattacgttagtaacctaaattaaatttaatttaagttaacttaaccgtttcgggtacggttaaccggttccggaaccgtaaacggggacccgtaaggggtacgtaagtaacgtacgaaacggtaaccgacttagggaggtcccgtagacccg

SEQ ID NO: 278478 - DNA, 622 bp, Homo sapiens
  misc_feature: GYAE6OF01EC4N1.19.71.G05.1.454.CMB.1.raw
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagccgggccaccatcaactgcagtccagccacaattcttttatacagttaccaacaatagaaaactacttagcttggtaccagcagagaccaggacacgcctccgtaggctgctctatttacgtgggactatccgtaacccgggtaacgtcccgggggtcccctggtacccgtattcgaggtcggcgaggtcggggtcgtcggggacaggtactttcgaccttctaccaccatcagcagcctggccagggtctagaacgtagttcggtaggtacttaggttttaattagttacgttacaaacgttaatttaatttaattaattaccgttcggtacggtaccggttaccggacccgtaaagggtacccgtaagggtcggtaattaacgtcgaaaggtaccgttaacgtggtcggtccgtggtaaccc

SEQ ID NO: 278479 - DNA, 681 bp, Homo sapiens
  misc_feature: GYAE6OF01DEZJL.19.71.G05.1.454.CMB.1.raw
  modified_base (236)..(236): a, c, t, g, unknown or other
  misc_feature (236)..(236): n is a, c, g, or t
tcagtactctcgtgcacgaccggtgctcgatttagtgtcgtcgcaagagagagggggaggtacaacaggcaggcaggggcagcaagatggtgttgcagacccaggtcttcatttctctgttgctctggatctctgtgcccacgggacatcgtgatgacccagtctccagactccctggctgtgtctctgggcgagcgggccaccatcaactgcaagtccagccacaattcttttanacagttccaaacaatagaaaaactactttacgctttagggtaccaagaccaagacgacccgaagggtaccaacgtccctcccgttaaggccttaggcctttactaattttaaccctggggaccacgttcccgtaaccccggggaattccccggggggttcccctaggacccgtaacgtttcgaacgttgggccaggtcccggggtcttcggggaactaaggtattttccgaacttcctacccacctaattcaacgtcacgccttagccaggtcgtagaacggattaggtggaccttaggtttttattacgttgttaccaaaacttagttatttaactttacgtaccgtttcgtacggtacgttaccggtaccgaaaggggtacctaaggggtggtaactacgttacgaacggtaacggtaaacttgggtacggtcctcggtaccc

SEQ ID NO: 278480 - DNA, 634 bp, Homo sapiens
  misc_feature: GYAE6OF01B5763.19.71.G05.1.454.CMB.1.raw
  modified_base (240)..(240): a, c, t, g, unknown or other
  misc_feature (240)..(240): n is a, c, g, or t
  modified_base (317)..(317): a, c, t, g, unknown or other
  misc_feature (317)..(317): n is a, c, g, or t
  modified_base (402)..(402): a, c, t, g, unknown or other
  misc_feature (402)..(402): n is a, c, g, or t
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctcgtgggcgagcgggccacatcaactgacaagtccagccacaattcttttanacagttccaacaatgaaaactacttagcttgtaccagcagagaccaggacacgcctcctaggctgcctcatttacgngggcagtccgtacccgggaatcccggggtcctgaccgtattccgaggtcggcaggcggggtctagggacagtatttccacttccnccaccgatcacgcacgcctgacgaggctaggaagtacgttggtcggtacttagtttttaacgttagtttacgtactaaaacgttaatttaattttaacgttaacttaccgtttacggttacgggtaaccggtttaccggggaacccgtaaaggggtaacccgtaaaggggttcggtaacttaacgtaccgaacggtaaccgtaacggttggacgggttcgtcggtaaccccg

SEQ ID NO: 278481 - DNA, 664 bp, Homo sapiens
  misc_feature: GYAE6OF01BLIZE.19.71.G05.1.454.CMB.1.raw
  modified_base (241)..(241): a, c, t, g, unknown or other
  misc_feature (241)..(241): n is a, c, g, or t
  modified_base (465)..(465): a, c, t, g, unknown or other
  misc_feature (465)..(465): n is a, c, g, or t
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagccgggccaccatcaactgacaagtccagccacaattcttttanacagttccaaacaatagaaaactacttagcttgtaccagcagagacagacagcctctaggctgctctatttacgtggacacttacgaaccccgggtaagtcccgggggttccctaggtaccgattcgaggtggactaggcgggtcgtagggacaggtactttcgaccttcgtacctaccagtccaagtccaagtcccgtgaccgtaaggtccgttagaaaggtnttacgggttagggaacttagtttttaacgttacgtttacgtacctaaaattaaagtttaacttttaaactttaagttaaccgtttacggtacggttaaccggtttcccggaaaccggtaaaggggtaccctaaaggggttacggtaacgttaacgtacggaacggtaacgtaaacttagggtcggtacctcggtaaccc

SEQ ID NO: 278482 - DNA, 762 bp, Homo sapiens
  misc_feature: GYAE6OF01CGST6.19.71.G05.1.454.CMB.1.raw
  modified_base (336)..(336): a, c, t, g, unknown or other
  misc_feature (336)..(336): n is a, c, g, or t
tcagtactctcgtgcacgaccggtgctcgatttagtgtcgtcgcaagagagagggggtcaggctggaactgaggagcaggcaggggcagcaagatggtgttgcagacccaggtcttcatttctctgttgctctggatctctggtgcccacggggacatcgtgatgacccagtctccagactccctggctgtgtctcgtgggcgagccgggccaccatcaactgacaagtccagccaactaattcttttaataccagttaccaaacaatacgtaaaacttacttagcttaggaccagcagacgacagacacgcctacctaggctgctcagtttacgngggacacgttccgaacccggggtaacttcccgggggtaccctacgggacccgtagtttccgaaggtcggacgagggtccgggttcgtaggggaacctaggttaactttccgaaccttactacccgtaaccctaactccgaaacggtaccctacggaccccgttggacccggaagggtaccttaacgggaaacggttagtacgggttagggtaccgtttaaggtttttaaccttttaagtttaccggttaacctaaaacttagttttaaaatttacgtttaaactttacccggtttacggtttacggggttaacccggtttacccggggaaacccggttaaaacgggggaaacccgtttaaagggggtaacgtaaacgttaaccggttaaccgaaaacgggttaccccggtaaacgggtttacgggg

SEQ ID NO: 278483 - DNA, 519 bp, Homo sapiens
  misc_feature: GYAE6OF01B7IH0.19.71.G05.1.454.CMB.1.raw
  modified_base (236)..(236): a, c, t, g, unknown or other
  misc_feature (236)..(236): n is a, c, g, or t
  modified_base (408)..(408): a, c, t, g, unknown or other
  misc_feature (408)..(408): n is a, c, g, or t
  modified_base (423)..(423): a, c, t, g, unknown or other
  misc_feature (423)..(423): n is a, c, g, or t
  modified_base (512)..(512): a, c, t, g, unknown or other
  misc_feature (512)..(512): n is a, c, g, or t
tcagtactctcgtgcacgaccggtgctcgatttagtgtcgtcgcaagagagagggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcggccaccatcaactgcaagtccagccacaatcttttanacagttccaacaatgaaaactacttagcttggtaccagcagagaccaggacagcctctaggctgctcattactggcatctaacccgggatccggggtcctgaccgtattcgagtcggcaggcgggtctgggacagtatttcactctcaccatcagcagcctgcagctgaagntgtggctagtttatnttgtacaataatattatatacttagcggtacgttcggaactaacgggtctaagggtggaattacgacgtaaggacgtaacgttgacggntgaaccc

SEQ ID NO: 278484 - DNA, 686 bp, Homo sapiens
  misc_feature: GYAE6OF01EPX7H.19.71.G05.1.454.CMB.1.raw
  modified_base (337)..(337): a, c, t, g, unknown or other
  misc_feature (337)..(337): n is a, c, g, or t
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagacctccctggctgtgtctcgtgggcgaggccgggccaccatcaactcgacaagtccagcccaactaattcttttataccagttacccaaataatagaaaaccttacttagcttaggtaccagacagagaccaggacacgccctcgtaggctgctactatttacgngggacacgtaccgtaacccgggtaagtcccggggtaccctggacccgagttccgagtggccaggtcgggtcgtagggactagtacgtttccacgtcctaccacctataccgacgtcacgcctcggaccgacggtactaggaagtgttaggtcggtacttagttttacgttaacgtttacgtaactaacttaaagttacttttaaagtttacttaccgttttcggttacggggttaccggtttacccgggaaccgtaaaacgggggtacccgtaaaggggttacggaattaacgtacccggtaaaggaaacccggttaacgtagggtttccgggtaccgtcgtaaccccg

SEQ ID NO: 278485 - DNA, 627 bp, Homo sapiens
  misc_feature: GYAE6OF01EE2PI.19.71.G05.1.454.CMB.1.raw
  modified_base (252)..(252): a, c, t, g, unknown or other
  misc_feature (252)..(252): n is a, c, g, or t
  modified_base (340)..(340): a, c, t, g, unknown or other
  misc_feature (340)..(340): n is a, c, g, or t
tcagtactctcgtgcacgaccggtgctcgatttagtgtcgtcgcaagagagagggggtcaggctggaactgaggagcaggcaggggcagcaagatggtgttgcagacccaggtcttcatttctctgttgctctggatctctggtcgcccacgggggacatcgtgatgacccagtcctccagacctccctggctgtgtctcgtgggcgagccgggccaccatcaactgcaagtccagccactaattcttttanactagttaccaaacaatacgaaaactacttagcttaggtaccagcaagacgaccgaaggacacgccctctaggctgctactatttacnggactactccgtaacccgggtaactcccggggtcctagaccgtattcgagtggcgaggtcggtcgtaggacagtactttccactctaccaactactcagccagtccctgcgaggtctagaagtgttggtaggtacttaagttttattaattaacgtacctaaataatttagtttaatttaacgtttaccgttaggttcgggtaaccgtttaccgggaccgtaaacggggaaacccgtaaggggttaaggtaacttaactaccggtaaacgaacccgtaaggttccgg

SEQ ID NO: 278486 - DNA, 651 bp, Homo sapiens
  misc_feature: GYAE6OF01BFSK7.19.71.G05.1.454.CMB.1.raw
  modified_base (246)..(246): a, c, t, g, unknown or other
  misc_feature (246)..(246): n is a, c, g, or t
  modified_base (328)..(328): a, c, t, g, unknown or other
  misc_feature (328)..(328): n is a, c, g, or t
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagacctccctggctgtgtctcgtgggcgaggccgggccaccatcaactgacaacgtccagcccacaattcttttanacagttccaacaatagaaaacttcttagcttaggtaccagacagacgaccaggacacgcctcgtaggctgctctatttacgngggcactccgtacccgggtactccggggtcctggacctattcgaggtcggcacggcgggtctacgggacaggtactttaccaccgtctccgaaccactccgacgtacacggtcctgaccggagtaccgtagaacgtgttacggtaggtcttaagttttattagtttacgtaacctaaaattaatttaatttaagtttaacttaccgtttacggtagggttaccgttaccgggaccgtaaacggggtaacgtaaggggttcgaaacgttacgtaccggaaacggtaaccggttaacgttaggggtacggtaccgtggtaacccg

SEQ ID NO: 278487 - DNA, 789 bp, Homo sapiens
  misc_feature: GYAE6OF01CJ9U8.19.71.G05.1.454.CMB.1.raw
  modified_base (358)..(358): a, c, t, g, unknown or other
  misc_feature (358)..(358): n is a, c, g, or t
tcagtactctcgtgcacgaccggtgctcgatttagtgtcgtcgcaagagagagggggtcaggctggaactgaggagcaggcaggggcagcaaagatggtgttgcagacccaggtcttcatttctctgttgctctggatctctggtcgcccgacggggacatcgtgatcgacccagtctccagacctccctggctgtgtctcgtgggcgaggccgggccaccatccaactgacaagtccagcccactaattcttttaatacctacgttacccaaactaatacgtaaaaacttacttagtcgttacggtaccagcaagacgaccgaggaccacgccctcgtaggctgctctagtttacgnggctacgtccgtaacccggggtaacgtcccggggtaccctaggacccgtagttccgaggtcggccgtacgggtcgggttacgtacggggaactacggttactttaccgaccttcctaccaacccgtacgtaccaaccggcctaaccggtcccgttacggacccgtaggggtacctttaacgggaaacggttacggttacgggttaccggtaaccgttttaagtttttaacgtttacgtttaacggttaaaccttaaaacgttaaagttttaaactttaacgttttaaaccgttaccgggtttttaccgggttaacggggttaacccgggtttacccggggaaacccggtaaacgggggtaaacccggttaaaggggttaccggtaaagttaccgttaacggtaaacgggtaaccggttaaacggttcgggg

SEQ ID NO: 278488 - DNA, 790 bp, Homo sapiens
  misc_feature: GYAE6OF01EE7T8.19.71.G05.1.454.CMB.1.raw
  modified_base (242)..(242): a, c, t, g, unknown or other
  misc_feature (242)..(242): n is a, c, g, or t
  modified_base (349)..(349): a, c, t, g, unknown or other
  misc_feature (349)..(349): n is a, c, g, or t
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactcccgtggctgtgtctcgtgggcgagcggccacatcaactgacaagtccagccactaattcttttaanactacgttaccaaacaatacgtaaaaacttacttaagcctttaggtaacctagacaagacgaaccgaaggaacacggtccctacgtacggctgctactactttacgnggactacgtaccgtacccgggtaacgtccgggtcctgaccgtattcgagtcggactacggcgggtcgtagggactaagtactttaccgacttctaccaacctagttaccgaacgtaccgaacgtccgtacggaccgtacgggtaccgttaggaaagttgttacggttacggtaacttttaaggttttaatttaacgtttaacgtaaaccgttaaaacttaaacgttttaaacgttttaactttaacggtttaacccggttttacggggttaaccggggttaaacccggttttacccggggaaaaccccggttaaaacggggggtaaaccccgtttaaaaggggggttaccggttaaaacgttaaccgttaaacccgggtaaacgggttaaacccggttaaaccggttgggttaaccgggttaccgtccggtaaaacccccg

SEQ ID NO: 278489 - DNA, 649 bp, Homo sapiens
  misc_feature: GYAE6OF01DPUWK.19.71.G05.1.454.CMB.1.raw
  modified_base (351)..(351): a, c, t, g, unknown or other
  misc_feature (351)..(351): n is a, c, g, or t
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccgacggggacatcgtgatgacccagtctccagacctccctggctgtgtctcgtggggcgaggcgggcccaccatacaactgacaagtccacgccactaattcttttatactacgttaccaaacaatacgtaaaaccttacttacgtcctttacggtaacccagccaaggaacgaccgaggacacgtcctcctaggctgctctatttacgnggcacgtccgtacccgggagtccggggtccctacgaccgtacttcgaggtcgacgtacggcgggtcgtgggactagtacttcgactccgtcaccatcgagccgagcctgccgaggtctaggaagtgtgtacggtcttaagttttagttagttagtacctaaacgttaattaattttaacttaagttaccggttcgtttacggtaccggttaccgggaaccgtaaaccgggtaaccggttaagggtagttaacgtacgttacgaacgtaacggtaacgttaggtcggtctcgtaacccg

SEQ ID NO: 278490 - DNA, 596 bp, Homo sapiens
  misc_feature: GYAE6OF01DUH04.19.71.G05.1.454.CMB.1.raw
  modified_base (238)..(238): a, c, t, g, unknown or other
  misc_feature (238)..(238): n is a, c, g, or t
  modified_base (318)..(318): a, c, t, g, unknown or other
  misc_feature (318)..(318): n is a, c, g, or t
  modified_base (372)..(372): a, c, t, g, unknown or other
  misc_feature (372)..(372): n is a, c, g, or t
  modified_base (419)..(419): a, c, t, g, unknown or other
  misc_feature (419)..(419): n is a, c, g, or t
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttanacagttaccaaacaatagaaaactacttagcttggtaccagcagacgaccaggacagcctcctaggctgctcatttacgnggcatccgtacccgggatccggggtcctgaccgtatcgagtcggcaggcgggtntgggacagtattcactctacacatcagcacgctgcaggtctagaagntggtcggacttaagttttattagttacgtactaaaacgtaatttaactttaatttaacttacgtttacggtacgggtaacggttaccggaaccggtaaacggggaaccgtaaagggttacggtaattaacgtaacgaacggtaaccgtaaacgttgggtacggtctaggtaaccccg

SEQ ID NO: 278491 - DNA, 508 bp, Homo sapiens
  misc_feature: GYAE6OF01AUZ14.19.71.G05.1.454.CMB.1.raw
  modified_base (238)..(238): a, c, t, g, unknown or other
  misc_feature (238)..(238): n is a, c, g, or t
  modified_base (410)..(410): a, c, t, g, unknown or other
  misc_feature (410)..(410): n is a, c, g, or t
  modified_base (416)..(416): a, c, t, g, unknown or other
  misc_feature (416)..(416): n is a, c, g, or t
  modified_base (503)..(503): a, c, t, g, unknown or other
  misc_feature (503)..(503): n is a, c, g, or t
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttanacagttccaacaatgaaaactacttagcttggtaccagcagagaccaggacagcctcctaggctgctcatttactgggcatctacccgggaatccggggtccctgaccgattcagtggcagcgggtctgggacagatttcactctcaccatcagcagcctgcaggctgaagntgtggntagtttattattgtcaaactaattattattatacttcgtggacgttcggaccgaagggaccaaggtaggatatacagacactgtggntgtac

SEQ ID NO: 278492 - DNA, 590 bp, Homo sapiens
  misc_feature: GYAE6OF01EIM92.19.71.G05.1.454.CMB.1.raw
tcagtactctcgtgcacgaccggtgctcgatttagtgtcgtcgcaagagagaggggggaggtacaacaggcaggcagggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaattcttttatactagttccaacaatagaaaactacttagtcttaggtaccagacagacgaaccaggaacacgcctccgtacggctgctctatttacgtggactacgtccgtaccgggaacgtccggggtccctacgaccgtattcgacggtggcgaggtcgggtcgtagggactagtactttcgactctaccacctatcagccagcctgacgagcgtagaagtgtgtcggtacttagtttattattacgtacaattaattatttattacttacgttggtacgtaccgttcggaccgtaacgggaccgtaaggtcggtaatacgtacaaggttaaccgaagttaggtcgtcgtgtaacccg

SEQ ID NO: 278493 - DNA, 736 bp, Homo sapiens
  misc_feature: GYAE6OF01C7RP2.19.71.G05.1.454.CMB.1.raw
  modified_base (343)..(343): a, c, t, g, unknown or other
  misc_feature (343)..(343): n is a, c, g, or t
tcagtactctcgtgcacgaccggtgctcgatttagtgtcgtcgcaagagagagggggtcaggctggaactgaggagcaggcaggggcagcaagatggtgttgcagacccaggtcttcatttctctgttgctctggatctctggtcgcccacgggggacatcgtgatcgacccagtctccagactccctggctgtgtctcgtgggcgagccggccaccactcaactgaccaagtccagccaactaattcttttaacacacgttaccaaactaataagaaaactacttagctttggaaccagcaggaacacaggacacgcctcgtaggctgctactagttaacgnggactactaccggtaaccgggacgtccccggggtcctacggaaccgtattccgaaggtcggacggtacggtcgggttccaggggtacctaaggttaccttacctaacctctacccgaacctacgtaaccaggaccctacgtccgtacggacggtacggtacgttaagggtaacgtacgggttacgggttaccgtaaggttttaagtttttaacgtttaacgtttacgttaaaccttaaaaatactttttaaacgtttaaacgtttaaccggttacgttttaccggttaacgggttaaaccggtttacccggggaaacggttaaacccgggtaacgttaaagggttacggtaaacgttaaacgtaggtaaaccggaacggttaaccggttcggg

SEQ ID NO: 278494 - DNA, 790 bp, Homo sapiens
  misc_feature: GYAE6OF01BGMSN.19.71.G05.1.454.CMB.1.raw
  modified_base (230)..(230): a, c, t, g, unknown or other
  misc_feature (230)..(230): n is a, c, g, or t
  modified_base (236)..(236): a, c, t, g, unknown or other
  misc_feature (236)..(236): n is a, c, g, or t
  modified_base (240)..(240): a, c, t, g, unknown or other
  misc_feature (240)..(240): n is a, c, g, or t
  modified_base (249)..(249): a, c, t, g, unknown or other
  misc_feature (249)..(249): n is a, c, g, or t
  modified_base (251)..(251): a, c, t, g, unknown or other
  misc_feature (251)..(251): n is a, c, g, or t
  modified_base (292)..(292): a, c, t, g, unknown or other
  misc_feature (292)..(292): n is a, c, g, or t
  modified_base (307)..(307): a, c, t, g, unknown or other
  misc_feature (307)..(307): n is a, c, g, or t
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtcgcccgacggggacatcgtgatcgacccagtctccagacctccctggctgtgtctcgtgggcgaggcggcctcgacaggacgtcactagcancatatnttanacactcaanancgaaatctagattgacagcagacacgagacacgctcacggntcgctctactttcgnggactacgtccgtaccgggtaacgtccggtcccgttacgtaacggaccttagtacgtcggcgccgtcgggtaggttccgggtacgacggtaagttcctaacgtttaccccgtaccgtaccgtaccgtacgtaccgtaccgacgtacggtaccggtacggtaccggtacggtaacggtaacgtacggttacggtacggtttaacgttttaacgttttaacgtttaacgttaacgttaaacgttaaacgtttaaactttaaaccgttttaaaccggtttaacgtttaaccggttttaaccggtttaaccgggtttaacccgggtttaaacccgggttaaaccgggttaaaccgggttaaaccggggttaaacgggttaaacgggttaaaccggttaaaccggttaaaccgggtaaaccgggttaaacccggtttaaacccgggttaaccgggttacccggttacccggttaaccggttaacccgg

SEQ ID NO: 278495 - DNA, 864 bp, Homo sapiens
  misc_feature: GYAE6OF01C3V5Z.19.71.G05.1.454.CMB.1.raw
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctcgtggtcgcccgacggggacatcgtgatgacccagtctccagactcctggctgtgtctcgtgggcgacgccgggccaccatacaactgacaagtccagccactaattactttatactacgttaccaaactaagtacgaaaacttacttagacgtttacggaaccagaccaaggaacgaaccgaggaacgacgccttccgtaggctgcctctagtttacgcgggctacgtacccggtaacccgggtacgttcccggggtcctaggaacccgttagttaccggaggttcgggaccgtacggggtccggggttacgtacggggaactaacggttaccttttaccgaaccgttccttacccgaaaccgtacttaacggtaccggacccttaaaccggtccccttagggaacccgggtaacggggtacccgtttaaaggggaaaacgtggtttacggggttaaccggttaaccggttttaaacggtttttttaattacgtttaacggtttaaaaaccctaaagtttaaaacgttttaaggttttaaacgtttaacgtttaacccgggttttaccgggtaacgggtttaacccgggtttaaaccgggggaaacccgtaaaaccggggggtaaaccgtaaagggggtttaacgtaaacgttaaccggtttaaacggaaaccgggtaaaccggttaaacgggtttccggggtaaacgtttcgggaccggttaaaccccg

SEQ ID NO: 278496 - DNA, 655 bp, Homo sapiens
  misc_feature: GYAE6OF01E0JP5.19.71.G05.1.454.CMB.1.raw
  modified_base (240)..(240): a, c, t, g, unknown or other
  misc_feature (240)..(240): n is a, c, g, or t
  modified_base (252)..(252): a, c, t, g, unknown or other
  misc_feature (252)..(252): n is a, c, g, or t
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgaggcgggccacatcaactgacaacgtccagccacattcttttanacagttaccaanaatagaaactacttagcttaggtaccagacaagacgaccaggacacgcctacgtaggctcgctactatttacgtcgggctacgtaccgtaccgggaacgtcccggggtcctaggaccgtattcgacggtcggactacgggtcggtcgtacgggacgtagtactttccgacttcacctaccgtactacgacgtctaacgtccgtaggacgacggtcgtacgaagtacgttcggtacggttacgttagttttaacttgttacggtacctaacgttaaatttagtttaacttacgttacgttacggttacggtaccgttaccgggaaccggtaaacgggtaccgtaaagggtcggtaacgttacgtacgtaacggtaacgtacggtaggtcggtccgtgtaacccg

SEQ ID NO: 278497 - DNA, 878 bp, Homo sapiens
  misc_feature: GYAE6OF01ER175.19.71.G05.1.454.CMB.1.raw
  modified_base (254)..(254): a, c, t, g, unknown or other
  misc_feature (254)..(254): n is a, c, g, or t
tcagtactctcgtgcacgaccggtgctcgattttagtgtcgtcgcaagagagaggggggaggtacaacacggcaggccaggggcagcaagtatggtgttgcagacccaggtcttcattttctctgttgctctggattctctggtgcccacgggggtacatcgtgattgacccagtctccagactccctggctgtgtctcgtgggcgagcgggccaccgatcgacgtcgacaagtccagccactaattcttttanacctacgttaccaaactaatacgtaaaaccttacgttagtcttaggtaaccagtcaagacgtaccgaggacacggcccttaccgtaggcgtcgctactaattttacgtgggactaagttccgtaacccggggtaagttccccgggggtaccctacggtaacccgtagttaccgaacgggttcggaccgtaacgggtaccggggtttacgtacggggaacgtacggttaacctttaccgtaccgttacccttaccgaaccccttagttaccccgaacgggtacccgtaacgttaccccgttaaggacccggtaacggggtccttaaacgggtaaacggttaacgtttcgggttaacggtaacccggtttttaagggttttttaacgtttaccgttttaaccgggtaaacctaaaaccgttaaacgttttaaacgtttttaaccggtttaaacgtttaacccggtttttccgggttaacggggtttaacccggttttaacccggggaaacccggttaaaacggggggtaacccgttaaagggggttacggttaaacgttaccggtaacggtaaacgggttaaccggtaacggtttacggggacgggttccgtaccgggtaaccccg

SEQ ID NO: 278498 - DNA, 681 bp, Homo sapiens
  misc_feature: GYAE6OF01ALQ1X.19.71.G05.1.454.CMB.1.raw
  modified_base (239)..(239): a, c, t, g, unknown or other
  misc_feature (239)..(239): n is a, c, g, or t
tcagtactctcgtgcacgaccggtgctcgatttagtgtcgtcgcaagagagagggggaggtacaacaggcaggcaggggcagcaagatggtgttgcagacccaggtcttcatttctctgttgctctggatctctggtgcccacggggacatcgtgatgacccagtctccagactccctggctgtgtctctgggcgaggcggccaccagtcaactgacaagtccagccactatcttttanactagttaccaaactaatacgaaaaactacgttacgcgtttacggtaccagccaagaacgaaccctaagggaacctacggaccctaccgtaagggccttacggccttacctaagttttaccgtgggactacgttaccggtaacccgggtaacgtccccgggggtccctcggaaccgtattccgaggtcggacgtaggtccggggtactacggggactagtactttaccgacgtcctacgacctatcctagccacgcctacgcgaggtctaggaagtctggtcgtactaagttttattacgttacgtaactaacttaagtttaatttaattaacgttacgttacggtacggttacccgttacgggacccgtaaaggggtaccgtaagggtcggtaactaagtaccgaaacggtaccggtaaagttcggtaggtcgcgtaaccg

SEQ ID NO: 278499 - DNA, 749 bp, Homo sapiens
  misc_feature: GYAE6OF01BY4L8.19.71.G05.1.454.CMB.1.raw
tcagtactctcgtgcacgaccggtgctcgatttagtgtcgtcgcaagagagagggggagagtctgctgaattctggctgaccagggcagtcaccagagctccagacaatgtctgtctccttctcttctctgccgtgctcggcctcccacaaggtcgtcctgtcacaagtacagctgcagcagtcgaggtccagggactgggtacgaacgtcccctggaccacggtaccccttcgtccggtcctaccaccgttggtacgccctaaggtccgtaccgggggaacacggacggttccgcgtagccgaactggttcgttcgcgttcgggactacggtcgggtcacgggtcctacggtacccagtcggagtacggtacgtagggacgtcgggacggttacggggaaacgtacgtaagtttacgttcgtaacggtttccggaaccctaaaacggtacgggttaaacggtaaacttaaacgttaaactttacgccgtaacctacgtacttaccggttaggttacggtaaggtaacgttacgacgttacgaaacgtaactaaccgtaaacgtacgaacgtaacgtaacggtaacgaaaccgtaccgttaacgttccgtacccgttacgaccgtacgtccgttacgtaccttcggtacgtaccgtaaccggtaccggaacggtacggttacggggtatttacggttacgttacggttacggtaccggtaaccgaaccggaaccctaggtacgtaaccg

SEQ ID NO: 278500 - DNA, 675 bp, Homo sapiens
  misc_feature: GYAE6OF01EJ50H.19.71.G05.1.454.CMB.1.raw
  modified_base (320)..(320): a, c, t, g, unknown or other
  misc_feature (320)..(320): n is a, c, g, or t
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaattcttttatacagttaccaacaatagaaaactacttagcttggtaccagcagagaccaggacacgcctacgtaggctgctcagtttacgnggcacgtccgtacccgggaactccggggtccctcgaccgtattccgagtcggactggcgggtcgtcgggactagtactttcgactctaccaccatcacgcgacgcctgaccgaggccgtagaagtacgtggtacggtacgttacggttttaattagtttacgttaacctaaacgttaaatttaattttaaactttaacgtttaccgttttaccgggttacgggttaaccccgggttttaccggggaaacccggttaaacggggtaaaccccggtaaaggggttacggtaaacgttaacgtaccgtaaaggtaccggtaaacggttaggttccgggttacccgttcgtaaaccccg

SEQ ID NO: 278501 - DNA, 819 bp, Homo sapiens
  misc_feature: GYAE6OF01BQEWC.19.71.G05.1.454.CMB.1.raw
  modified_base (321)..(321): a, c, t, g, unknown or other
  misc_feature (321)..(321): n is a, c, g, or t
tcagtactctcgtgcacgaccggtgctcgatttagtgtcgtcgcaagagagagggggaggtacaacaggcaggcaggggcagcaagatggtgttgcagacccaggtcttcatttctctgttgctctggatctctggtgcccacggggacatcgtgatgacccagtctccagacctccctggctgtgtctcgtgggcgagcgggccaccatcaactgacaagtccagccactaatcttttagacagttccaagaatagaaaactacttagcttgtaccagacagagaccaggacagcctaccgtagctgctctactttacgnggctactccgtacccgggaacgtcccggggtccctagaccgtacttcgaggtggccgtacggtcggggtacgtagggaactacgtactttccgaacgttctaccgtacctaacgttccgaacgtcctaacggtccccgtaggcccgtaacgggtaccttaggaaacgggtacgttacggtacggggtaacctttaagggttttttaagtttaaccgttttaacgggtttaaaccctaaaaccgtttaaaagttttaaacttttttaaacgttttaaaccgttttaacccggttttaccggggtttaaccccggggtttaacccgggttttaaccccggggaaaaccccggttaaaaccggggggttaaacccccggtttaaaagggggttaccggggtttaaaacgttaacccgttaaacccggggaaaacggttaaaacccgggttaaacggtttaggggtaacccggggtttaccgtaacgggttaaaccccccgg

SEQ ID NO: 278502 - DNA, 701 bp, Homo sapiens
  misc_feature: GYAE6OF01AR2KK.19.71.G05.1.454.CMB.1.raw
  modified_base (237)..(237): a, c, t, g, unknown or other
  misc_feature (237)..(237): n is a, c, g, or t
  modified_base (319)..(319): a, c, t, g, unknown or other
  misc_feature (319)..(319): n is a, c, g, or t
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctcgtgggcgagcgggccaccatcaactgcaagtccagccacatctttanacagttaccaacaatagaaaactacttagcttaggtaccagacagagaccaggacagcctccgtaggctgctctatttacgngggctacgtaccgtaacccgggtaacgtcccggggtaccctgaaccgtattcgagtcggcacggcgggtctggggaactaggtactttccgacttccgtaccaaccgtactaccgacgacctaacgcccgttacggaccgtacgggtaccgtaggaaacggtacgttaggtacggtactttaagggtttttaactttaagtttacgtaacctaaaacgttaaatttaacttttaaatttaacgttaaccgttttccggtacgggttaacccggtttacccgggtaaacccggtaaacggggtaacccggttaaggggtacggttaaacgtaacgttaccgaaacggtaacggtaacgttaggtacggtccgtaggtaacccg

SEQ ID NO: 278503 - DNA, 641 bp, Homo sapiens
  misc_feature: GYAE6OF01C3CBA.19.71.G05.1.454.CMB.1.raw
  modified_base (243)..(243): a, c, t, g, unknown or other
  misc_feature (243)..(243): n is a, c, g, or t
  modified_base (256)..(256): a, c, t, g, unknown or other
  misc_feature (256)..(256): n is a, c, g, or t
  modified_base (323)..(323): a, c, t, g, unknown or other
  misc_feature (323)..(323): n is a, c, g, or t
  modified_base (339)..(339): a, c, t, g, unknown or other
  misc_feature (339)..(339): n is a, c, g, or t
tcagtactctcgtgcacgaccggtgctcgatttagtgtcgtcgcaagagagagggggtcaggctggaactgaggagcaggcagggcagcaagatggtgttgcagacccaggtcttcatttctctgttgctctggatctctggtcgcccgacggggacatcgtgatcgacccagtctccagtacctcccgtggctgtgtcctcgtgggcgacgcggccaccatcaactgcaagtccagcctaanaattcgttttaanactacgttaccaaactaatagaaaacctagttacgcttacggacagcagacacgagacagcctacgngctgctctagttacgnggactacgtaccgtaacccggatcccggggtacctcggaccgtattcgaggtacgcgtaacggtcgggtcagggactagtacttcacttctacgacctatacacgacacgtccgtagacacgtagtagagtacgtggttaacgtattacggtttattacgttacgtacttaaattacggttaactttaactacgtttaaccgttaccgggtacggttaaccggttaccggtaaacccgaaacggggttaacccgtaagggttcgtaaacttacgtaacccgagggtaaaccgtcgttacggg

SEQ ID NO: 278504 - DNA, 621 bp, Homo sapiens
  misc_feature: GYAE6OF01CAO2Y.19.71.G05.1.454.CMB.1.raw
  modified_base (240)..(240): a, c, t, g, unknown or other
  misc_feature (240)..(240): n is a, c, g, or t
  modified_base (321)..(321): a, c, t, g, unknown or other
  misc_feature (321)..(321): n is a, c, g, or t
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccactaattcttttanacagttaccaacaatagaaaactacttagcttggtaccagcagagaccaggacagccctcgtaggctgctactatttacgnggcatccgtaccgggatcccggggtcctgacccgtattcgaggtcggacacggtcgggtcgtagggactagtactttccacgttcctaccaccgtataccgagtccaacgtccgtgccgaggtctaggaacgtactggtagtacttaagttttattattacgtactaaactaattatttaattactacgttcggtacggtaccggttacggaaccggtaaacgggtaccgtaaagggttcgtaacgttacgtaaccggaaaggttaacccgtacgttagggcggtccgttacgaaccccg

SEQ ID NO: 278505 - DNA, 598 bp, Homo sapiens
  misc_feature: GYAE6OF01B8U49.19.71.G05.1.454.CMB.1.raw
  modified_base (374)..(374): a, c, t, g, unknown or other
  misc_feature (374)..(374): n is a, c, g, or t
tcagtactctcgtgcacgaccggtgctcgatttagtgtcgtcgcaagagagaggggggcagagcctgctgaattctggctgaccagggcagtcaccagagctccagacaatgtctgtcgccttcctcatcttcctgcccgtgttggcctccagtggggtgtcctgtcacaggtgcagctgcaacagtcaggtccaggactggtgaacgcccctgcagacgcctctcactcacctgtaccagtacgtccggggacagtcgtctctagtgacagcgacaacgttgggactggctcaggcacgtcccatcgagaggtccttgagtggcgtagggaagactatacgtacgacggtaccaggtgtatgatgaatttagngactagtactcgtagtaagtaaaacgtcgtaatttaccaattaacgcctaagaacctactaactaaccgaaacgtaacctagttacccctaccgttacgaccgttaacgttagaacccttcgtacgtaccgacccgtacccgaaccgtaacgaccggtcttaggttaccttaagttacgtggtacccgaagaaacggtacggtactacggaggtaaaaccgggg

SEQ ID NO: 278506 - DNA, 619 bp, Homo sapiens
  misc_feature: GYAE6OF01DDGDU.19.71.G05.1.454.CMB.1.raw
  modified_base (239)..(239): a, c, t, g, unknown or other
  misc_feature (239)..(239): n is a, c, g, or t
  modified_base (408)..(408): a, c, t, g, unknown or other
  misc_feature (408)..(408): n is a, c, g, or t
  modified_base (469)..(469): a, c, t, g, unknown or other
  misc_feature (469)..(469): n is a, c, g, or t
tcagtactctcgtgcacgaccggtgctcgatttagtgtcgtcgcaagagagaggggggaggtacaacaggcaggcaggggcagcaagatggtgtgcagacccaggtcttcatttctctgttgctctggatctctggtgcccacggggacatcgtgatgacccagtctccagacctccctggctgtgtctcgtgggcgagcggccacatcaactgacaagtccagccataattcttttanactacgttaccaaactaatacgaaaacttacttagcttaggtaccagacagagacctaggacacgcctaccgaggctgactctaatttcgtagggactacgtaccgtacccgggaactcccgggggtaccctcggaaccgtatccgaggtcggccgagggtcgggtcgngggaactagtactttcaacgtctaccacatcgagccacgcctagcgtagcgtaggaaagtntaggtcgtacttagtttattacttagtaccgtaaattaacgttaatttaatttaccgttacgttacggtacggtaaccgggtttaccggaccgtaaacgggtacgtaagggtgacgtagtacgagtaacgtacgtaggtcgtgtcggacc

SEQ ID NO: 278507 - DNA, 696 bp, Homo sapiens
  misc_feature: GYAE6OF01CE68X.19.71.G05.1.454.CMB.1.raw
  modified_base (260)..(260): a, c, t, g, unknown or other
  misc_feature (260)..(260): n is a, c, g, or t
  modified_base (359)..(359): a, c, t, g, unknown or other
  misc_feature (359)..(359): n is a, c, g, or t
  modified_base (466)..(466): a, c, t, g, unknown or other
  misc_feature (466)..(466): n is a, c, g, or t
  modified_base (471)..(471): a, c, t, g, unknown or other
  misc_feature (471)..(471): n is a, c, g, or t
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtcgcccgacggggacatcgtgatcgacccagtctccagacctcccgtggctgtcgtctcgtggggcgaggccgggcctaccgatacaactgactaacgtccaacgccaactaattcttttaanaactacgttaccaaactaataacgtaaaacttcttagcctttacggaaccagacaggaacgaccgaaggacacgccctacaggctgctactagttacgngggacctacgtaccggaacccgggtagttccccgggtcctacggaccgtattcgaggtcgctacgggtcggtacgtgggaactagtactttccgactcctacactancgacncacgctagcgacggtacgtagaacgtagtcggtacgtagttaacgttttagttacgtacggtaactaaaacgttaattttactttaacgtttaaccgttacgttacgggttaacggtaaccggtttacccggaaaccggtaaacggggtaaccctaggggttaaccgaacttaacgtaaccggaaggtaacccgtaaggttgggtaaccgcgttaccgtaacccg

SEQ ID NO: 278508 - DNA, 713 bp, Homo sapiens
  misc_feature: GYAE6OF01D3T1E.19.71.G05.1.454.CMB.1.raw
tcagtactctcgtgcacgaccggtgctcgatttagtgtcgtcgcaagagagagggggagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaacgccctcgcagaccctctcgctcacctgtcgccatccgtccggggacagacgtcgctagcgactagtgttgcttggcacgttgggtcaggcacgtcccagtcgagtagtcgtagagtggcgtaggggaagactagttattcatcggtaccaacgtacggtaggaaacttaacgtaaaatttatacgacctaccgtaattccgttaggtttaggaacggtacgttaccgaacgttaagaaacctaaacgttaccgtaaaaccggttaacgaaacccgtaacgtaacgttaaccggtaaaacgtaacccgttaacgtttacccgttacccgttacgtaccgtaacggtacccgttacggtaaccccttcgttacggttaaccggtacccgttaccccgggaacgggtaacccggtaacggggtttacgtttaaacgtttaacgtttaaccgttacgggttaacgggtaaacggtaccccgggtaaccccccgtaagtaacggtaaacccg

SEQ ID NO: 278509 - DNA, 852 bp, Homo sapiens
  misc_feature: GYAE6OF01CSQCP.19.71.G05.1.454.CMB.1.raw
tcagtactctcgtgcacgaccggtgctcgatttagtgtcgtcgcaagagagagggggagtacaacaggcaggcagggcagcaagatggtgttgcagacccaggtcttcatttctctgttgctctggatctcgtggtcgcccgagggacagtcgtgaacgtcgacccgtagtcctaccgtacgtacccttcccgtggtccgtcggttcgtcgtccggtaaggggccgtaacggcccgggtaccctaaccggacttaacgaaccgtcggtacctaacggtcccgacggtaccctaacgttaaacgtttccttttaagaccgttaaccggttaacctaaaaccgtaaagttacgtaaaaccttcgttaacgtcgttaacggtaaccaggtaccgaggtaacgacccgtaaggacccgtaacgtccttaaccggtcggctacggtactacgttacgtttaccgcggtactacggtaccggtacccggtacgttccgggactacggtaccgtatccggtagacggtaccgagggttcggttacgtacggaacgtttacgtaccgttacgaccgttaccgtacccggtaactaccgttacgaccgtacggtaacgtcccggttacgaaccgttcggtaacgttacgaacggtttacgtacggttaccggttaagttttaaccggtttacgtaaccggtttaacgtaaccgtaacgttaacggtttaaccttacgtttaacccggttacggttaccggtaaccggttacccgggtttacgaacccggtttaacggtacggtaacggttagtaccgttaacgacgtttacgaacgtacgtaggtaacgcgtaacgtaccg

SEQ ID NO: 278510 - DNA, 626 bp, Homo sapiens
  misc_feature: GYAE6OF01EIUSD.19.71.G05.1.454.CMB.1.raw
  modified_base (249)..(249): a, c, t, g, unknown or other
  misc_feature (249)..(249): n is a, c, g, or t
  modified_base (346)..(346): a, c, t, g, unknown or other
  misc_feature (346)..(346): n is a, c, g, or t
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccgacggggacatcgtgatgacccagtctccagactccctggctgtgtctcgtgggcgaggcgggccaccatacaactgacaacgtccacgccaactaattcttttaanacacgttaccaaacaatagaaaaccttacttagctttacggaaccagacaagacgaaccgaggacaacgcctaccgtaggctgcctactatttacgnggactacgtaccgtaccgggaacgtcccggggtccagtaccgattccgagtcggacaggtcgggtcgagggacagttacttcactcgtaccacatacacgcacgccgtgaccgaggtactaggaagtgtggtacgtcttagtttaattcgtacgtaacaacttaaagttatttaatacttacgttcggttacggtacgttaccggacgtaacgggaacctaagggtacggtaacttacgtactaacggtaacgtaaacgttgggcggtccgtgtaacccg

SEQ ID NO: 278511 - DNA, 579 bp, Homo sapiens
  misc_feature: GYAE6OF01CXCSG.19.71.G05.1.454.CMB.1.raw
  modified_base (243)..(243): a, c, t, g, unknown or other
  misc_feature (243)..(243): n is a, c, g, or t
  modified_base (326)..(326): a, c, t, g, unknown or other
  misc_feature (326)..(326): n is a, c, g, or t
  modified_base (437)..(437): a, c, t, g, unknown or other
  misc_feature (437)..(437): n is a, c, g, or t
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagacctccctggctgtgtctcgtgggcgagccgggccaccatcaactgcaagtccagccaactaattctttanactacgttacaacaatagaaaactcttagcttggtaccagcagtacgaccaggacacgcctcctaggctgctactatttacgnggcataccgtacccgggagtcccgggtcctgaccgtatcgagtcggcaggtcgggtctggactagtacttcactctaccactatcagcacgtcctgacgagctaggaacgngttcgtggacttagtttattagttagtactaatattatttattacttcgttacgtggtaccgttaccggacgtaaacgggtacctaagggttacgacttacgtacgaacggtaccgtaacgttggtacggctcggtaacccg

SEQ ID NO: 278512 - DNA, 576 bp, Homo sapiens
  misc_feature: GYAE6OF01BLVD1.19.71.G05.1.454.CMB.1.raw
  modified_base (203)..(203): a, c, t, g, unknown or other
  misc_feature (203)..(203): n is a, c, g, or t
  modified_base (261)..(261): a, c, t, g, unknown or other
  misc_feature (261)..(261): n is a, c, g, or t
  modified_base (280)..(280): a, c, t, g, unknown or other
  misc_feature (280)..(280): n is a, c, g, or t
  modified_base (317)..(317): a, c, t, g, unknown or other
  misc_feature (317)..(317): n is a, c, g, or t
  modified_base (420)..(420): a, c, t, g, unknown or other
  misc_feature (420)..(420): n is a, c, g, or t
  modified_base (436)..(436): a, c, t, g, unknown or other
  misc_feature (436)..(436): n is a, c, g, or t
tcagtactctcgtgcacgaccggtgctcgatttagtgtcgtcgcaagagagaggggggaggtacaacaggcaggcaggggcagcaagatggtgtgcagacccaggtcttcatttctctgttgctctggatctctggtcgcccgacggggacagtcgtgatcgacccagtctccagactcccgtggctgtcgtctcgtggacgnggccggccacagtccaactgacagtccacgactacattctttacactacgttaccaanaatacaaaactcgtacgtnttacggacagcagacacgagacacgtcctcgagctcnctacagttcgcggtacacgtaccgtaacccggacggttccgggtaccaggacctagttacgcgtagcgtggacggtcgaggacctgtacttcaccgtcaccancgtacacgcacgccgngacgacgacgagtaagcgtgacgttattacgttatgtactactaattattacttagttctacgttacggagtacggtacgacgtaacggtacgtaggtatcgacgtacgaacggttaacgacgtagaccgtcgtagaccg

SEQ ID NO: 278513 - DNA, 622 bp, Homo sapiens
  misc_feature: GYAE6OF01BXGBF.19.71.G05.1.454.CMB.1.raw
  modified_base (241)..(241): a, c, t, g, unknown or other
  misc_feature (241)..(241): n is a, c, g, or t
  modified_base (615)..(615): a, c, t, g, unknown or other
  misc_feature (615)..(615): n is a, c, g, or t
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctcgtgggcgagcgggccaccatcaactgcaagtccagccagaactattttccnccacctccaagaacaaaacttctagcctggtaccaacagacgaccaggacagcctcctaagttgctcatttacgtgggtccttctacgcgacgtaacgttcgggtccctgaccgtcgtccgggcaggcggtcgtagggactaggtatttccactcctacaccagtccgagtccacgtccctgcccgtaggccgtaggaaacgtagttcgggtcggtacgtttaaggttttaccttacgttcgtacgacgtaacttaatttacctttttctaaccttcccgttaccggttcggtaccggttccggaccgaacgggtaccgtaggggtacgaaacttcgaacggtaacgtacgtggtcggacttacgaccaccgtnttcgtcg

SEQ ID NO: 278514 - DNA, 628 bp, Homo sapiens
  misc_feature: GYAE6OF01C29XT.19.71.G05.1.454.CMB.1.raw
  modified_base (393)..(393): a, c, t, g, unknown or other
  misc_feature (393)..(393): n is a, c, g, or t
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaacgccctcgcacgaccctctcgctcaccgtgtcgcctagtccgtaccggggacaggacgtcgactaggcgacgtggtcgttgtcgttggctacgtcgggtcacggcacgtcccagtcgagcggtctaggaggtggacgtagggaagactagtatttcatcgtacaacgtagtagaactaactaattntacgactacgtaattcgtaggttagacgtacgtcgtaacgttagaacctaagtaccaacggtacaacctacaaggttaccgaaacgtaccttacgttcccgccgtagccgtacgtaccgtacgttaccgttgttacggtaccgtaaccccgtccgggaaacgggtaccgttaacggggtttattaacttacgtttacggtagggtaccggaacggacccggtccctaagtaaacg

SEQ ID NO: 278515 - DNA, 601 bp, Homo sapiens
  misc_feature: GYAE6OF01D4JPX.19.71.G05.1.454.CMB.1.raw
  modified_base (245)..(245): a, c, t, g, unknown or other
  misc_feature (245)..(245): n is a, c, g, or t
  modified_base (325)..(325): a, c, t, g, unknown or other
  misc_feature (325)..(325): n is a, c, g, or t
tcagtactctcgtgcacgaccggtgctcgatttagtgtcgtcgcaagagagagggggtcaggctggaactgaggagcaggcaggggcagcaagatggtgttgcagacccaggtcttcatttctctgttgctctggatctctggtgcccacggggacatcgtgatgacccagtctccagactccctggctgtgtctctgggcgaggcggccaccagtcaactgcaagtccagccacaatcttttanacagttccaacaatgaaaactcttagcttggtaccagtcaagagaccaggacagccctcctaggctgctacatttaccgnggcacgtcgtaccgggacgtcccgggtcctgaccgtattcgaggtcggcgaggtccgggtactacgggactagtactttccgactctacacctatccagcctacgtccgtcgacgacggtctagaacgtgtcggtaggtacttaagtttattagttacgtaactaatatttaatttaattacgttacgttacggtacggtaccggttaccggaaccggtaaacgggtaaccgtaagggtacggtaacgttaacgtacgtaacggtacgtacgtcgg

SEQ ID NO: 278516 - DNA, 552 bp, Homo sapiens
  misc_feature: GYAE6OF01B9AV5.19.71.G05.1.454.CMB.1.raw
  modified_base (421)..(421): a, c, t, g, unknown or other
  misc_feature (421)..(421): n is a, c, g, or t
tcagtactctcgtgcacgaccggtgctcgatttagtgtcgtcgcaagagagagggggagagtctgctgaattctggctgaccagggcagtcaccagagctccagacaatgtctgtctccttctcttcttcctgcccgtgctggcctcccacaaggtgtcctgtcacaagtacagctgcagcagtcaggtccaggactggtgaagccctcgcagacccctctcgctcacctgtgccatcctccggggacagagtcgctagcgacagtgttgcttggcacgtgggtcaggcacgtcccatcgagaggtctagagtggctggggaacgacattatttcagtcgtaccaacgtacgtggaaattacaaattatgactacctatcgttagttagagtacgtcgaactagactaatacgaaacgtanacacactacgaacgtaacctacgttcctcccgtagtacacgtctcgaccttctgtacgccgtacccggaggtaccgtacgggtagttactacgttacgtaggtacggaacgacggacccctgtacgtaacg

SEQ ID NO: 278517 - DNA, 689 bp, Homo sapiens
  misc_feature: GYAE6OF01D0XHL.19.71.G05.1.454.CMB.1.raw
  modified_base (239)..(239): a, c, t, g, unknown or other
  misc_feature (239)..(239): n is a, c, g, or t
  modified_base (321)..(321): a, c, t, g, unknown or other
  misc_feature (321)..(321): n is a, c, g, or t
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagccgggccaccatcaactgcaagtccagccacaatcttttanacagttaccaaacaatacgaaaactacttagctttaggaccagcagacgaccaggacagcctcctaggctgctctatttacngggacagtccgtaacccgggaagttcccggggtaccctggaccgtattcgagtacggcgacggcgggtcgtacggggaactaggtactttccgtacttaccctacgaaccctagttaccgaacgggtcctacggacccttcggaccgtacgggacgttacgggaaggtagttcggtaggtaccgttaagtttttactttaagtttacggtaactaaaccttaatttaacgtttatttaaacgttacgtttacgggtacggttaaccggtttccgggaaccggtaacgggtaaaccggtaagggttaggtaacgttaaggtaccaaacgggttaacgtaaccgttgggtacggtccgttcggtaacccg

SEQ ID NO: 278518 - DNA, 878 bp, Homo sapiens
  misc_feature: GYAE6OF01CM8X4.19.71.G05.1.454.CMB.1.raw
  modified_base (625)..(625): a, c, t, g, unknown or other
  misc_feature (625)..(625): n is a, c, g, or t
tcagtactctcgtgcacgaccggtgctcgatttagtgtcgtcgcaagagagagggggaggtacaacaggcaggcagggcagcaagatggtgttgcagacccaggtcttcgatttctctgttgctcgtggatctcgtggtcgcccgagggactagtcgtagatcgaccctagtcctaccgagacctcccgtggtccttagtcgtcctcggtacgggacgacggccgggacctaaccgataccgaaacgtgaccgtaacgtccgaacgtcctaacttaacgtttactttaacgacgtaacgttaccaaaactaacgtaacgtaaaaccgttaccgttaggtaccgtttacggtaacccgagaccgtaacggtaaccgtaaccggacggtaacccgtaaccggtaccccgttacccggtaacggtcccgttcgtacctttaccggttaacgttttaccggtacggtaccgttaacccgttacccggttaacccggggtaccgttcccggggtacctaacgggtaacccgtacgttccggtaacgtcggtacgtacgggtccggtacggtacggtaaccgttacgttacgttaccgtaccgttaccgttaccgaaccgtacggttaccngtaacccgtacgtccgtacggaccgttaacggtcgtaaacgtaacggtacgttaccggttacggtactttaaagtttcgtttaaccgtaacgttaacccgtaaattacgtttaaccgtttaaggtaccgtttaccggtaccggttacggttacccgtaccgggaaccgttaaaggtaccgggtaaggtaacgtaacgttacgtaacggttaccggtaaacggttcgttaacggtcgtcccgttaagtaccccg

SEQ ID NO: 278519 - DNA, 605 bp, Homo sapiens
  misc_feature: GYAE6OF01EQJSK.19.71.G05.1.454.CMB.1.raw
tcagtactctcgtgcacgaccggtgctcgatttagtgtcgtcgcaagagagagggggagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaacgccctcgcacgaccctctcgctcacctgtcgccatcgtccggggacagacgtcgctagcgacagtgtgcttggcacgtgggtcaggcacgtcccagtcgagaggtctagagtggcgtagggaaggacattattcagtcgtaccaaacgtacggtaggaaacttaactaaaatttacgtacgccaacctattcgttaggttagaaggtacgtacgactacgaacctaaactacgaaacgtagaacctaacgaagtaccggaaacgtaacctacgtttaccctacccgtgacacgtctacgtacccttgtcgtacgtacccgtaccggaacggtaccgtagggttagttaattacgttacgtacggtacggaacggtacccgtaccccgaagtacgtaacg

SEQ ID NO: 278520 - DNA, 670 bp, Homo sapiens
  misc_feature: GYAE6OF01ELFVN.19.71.G05.1.454.CMB.1.raw
  modified_base (246)..(246): a, c, t, g, unknown or other
  misc_feature (246)..(246): n is a, c, g, or t
  modified_base (432)..(432): a, c, t, g, unknown or other
  misc_feature (432)..(432): n is a, c, g, or t
  modified_base (443)..(443): a, c, t, g, unknown or other
  misc_feature (443)..(443): n is a, c, g, or t
  modified_base (485)..(485): a, c, t, g, unknown or other
  misc_feature (485)..(485): n is a, c, g, or t
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatcgacccagtctccagactccctggctgtgtctcgtggcgagcgggccacatacaactcgacaacgtccacgccactaattcttttaanacacgttaccaaactaataacgtaaaacttacgttagtccgtttaggtaaccaagaccaaggaacgacccgaagggaccaacgcccgttaccgtacgggcctacgccttactaacttttacgcgggactacgtacccggtaacccgggtacggtccggggtcctacgaccgtattcgagtcggacnggtcgggtcgngggacagtctttcactcacaccatcgagaccacgctgaccgnggtactaggaacgtagtggttacgtagtttacgtttaagttataacgttaactaaatttaaacgtttatttacgtttaactacggtttaccggtacggttaccggtcccggtaaacggtaaacgggtccgtaaaggtacggtactacgtacggaacgtacgtacggttgacggtcgtacgtaccg

SEQ ID NO: 278521 - DNA, 788 bp, Homo sapiens
  misc_feature: GYAE6OF01BZY3A.19.71.G05.1.454.CMB.1.raw
  modified_base (251)..(251): a, c, t, g, unknown or other
  misc_feature (251)..(251): n is a, c, g, or t
tcagtactctcgtgcacgaccggtgctcgatttagtgtcgtcgcaagagagagggggtcaggctggaactgaggagcaggcaggggcagcaagatggtgttgcagacccaggtcttcatttctctgttgctctggatctctggtgcccacggggacatcgtgatgacccagtctccagacctccctggctgtgtctcgtgggcgagcgggccaccatcaactgacaacgtccacgccactaattcttttanactacgttaccaaactaatacgaaaacttacttagacttggtaccagcagacgaccaggacacgtccctacgtacggctgctctatttacgcgggtactacgtaccgtaaccccggggtaacgtccccgggggttccctacgggacccgttaacgtttccggaacggttcgggacctacggggtccggggttcgtacggggaactacggttaacttttccaccgttccctaccgaacccctagttaccgaacgtccgtaacggtccctagggaccgtacggggtacttaacgggaaacgtacggttcggggtacgtaaccgtttaaaggttttttaagtttaacgtttaacggtaaacccttaaaaacgttaagttttaaaacgttttaaccgttttaacgttaacccggtttttaccgggtaacgggtttacccggggtttaaccggaaacccgggtaaaccgggggttaaaaccgtaacggggttaggtaaaccgttagttaaccggaacgggttaaccggtaaaccggttaggg

SEQ ID NO: 278522 - DNA, 580 bp, Homo sapiens
  misc_feature: GYAE6OF01DXX2Q.19.71.G05.1.454.CMB.1.raw
  modified_base (238)..(238): a, c, t, g, unknown or other
  misc_feature (238)..(238): n is a, c, g, or t
  modified_base (324)..(324): a, c, t, g, unknown or other
  misc_feature (324)..(324): n is a, c, g, or t
  modified_base (417)..(417): a, c, t, g, unknown or other
  misc_feature (417)..(417): n is a, c, g, or t
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagctccctggctgtgtctctgggcgagcgggccaccatcaactgcaagtccagccacaattcttttanactagttaccaaacaatagaaaaccttacttagctttaggtaaccagcaagagaccaggacagcctcctaggctgctcatttacgnggcatccgaccgggatccgggtcctgaccgattcagtgcagcgggtctgggacagtactttcactctcaccatcagcagcctgcagctgaagntgtgcttagtttacttagttcgtactaaactattatttaattagttaccgtttcggtacgggtaccgtttccgggaaccgtaaacggggtaaccctaagggttcggtaaagttaacgtaccgaaagtaaccggaacgtttgggtacggtaccgttggaacccc

SEQ ID NO: 278523 - DNA, 725 bp, Homo sapiens
  misc_feature: GYAE6OF01CM173.19.71.G05.1.454.CMB.1.raw
  modified_base (187)..(187): a, c, t, g, unknown or other
  misc_feature (187)..(187): n is a, c, g, or t
tcagtactctcgtgcacgaccggtgctcgatttagtgtcgtcgcaagagagagggggaggtacaacaggcaggcaggggcagcaagagtggtgttgcagacccaggtcttcatttctctgttgctctggatctcgtggtcgcccgacgggacagtcgtgactcgaccctagtctccagacctcccgnggctgtgtctcgtgggcgacgccgggcccacgataccaacgtgaccgtaacgtcccacgacccaactaacgtttccttttaagaccgtaacgttaccaaaactaaacgtaacgtaaaaaccttacgtttaacgccgtttacggtaaccagacgaagacgaccgagggaaccacggtcccttccggtaaggtcctcgtacttaccgtaattttacggcggactaacgtcccggtaacccggtacgtccccggggtcctacggaaccttagttccgaggtcggactacgggtcgggtactagggactagttcttccgacctacgtaaccaccgattacgacgtacaccgtccgtacggaccgtaggtaccgtaagaaacgtggttacgtacggttacgttagttttaaagttcgttaacgttaactaaacgttagtttaacttttacgttaacgttcggttacggtcggtaccggttacgaacgtaacgggacgtaaggtagtaacgtatacgaaacgtacgaacgtgtacgcagtaccg

SEQ ID NO: 278524 - DNA, 660 bp, Homo sapiens
  misc_feature: GYAE6OF01AREE3.19.71.G05.1.454.CMB.1.raw
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatcgacccagtctccagactccctggctgtgtctcgtgggcgagccgggccaccatcaactgacaagtccagccaactaattcttttaatacacgttaccaaacaatagaaaactacttagtcttcggtaccagacagacgaccaggacacgcctcgtaggctgctctagttacgtgggctacgtccgtaacccgggacgtcccggggtccctacgaccgtattcgaggtgcgtaggcgggtcgtagggactagtactttaccaccttcctccacctactaccgacgccgacgtccgtacggccgacgggtcgtaacggaagtagtgggtcggtacttaaggtttttaacgtttacgtttacgtaactaaaacttaatttaatttaactttagttaaccgttcggttaccggtaccggttaccggaaccggtaaacggggtacgtaagggtaggtaattacgtaacgaacgtaaccggtacgtagggtacggtcgtcgtaaccg

SEQ ID NO: 278525 - DNA, 898 bp, Homo sapiens
  misc_feature: GYAE6OF01BPEVP.19.71.G05.1.454.CMB.1.raw
tcagtactctcgtgcacgaccggtgctcgatttagtgtcgtcgcaagagagagggggaggtacaacaggcaggcaggggcagcaagatggtgttgcagacccaggtcttcatttctctgttgctctggatctctggtgcccgacggggacatcgtgatgacccagtctccagacctccctggctgtgtctcgtgggcgagccgggccaccatcaactgacaacgtccacgccaacaattcttttatacctacgttaccaaactaataacgtaaaaaccttacttaacgtctttacggtaaccacggtacgaacgaacggaccgaacggaaccgaaccggtcccttacccggttaacgggtccttcggtaccttaccgttaacgtttttaaccggtcggggtacctaaccgtttacccgggttaaaccccggggtaaaccggtttcccccggggggttaccccgttacggtaaccccggttacgtttaccgtaacgggtttacgggaccggtaacgggtcccggggttaccgggtacggggtaaccgttaacggttaaccgttttacccgtaacctttacccggttaccccaacccgttaacgtaccccgaacggtcccgtaaccgggtcccctagggacccggtacgggtaccgtaagggtaaacggttacggttacgggttacgggtacctttttaaagttttaacgtttacgtttaacggtaaacctaaacttaaacgttttaagttttaactttacgttaaccgtttggggttaaccgggttacccggtttacccggaaaccggtaaagggggtacccgttaaagggggttcgtaaacgttaccgaacggtaacgtaaaccgggtacgttagggtacggtcccgtcgtaaccccg

SEQ ID NO: 278526 - DNA, 524 bp, Homo sapiens
  misc_feature: GYAE6OF01A7ZCN.19.71.G05.1.454.CMB.1.raw
  modified_base (238)..(238): a, c, t, g, unknown or other
  misc_feature (238)..(238): n is a, c, g, or t
  modified_base (317)..(317): a, c, t, g, unknown or other
  misc_feature (317)..(317): n is a, c, g, or t
  modified_base (499)..(499): a, c, t, g, unknown or other
  misc_feature (499)..(499): n is a, c, g, or t
  modified_base (514)..(514): a, c, t, g, unknown or other
  misc_feature (514)..(514): n is a, c, g, or t
  modified_base (517)..(517): a, c, t, g, unknown or other
  misc_feature (517)..(517): n is a, c, g, or t
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttanacagttccaacaatagaaaactacttagcttggtaccagcagacgaccaggacacgcctcctaggctgctcatttacgngggcagtccgtacccgggaatccggggtccctagaccgtattccgagtggcaggcgggtctgggacagtacttcactctcaccatcagcagcctgcaggctgaagagtgtgactagtttatatagtacaatattattatacttacttgtgtacgtcggaccgtaagggactaaggtggatancgaagacgaactggngtntgtaccg

SEQ ID NO: 278527 - DNA, 520 bp, Homo sapiens
  misc_feature: GYAE6OF01EC1J1.19.71.G05.1.454.CMB.1.raw
  modified_base (373)..(373): a, c, t, g, unknown or other
  misc_feature (373)..(373): n is a, c, g, or t
  modified_base (390)..(390): a, c, t, g, unknown or other
  misc_feature (390)..(390): n is a, c, g, or t
  modified_base (513)..(513): a, c, t, g, unknown or other
  misc_feature (513)..(513): n is a, c, g, or t
  modified_base (515)..(515): a, c, t, g, unknown or other
  misc_feature (515)..(515): n is a, c, g, or t
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttatacagttccaacaatagaaaactacttagcttggtaccagcagagaccagacagcctcctaggctgctctatttactgggcataccgtacccgggaagtcccggggtcctgaccgtatcgagtggcaggcgggtcngggacagtattcactcncaccatcagcagcctgcgaggctagaagtgtggtgcttagtttatattgtacaactaattattattatacttgtaggtacgttacggaccgaagggtaccaaggtggatagtcagtacgatgngntgacc

SEQ ID NO: 278528 - DNA, 635 bp, Homo sapiens
  misc_feature: GYAE6OF01BWZQG.19.71.G05.1.454.CMB.1.raw
tcagtactctcgtgcacgaccggtgctcgatttagtgtcgtcgcaagagagagggggaggtacaacaggcaggcaggggcagcaagatggtgttgcagacccaggtcttcatttctctgttgctctggatctctggtgcccacgggacatcgtgatgacccagtctccagactccctggctgtgtctctgggcgagcgggccaccatcaactgcaagtccagccacaattcttttatacagttaccaacaatagaaaactacttagcttggtaccagcagagaccaggacagcctcctaggctgctctatttacgtgggcagtccgtacccgggaacgtcccggggtccctaggacccgtacttcgaggtcggcgtacggcggggtcgtacggggactagtactttcacgttctccaacctatcacgccacgcctaggcgacggctaggaagtagtgtaggtcttaagtttatttagttagtactaaactaatttatttaactttattacgttacggtaggttaccggtttaccgggaacccgtaaacggggtaacccgtaaggggttacggtaagttaacgtaccggtaaggtaaccgttaaacggttagggttcgggtccgtacggtaacccg

SEQ ID NO: 278529 - DNA, 846 bp, Homo sapiens
  misc_feature: GYAE6OF01CVGP3.19.71.G05.1.454.CMB.1.raw
  modified_base (248)..(248): a, c, t, g, unknown or other
  misc_feature (248)..(248): n is a, c, g, or t
  modified_base (263)..(263): a, c, t, g, unknown or other
  misc_feature (263)..(263): n is a, c, g, or t
tcagtactctcgtgcacgaccggtgctcgatttagtgtcgtcgcaagagagagggggaggtacaacaggcaggcaggggcagcaagatggtgttgcagacccaggtcttcatttctctgttgctctggatctcgtggtcgcccgacggggacatcgtgatgacccagtctccagcctccctggctgtgtctcgtgggcgagcgggccactataccaactgacaacgtccagccaactaacttctttanactacgttaccaaanaataacgtaaaaccttacgttagcgtttaggaaccagacgaagacaaccgaggaaccacgtacccgtaccgtaaggcttcggtaccttactaacgtttttaccgagggacctaacgttcccggtaaaccccgggtacgttaccccggggttcccgttaaggaccccgttaagttacccggaaggttccgggacgtaacgggtcccggggttacgtaggggtaaacccaaggtttacctttaccgaccttaccgttacccgaaccgttaacgtaccgaacggccgtaaccggtccgttaacggccgtaacgggtaccgtaagggtaaaaccgtgtttacgggtacccgggttaacgtttaaagttttaccgttttaaagtttaccggttaaaccttaaaaccgttaaattttaaacgtttaactttttaacggtttacccgtttacgggtacgggtttaaacccggttccgggaaaccggttaaaaccggggtacccggttaaagggtacggtttaaactacggtaaccgtaaacgggtaaacccgttaaggttaccggttacggtaacccgttcggtaaaccc

SEQ ID NO: 278530 - DNA, 598 bp, Homo sapiens
  misc_feature: GYAE6OF01CCYF8.19.71.G05.1.454.CMB.1.raw
  modified_base (241)..(241): a, c, t, g, unknown or other
  misc_feature (241)..(241): n is a, c, g, or t
  modified_base (318)..(318): a, c, t, g, unknown or other
  misc_feature (318)..(318): n is a, c, g, or t
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccaactaatcttttaanacagttaccaacaatagaaaaactacttagcttaggtaccagcagacgaccaggacagcctcaggctgctcattacnggcagtcgtacccgggatccggggtcctgaccgtattcagtggcgaggtcgggtctgggactagtactttcactctcacatcagtcacgtcctgccaggctaggaagagtgtggtacttaagttttatagtttgtaacctaaacttaattaactttaatttaacgttaccgttacggtacgggtaccgttaccggaaccgtaaacggggtaacccgtaaagggtggtaacttacgtaccgaacggtaacggtaacgttgggtacggtacctggtaacccg

SEQ ID NO: 278531 - DNA, 228 bp, Homo sapiens
  misc_feature: GYAE6OF01BYFW2.19.71.G05.1.454.CMB.1.raw
  modified_base (217)..(228): a, c, t, g, unknown or other
  misc_feature (217)..(228): n is a, c, g, or t
tcagtactctcgtgcacgaccggtgctcgatttagtgtcgtcgcaagagagagggggagtacaacaggcaggcaggggcagcaagatggtgttgcagacccaggtcttcattttctctgttgctctggatctctggtcgcccgagggacagtcgtgatcgacccagtcctccagacctccgtggctgtgtctctgagcggctggcaaggcactatgnnnnnnnnnnnn

SEQ ID NO: 278532 - DNA, 696 bp, Homo sapiens
  misc_feature: GYAE6OF01A3EKB.19.71.G05.1.454.CMB.1.raw
  modified_base (243)..(243): a, c, t, g, unknown or other
  misc_feature (243)..(243): n is a, c, g, or t
  modified_base (328)..(328): a, c, t, g, unknown or other
  misc_feature (328)..(328): n is a, c, g, or t
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccgacggggacatcgtgatcgacccagtctccagactccctggctgtgtctcgtgggcgagcgggccacatcaactgcaagtccagccactaattcttttaanacagttaccaacaatagaaaactacttacgacttacggtaccagcaagagaccaggacacgcctaccaggctgctactattacgnggctacgtaccgtacccgggtaacgtcccgggggtaccctaggaaccgtacgttccgagggtcggacgtacgggccgggtcgtacgggaactacggtactttccactcctacaaccgtagtccgagtacgacgtcctagcacgggtcctaggaagtagtacggtacggtactttaacggttttagttacgttacggttaacctaaacttaaagtttaactttaaagtttaacgttacggtttaccggttacgggtaccggttttaaccgggaacccgtaaacggggttaacgtaaaggggttacggtaacgttaacgtacccggaaacgtaaccggtaacgttagggtaccggtccgttcggtaaccc

SEQ ID NO: 278533 - DNA, 547 bp, Homo sapiens
  misc_feature: GYAE6OF01BFIVP.19.71.G05.1.454.CMB.1.raw
  modified_base (239)..(239): a, c, t, g, unknown or other
  misc_feature (239)..(239): n is a, c, g, or t
  modified_base (342)..(342): a, c, t, g, unknown or other
  misc_feature (342)..(342): n is a, c, g, or t
  modified_base (377)..(377): a, c, t, g, unknown or other
  misc_feature (377)..(377): n is a, c, g, or t
tcagtactctcgtgcacgaccggtgctcgatttagtgtcgtcgcaagagagagggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccacgatacaactgacaagtccagccacaatcttttanacagttccaacaatagaaaactactagcttggtaccagcagagaccagacagcctctaggctgctcattactgggcatctaccgggatccggggtcctgacgnttcagtcgcagcgggtctgggactagattcactcncacatcagtcagcctgcgtagctaggaagtacgtggtcgtactagtttacttagttcgtactaaactattaattagttacttacgttacgtacggtccgttacggaccgtaacgggacctaagggtgtaacgtactacgaaggtacgaacgttggtcggtgtcgtaaccg

SEQ ID NO: 278534 - DNA, 711 bp, Homo sapiens
  misc_feature: GYAE6OF01ANIKI.19.71.G05.1.454.CMB.1.raw
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccgacggggacatcgtgatcgacccagtctccagactccctggctgtgtctcgtgggcgagccgggcccaccatccaactgacaacgtccacgccaactaactttctttttaataccgtagttacccaaactaataacgtaaaaaccttacttagtccgtttacggtaaccagtacgaagacggaacccagggaccacggtcccctaccgtacggtcctagtccttacgttaacgttttaccgtacgggacctaccgttacccggttaaccccggggtaacggttccccgggggttaccctacggacccgttattcgacggtcggacgtaggggtccgggtacgtacgggtacgtagttactttccacttccgtaccaccctataccgacgcctacggccctggtaccgacgggtacgtaggaagtagttcggtgttacttaagttttacttagtacgtactaaattatttaactttattaaccgttacgttcggtacggtaccggttacggaccgtaaacgggtcgtaaggtgtactagtacgaagacgttatggtcggcgtacgtaccg

SEQ ID NO: 278535 - DNA, 772 bp, Homo sapiens
  misc_feature: GYAE6OF01CDWFX.19.71.G05.1.454.CMB.1.raw
  modified_base (379)..(379): a, c, t, g, unknown or other
  misc_feature (379)..(379): n is a, c, g, or t
tcagtactctcgtgcacgaccggtgctcgatttagtgtcgtcgcaagagagagggggtcaggctggaactgaggagcaggcaggggcagcaagatggtgttaaaaaagcagacccaggtcttcatttctctgttgctctggatctctggtcgcccgacggggacatcgtgatcgacccagtctccagacctccgtggctgtgtctcgtgggcgacgccggccaccatacaactgacaacgtccacgaccaactaacttctttttaacacctaacgttacccaaaataaagtaacgtaaaaaccttacgtttagacgtttacggtaacccagacaagacgaaccgaggacacgccctcgtaggctagctactagttacgnggactacgttccggtaaccggacgttcccgggtcctacgaccgtagttcgaggttcggacgtaggtccgggttacgacgggtaaccttaggttaccttttaccgacccgtttaccctacccgtaaacccgtaacgttaccgaaccgaccgtaccggtccccttagggaacccgtaacggggttcctaaacgggtaaggtaccgtttggggtaccggttaacttttaaaggtttttacttacgtacgttaaacctaaaacgtttatttaaacttttacgttaacgttacccggttttagggtaccggtaccggtttacccggaaaccggtaaacgggtaacccgttaaaggggtcgtaaacttacgggaccgtaaacggaacgttacggttcgg

SEQ ID NO: 278536 - DNA, 585 bp, Homo sapiens
  misc_feature: GYAE6OF01D9ABO.19.71.G05.1.454.CMB.1.raw
  modified_base (360)..(360): a, c, t, g, unknown or other
  misc_feature (360)..(360): n is a, c, g, or t
  modified_base (375)..(375): a, c, t, g, unknown or other
  misc_feature (375)..(375): n is a, c, g, or t
tcagtactctcgtgcacgaccggtgctcgatttagtgtcgtcgcaagagagagggggggaggtacaacaggcaggcaggggcagcaagatggtgttgcagacccaggtcttcatttctctgttgctctggatctctggtgcccgacggggacatcgtgatgacccagtctccagactccctggctgtgtctcgtgggcgagcgggccaccatcaactgcaacgtccagccaacaattcttttaataccagttaccaaacaatagaaaaacttacttagcttaggtaccagacagacgaccaggacagcctctaggctgctctatttactgggcacgtccgtacccgggatccggggtccngaccatcgagtgcgnggcgggtctgggactagtatttcactctaccaccatcgagccacgcctgaccgaggtcgtagaagtgtggtcggtacttaagtttattattcgtaacaacttaattatttacttatacgttcggacggttacgttaccggaccggtaagggaacgtagggttaggatagtacgaaaggtaccggtaacgttggtacggtcgtacgtaccg

SEQ ID NO: 278537 - DNA, 794 bp, Homo sapiens
  misc_feature: GYAE6OF01B6GX6.19.71.G05.1.454.CMB.1.raw
  modified_base (252)..(252): a, c, t, g, unknown or other
  misc_feature (252)..(252): n is a, c, g, or t
tcagtactctcgtgcacgaccggtgctcgatttagtgtcgtcgcaagagagagggggtcaggctggaactgaggagcaggcaggggcagcaagatggtgttgcagacccaggtcttcatttctctgttgctctggatctctggtcgcccgacggggacatcgtgatcgacccagtctccagactcctggctgtgtctcgtgggcgaggccgggccacgactacgacgtgacacgtcagccataattctttanacacgttaccgaataactagtaaaacttacgttagcgttcggtaccagtaccaggacgaaccgaggaccacgtccctaccgtaggtacctcgccttactaacgttttacgtccgggtataccggttaccggtaaccccggggtacggttacccccgggggtaccctacgggtaacccgtaacgtttccggaacggttcgggacggacggggtccgggttacggtcggggtaacctaacggttactttcccgtaacccttccgtaacccaccgtactccgaacgtccgaccgtccgtacgaccgaggtacgtacggaagttcgtacggtacgggttacctttaggttttaaacgtttaccgtttaacggttaaacccttaaagttaaaccttttaagttttaagttaaccgtttaccgggtttaacgggttacggggttaacccggtttaccgggaaaccggggttaaccggtaaaccgggttaaagggtaccggtaaactacgggttacccgaaacgggttaaacccggtaggtttaccggg

SEQ ID NO: 278538 - DNA, 591 bp, Homo sapiens
  misc_feature: GYAE6OF01BTQ2E.19.71.G05.1.454.CMB.1.raw
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccgacggggacatcgtgatgacccagtctccagacctccctggctgtgtctcgtgggcgagccgggccaccatcaactgcaagtccagccaactaattcttttatactacgttaccaactaatagtaaaactacttagcttaggtaccagacagagaccaggacacgcctccgtacggctgctctatttacgtgggctacgtccgtacccgggacgtcccggggtccctcgaccgtattcgagtggacaggcgggtcgtgggacagtactttcacttcgtaccacctactcacgcacgcctgcgaggctaggaacgtgtcggtggtacttagtttattagttagtactaactaattatttattacttacgttacggtcggttacgtccggacgaacgggtacgtaagggttggtatacgtagaacggacgtacgtaggtcggaccgtgacc

SEQ ID NO: 278539 - DNA, 682 bp, Homo sapiens
  misc_feature: GYAE6OF01BB8I9.19.71.G05.1.454.CMB.1.raw
  modified_base (474)..(474): a, c, t, g, unknown or other
  misc_feature (474)..(474): n is a, c, g, or t
  modified_base (510)..(510): a, c, t, g, unknown or other
  misc_feature (510)..(510): n is a, c, g, or t
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagacctccctggctgtgtctcgtgggcgagccgggccaccatcaactcgacaacgtccacgacccaactaacttcttttaactactaacgttaccaaactaaataacgtaaaaaccttacttaacgtacgtttacggtaaccagtacgaagacgaaccgacggacacgtccctaccgtaggctgcctactatttacgcggtactacgtaccgtacccgggtaacgtcccggggtacctcgaaccgtactcgaggtcggacgacggcggtcgtagggactagtacttccactcctaccaacctanccgagccacgtacgtgaccgaggtactaggaacgtntaggtacggtacttaagttttacgttattacgtaacgtaacttaagtttatttaattacgttacgttaccggtaggtaccggttaccgggaacgtaaacgggaccgttaagggtacggtacgtaactaacggaacggtaaccggtaacgttgggtaccggtgtccgtaaccg

SEQ ID NO: 278540 - DNA, 721 bp, Homo sapiens
  misc_feature: GYAE6OF01CX5GN.19.71.G05.1.454.CMB.1.raw
  modified_base (241)..(241): a, c, t, g, unknown or other
  misc_feature (241)..(241): n is a, c, g, or t
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccgacggggacatcgtgatgacccagtctccagacctccctggctgtgtctcgtgggcgagcggccaccatcaactgcagtccagccactaattcttttanactacgttaccaaactaataagaaaaccttacttagtcttaggtaaccagcaagacgacaggacacgcctcgtagctgctctatttacgtggctacgtccgtaaccgggtactcccggggtcctgaccgtattcgagtcggcgcggtcgggtcgtgggactaggttactttccgactctacccacctatcacgcccgtacgtcccgtaggaccgtacgggtacgtacggaaagtcggttaggttacgggtaacgtttagggtttttaactttaagtttcgtaaaccgttaaacgtaaatttttaaactttaacgttttaacgtttacgttacccggggtttacgggttaaccccgggtttacccggggaacccggtaaaacgggggttaacccgtaaagggggttacgtaaacttaacggttacccgaaacggttaacccggttaaacggttcggttaccgggtccgttcggaaaccccg

SEQ ID NO: 278541 - DNA, 630 bp, Homo sapiens
  misc_feature: GYAE6OF01B1UD2.19.71.G05.1.454.CMB.1.raw
  modified_base (236)..(236): a, c, t, g, unknown or other
  misc_feature (236)..(236): n is a, c, g, or t
  modified_base (247)..(247): a, c, t, g, unknown or other
  misc_feature (247)..(247): n is a, c, g, or t
  modified_base (323)..(323): a, c, t, g, unknown or other
  misc_feature (323)..(323): n is a, c, g, or t
  modified_base (338)..(338): a, c, t, g, unknown or other
  misc_feature (338)..(338): n is a, c, g, or t
  modified_base (372)..(372): a, c, t, g, unknown or other
  misc_feature (372)..(372): n is a, c, g, or t
tcagtactctcgtgcacgaccggtgctcgatttagtgtcgtcgcaagagagagggggtcaggctggaactgaggagcaggcaggggcagcaagatggtgttgcagacccaggtcttcatttctctgttgctctggatctctggtgcccacggggacatcgtgatgacccagtctccagactccctggctgtgtctcgtgggcgagccgggccaccatcaactgcaagtccagccanaattcttttanactagttccaaacaatacgtaaaactacttacgcgttaggtacccagcagacgaccgaggacagccctcgtaggcngtctactatttacgnggcatccgtaccggactcccgggtcctgaccgtnttcgagtcggacgaggccgggtagtcgggacagttactttccacgtctaccacgactacgagccacgtcctggaccgaggtccgtagaacgtagttcggtggtacgttaagttttacgttacgtttagtaacctaaacgtaatttaaatttacgttaacgtttaccgtttacggtacgggttaccggtttaccggacccggtaaagggaacccgtaaggttacggtaacttagaacgaacgtacggtaacgttacggg

SEQ ID NO: 278542 - DNA, 779 bp, Homo sapiens
  misc_feature: GYAE6OF01EU5YP.19.71.G05.1.454.CMB.1.raw
  modified_base (542)..(542): a, c, t, g, unknown or other
  misc_feature (542)..(542): n is a, c, g, or t
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctcgtggtcgcccgacggggacatcgtgatcgacccagtctccagtacctccctggctgtgtctcgtgggcgaggccgggccacgatacgaacgtgactaacgtccacgacctaactaactttacttttaacaccgtaacgttacccaaaataaacgtaacgtaaaaacctttcgttaacgtaccgtttacggtaacccaggtaccgaacggaacgaacccgaaggaccacgtccctacgtacggctcgtacttacgtaattttcgcgggtactacggtaccccgtaaccggggaaccgttcccggggtacctacggaccgttactcggaggtcgacgtcggtcgggtacacggggaactagttacttacacgttcctaccgactactcgacgccgacgtccgtgaaccgnggtacgtagaagtcggttcggtacgtactttaagttatttaccgtaacgtaacttaaacgttaaattttaccgtttaagtttaaccggtttacgttaccggggtaaggttaccccgggtttaacccggtaaccgggtaaaaccggggtaccggttaaagggttacgtaaacgtaaccgtaaggtaaaccccggttaggtaaccgggttaggttaccgggactaacccgttaacccgg

SEQ ID NO: 278543 - DNA, 716 bp, Homo sapiens
  misc_feature: GYAE6OF01CD79P.19.71.G05.1.454.CMB.1.raw
tcagtactctcgtgcacgaccggtgctcgatttagtgtcgtcgcaagagagagggggagagtctgctgaattctggctgaccagggcagtcaccagagctccagacaatgtctgtctccttcctcttcttcctgcccgtgcgtcggccctcccacgaggtcgtcctgtcacaagtacagctgcagcagtcaggtccaggtactgggtacgaacgccctgacaccgtaccctcgtccgccttccgaccgtcggtcgaccctacgtccggtaccggggaacgagtacggtcgacgtacgacgtacgtaggtcgttgtcgttggccgtacgtggcacggccacgtcccgagtcggagtacggtactaggaggtggacggtaggggaacgtaactagtttacgttacgacgtaccgtaaccaagtaacggtaagtaaacgttaaacgtaaagttagtacgtaccgtaacctaagttcgtaaggttaggtaacgtaacggtccgttaacgaacggtaaactaacgttaacgaaacggttaacaacgaactaaccgtaacggaaaaccgtaccgttaaccgttacccttccgtacgaacgtacgttacctacgtaccgtcgtacgtaccgaacccgtaccgggaacggtaccggtaagggttagttaaacgttacgtacggtacgggtaacggaaccgtacccggtaccttaagccgtaacg

SEQ ID NO: 278544 - DNA, 660 bp, Homo sapiens
  misc_feature: GYAE6OF01DF7MW.19.71.G05.1.454.CMB.1.raw
  modified_base (598)..(598): a, c, t, g, unknown or other
  misc_feature (598)..(598): n is a, c, g, or t
tcagtactctcgtgcacgaccggtgctcgatttagtgtcgtcgcaagagagaggggggcagagtctgctgaattctggctgaccagggcagtcaccagagctccagacaatgtctgtctccttcctcttccttcctgcccgtgctcgggcctcccacaaggtcgtcctgtccacaagtacagctgcagcagtcaggtccaggactggtgaacgccctcgcacgtacccctctccgctccaccgtgtcgacctagtccgtccggggacaggacgtcgctagcgacagttgtcgcgttggctacggtgggtcaggcctacgtcccagtcgaggtacggtctaggtagtggacgttagggaagactattactttcagttacgtaccaaacgtacggttaggaaacttaacgtaaagtttacgacgtacctaacctagttccgttagttacggagtacgtacgtacgtagtaactaagtaccgtaaaggtacgaacgtacaacgtaccgaaacgtaaccgttacgttaccctcccgtagacctacgtacctacggtaccttcgttcgtaccgaccgtcccgggaaacggtacgtacgggttntaacgttacgtttaacggtacggttaacggaaccggaacccggtaccccgtaagtaacccgg

SEQ ID NO: 278545 - DNA, 598 bp, Homo sapiens
  misc_feature: GYAE6OF01CDKU7.19.71.G05.1.454.CMB.1.raw
  modified_base (239)..(239): a, c, t, g, unknown or other
  misc_feature (239)..(239): n is a, c, g, or t
  modified_base (308)..(308): a, c, t, g, unknown or other
  misc_feature (308)..(308): n is a, c, g, or t
  modified_base (316)..(316): a, c, t, g, unknown or other
  misc_feature (316)..(316): n is a, c, g, or t
  modified_base (368)..(368): a, c, t, g, unknown or other
  misc_feature (368)..(368): n is a, c, g, or t
  modified_base (397)..(397): a, c, t, g, unknown or other
  misc_feature (397)..(397): n is a, c, g, or t
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaattcttttanacagttccaacaatgaaaactacttagcttaggtaccagcagagaccaggacagccctctaggctgctnatttacgnggcagtcctacccgggatccgggtcctgaccgattcgagtggcagcgggtcnggacagatttcactcgtcaccatcagcanccgtgcaggctagaatgtgtgcttagtttattagttagtactaacgtaaatttagttaaatttacgttaacttcggttacggtaccgtttaaccggaaacccgttaaaacggggaaccttaaacggggttggtaaaccgttagtaaccgtaacgggtaaaccggttaactttacggggacggtacccgttcggtaaacccg

SEQ ID NO: 278546 - DNA, 715 bp, Homo sapiens
  misc_feature: GYAE6OF01CAO6A.19.71.G05.1.454.CMB.1.raw
  modified_base (263)..(263): a, c, t, g, unknown or other
  misc_feature (263)..(263): n is a, c, g, or t
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgccttcggggacatcgtgctgacccagtctccagacacactggctgtgtctcgtgggcgagaggccaccatcaactgcaggtccagcgagtagtatttgacagaccaacagtaagaactactggnttggtatcagacagaaaccaggacacgcctacctaaactgactactatttacgtgggactacgtccgtaacccgggaacgttcccgggggtccctacggtaaccgtacttccgaaggtcggaccgtacgggtccggggtcgtacgggtaactaacgtaacgttttccaacgttccgtacccaacccgtaataccgaacgtaccgtaacgtacccgtaggaccgtaacgggtaccgttaagggaaacgtacgtacggtacggtaccttaaggtttttaacttaagtttacgtaaccgtaaaacttaaacgtttaatttaactttagttaaccgtttaccggttacgggttaccggttaccggtaacccggtaaaacggggtacccgtaaaggggttacggtaattacggtaacgaacgtaaccggaacgttggtacggtcgtacggtaacccg

SEQ ID NO: 278547 - DNA, 718 bp, Homo sapiens
  misc_feature: GYAE6OF01CC9ZU.19.71.G05.1.454.CMB.1.raw
  modified_base (243)..(243): a, c, t, g, unknown or other
  misc_feature (243)..(243): n is a, c, g, or t
  modified_base (353)..(353): a, c, t, g, unknown or other
  misc_feature (353)..(353): n is a, c, g, or t
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccgacggggacatcgtgatcgacccagtctccagactccctggctgtcgtctcgtggcgaggcggccacatcaactgacaagtccagccaactaattctttanactacgttaccaataatacgaaaacttacttaagctttacggaaccagacgaggaacgaccgaaggaccacgtccttaccgtaggctcgtaccttacttaacgtttacgngggaccttacgtaccccggtaaacccgggtaacggttccccggggtacccttacgaaccgttattccggaaggttcggaccggacgggtccggggtacgtacggggtaactaggtttaccttaccgtaccttccgtaacctaccgattaccgaacgacgaactccgtacgacgacgtacgttaaggaaacgttgtaggtcgtacgtttaagttttagttaacgttactaacgtaaacttaaatttactttatttaacgttaccgttaggttacggtaccggttaccgtaacggaacgggttaaccagggttacgaacttacgtaacgaaccggttaacggtaacgttgggtactcgtcgtaaccg

SEQ ID NO: 278548 - DNA, 808 bp, Homo sapiens
  misc_feature: GYAE6OF01EV8ED.19.71.G05.1.454.CMB.1.raw
tcagtactctcgtgcacgaccggtgctcgatttagtgtcgtcgcaagagagagggggtcaggctggaactgaggaggtacaacaggcaggcaggggcagcaagatggtgttgcagacccaggtcttcatttctctgttgctctggatctctggtcgcccgacggggacagtcgtgatcgacccagtctccagacctccctggctgtcgtctcgtgggcgacggcgggccacactcaactgacaagtcccagaccaactaactttacttttaacacctacgttaccaaacaaatacgtaaaaacttacgttacgtacgttacggtaaccagacgaaggaccgaaccgaggaaccacgtaccctcgtaagggccttacggtaccttacttaacgtttacgtacgggtacctaccgttacccgggttaaccccgggaacgggtttcccccggggtaccccttacggtaacccgttacgttacggtaacgggttcggaccggtaaccggggtccggggttacggtacgggggtaaccgtaaggttaccttttaccgaccttaccggtaccctaaacccgtacgtaaccgacggtaccgtacgtccgtacggacgtacgggtacgtaacggaagtacgttacgggttacggtatttaacggtttttaatttacgttacgtaaaccttaaacgttaaagtttaaactttaacgtttaacggtttaccggtttaggggttacggttaacccggttaccgggtaacccggaaggggtaaacccgttagggtaagtaacgttaagtacggtaaacgg

SEQ ID NO: 278549 - DNA, 603 bp, Homo sapiens
  misc_feature: GYAE6OF01AR0GW.19.71.G05.1.454.CMB.1.raw
  modified_base (332)..(332): a, c, t, g, unknown or other
  misc_feature (332)..(332): n is a, c, g, or t
  modified_base (424)..(424): a, c, t, g, unknown or other
  misc_feature (424)..(424): n is a, c, g, or t
  modified_base (430)..(430): a, c, t, g, unknown or other
  misc_feature (430)..(430): n is a, c, g, or t
  modified_base (596)..(596): a, c, t, g, unknown or other
  misc_feature (596)..(596): n is a, c, g, or t
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctcgtgggcgagcggccacatcaactgacacgtccagccactaattcttttatactacgttaccaaacaatagaaaacttacttaagcgttaggtaccagacaggacgaccaggacacgcctccgtaggctgactctatttacgngggctacgtccgtacccgggaacttcccggggtccctggaccgtagttcgaggtcggcgaggtcggggtactgggactagtctttcgactcnccaacntacagcacgcctggacacggacgtacgaaggtactggtacgacttagttttatattacgtactaaacgttaattaatttaattacgttacgttcggttacggtaccgttaccgggacgtaaacgggtaaccgtaggtagaactacgtacgaagtacgtagtgtcgngtcgacc

SEQ ID NO: 278550 - DNA, 750 bp, Homo sapiens
  misc_feature: GYAE6OF01D78WS.19.71.G05.1.454.CMB.1.raw
  modified_base (247)..(247): a, c, t, g, unknown or other
  misc_feature (247)..(247): n is a, c, g, or t
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtcgcccacggggacatcgtgatcgacccagtctccagacctccctggctgtgtctcgtgggcgaggccgggccacgatcaactgacaagtccagccaactaattctttanacacgttaccaaactaatagaaaactcttagtcttaggaccagacaaggacgaccgaaggacacgccctacgtaggcttcgaccttactacttttacgcgggtacctaagtaccccggtaaacccggggtacgttccccgggggtaccctacgggtaacctacgtttacgacgggtcgggaccgaacgggtccggggtttacgacggggtaacctaaggttaccttttccgaacctttcctaccgaacctaagtaccgaacggtccgaacggttcccgtaggtaccgacggtacgtaagtaaacggtagtcggtacgttacgttaacgttttaagttacgtttacgtaaaccgtaaactttaaagttaaacttttaacttaacgttacgttacggtacgggttaaccggttaccggaaacccgtaaaggggtaacccgtaaggtaggtaaacctacgtaacgaacggttaccgaaacgttcgggtacgtccgtacgtaaaccg

SEQ ID NO: 278551 - DNA, 816 bp, Homo sapiens
  misc_feature: GYAE6OF01DM529.19.71.G05.1.454.CMB.1.raw
  modified_base (257)..(257): a, c, t, g, unknown or other
  misc_feature (257)..(257): n is a, c, g, or t
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtcgcccgacggggacatcgtgatcgacccagtcctccagacctccctggctgtgtctcgtgggcgacggccgggtccaccataccaactcgacaacgtccagcccaactaattcttttanacctacgttaccaaaactaataacgtaaaaccttacttaacgtcctttacggaaccagaccaaggacgacccgagggacacgtccccttacgtacggcttcggtaccttacgtaacttttaccgcggggacctaaccggttacccccggttaacccggggtaaccggtccccgggggttacccctaggtacccgtagtttaccggagggtcgggaccgtacggggtccggggtaccgttagggggaacccttagggttaaccttttccaacccgtttacccgtaccgtaacccctaagttcccggaacgtcccgtaaccggtcccgtaggacccggtacggtagtaacggtaacgtcggtttacgggagtttacgtttaagttttagttaacttaacggtaaactaaacgtttatttaactttacgtttacggttaccggttttggtaaccggggttaccgttaaccgggaaccgggtaaaccgggtagttaaacgggtacgttaagttaaccgaggaaccggttaacggttacgtagggtccgtacgcccggtaaacg

SEQ ID NO: 278552 - DNA, 742 bp, Homo sapiens
  misc_feature: GYAE6OF01BH6FH.19.71.G05.1.454.CMB.1.raw
  modified_base (241)..(241): a, c, t, g, unknown or other
  misc_feature (241)..(241): n is a, c, g, or t
  modified_base (353)..(353): a, c, t, g, unknown or other
  misc_feature (353)..(353): n is a, c, g, or t
  modified_base (421)..(421): a, c, t, g, unknown or other
  misc_feature (421)..(421): n is a, c, g, or t
tcagtactctcgtgcacgaccggtgctcgatttagtgtcgtcgcaagagagaggggggaggtacaacaggcaggcaggggcagcaagatggtgttgcagacccaggtcttcattttctctgttgctctggatctctggtgcccacggggacatcgtgatgacccagtctccagactccctggctgtgtctcgtgggcgagcgggccaccatcaactgcaagtccagccacaattcttttanactagttaccaacaatacgaaaaacttactttacgacgtttacggtaaccaggaccaaggaacgaacccaagggaaccacgccctaccgtaggctgctctaagttttaccgngggactacgtccgtaacccgggaacgttccccggggtaccctaggacccgtattaccgaggtcggacncgggtcgggtacgtaggggactaacggtctttaccaaccgttcctaccaaccgtactaccgacgtccgaaccgggtcccttaacggccggtaacgggtcccgtaaagggtaaaggttaacgttcgggttacgggttaacctttaaggtttttaatttaacgtttacggtaaccttaaacgttaaatttaagtttaactttaacgtttacgttacgggtacgggtaacccgggtttccggaaccggtaaacggggtaacgtaaggggtagtaactagtaaccgaacgtaaccgtaacgtcggttaggcccgttggtaacccc

SEQ ID NO: 278553 - DNA, 723 bp, Homo sapiens
  misc_feature: GYAE6OF01B64DM.19.71.G05.1.454.CMB.1.raw
  modified_base (256)..(256): a, c, t, g, unknown or other
  misc_feature (256)..(256): n is a, c, g, or t
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtcgcccgacggggacatcgtgatcgacccagtcctccagacctccctggctgtcgtctcgtgggcgagccggccaccgatacaactcgacaacgtccacgccaactaacttcttttaanaactacgttaccaaaccgtaaataacgtaaaaaccttacgttaagtaccgtttacggtaaccaggacaaggaacgaaccgaacggaccagtccctccgtacggccttcgaccttactagttttacgcgggtacctacgtacccggtaaccccggggaacgtttccccgggggtaccctacggaaccgtacgttacgaggtcgggccggtacgggtccgggtacggtaggtaacgtacgttacttccctaccttccgtaccaaccgactaccgacgccgtacgccgtacgacggcgtacgtaaggacgtagtcggtacgtacgttaagtttactagttaactaacgtaaattaagttatttaacgttacttacggttacggtacggttaccgtaccgggacggtaaacggtcgtaaggtcgtaacgtacgtaggtaacgtacgttaggacggttcgcggtgtaacccg

SEQ ID NO: 278554 - DNA, 637 bp, Homo sapiens
  misc_feature: GYAE6OF01E4R8D.19.71.G05.1.454.CMB.1.raw
  modified_base (239)..(239): a, c, t, g, unknown or other
  misc_feature (239)..(239): n is a, c, g, or t
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctcgtgggcgagcgggccaccatcaactgcaagtccagccacaatcttttanacagttaccaacaatagaaaactacttagcttgtaccagcagagaccaggacagcctccgtagctgctcatttactggcatccgtacccgggtacgtcccggggtccctcggaccgtattcgaggtcggcgaggtcggggtcgtggggactaggtactttcacctcctaccacctactacgacgccacgtcctggacacgggtctaggaacgtagttggtcggtacgttaagttttaagtttactttacggttaaccaaacgttaaattaaatttttaacttaacgtttaccgtttcggtacgggtaccggttaccgggaaccgtaaacggggtaccgtaagggtacggtaacttacgtaccgaggtaaaccgtaacgttacggtgtccgtggtaccc

SEQ ID NO: 278555 - DNA, 944 bp, Homo sapiens
  misc_feature: GYAE6OF01DH8L5.19.71.G05.1.454.CMB.1.raw
  modified_base (246)..(246): a, c, t, g, unknown or other
  misc_feature (246)..(246): n is a, c, g, or t
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctcgtggtcgcccgaggggacatcgtagatcgacccagtctccagacctcctggctgtgtctcgtgggcgagcggccacatcaactgacaagtccagcctacaattcgttttaanactagttaccaaacaatagaaaaccttacttagtactttacgggtaaccaggaccaaggaacgaccccgaaggggaacctacggttcctcccgtaaggtctacggacctttacgtaacttttttaacggcggggaacctaacggttaccccggttaaacccggggtaaaagtttcccggggggttacccctttagggttacccgtaaactttcggaacgggtccgggtaccgtaagggttccccgggttgggtttacccgggttacgggggtaaacccttaagggttaaaccgttttttcccgtaaacccgtttcccgtaaccctaaacccccggtaagtttacccgtaaacccggcggttaaccgggtcccgttaaccgggacccggttaagggacccgttaagggtaaaaccggtaggttttcggggtaccggggtttaccgttttaaccgtttaagtttaacccggttacggttaaacctaaaccggttaaaattttaacgtttaaacggtttaacgggtaaaaccgggttaccccggttaaacggggggtttaacccctttcccggggggtaaccccggtttaaccggggggttaaaccggtttaaaacgggggtcgggttaaaacgtaaacgttaccgggtaaacgggttaaacgggttacgtttacgggggttaccggcccgttaacccggg

SEQ ID NO: 278556 - DNA, 727 bp, Homo sapiens
  misc_feature: GYAE6OF01BZLB7.19.71.G05.1.454.CMB.1.raw
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtcgcccgacggggacatcgtgatcgacccagtcctccaagcctcccgtggctgtcgtctcgtgggcgacggccgggccaccatccaacgtgactaacgtccacgacctaactaactttcttttaacacctacgttaacccaaaataaataacgtaaaaaccttcttaacggtcgtttacggaaccagacgaacgacgtaccgaggacacgtccctaccgtaggtcctagtcctacgtaatttacggcggactacgtacccggtaccgggacgtcccgggtcctaggacctagtccgagtcggacgtaggtcggtacgtagggactagtacctttcgaccttctaccgactagtaccaaggcctacgtccgtaggaccgtacgggtctaaggaacgttacgttcggttaacggtactttaaaggtttttacttaggttaactaaactaaattaagttttaacttttaacgttacgttaaccggtttcgggtaacgggttaacccgttcgggaaaaccggtaaccgggttaaacgtagggtataacgtacgtaacggaagttaaccggtagttcggcggtactcggaaaccc

SEQ ID NO: 278557 - DNA, 721 bp, Homo sapiens
  misc_feature: GYAE6OF01B40J8.19.71.G05.1.454.CMB.1.raw
  modified_base (286)..(286): a, c, t, g, unknown or other
  misc_feature (286)..(286): n is a, c, g, or t
  modified_base (320)..(320): a, c, t, g, unknown or other
  misc_feature (320)..(320): n is a, c, g, or t
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctcgtgggcgagccgggccaccatcaactggacaagtccagccaactaattctttatacagttaccaacaatagaaaactacttagcttaggtaccagnagagacaggacagcctctagctgctcatttacgnggactactcgtaacccggagttcccggggtaccctagacccgattcgaggtcggacgtacggcgggttcacggggtacaacgtactttcacgttcctactaaccgtactcgaacggtcacgtacccgtagacgtacgggtccttaaggaaagtagtcgggtacggtacgttaagttttaactttaagtttacgttaacccgtaaaattaaacgtttaaactttaacgtttaacgtttaacccggttaccggttttacggggaaacccgtttaccggggtaaacccggttaaacggggtaaacccggtaaggggttaacggtaacgtttaaaccgtaccggtaaacgggtaaaacccggttaaacccgttagggttaccggtaaccggttcgtaaaccccgg

SEQ ID NO: 278558 - DNA, 530 bp, Homo sapiens
  misc_feature: GYAE6OF01A48WC.19.71.G05.1.454.CMB.1.raw
  modified_base (325)..(325): a, c, t, g, unknown or other
  misc_feature (325)..(325): n is a, c, g, or t
  modified_base (428)..(428): a, c, t, g, unknown or other
  misc_feature (428)..(428): n is a, c, g, or t
  modified_base (432)..(432): a, c, t, g, unknown or other
  misc_feature (432)..(432): n is a, c, g, or t
  modified_base (515)..(515): a, c, t, g, unknown or other
  misc_feature (515)..(515): n is a, c, g, or t
tcagtactctcgtgcacgaccggtgctcgatttagtgtcgtcgcaagagagagggggtcaggctggaactgaggagcaggcaggggcagcaagatggtgttgcagacccaggtcttcatttctctgttgctctggatctctggtgcccacggggacatcgtgatgacccagtctccagactccctggctgtgtctctgggcgagcggggccaccgatacgaactgacaagtccagccacaatctttatacagttccaacaatagaaaacttacttagcttggtaccagcagagaccaggacagcctctaggctgctctatttacnggcatccgtaacccgggaatcccggggtccctgacccgattcgagtggcagcgggtctagggacagtattcactctacacatcagcacgctgcaggctagaanatgngactagtttatacttgtacaactattattattactacttcggtaggtacgttcggaccggtaaggaccgtaaggtcggtatanagaacgagtagtcgg

SEQ ID NO: 278559 - DNA, 736 bp, Homo sapiens
  misc_feature: GYAE6OF01CTTT3.19.71.G05.1.454.CMB.1.raw
  modified_base (256)..(256): a, c, t, g, unknown or other
  misc_feature (256)..(256): n is a, c, g, or t
  modified_base (354)..(354): a, c, t, g, unknown or other
  misc_feature (354)..(354): n is a, c, g, or t
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtcgcccgaggggacatcgtgatcgacccagtcctccagacctccctggctgtcgtctcgtgggcgaggccgggccacgatacaactgacaacgtccacgaccaactaacttcttttaanactacgttacctaaacaataagtaaaaccttacttagcttacggaaccagcaagacgaccgaggacacgcctccgtaggctgacttactactttacgnggtactacgtaccggtacccgggtaagttccccgggtcctacggacccgtagttaccgaggtcggacgtacgggtccggggtactaggggaactaggttactttaccgactacctaccgacctacgtacacgacccgtacgaccttaggaccgtagggtacgtacggtaaacggtgtttaccggtcggtaacttttaaggttttaacttttaagtaccggtttaaacaaacgtttaaactttattttaaactttaccgtttacgttaccgggttacggttaccgggttaccggtaaaccggtaacgggtaaaccgttaagggtacgtaacttaacggtacgtaaacggtaaccgttaacggttcggtacggtccgcgtaacc

SEQ ID NO: 278560 - DNA, 870 bp, Homo sapiens
  misc_feature: GYAE6OF01BZRDE.19.71.G05.1.454.CMB.1.raw
  modified_base (380)..(380): a, c, t, g, unknown or other
  misc_feature (380)..(380): n is a, c, g, or t
tcagtactctcgtgcacgaccggtgctcgatttagtgtcgtcgcaagagagagggggaggtacaacaggcaggcaggggcagcaagatggtgttgcagacccaggtcttcatttctctgttgctctggatctctggtcgcccgacggggacatcgtgatcgacccagtctcagactccctggctgtgtctcgtgggcgacggccgggcctaccatacaacgtgaccaacggtccacgcccaactaacttcttttaacacctagttacccaaaacgtaaactagtaaaaaccttacgttaagcctttaggtaaccaagacaaggaacgaaccgaggaacctaacggtccctaccgtaggccttgacctactagtttaccgngggacctaacgttacccggtaaccccggggtaacgttccccgggggtaccctacggtaacccgttacgttccgaagggttcgggaccgtaacgggtccgggggttacgtacggggaaaccgttaacggttaccttttacccgaaccctttcccgttacccgtaaccccgtaacgttacccgaacggtacccgaaccggtccctacgggtaccggaacgggtaccgttaggaaacgttaacggttcggtaacgggttaacttttaacgggttttaatttaacgtttacggttaacctaaaagtttaaacgtttaacttttaaacgttttaacgtttaccgtttacgggttaacggggttacccggtttaccggggtaaacccgggtaaaacggggtaaccgtaaacggggttaggttaaccgttaaacgttaacccggtaaaacggtaaccggtaaacggtttagggtaacgttcggttcccgtaaacccg

SEQ ID NO: 278561 - DNA, 650 bp, Homo sapiens
  misc_feature: GYAE6OF01BQU58.19.71.G05.1.454.CMB.1.raw
  modified_base (243)..(243): a, c, t, g, unknown or other
  misc_feature (243)..(243): n is a, c, g, or t
  modified_base (325)..(325): a, c, t, g, unknown or other
  misc_feature (325)..(325): n is a, c, g, or t
  modified_base (418)..(418): a, c, t, g, unknown or other
  misc_feature (418)..(418): n is a, c, g, or t
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctcgtgggcgagccgggccaccatcaactgcaacgtccagccactaattcttttanacagttaccaaactaatacgaaaactacttagcttaggtaccagcagacgaccaggacacgcctcgaggctgctcatttcgnggcacgtccgtacccgggacgtccggggtccctgaccgtatcgagtcggcaggcgggtcgtagggactagtactttaccactcgtaccacctntaccgagccaacggtcctaggccgtaggcgtaaggaagtacgttggtacggtacttaagttttattacgtttacgtaacctaaacttaagtttaactttaacgtttaacgttacgtttacggtacgggtacccgtttaccgggaacccggtaaaggggtaacccgtaagggttacggtaacttacgtaacgaacgggtaacgtaacggttggaccggtcgtacggtaacccg

SEQ ID NO: 278562 - DNA, 618 bp, Homo sapiens
  misc_feature: GYAE6OF01BCY3Q.19.71.G05.1.454.CMB.1.raw
  modified_base (230)..(230): a, c, t, g, unknown or other
  misc_feature (230)..(230): n is a, c, g, or t
  modified_base (240)..(240): a, c, t, g, unknown or other
  misc_feature (240)..(240): n is a, c, g, or t
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctcgtgggcgagcgggccaccatcaactgacaagtccagccanattcttttanactagttaccaaacaatagaaaaaccttacttaagtcttacggtaaccagacagacgaccaggacacgcctccgtaggctgctcatttactgggcatacgtacccgggtagtccgggtcctgaccgtatcagtggcaggccgggtctcggggacagtactttacgactcctccgtaccactacagtacacgtcctgacgacggctaaggagtacgttgtaggtctaagttttagttactttgtaactaaacttaattaatttaacttattacgttcgtacgggtaccgttccggaaccgtaaaggggtaacctaagggtacggtaaattacgttaagaacggttaaccggaacggttaggtacgggctcggtaacccg

SEQ ID NO: 278563 - DNA, 733 bp, Homo sapiens
  misc_feature: GYAE6OF01DQDHK.19.71.G05.1.454.CMB.1.raw
tcagtactctcgtgcacgaccggtgctcgatttagtgtcgtcgcaagagagagggggtcaggctggaactgaggagcaggcaggggcagcaagatggtgttgcagacccaggtcttcatttctctgttgctctggatctctggtcgcccgacggggacatcgtgatcgacccagtctccagactccctggctgtcgtctcgtgggcgaggccgggaccacatacaactcgacaacgtccacgaccactaacttcttttaagacctagttaccaaactaaataacgtaaaaccttacgttaacgtcgttacggtaaccagacaaggaacgaaccgaggaccacgccctaccgaggtctgcctactatttacggcggtactacgtaccgtaaccccgggtaacgttcccggggtaccctacggacccgtacgttaccgaggtccggacgtacgggtccgggttacgagggacctaacgttacgtttaccaccgttccgtaccacctaacgtcgacgtacgtacggtccgtagaccgtacggtactaagaacggtgttcgggtacgtacgttaagttttatttacgttacttaaccgtaaacttaatttaactttaaacgtttaacgttaccgttttaacggtacgggttaacccggtttaccgggaaccggtaaacgggtaacccggtaaaggtcggtaaacgtaactacgtaaacggtaccgttaaggttcggg

SEQ ID NO: 278564 - DNA, 725 bp, Homo sapiens
  misc_feature: GYAE6OF01BS47E.19.71.G05.1.454.CMB.1.raw
  modified_base (351)..(351): a, c, t, g, unknown or other
  misc_feature (351)..(351): n is a, c, g, or t
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccgacggggacatcgtgatcgacccagtctccagactccctggctgtgtctcgtgggcgaggccgggccaccatcaacgtgacaagtccagacccactaattcttttaacacacgttaccaaacaatacgaaaacttacttagctttacggtaaccagaccgaagacaccgaaggacacgtccctacgtaggctgtcctactaatttacgngggactacgttaccgaacccggggtaacgtcccggggtaccctgtacccgtatttcgaggttcggacgacggtcgggtaccgtagggaaccaggttacttttccgaccttccgtaccaacctactacgaacgtcgaacggtcctacgaccgacggtacgtacgtaaaggtgttacggtgggtactttaagggtttttattaacgtttacgtaacctaaacttaaatttaatttaactttaacgtaccgtttcgggttaaccggttaccgggtttaccggaacccggtaaacggggtaacccgtaaaggggttacgtaacgttacgttaacgaaacgggtaccctaaagggttccggtcggtccgacggtaaccc

SEQ ID NO: 278565 - DNA, 599 bp, Homo sapiens
  misc_feature: GYAE6OF01CCCY6.19.71.G05.1.454.CMB.1.raw
  modified_base (245)..(245): a, c, t, g, unknown or other
  misc_feature (245)..(245): n is a, c, g, or t
  modified_base (325)..(325): a, c, t, g, unknown or other
  misc_feature (325)..(325): n is a, c, g, or t
  modified_base (418)..(418): a, c, t, g, unknown or other
  misc_feature (418)..(418): n is a, c, g, or t
  modified_base (442)..(442): a, c, t, g, unknown or other
  misc_feature (442)..(442): n is a, c, g, or t
  modified_base (459)..(459): a, c, t, g, unknown or other
  misc_feature (459)..(459): n is a, c, g, or t
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccgacggggacatcgtgatgacccagtctccagacctccctggctgtgtctcgtgggcgagccgggccaccatcaactgacaagtccagccactaattcttttanactacgttaccaacaatagaaaacttacttagcttggaccagcagagaccaggacagccctcaggctgctctatttacgngggctacgtccgtacccgggtaacgtcccggggtcctaggaccgtattcgaggtcggcaggtcgggtctgggacagtactttcactctcaccntcagcacgcctgcagtctagagtntggtgtacttagttttnttagttcgtactaaactaatttaatttacttacttacgttcggttacggtaccggttcggaaccgtaagggtaaccgtaagggttaggtaacttacgtaacgacggttaaaccgtacgttcgggtacgtcctggtacccg

SEQ ID NO: 278566 - DNA, 576 bp, Homo sapiens
  misc_feature: GYAE6OF01EMX0X.19.71.G05.1.454.CMB.1.raw
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaattcttttatacagttaccaacaatagaaaactacttagcttaggtaccagcagagaccaggacagcctccgtaggctgctctatttacgtgggcacgtccgtaacccgggacgttcccggggtccctggaccgtattacgaggtcggacgtacggcgggtcgtcgggacagtatttcgactcgtccacatcagcacgctgcagtctagagtgtggtagcttagtttattagttagtactaacgtaattatttattacttacgttcgtaggtaccgttcggacgaacgggtaccgtaagggtacggtatacgtacgaacggtacgtaacgtggtcggtcgtgtaccg

SEQ ID NO: 278567 - DNA, 770 bp, Homo sapiens
  misc_feature: GYAE6OF01EB33L.19.71.G05.1.454.CMB.1.raw
  modified_base (246)..(246): a, c, t, g, unknown or other
  misc_feature (246)..(246): n is a, c, g, or t
  modified_base (259)..(259): a, c, t, g, unknown or other
  misc_feature (259)..(259): n is a, c, g, or t
  modified_base (294)..(294): a, c, t, g, unknown or other
  misc_feature (294)..(294): n is a, c, g, or t
  modified_base (330)..(330): a, c, t, g, unknown or other
  misc_feature (330)..(330): n is a, c, g, or t
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtcgcccgacggggacatcgtgatcgacccagtcctccagacctccctggctgtgtctcgtgggcgagcggccacatcaactgcaagtccagaccactaaattcttttanactagttaccaanaatagaaaacttactagcgttacgtacagacaganaccaggacacgcctctaggctgacctctaatttcgnggactacgtaccgtaacccgggagtcccggggtacctagacccgtattccaaggtccgggacgaggtcgggtacgtacggggaactaggtacttttaccaaccgttcctacgtaacccgtagttaccaaacggcccgtaaacgtcccggtagacccggaaggttccgtaaggtaaagtacggttcggttacggactttaaggtttttaacttaacgtttacgggtaacccttaaaggtaaaacctttaaagttttaacgtttaacgtttaaacccggtttccggtaaagggtttaacccgggttaacgaaacccggggttaaaacggggtaacccggttaaaagggggtttaaggtaaaccgttaacgggtttaaacgaaccggttaaaacccgggaactttacggggtaaccggttaccgttaacccggtaaaacccgg

SEQ ID NO: 278568 - DNA, 588 bp, Homo sapiens
  misc_feature: GYAE6OF01DMJHJ.19.71.G05.1.454.CMB.1.raw
  modified_base (240)..(240): a, c, t, g, unknown or other
  misc_feature (240)..(240): n is a, c, g, or t
  modified_base (324)..(324): a, c, t, g, unknown or other
  misc_feature (324)..(324): n is a, c, g, or t
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccgacggggacatcgtgatgacccagtctccagctccctggctgtgtctcgtgggcgagccgggccaccatcaactgcaagtccagccacaattctttanacagttaccaacaatacgaaaactacttagcttaggtaaccagcaagacgaccaggaccagcctcgtaggctgctcatttacgnggactagtccgtaaccgggagtccggggtcctggaccgtattcgagtggcaggcggtctgggacagtacttcactctaccactacgtcagctagccctagcgtacgcgtagaagtagttggtaggtacttaaggttttactagtttcgtaacaaacgttattaagtttattacttacgtttcggtacggttacgttccggaaccgtaagggtaaccaagggttgtaacgtatacgaaacgtcgtaatggtaggcttcggaaccc

SEQ ID NO: 278569 - DNA, 664 bp, Homo sapiens
  misc_feature: GYAE6OF01EO2S6.19.71.G05.1.454.CMB.1.raw
  modified_base (348)..(348): a, c, t, g, unknown or other
  misc_feature (348)..(348): n is a, c, g, or t
  modified_base (388)..(388): a, c, t, g, unknown or other
  misc_feature (388)..(388): n is a, c, g, or t
  modified_base (654)..(654): a, c, t, g, unknown or other
  misc_feature (654)..(654): n is a, c, g, or t
tcagtactctcgtgcacgaccggtgctcgatttagtgtcgtcgcaagagagagggggtcaggctggaactgaggagcaggcaggggcagcaagatggtgttgcagacccaggtcttcatttctctgttgctctggatctctggtgcccgacggggacatcgtgatcgacccagtctccagactccctggctgtgtctcgtgggcgacggcgggccaccgatcgaactgacaagtccagccaactaattcttttagacacgttaccaaacaagtacaaaactcttagccttggtaccagcagacgaccaggtaccaggccctacctagggctgcttactacgtttacgnggactacgtaccgtacccggggtacgtccccggggtaccncggaccgtacgttcgaggtcggctacgggtccgggttcgtacgggacctaggtacttttaccaaccttccctaccaacctactaccgacggtaccaaccgtcccgttaacggcggttaaccggccgttaacggaacgtacgttcgggtagtaccgtttaagttttattaacgttacgtaactaaacttatttaattacgtttaactacgttacggtaggtacccgttacggaacggtacggtaaccgtaggtacgattacgagtanacgtagtcgg

SEQ ID NO: 278570 - DNA, 562 bp, Homo sapiens
  misc_feature: GYAE6OF01E0Q4H.19.71.G05.1.454.CMB.1.raw
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcagtccagccacaattcttttatacagttaccaacaatagaaaactacttagcttggtaccagcagagaccaggacagcctctaggctgctcatttactgggcatccgtacccgggtaacgtccggggtccctgtaccgacttcaggtcggcgaggccggggtacgtgggacgtagtactttccacttctccacctatccgacgcacgcctgccaggctagagagtggtgactagtttattagttagactaataattatttattagtacttggtaggtaccgttacggaccgtaaagggacctaagggttagatagtacgaagtaccgtatggtcggtctggtaccc

SEQ ID NO: 278571 - DNA, 699 bp, Homo sapiens
  misc_feature: GYAE6OF01CMJTT.19.71.G05.1.454.CMB.1.raw
  modified_base (423)..(423): a, c, t, g, unknown or other
  misc_feature (423)..(423): n is a, c, g, or t
tcagtactctcgtgcacgaccggtgctcgatttagtgtcgtcgcaagagagagggggagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaacgccctcgcagaccctctccgctcacctgtcgcctagtccgtccggggacagagtcgcgtagcgacaggttgttgcgttggcgtacgtcgggtcacggacacgtccccgtagtccggaggacgggtacgtaggtacggtgggacggtagggggaaaggacctaagtttatttacgagtacgtaccaaacgtacggtagtaaactaactaaagtttacncgacctacctacttacgttaggtacgtacgaacggtcgtaacgtagtaacctaacgtaaccgtaaacgtaccgaaactaacgtaacgtaaccggaaacgtaacccgttaaccgtttaccccgtacccgtacgacgtaccgtacgttaccgtaccgttaccgtcggtacgtacccgtaccggggtaacggtaccgggtaccgggttaagtttacgttaacgttaccggttagggtaacgggtaaccggacccggtaaccccaagtacccggtaaccg

SEQ ID NO: 278572 - DNA, 669 bp, Homo sapiens
  misc_feature: GYAE6OF01EIQ66.19.71.G05.1.454.CMB.1.raw
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctcgtggtcgcccgacggggacatcgtgatcgacccagtctccagacctccctggctgtgtctcgtgggcgaggcggccacatacaacgtgacaacgtccacgccactaattcttttatactacgttaccaaactaagtacgaaaacttacttacgtcgtttacggtaaccagacgaacgacgaccgaggacacgccctaccgtaggctcgaccttactagtttacgtcgggacctacgttacccggtaacccggggtaacgtcccgggggtaccctaggaccgtattcgagtcggcgacggcgggtacgtgggacagtacttaccacctctaccaccatacgacgccgacgtccgtagcgaggtcgtaggaagtgtcggtaggtacctttagtttacttagttacgtactaaacgtaatttactttaattacttacggtttcggtacggttaccggttaccggacgtaaacgggtacgtaagggttaggaacgttacacggtaacgtacggtaacgtgggttcggccgttggaaccc

SEQ ID NO: 278573 - DNA, 624 bp, Homo sapiens
  misc_feature: GYAE6OF01BUGE2.19.71.G05.1.454.CMB.1.raw
  modified_base (244)..(244): a, c, t, g, unknown or other
  misc_feature (244)..(244): n is a, c, g, or t
  modified_base (256)..(256): a, c, t, g, unknown or other
  misc_feature (256)..(256): n is a, c, g, or t
  modified_base (325)..(325): a, c, t, g, unknown or other
  misc_feature (325)..(325): n is a, c, g, or t
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctcgtgggcgagccgggccaccatcaactgacaagtccagccaactaattcttttanacagttaccaanaatagaaaactacttagcttaggtaccagacagagaccaggacacgcctcgtagctgctctatttacgnggactacgtccgtaacccgggaacgtccggggtccctaggaccgtattcgaggtggacgtaggtcgggtacgtgggactagtactttcacctctaccaacctagtaccgagccacgtcctgaccgaggtctaagaagtagtggtcgtacttagttttattacgttagtaactaaactaattatttaacttagttaccgttcggtacggtaaccgttccggaaccgtaaacggggtacctaaggggttcgtaaacttacgacgaaacggtaccgtaacgttgggtcgtcgtcggtaaccc

SEQ ID NO: 278574 - DNA, 665 bp, Homo sapiens
  misc_feature: GYAE6OF01A382Z.19.71.G05.1.454.CMB.1.raw
  modified_base (428)..(428): a, c, t, g, unknown or other
  misc_feature (428)..(428): n is a, c, g, or t
tcagtactctcgtgcacgaccggtgctcgatttagtgtcgtcgcaagagagagggggagagtctgctgaattctggctgaccagggcagtcaccagagctccagacaatgtctgtctccttcctcttcttcctgcccgtgctgggcctcccacaaggtcgtcctgtcacaagtacagctgcagcagtcaggtccaggactggtgaacgccctcgcacgacccctcgtcgctccaccgtggtacgccctaagttccgtacccgggggacacggtacgtcggtcgtacggcgtacgagttggttcgcgtttggctacggtgggtacacggcacgtccccagtcgaggacgtacgtacggaggtggacgtaggggaagactagttacgttcgatacgtaccgaacgacgtaaggtaaactaactaaagttntacgtaccacgtattacgtggttagacgtacggtaccgtacgtacgaactaacgtaccgaaacgtacgaacaacgtacttaacggaaacctacccgtacgtttaccctacccgttagaccgttacggtccttaccggaccttcgtacgtaccggtaccccgacggtaacgggtacgtacgggttgttaacttacgttagtacggtaacggaaacggcccgccctaaggtcgtaaccg

SEQ ID NO: 278575 - DNA, 703 bp, Homo sapiens
  misc_feature: GYAE6OF01DA0NM.19.71.G05.1.454.CMB.1.raw
  modified_base (248)..(248): a, c, t, g, unknown or other
  misc_feature (248)..(248): n is a, c, g, or t
  modified_base (330)..(330): a, c, t, g, unknown or other
  misc_feature (330)..(330): n is a, c, g, or t
  modified_base (642)..(642): a, c, t, g, unknown or other
  misc_feature (642)..(642): n is a, c, g, or t
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccgacggggacatcgtgatgacccagtctccagacctccctggctgtgtctcgtgggcgaggccgggcctaccatcaactgacaacgtccagccactaattctttaanactacgttaccaaacgaataacgaaaactacttagcttaggtaccagcaagacaccgaggacacgcctacgtaggctgcctnatttacgcgggactacgtaccgacccgggtacgttcccggggtccctggaaccgtagttcgaggtcggcaggtccggtacgtagggactagttacttacactcgtaccaccgtatcgaacgcgacgcccgtggaccgagggtcctaagggaaagtcgttacgggttacggtacttttaacggtttttaagtttaagtttaccgttaaacctaaacgttaattttaacgtttaacgttttaacgttaccggtttacgggtaacggtttaccggttacccgggaaccggtaaaccggggtacgtaaaggggttntaaaccggtagtaaccggaaacggtaacgtaaccgttgggacccgtacgtcggtaaacccg

SEQ ID NO: 278576 - DNA, 858 bp, Homo sapiens
  misc_feature: GYAE6OF01CUIDI.19.71.G05.1.454.CMB.1.raw
  modified_base (255)..(255): a, c, t, g, unknown or other
  misc_feature (255)..(255): n is a, c, g, or t
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctcgtggtcgcccgacggggacatcgtgatgacccagtctccagcctcctggctgtcgtctcgtgggcgaggccgggccacgactacaactgacaacgtccacgaccaactaacttcttttaanaacctacgttaaccaaactaataacgtaaaactacttaacgtcttacggtaccagacaagacgtaccgaggacacgtcctacgtaggctgtacctacttacgtttacggcgggacctaccggtacccggtaacccggggtaacgtttcccccgggggttacctacggaaccgttacttaccggaggttcggacggacgggtccggggtcgtacggggtaactacgttactttaccacgttacctaacccgacctaacgtaccgacggtacccgtaacggtccgtacggacgtacgggtacgtaaggtaacgttacggttcgggttaagggttaccttttaaagtttttaacgttacgtttaaacgttaaaccgttaaaactttaattttaaaccgttttaacgtttaaacggttttcccggtttacggggttaaacccgggttacccgggtttaaacccggggaaaccgggttaaaacccggggtaaaacgggttaaaggggttacgggttaaaacttaacccgggttaaaccgggttaaacgggtaaacccgggttttaaacggtaggggttaacccggtccggtaaccgggttaaaccccg

SEQ ID NO: 278577 - DNA, 594 bp, Homo sapiens
  misc_feature: GYAE6OF01B1V92.19.71.G05.1.454.CMB.1.raw
  modified_base (240)..(240): a, c, t, g, unknown or other
  misc_feature (240)..(240): n is a, c, g, or t
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccaacaattcttttanactagttccaaacaatagaaaactacttagcttaggtaccagcagagaccaggacagcctccgtaggctgactctatttacgtgggcactcgtacccgggaatcccgggggtccctaggaccgtagttcgagtggccgaggcgggtcgtggggacaggtatttcacttctacacctatcagcagcctgccgaggactagaagtagtgtcggtataagttttattagtttcactaaacgtaattaatttaattacttacgttcgtaggtaccgttaccggaaccgtaagggtacctaagggtacggtattaacgtacgaacgtaacggtaacgttaggtcggtctacggtaaccc

SEQ ID NO: 278578 - DNA, 738 bp, Homo sapiens
  misc_feature: GYAE6OF01BAN47.19.71.G05.1.454.CMB.1.raw
  modified_base (132)..(132): a, c, t, g, unknown or other
  misc_feature (132)..(132): n is a, c, g, or t
tcagtactctcgtgcacgaccggtgctcgatttagtgtcgtcgcaagagagagggggagagtctgctgaattctggctgaccagggcagtcaccagagctccagacaatgtctgtctccttcctcttcttcngcccgtgctggcctccacaaggtgtcctgtcacaagtacagctgcagcagtcaggtccaggactggtcgaacgccctcgcagacccctctccgactccacctgtcgcctagtccgtccggggacaggtacgtcgcgtagccgactagttggttcgtcgttaggcctacgtggggtaccaggccgaccgtccccgagttccggagtaggtcgtaggacgtgggccgtaggggaacggactatttacgttcagtacgtacccgaacggtaccggttaagaaacgtttaaactaaagtttactcggacctaacctacgttacgttacggttgtaacggtacgtacgtacgtacgtaaactaaccgtaacgtaaaccggtacgaaccgaacgtaacgtaaccgaaaccggtaacctaacgttaccctacccgtcgtaccgtacggtaccttaccgtaacccgttcgtacggttaccggtacccgttaccccgggtaacggtaacccgggttagggttaaccggttaaacgtttaacggtttaaccggtacgggttaaccgggtaaccggaaccccggttaaccccccgtaaagttaacccggtaacccgg

SEQ ID NO: 278579 - DNA, 707 bp, Homo sapiens
  misc_feature: GYAE6OF01EUPDI.19.71.G05.1.454.CMB.1.raw
  modified_base (246)..(246): a, c, t, g, unknown or other
  misc_feature (246)..(246): n is a, c, g, or t
  modified_base (334)..(334): a, c, t, g, unknown or other
  misc_feature (334)..(334): n is a, c, g, or t
tcagtactctcgtgcacgaccggtgctcgattttagtgtcgtcgcaagagagagggggaggtacaacaggcaggcaggggcagcaagatggtgttgcagacccaggtcttcattttctctgttgctctggatctctgggtgcccgacggggacatcgtgatgacccagtctccagactccctggctgtgtctcgtgggcgagcgggccaccgatcaactgacaagtccagccactaattcttttanacagttaccaacaatagaaaacctacttagtcttaggtaccagcagagaccaggacagcctaccgtaggctagcctcgtattttacgngggtctagtccgtaacccgggtaagttcccggggtaccctacgaccgtattacgtaggtcggaccgaggtccgggtacgtcggggaactaaggttacttttaccgaccttccttaccgtaaccctagttaccgaacgtacccgaaacgtccccgtggacccgtaagggtccgttaaggaaacggtacgttagggtacggtactttaaggttttaatttaacgtttacgtaactaaacgttaaatttaattttaagtttaacgtacgtttcggttaggttacccggtttacggaaccgtaaacgggtaccgtaaggttacggtataacgtacggtaacgtaaccggaaacgttacggtcggcgtcggtaacccg

SEQ ID NO: 278580 - DNA, 676 bp, Homo sapiens
  misc_feature: GYAE6OF01CESRI.19.71.G05.1.454.CMB.1.raw
  modified_base (279)..(279): a, c, t, g, unknown or other
  misc_feature (279)..(279): n is a, c, g, or t
  modified_base (335)..(335): a, c, t, g, unknown or other
  misc_feature (335)..(335): n is a, c, g, or t
tcagtactctcgtgcacgaccggtgctcgatttagtgtcgtcgcaagagagaggggggagagtctgctgaattctggctgaccagggcagtcaccagagctccagacaatgtctgtctccttcctcttcttcctgcccgtgctgggccctcccacgaaggtgtcctgtcacaagtacagctgcagcagtcacggtccaggactggtgaacgccctcgcacgacccctctccgctccacctgtcgccagtccgtccggggacaggacgtcgctagcgacngtgttgcgtggcacgtgggtcacggctaccgtcccagtcggaggtaggtcgtaggnggtcggacgtagggagtactattagttcagtcgtaccaacgtacggtaggtaaactaaactaaagtttacgtcgacctacgtacgttcgtagtagacgtagtacgaactagaactaacgtactaacggtaacacgtaactacgtaaccggtaaacgtaaccgtaccgttaccctccgtacggtacctaacggttacctacggtacccgttcgtacggtaccggtacccgtaccgggaacggtaccgggttaacgggttacggtttaacgttacgttaacgggttacgggtaacgggtaaaccggtaacccccggtaaccccgtaaaggtaccggtaaaccg

SEQ ID NO: 278581 - DNA, 605 bp, Homo sapiens
  misc_feature: GYAE6OF01A1NEJ.19.71.G05.1.454.CMB.1.raw
  modified_base (318)..(318): a, c, t, g, unknown or other
  misc_feature (318)..(318): n is a, c, g, or t
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacattctttatacagttaccaactaatacgaaaactacttaagcttggtaaccagcagacgaccaggacagcctctaggctgctcatttcgnggcatccgtaccgggagtccgggtcctgaccgattcgagtcggcaggtcgggtcgtgggactagtctttacgactccgtacacctatacgagcgacgtcctgaccgacggtctaggtaactagtggtcggtacttaagtttttaagttagttactaaccgtaaacttaaagtttactttaatttacgttacgttcggttacggttaccggtcggtaaccgtaaacgggtacgtaagggtagaacttacgacaacggtaccgtaacttgggtacgtcgtcggtaaccc

SEQ ID NO: 278582 - DNA, 599 bp, Homo sapiens
  misc_feature: GYAE6OF01B7SPT.19.71.G05.1.454.CMB.1.raw
  modified_base (329)..(329): a, c, t, g, unknown or other
  misc_feature (329)..(329): n is a, c, g, or t
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctcgtgggcgagcgggccaccatcaactgcaagtccagcccaactaattcttttaatacacgttaccaaacaatagaaaacctacttagcttggtaccagcagacgaccaggacagcctccgtaggctgctacactttacgngggcacgtccgtaaccccgggaagtcccgggggtccctgaccgtattcgagtggcaggcgggtctgggacagtatttcactctcaccatcagcagcctgcgaggtctagaagtagtggtggtacttaagttttataactttcgtaacaattaatttaatttaatttaacttacgtttcgggtacggtaccgttaccgggacccgtaaaggggaccgtaagggtcggtaatacgtacgaacggtaaccgtaagttggtcggcctcggaacc

SEQ ID NO: 278583 - DNA, 654 bp, Homo sapiens
  misc_feature: GYAE6OF01A6ABK.19.71.G05.1.454.CMB.1.raw
  modified_base (339)..(339): a, c, t, g, unknown or other
  misc_feature (339)..(339): n is a, c, g, or t
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctcgtgggcgagccgggccaccatcaactgcaagtccagccacaattcttttatacagttaccaaacaatacgaaaaaccttacttagctttacggtaaccagtcaggacgaacccgaggaccagcccttccgtaggctgctctatttacgngggcacgttccgtacccgggaacgttcccggggtccctgacccgtattccgaggtcggctacggtccgggtcgtggggacaggtactttaccacgttcctaccacctactacgacgcacgtcctggccgaggtctaggaagtgtggtggtccttaagttttattagtttagtacctaaactaatttaatttaatttacgtaccgtttcggttacggtaccggtttaccggaacccggtaaacgggtaaccgtaagggttacggtaattaacgtcgaaacggtaacgttaacgtggttacggtccgtacgtacccg

SEQ ID NO: 278584 - DNA, 837 bp, Homo sapiens
  misc_feature: GYAE6OF01B6F2Y.19.71.G05.1.454.CMB.1.raw
  modified_base (256)..(256): a, c, t, g, unknown or other
  misc_feature (256)..(256): n is a, c, g, or t
  modified_base (372)..(372): a, c, t, g, unknown or other
  misc_feature (372)..(372): n is a, c, g, or t
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtcgcccgacggggacagtcgtgatcgacccagtctccagacctccgtggctgtcgtctcgtgggcgaggccggaccacataccaactgacaacgtccacgaccaactaatttctttaanactacgtaccaaactaataacgtaaaaccttacttacgtctttacggaaccagacgaagacgaccgtacggaacacggtaccctccgtaacggctcgtccttacgtactttacggnggacctacgtaccggtaacccgggtaacggtccccggggtccctaggtaccgtacgttcggagttcggaccgacgggtcggggttacgacgggtactacggtacgtttacctacctaccgtacaaccgtacgtaccgaggacccgtaccgtccgtagtaccggtacgtttcgtaaagtaacgttttacgttttacggtaacgttttaacgttttaacgtttacccgttaacgttacgtaaccggtaccgtttaaaagttaaacgtttaaaaccgttaccgttaccggttaccctaaaccggttaccgggtttaaacccgggtttacccggggggaaacggggttaaaccggggtaaacccggttaaaagggggttaccccgggaaacgtttaaaaccggaaaccggttaaaaaccccgggttaaggttcccgggtttaaaccggacgggttacccgtaaaccccg

SEQ ID NO: 278585 - DNA, 512 bp, Homo sapiens
  misc_feature: GYAE6OF01AWPSD.19.71.G05.1.454.CMB.1.raw
  modified_base (238)..(238): a, c, t, g, unknown or other
  misc_feature (238)..(238): n is a, c, g, or t
  modified_base (314)..(314): a, c, t, g, unknown or other
  misc_feature (314)..(314): n is a, c, g, or t
  modified_base (384)..(384): a, c, t, g, unknown or other
  misc_feature (384)..(384): n is a, c, g, or t
  modified_base (418)..(418): a, c, t, g, unknown or other
  misc_feature (418)..(418): n is a, c, g, or t
  modified_base (506)..(506): a, c, t, g, unknown or other
  misc_feature (506)..(506): n is a, c, g, or t
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttanacagttccaacaatagaaaactacttagcttggtaccagcagagaccaggacagcctctaggctgctcatttacgnggcatccgtaacccgggaactcccggggtccctgaccgtattcgagtggcgaggcgggtctgggacagtnttcactctcacatcagcagcctgcgagctgaacntgtgtctagtttatagtagtacaaagtattattattactacgttcgtaggtacgtcgacgaaggacctaaggtgatagcagtacatgngctgac

SEQ ID NO: 278586 - DNA, 781 bp, Homo sapiens
  misc_feature: GYAE6OF01C882D.19.71.G05.1.454.CMB.1.raw
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccgacggggacatcgtgatcgaccagtctccagactccctggctgtgtctcgtgggcgaggccgggccaccactccaactgacaacgtccacgccaactaattcttttatactacgttaccaaactaataagtaaaactacttacgtctttacggtaccagacaggacgaccgacggacacgtccgtccgtaggctgcttactactttacgtggactacgtaccgtaccgggacgtcccggggtacctcgaccgtacttcgacggttcggacgtacgggtccggggtacgtacggggtaactaggttactttaccgaccttccgttaccaacctagtacccaggtaccctacggtccctagggaccgtaagggtaccgtaggaacggtacggttcgggttacgttaccggtttaaggttttttaacgtttaacgtccggtttaaactaaaaccgtttaagtttaaactttaacgttttaacgtttacccgggtttacgggttaaccggggttaccggtttaccccggggaaccgggttaaaacggggtaacccgtaagggggtttacgtaacgttaaacgttaccgggtaaacgaaaccggtttaaccggttgggttccggaaccgttccggtaaaccccg

SEQ ID NO: 278587 - DNA, 779 bp, Homo sapiens
  misc_feature: GYAE6OF01D7PDS.19.71.G05.1.454.CMB.1.raw
  modified_base (366)..(366): a, c, t, g, unknown or other
  misc_feature (366)..(366): n is a, c, g, or t
tcagtactctcgtgcacgaccggtgctcgatttagtgtcgtcgcaagagagagggggggaggtacaacaggcaggcaggggcagcaagatggtgttgcagacccaggtcttcatctctctgttgctctggatctcgtggtcgcccgacggggacatcgtgatcgaccagtcctccagacctccctggctgtcgtctcgtgggcgacggccgggccaccatacaactgacaacgtccacgccaactacttcttttaacactacgttaccaaacaatagtaaaaaccttacttacgtcttacggtaaccagacacggacgaccgaaggaccacggaccctcgtaggtctcgcttactaacgtttacgngggacctaacgtcccggtaacccgggacgttccccggggtaccctacggaacccgtattaccgaggtcggaccgacgggtcggggtctacgggaactaggtactttccgacttcccgttacaaccacgtacacggtaccgaaccgtccgtacggcgtaacgggtcctaagggtaggtaccgtttgggttcggtaactttaaggtttttaactttaagttcgttaaacctaaaagtttaaaacttttagttttaaagttaccgttttacggttaccggggtttaaacggggttaccggttaacccggggaaacccgggaaacggggttaaacccggttaaaggggttacgtaaacgttaacgtaaacccggtaacgggaaacgtttaaacgggtggttccggaaccgttaccgg

SEQ ID NO: 278588 - DNA, 684 bp, Homo sapiens
  misc_feature: GYAE6OF01CHRQQ.19.71.G05.1.454.CMB.1.raw
tcagtactctcgtgcacgaccggtgctcgatttagtgtcgtcgcaagagagagggggagagtctgctgaattctggctgaccagggcagtcaccagagctccagacaatgtctgtctccttctcttcttcctgcccgtgctgggcctcccacaaggtgtcctgtcacaagtacagctgcagcagtcaggtccaggaccggtgaacgccctcgcacgaccctctcgactccactgtcgccagtccgtccggggacaggacgtcgctagcgactgtcgtgcttggctagtggtcaggcacgtcccgagtacggagtacgtcgtaggtacggtggacgtagggaacggtactaattagttcagtcgtaccaacgtacgtagaaactaactaaattacgtcgactaacctagttacgttagttacggtaagtacgtaccggtaacgtaacgaaactaacgtactaaacgttaacggaacctaacgtaacgtaacggaaacgtaaaccgttacgttaccctacccgtagtaaccgtacgtaccgttacgtaccgttcgtacggtacccgtaccggtaccccggtaagggtaacccggttaacggggttaagttaagttaaccgttaacggtacggtaaacgggtaaccggtaaacccggacccccgtaaagtaccgtaacgtaacccgg

SEQ ID NO: 278589 - DNA, 756 bp, Homo sapiens
  misc_feature: GYAE6OF01D3EMR.19.71.G05.1.454.CMB.1.raw
  modified_base (244)..(244): a, c, t, g, unknown or other
  misc_feature (244)..(244): n is a, c, g, or t
tcagtactctcgtgcacgaccggtgctcgatttagtgtcgtcgcaagagagagggggaggtacaacaggcaggcaggggcagcaagatggtgttgcagacccaggtcttcatttctctgttgctctggatctcgtggtgcccgacggggacatcgtgatgacccagtctccagctccctggctgtgtctctgggcgaggcggccacatcaacgtgacaacgtccagaccactaattcttttaanacctagttaccaaacgaataacgaaaaccttacttaggtcctttagggtaacccagaccagaacgaccgaggaacacgtccctacgtaggctacgcttactagtttacgcggactacgtccgtaaccgggtacgttcccggggtaccctagtaacccgtattaccgaggtcggacgtacgggtcgggttacgtacggggaactaacggttaacttttacccgaccgttacccgtaaccgtaacccttaacgttcgaaaccggtccgtaacgtcccgttaggacccggtacgggtacgtaggtaaacgcgttaggtacgggtaccctttaagttttaacccgttaggttaccgttacgaacgttactttaaagttttctttttaccgttaaccgtcccggtttaccggtagggtacccggtttacccggaacgggtaaacggggtaaccgtacgggggttaaataaaccgttcgaaacggtaacgttaacgtgggtaacgtccgtagtaaccc

SEQ ID NO: 278590 - DNA, 735 bp, Homo sapiens
  misc_feature: GYAE6OF01B1R07.19.71.G05.1.454.CMB.1.raw
  modified_base (117)..(117): a, c, t, g, unknown or other
  misc_feature (117)..(117): n is a, c, g, or t
  modified_base (125)..(125): a, c, t, g, unknown or other
  misc_feature (125)..(125): n is a, c, g, or t
  modified_base (220)..(220): a, c, t, g, unknown or other
  misc_feature (220)..(220): n is a, c, g, or t
  modified_base (248)..(248): a, c, t, g, unknown or other
  misc_feature (248)..(248): n is a, c, g, or t
tcagtactctcgtgcacgaccggtgctcgatttagtgtcgtcgcaagagagagggggagtacaacaggcaggcaggggcagcaagatggtgttgcagaccccaggtcttcattttcnctgtttcnctggatctctggtgcccacgggacatcgtgatgacccagtctccagtacctccctggctgtgtctcgtgggcgagccgggccaccatcaactganaacgtccagccacaattcttttagaacngttaccaacaatagaaactacttagacttgtaccagacagagaccaggacagccgtacctagcgtcgtctctagttactgggacctagttaccgtacccgggtaacgtcccgggtcccgtacgtaccgactttacgaggtcggacgacggtcgggtccggttacgggacgtacgttaacgtttacacctccgtaccgtacctaactacgacgtacgtacgccgttgcgtacggacgtacgtaagtaagtttcggtacggttaaccgttaagtttttaattaaccgtttacggttaactaaaaccgttaaactttaagttttaaactttaaagtttaccctttacccgggttaagggttaacccggttttaccgggaaacccgggttaaaaggggtaaccccgtaaagggtagggttaacggtaaccgtcgttaaaacggaaacggttaacgtagggttaccggaaccttcgggtacccttaaacccg

SEQ ID NO: 278591 - DNA, 662 bp, Homo sapiens
  misc_feature: GYAE6OF01DESG3.19.71.G05.1.454.CMB.1.raw
tcagtactctcgtgcacgaccggtgctcgatttagtgtcgtcgcaagagagagggggagagtctgctgaattctggctgaccagggcagtcaccagagctccagacaatgtctgtctccttcctcttcttcctgcccgtgctggccctcccacaggtgtcctgtcacaagtacagctgcagcagtcaggtccaggctggtagacgccctcgccacgacccctctcgcctccaccgtgtcgcccagtccgtccggggacaggacgtccgacgtacggccgtacgaggttgttcggtccgtttggcgtacggttcggggtccacgggccgaccgttccccgaagtcggaggtacggtacgtagaggtcggcggtagggaggtactattagttcagtcgtacccaagtacggtaagtaaactaaactaagttacgtcgacacctattcgttgtagaaggtactacgtaactaggaactaacgtacgaaacgtagaaccaacgtaagtaccgaaacgtacttacgttacccgtccctagtccgaacgtccttacgaccttcgtacggtaccgacccgtacccgggaggtaaccgtagggttacttacgttaccgttacgtacgggttacgggaaacccggtcccggacccaaagttaaccgaaccg

SEQ ID NO: 278592 - DNA, 655 bp, Homo sapiens
  misc_feature: GYAE6OF01EQC8S.19.71.G05.1.454.CMB.1.raw
  modified_base (244)..(244): a, c, t, g, unknown or other
  misc_feature (244)..(244): n is a, c, g, or t
  modified_base (329)..(329): a, c, t, g, unknown or other
  misc_feature (329)..(329): n is a, c, g, or t
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccgacggggacatcgtgatgacccagtctccagacctccctggctgtgtctcgtgggcgagcgggccacatcaactgacaagtccagccaacaattcttttaanacagttaccaacaatagaaaacttacttagcttaggtaccagacagacgaccgaggaccagcctccgtaggctgctctatttcgnggcataccgtaccgggactcccggggtccctgaccgtattcgaggtcggcgaggtcgggtcgtacgggacctagttacgtttcaccttcgtaccacctatacgacgctacgccgttagcgaagggtctaggaagtgtacggtgtacgttagttttattagttacgtaactaaacgttaattaagttttaattaacgttaccgtttacgggtacgggttaccggtttaaccgggaacccggtaaacggggtaaccggtaaagggttacggtaattaccgtacgaaacggtaccggtaacggttacggtaggtacccgtcgtaacccg

SEQ ID NO: 278593 - DNA, 684 bp, Homo sapiens
  misc_feature: GYAE6OF01DQJPS.19.71.G05.1.454.CMB.1.raw
  modified_base (170)..(170): a, c, t, g, unknown or other
  misc_feature (170)..(170): n is a, c, g, or t
  modified_base (261)..(261): a, c, t, g, unknown or other
  misc_feature (261)..(261): n is a, c, g, or t
  modified_base (512)..(512): a, c, t, g, unknown or other
  misc_feature (512)..(512): n is a, c, g, or t
  modified_base (542)..(542): a, c, t, g, unknown or other
  misc_feature (542)..(542): n is a, c, g, or t
tcagtactctcgtgcacgaccggtgctcgatttagtgtcgtcgcaagagagaggggggaggtacaacaggcaggcaggggctagcaagatggtgttgcagacccaggtcttcatttctctgttgctctggatctctggtcgcccgacggggactattcgtgatcgacccngtctccgagcctccgtggctggtgtcgtcgtgggcgacggccgggcctaaccgatacgaacctgctaagtccagccctataatttctttanactacgttaccaaacaataagaaactacttagcgttaggaccagcgaagacgacccgaagggtacaccgtccttccgtaacggcgttcgtaccttgtaacttttacgtggggaccttaacgtaccgggttaacccgggtaacgtaccccgggggtttaccttaggaaccgttacgttacggtacggttcgggacgtacggggttcgggtacgtacgggactacggtattccgaacctctacactatccganccgtacgtctagacgacgtagtacgtaagngtacggtacgagtttattaagttctaacgttactaacttattaagtttactaacgtttcgtgggtaggtacgtaccggaacggtaacgggtaaccgtaggtacggtatactagacgttaatggtagtcgacgtcggtaaccg

SEQ ID NO: 278594 - DNA, 715 bp, Homo sapiens
  misc_feature: GYAE6OF01EI5YA.19.71.G05.1.454.CMB.1.raw
  modified_base (355)..(355): a, c, t, g, unknown or other
  misc_feature (355)..(355): n is a, c, g, or t
tcagtactctcgtgcacgaccggtgctcgatttagtgtcgtcgcaagagagagggggggaggtacaacaggcaggcaggggcagcaagatggtgttgcagacccaggtcttcatttctctgttgctctggatctctggtgcccacggggacatcgtgatcgacccagtctccagacctccctggctgtgtctcgtgggcgacggccggccaccatacaactgacacgtccacgccactaattcttttaatacctacgttaccaaacaataacgaaaaccttacttagtctttacggtaccagacaagacgaccgacgacacgtccctacgtacggctcgcctacgtactttacgngggtacacgtaccggtacccgggaccgttcccggggtcctacggaccgtattcggagttcggccgtagggtccgggtacgacgggactaggttacctttaccacctcctaccacctactacggtaccgactacggtcccgtcgacccgtaggtaccgttaagtaaggttcgtcggttacggttactttaggttttaatttacgttacggtaaccttaaacgttaacttttaagtttactttaacgtttcggttacgggttaacgggttaccggttaccgggaaaccggtaacgggtaaccgtaagggttacgtaacgtatacggtaacggtacgtaacgtggttacgtccgtcgtacccg

SEQ ID NO: 278595 - DNA, 668 bp, Homo sapiens
  misc_feature: GYAE6OF01BYS0S.19.71.G05.1.454.CMB.1.raw
  modified_base (250)..(250): a, c, t, g, unknown or other
  misc_feature (250)..(250): n is a, c, g, or t
  modified_base (487)..(487): a, c, t, g, unknown or other
  misc_feature (487)..(487): n is a, c, g, or t
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtcgcccgacggggacatcgtgatcgacccagtctccagacctccctggctgtcgtctcgtgggcgagccggccacatcaactgacaacgtccacgccactaacttcttttaanactacgttaccaaactaataacgtaaaactacttacgtcgttacggtaccagacaggacgaccgaggacacggtcctaccgtaggctacgtccttactaacgtttacgtcgggtactaccgttacccggtaaccccggggtaacggttccccgggggtaccctacggaccgttatccggtaggtcggacgtacgggtcggtacggtagggactagtacttacaccttaccaccaacngtcaacgcacgcgtcgacgagtactaggaacgtgtacggtaggtacttagtttacttagtactaactaaactaatttactttattaccgttacgttcgggtacggttaccgtaccggaacggtaacggggtctaagggtaggtatacgtacgaacgtacgtacgttggcgtcgcgtaaccg

SEQ ID NO: 278596 - DNA, 727 bp, Homo sapiens
  misc_feature: GYAE6OF01BET8Y.19.71.G05.1.454.CMB.1.raw
  modified_base (240)..(240): a, c, t, g, unknown or other
  misc_feature (240)..(240): n is a, c, g, or t
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctcgtgggcgagcggccaccatcaactgcaagtccagccactaattcttttanactacgttaccaacaatacgtaaaactacgttagtcttacggtaccagacagacgaccacggacacgtcctcgtaggctgcctactagtttacgcgggacctacgtacccggtaacccgggtaacggttccccgggggtaccctaggacccgtattccggaggtcggaccgtacggtcggggttccgtagggtaactacggttactttaccgtaaccgttcctaccgtaacctacggtaccgtaacgcccgtaaccgtcccgtaggtacccggtacggtaccgtaaagggtaactcggttaggttacgggttacctttaagtttttacgttaagttaccgtaaacttaaacgttaattttaacgttttacgttaacttttaccgggtacggttacgggttaccggtttacccgaaccgggtaaacggtaccggtaagggtacgttaatacgtacggacgttaacgtacgtacgcgtcgtcgtaaccg

SEQ ID NO: 278597 - DNA, 683 bp, Homo sapiens
  misc_feature: GYAE6OF01EX7TK.19.71.G05.1.454.CMB.1.raw
  modified_base (230)..(230): a, c, t, g, unknown or other
  misc_feature (230)..(230): n is a, c, g, or t
  modified_base (282)..(282): a, c, t, g, unknown or other
  misc_feature (282)..(282): n is a, c, g, or t
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctcgtgggcgagcgggccaccatcaactgacaagtccagccanatcttttatacagttccaacaatagaaaactacttagcttgtaccagcaganaccaggacagcctaccaggctgctactatttacgtcgggcacgtaccgtaacccgggtaacgtcccgggggtaccctcggacccgtacttcgaaggtcggacgacggtcgggtcgtaggggacaggttacttttcgaaccttccgtaccgtaaccacgtacacggtacgacgccgttggaccgacgggtactaggaaacgtacgtcgggtaggtaccttaaggttttaatttacgtttaagtaccgtaaacttaaatttaactttaactttaattaccgtttcggttacggttaccggttacgggacccgtaaaacggggtaacccgttaaagggtacggtaacgttaacgttaacaacgggtaaaccggttaacgttagggtcgggtaccgtcggaaccg

SEQ ID NO: 278598 - DNA, 643 bp, Homo sapiens
  misc_feature: GYAE6OF01CT18A.19.71.G05.1.454.CMB.1.raw
  modified_base (237)..(237): a, c, t, g, unknown or other
  misc_feature (237)..(237): n is a, c, g, or t
  modified_base (254)..(254): a, c, t, g, unknown or other
  misc_feature (254)..(254): n is a, c, g, or t
  modified_base (306)..(306): a, c, t, g, unknown or other
  misc_feature (306)..(306): n is a, c, g, or t
  modified_base (321)..(321): a, c, t, g, unknown or other
  misc_feature (321)..(321): n is a, c, g, or t
  modified_base (333)..(333): a, c, t, g, unknown or other
  misc_feature (333)..(333): n is a, c, g, or t
  modified_base (342)..(342): a, c, t, g, unknown or other
  misc_feature (342)..(342): n is a, c, g, or t
  modified_base (413)..(413): a, c, t, g, unknown or other
  misc_feature (413)..(413): n is a, c, g, or t
  modified_base (428)..(428): a, c, t, g, unknown or other
  misc_feature (428)..(428): n is a, c, g, or t
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctcgtggtcgcccgacggggacatcgtgatcgaccctagtctccagcctccctggctgtgtctcgtagggcgagccgggcctaccataccaactgactaagtccanccaactaattctttaanacacgttaccaaactaataagaaaacctattagctttaggaaccagcagaanaccaggacacgtccnccgaggctgctntatttacgnggactacgtaccggttaacccgggattcccggggtacctggaacctattcgaggtggccagggcggttacngggaactagtacttnccgtactaccacatcaagcacgccgtagcgagacgtaggaatacgtggtaggactttaatttagttaactttacgaacttaaaactattaactttaagttaaccgtttcggtaccggttaaggtacccggttaccggtaacccggaaacggtaccggtaaagggtacgtaattaacgacgtaaaggaacctaacgtggtacgacgttcgaaaccg

SEQ ID NO: 278599 - DNA, 563 bp, Homo sapiens
  misc_feature: GYAE6OF01E47QM.19.71.G05.1.454.CMB.1.raw
  modified_base (243)..(243): a, c, t, g, unknown or other
  misc_feature (243)..(243): n is a, c, g, or t
  modified_base (338)..(338): a, c, t, g, unknown or other
  misc_feature (338)..(338): n is a, c, g, or t
  modified_base (380)..(380): a, c, t, g, unknown or other
  misc_feature (380)..(380): n is a, c, g, or t
  modified_base (403)..(403): a, c, t, g, unknown or other
  misc_feature (403)..(403): n is a, c, g, or t
  modified_base (409)..(409): a, c, t, g, unknown or other
  misc_feature (409)..(409): n is a, c, g, or t
  modified_base (426)..(426): a, c, t, g, unknown or other
  misc_feature (426)..(426): n is a, c, g, or t
  modified_base (455)..(455): a, c, t, g, unknown or other
  misc_feature (455)..(455): n is a, c, g, or t
  modified_base (554)..(554): a, c, t, g, unknown or other
  misc_feature (554)..(554): n is a, c, g, or t
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctcgtgggcgagcgggccaccatacaactgacaagtccagccactaattcttttanacagttaccaaacaatacgaaaaacttacttagccttggtaccagccagacgacctagggacagccctcgtacggctcggccttcaattttacgngggaccagttccgacccgggattccccggggtccctgacctnttccgaggtcggcaggcgggtcngggacngtacttcactctcaccntcagcagcctgcagctagagagtgtggtntagtttatagttacactaatattattattagtacgttcggtgtaccgttcgaccgtaagggcctaaggtcgaatacgtcgaagtaccgtaatggtcggntacgtaccg

SEQ ID NO: 278600 - DNA, 898 bp, Homo sapiens
  misc_feature: GYAE6OF01DC5J8.19.71.G05.1.454.CMB.1.raw
tcagtactctcgtgcacgaccggtgctcgatttagtgtcgtcgcaagagagagggggtcaggctggaactgaggagcaggcaggggcagcaagatggtgttgcagacccaggtcttcatttctctgttgctctggatctctggtcgcccgacggggacagtcgtgatcgacccagtctccagactccgtggctgtgtctcgtgggcgagccgggccaccatacaactcgacaacgtccgacaccactaacttcttttaacacctacgttaccaaaactaataaccgtaaaacttacgttaacgtcgtttaggtaaccctagacgaacggaacgaacctaagggaccacggtaccctaccggttaaggcctaccgtacctacgtacgtttaccggcgggtacctaaccgttcccggtaaaccccggggtaacggttccccgggggtacccctacggtaaccggtaacgttccggtacgggtacgggtaccgtaacggggttccggggttaaccggtccggggtaaaccgtaacgtttacgtttaccctaacccggttttaccaaccctaaccccgttaatacccggaaagtaccccggtaaccggtcccgttaccgggccgtaaaccgggtcgttaacgggtaaaagtaccgggttttgggaaccggtttaaccggtttaaaccgttttttttaaagttcccggttttaataaaacccgtttaaaatttaaaccgtttaaatttttaaaccgttttaaacggttaaccggtttttaccggggttaaccggggtttacccccgggtttaaggggtaacccgggtaaaacggggtaaacccgtaaggggttaacgttaacgtaaacgttacccgaaagggtacccgtaaaacggttcgggg

SEQ ID NO: 278601 - DNA, 851 bp, Homo sapiens
  misc_feature: GYAE6OF01B70KC.19.71.G05.1.454.CMB.1.raw
tcagtactctcgtgcacgaccggtgctcgatttagtgtcgtcgcaagagagaggggggaggtacaacaggcaggcaggggcagcaagatggtgttgcagacccaggtcttcattttctctgttgctctggatctctggtcgcccgaggggacatcgtgatcgaccctagtctccagcctccgtggctgtcgtcgtcgtggacgaggccggacccactatacctaacgtcgacgtaacgtcccgaacgacccaaacgttaactttaccttttaactaacgtaccgtttaacccaaaaacctaagtaaacgttaaaaaccttaccgttaaggtccgttttaacggaacctaacggacaacggtaaccgaaccaagggtaaccaccggtaccccttacggtacgggtcctacgtaccttaacgtaacgttttaccgcggtacctaacgttaacccgggtaaccccgggtacgttccccggggtacctacggtaccgtaacgttccgaagggtaccgtacgtacgggtcgggtaccgtagggactacgttactttaccgaccttacgtacccgtaacctactaccgtacgacctaaccggtcctacggacgtaagtccgtaagaacgtcgttacggtcggttaacttaacgtttttaacttacgtaacgttaaccaaatttaacgttaaacgttttaactttaacggttacgttttaccggaacggtttaacccggtacgggtaaaacccggtaacggggtaacccgttaaaggggttaggtaaccgttaactaaaccgggtaaacttacccggggtaaactttccgggtaaaggttcccggttcgtaaaccccg

SEQ ID NO: 278602 - DNA, 658 bp, Homo sapiens
  misc_feature: GYAE6OF01DVKMJ.19.71.G05.1.454.CMB.1.raw
  modified_base (325)..(325): a, c, t, g, unknown or other
  misc_feature (325)..(325): n is a, c, g, or t
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccgacggggacatcgtgatgacccagtctcagacctcctggctgtgtctcgtgggcgaggcgggccaccatcaactgcaagtccagccacaattcttttacacagttaccaacaatagaaaactacttagcttaggtaccagcagacgaccgagacacgtcctacgaggctgctactatttacgngggactacgtaccgtaacccgggacgtcccggggtccctaggaccgtatccgaggtgacgtaggtcggtgtacgggacagtacttacgtacctactaccacctatcacgcgacgtacgtcgcgacggtcgtacgtaagtacgtgggtcggtacgtttaagttttaagttttaaactttactaaacgttaatttatttaacgtttaacttacggtttacggttacggtaccgggtttaccgacccgggtaaaggtaacccggtaaagggttacggtattaacgtaccgtaaacggtaacgtaacgttaggtacggtacctaggccctaaaccgg

SEQ ID NO: 278603 - DNA, 962 bp, Homo sapiens
  misc_feature: GYAE6OF01C27LH.19.71.G05.1.454.CMB.1.raw
tcagtactctcgtgcacgaccggtgctcgatttagtgtcgtcgcaagagagaggggggaggtacaacaggcaggcaggggcagcaagatggtgttgcagacccaggtcttcatttctctgtgctctggatctcgtggtcgcccgacggggacatcgtgatcgacccagtcctccagacctcccgtggctgtgtctcgtagggcgaggccgggccaccatccaactcgacaacgtccagacccaactaactttccttttaactactacgttaccaaaactaataacgtaaaaaccttacttaacgtaccgtttacggtaacctaacgacgaaacggaacggaaccccgtaaaggggaaccaaccggtacccgttaccccgtaaggggtcccttacggacctttaacgtaaccggtttttaccgtacgggggtaccctaaccggttaaccccgggttaaacccccgggggtaaacgtttccccccggggggggttacccctttaacgggaaccccgggtttaactttacccggtaacggggtttaccgggaccggtaaccgggggttcccgggggttacggttaacgggggaacccgttaaggtttaacctttttacccggaccctttaccgttacccctaacccgttaaccgttaccgaacgggtacccacggtaccctacggaccgtaacgggtaccgttaaggaaacggtagttcgggttaacgtcgttttaaaggttttatttaacgtttaccggttaaacttaaacgttaaatttaacttttaacgtttaacttttaccgggtttaccggttaacgggttaacccggggttaccgggaaaccggttaaaaccgggggaccgtttaaaagggggtacggttaaacgttaaacggttaaaacgggtaaccggttaaaccggttacggggttacggtaacctcgggtaacccgttaaacccg

SEQ ID NO: 278604 - DNA, 608 bp, Homo sapiens
  misc_feature: GYAE6OF01A98LX.19.71.G05.1.454.CMB.1.raw
  modified_base (229)..(229): a, c, t, g, unknown or other
  misc_feature (229)..(229): n is a, c, g, or t
  modified_base (323)..(323): a, c, t, g, unknown or other
  misc_feature (323)..(323): n is a, c, g, or t
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctcgtgggcgagcgggccaccatcaactgcaagtccagccanaattctttatacagttaccaacaatagaaaactacttagcttaggtaccagcaagacgaaccaggacacgcctcctaggctgctctatttacgngggcacgtccgtacccgggaacgttcccgggggtccctggaccgtattcgaggtcggcgtaggtccgggtcgtgggactagtactttcaccgttctccaacctatccgacgccacgtcctcgaccgaggctagaagtcgtgtcggtacttagttttattatttcggtaactaaagtaatttatttaattacgttacgttcggtacggtacgttcggaccgtaagggtaccgtaaggtcggtaattacgtacgtaacggtacgtacgttggtaggtcgtggtaccc

SEQ ID NO: 278605 - DNA, 795 bp, Homo sapiens
  misc_feature: GYAE6OF01C3C1Z.19.71.G05.1.454.CMB.1.raw
tcagtactctcgtgcacgaccggtgctcgatttagtgtcgtcgcaagagagaggggggaggtacaacaggcaggcaggtgcagcaagatggtgttgcagacccaggtcttcatttctctgttgctctggatctctggtcgcccgacggggacatcgtgatcgacccagtcctccagacctcccgtggctgtcgtctcgtgggcgacggccggccacatacaactcgacacgtccacgccaactaacttcttttaacacgtaacgttaccaaactaaataacgtaaaaaccttacgttaacgtacgtttacggaaccagacaacggaacgtaaccgaaggacctaacgtccctaccgtacggtcctacgtccttactaaacgttttcgacgggtacctaacgttacccggtaaaccgggtaacggttccccgggtacctacggtaaaccgtcgttcggaacggtcggacgtacggggtccggttacggacgggaacttaacggttactttaccgaccgtttctaacccgtaaccgaacgttaccgaacgtcccgtaacgtcccgtaagggacccgtaagggtacccgtaaagggtaacgtacgtttcgggtacgttaacttttaaggtttttaacttaacgtttaacggtaaactaaacgttaattttaagttttacttacgtttaacggttcgggttacgggttaccggtttaccgggaacggttaaacgggaaccggttagggttacgtaactacggtaacgaacggttaacgtagttcggacggtctaaccgg

SEQ ID NO: 278606 - DNA, 705 bp, Homo sapiens
  misc_feature: GYAE6OF01DTJGQ.19.71.G05.1.454.CMB.1.raw
  modified_base (334)..(334): a, c, t, g, unknown or other
  misc_feature (334)..(334): n is a, c, g, or t
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagacctcctggctgtgtctcgtgggcgaggcggccacatcaactgacaagtccagccaactaattcttttagactacgttaccaaacaatacgtaaaacttacttagcttacggtaccagcaagacgaccaggacacgcctccgtaggctgctactatttacgnggactacgtaccgtacccgggaacgttccccggggtccctacggtaccgtattccgaggtcggacgacggtcggggtcgtagggactaggttactttaccgactcctaccacctactacgaacgacgtacgtccgtacgccgtacggtacgtacgaagtacgtggtttttttacggacgtttaagttttaacgtttacgtttaacggtaacctaaacgttaaatttaacttttaactttaacgtttaccgtttacggttacgggttaccggttaccgggtaaccggtaaacgggtaaccggtaagggttacggtaacgttaacgtacgaaacggtaaccggtaacgttaggtacggtcgtacggtaacccg

SEQ ID NO: 278607 - DNA, 620 bp, Homo sapiens
  misc_feature: GYAE6OF01A0IWE.19.71.G05.1.454.CMB.1.raw
  modified_base (159)..(159): a, c, t, g, unknown or other
  misc_feature (159)..(159): n is a, c, g, or t
tcagtactctcgtgcacgaccggtgctcgatttagtgtcgtcgcaagagagagggggagagtctgctgaattctggctgaccagggcagtcaccagagctccagacaatgtctgtctccttcctcttcttcctgcccgtgctgggcctcccacaaggtntcctgtcacaagtacagctgcagcagtcaggtccaggactgggtagaacgcccctcgcacgacccctctcgctccaccgtgtcgcccagtccgtccggggacaggacgtcgctagcgactaggtgttgacttggctacgtcggcgacggctaccgtcccagtcgaggtacggtctaggtagtggacgtaggggaacgactagttattacgatacgtaccaagtacgtagaaacttactaaattgtcgactactagtcgtagttagagtcgtaccgtatacgaactaactacgaacggtacaaccgtactaacgtaacgaaaccgtaacctacgttccctaccgtacggactacgcttacgtaccgtcgtcgtacgtacccgtaccggtaacggtacgtaacggttagttaacgtacgttacgtagggtaacggaacggacccgtacccaagtaccgtaacg

SEQ ID NO: 278608 - DNA, 695 bp, Homo sapiens
  misc_feature: GYAE6OF01DZMKO.19.71.G05.1.454.CMB.1.raw
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtcgcccgacggggacatcgtgatcgacccagtctccagacctcccgtggctgtgtctcgtgggcgaggccggccaccatcaactgacaagtccagaccactaattcctttaatacctagttaccaaacaataacgtaaaaccttacgttaagtccgtttacggtaaccaagacaaggaacgaaccgtaacggactaccgcccgttaccgtaacggctacgcttactaacgttttacgtcgggactaccgttacccggtaacccgggtaaccgtcccgggggtaccctaggaacccgtagttaccgaggtcggacgtacgggtccgggtcgtagggaactagttactttccgacgttaccacctacctactacgacgaccacgtccgtagcgaggtacctaggtaagtcgttacggtcggtactttagttttaacttagttacgtaactaaattattaatttaagtttacttacgttcggttacggtaccgtcggaaccgtaagggtaaccgtaaggtgtaactacgtacgaacgtaccgagttggcgtcgtgtaaccc

SEQ ID NO: 278609 - DNA, 655 bp, Homo sapiens
  misc_feature: GYAE6OF01EURGC.19.71.G05.1.454.CMB.1.raw
  modified_base (240)..(240): a, c, t, g, unknown or other
  misc_feature (240)..(240): n is a, c, g, or t
  modified_base (328)..(328): a, c, t, g, unknown or other
  misc_feature (328)..(328): n is a, c, g, or t
  modified_base (536)..(536): a, c, t, g, unknown or other
  misc_feature (536)..(536): n is a, c, g, or t
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggccctcccacaaggtgtcctgtcacaagtacagctgcagcagtcaggtccaggctggtcgaacgccctgcacgaccctctcgcctcacctgtcnccagtccgtccggggacagagtcgctagcgactagtgttcgtcttggcacggtgggtcacggcacgtccccagtcgaggagtctaggngtcggcgtagggaacgatagttacttcagttcgtaaccgaacgtacggtaggtaaacttaaacgtaaaattataccggactaacccgtagttacgttaggttacggaacgttaacggttaccgtaacgtaacgtaacctaaacgttaaccgaaaccgttaacgaacctaaccgtaagtaaccggaaacgtaaccgttaccgttacccnccggtacgcgaacgtcgtaccgtaccgtgtaccgttacggacccctaccggacggtacggtaccggttagtaacgttgtaacggtacggtaagggaaccgacccggtcccaagtaaccg

SEQ ID NO: 278610 - DNA, 773 bp, Homo sapiens
  misc_feature: GYAE6OF01BADYF.19.71.G05.1.454.CMB.1.raw
tcagtactctcgtgcacgaccggtgctcgatttagtgtcgtcgcaagagagagggggagagtctgctgaattctggctgaccagggcagtcaccagagctccagacaatgtctgtctccttcctcttcttcctgcccgtgctggcctcccacaaggtgtcctgtcacaagtacagctgcagcagtcaggtccaggactggtgaacgccctcgcacgaccctctcgcctcactgtcgcctatccgtccgggaacaggtacgtcgctacgcgactagttgttcgcgttgggacgtacggttcgggtcgacggtccgaccgttccccgagtccggacggtaacggttcgtaaggtacggtcgggtcggtagggggaaacggtacgtaagtttacgtttacgacgttcggtaaccctaaacggtaacggttacggtaaaacttaaaccgttaaaagttataccggtaccctaaccttacgtttacgtttagggttacgaaacgggttacgttaccggtaaccgttaagaaaccttaaacgtacccgtaaaacggtaacgtaacccgaacgtaacgtaaaccggtaaaccgtaaccgttaccgtttacccttacccgtagtaccgtacggttacccgtacgggtacccttcggttacgtacccggtaacccgttaccccgggaaggtaaccggttacgggttacggttaaacgtttacgttaaccggtagggtaaccgggtaaccggtaacccgaccccgttaaggtaacgtaacccg

SEQ ID NO: 278611 - DNA, 913 bp, Homo sapiens
  misc_feature: GYAE6OF01EEYI5.19.71.G05.1.454.CMB.1.raw
  modified_base (155)..(155): a, c, t, g, unknown or other
  misc_feature (155)..(155): n is a, c, g, or t
tcagtactctcgtgcacgaccggtgctcgatttagtgtcgtcgcaagagagaggggggaaggtacaacaggcaggcaggggcagcaagatggtgttcgcagacccaggtcttcattttctctgttgctctggatctctggtcgcccgaggggacntcgtgatcgaccctagtcctaccacgaccttcccgtcggtcttgtcgtactcgtcgggccgaggtccgggccaccgagtacgaactgactaacgtccacgtaccgaactaagttcctttttaagaaccgtagttacccaaaactaagtacggtaaaaacctttacgttacgtaccgtttacgggtaaacctaggaccaacggtaacgaaccccgtaacgggtaacctaacgggtcccccttacggttaacggggtccttacggtacccgttaccttaacggtttttacccggtcggggtaacccttaacggtttaacccccggggttaaacccgggggtaaccggtttcccccggggggttacccgttacggggtaaccccggttagttaccggaaggggtttccggtaccggtaacgggggttccggggtttccggtaaaccgggggaacttaacgggtttacctttaccctaaacccgtttccgtaacccgtaacccgtaagttaccgtaaccggtaccgtaccgtaccggtttcgacgggtaacggtctaaggtaacgttcttagggtcgttaacgtttacgttttaacgttaccgtgttaaccgtatttaaccgttaacgtttttcttttaccgtaacgttcccggttaacggtcggtaaaccggttccgggaaccggtaacgggtaccggtaagggtaccggtaaacgtcggtaaacgtaccgtaaggttccggtgttaccggcttaacccgg

SEQ ID NO: 278612 - DNA, 740 bp, Homo sapiens
  misc_feature: GYAE6OF01C4AEC.19.71.G05.1.454.CMB.1.raw
  modified_base (257)..(257): a, c, t, g, unknown or other
  misc_feature (257)..(257): n is a, c, g, or t
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtcgcccgacggggacatcgtgatcgacccagtctccagacctcctggctgtgtctcgtgggcgaggccggacccaccatacaacctgaccaacgtcccacgccaactaatttcttttaanacctacgttaccaaaactaaataacgtaaaaaccttcgtttaacgtccgtttacggtaaccagaccaaggacgaaccaaggacaacgtcctccgtaggcctgccttatactttacgtgggcctacgttcccggtaaccccggggaagtttccccggggtaccctacggtaacccgtattaccggaaggtcggacgacggtcgggtcggtgggtaacctaggtactttacccgactcccttaccaacccgtgtaaccgacgaccgtaccgtccgtacggacgagggtcaaggtaacgagttgggtaccgagttttaagttttacgtaacgttcgtaactaaacttaatttaactttatttaaccgttcgtttacgggcggttaacccggtacccggtaggtaaacggggaaccctaggggtttaacaacgtttacgaacggtaacgtaaccgttaacgggtgggttaccgtccgtaggtacccc

SEQ ID NO: 278613 - DNA, 647 bp, Homo sapiens
  misc_feature: GYAE6OF01BQ3TD.19.71.G05.1.454.CMB.1.raw
  modified_base (540)..(540): a, c, t, g, unknown or other
  misc_feature (540)..(540): n is a, c, g, or t
  modified_base (640)..(640): a, c, t, g, unknown or other
  misc_feature (640)..(640): n is a, c, g, or t
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctcgtgggcgagccgggccaccatcaactgacaacgtccagccactaattcttttatacacgtttaccaaacaatacgtaaaaaccttacgttaagtcctttaggtaaccctagaccaagacgaaccgaggaaccacgtccctccgtaggctgacctcctattttacgtgggcctacttacccggtaaccccggggtaacgttccccgggggtaccctacggtaaccgtacgtttcgagttcgggcgtacggtcggggtcgtaggggactacggtactttccacttccaccgacctatacgagtcgactccgtagccgacgtcgtagacgtagtgtcggtactagttttattntacggtaacaattaagttatttattaacgttacgttcgaggttaccgttacgacggtaacggtacgtaagggtgtatacgtacgagtacgaagtggtcgntcgaccg

SEQ ID NO: 278614 - DNA, 802 bp, Homo sapiens
  misc_feature: GYAE6OF01EOROK.19.71.G05.1.454.CMB.1.raw
  modified_base (214)..(214): a, c, t, g, unknown or other
  misc_feature (214)..(214): n is a, c, g, or t
  modified_base (244)..(244): a, c, t, g, unknown or other
  misc_feature (244)..(244): n is a, c, g, or t
  modified_base (254)..(254): a, c, t, g, unknown or other
  misc_feature (254)..(254): n is a, c, g, or t
  modified_base (266)..(266): a, c, t, g, unknown or other
  misc_feature (266)..(266): n is a, c, g, or t
  modified_base (282)..(282): a, c, t, g, unknown or other
  misc_feature (282)..(282): n is a, c, g, or t
  modified_base (300)..(300): a, c, t, g, unknown or other
  misc_feature (300)..(300): n is a, c, g, or t
  modified_base (336)..(336): a, c, t, g, unknown or other
  misc_feature (336)..(336): n is a, c, g, or t
tcagtactctcgtgcacgaccggtgctcgatttagtgtcgtcgcaagagagagggggggaggtacaacaggcaggcaggggcagcaagatggtgttgcagacccaggtcttcatttctctgttgctctggatctctggtcgcccgacgggacatcgtgatcgacccagtctccagacctccctggctgtgtctcgtgggcgagcgggccacganacaactgacaagcagccataattctttaanacagtccaanaatagaaaactntagcttaggtacagtnaacgacgaaccaggaacnggtacctaccgtaggcctgtacttcgtaatttacgngggactacgtaccgggtaacccgggtaacgtcccgggggtcccttaagggaaccctaagtttccgtaagggtccggtaccggaacgggttacccggggttggttaccggggaaattaaaacggttcgtttttacccgaaacccgttcccgtttaacccgaaccctaacgtttaaccgtaaacgggcccaaacggtccgttaacgaacccgggacgtaacgggttaaacggaaaggtaacggttccggtaggttaaccgtttaaggtttttaaacttttaagtttacggtaaacccgtaaaacgttaaagttttaaatttacccgtttaaagtttaaccgttacgggttaacgggtacccggtttaacggaaacccggtaaaggggtaacccggtaaggggtaacgttaagttaacgaacgtaaacggggtaaacctaaccggttaagtcgggtaatccgggtaacc

SEQ ID NO: 278615 - DNA, 730 bp, Homo sapiens
  misc_feature: GYAE6OF01AWCV2.19.71.G05.1.454.CMB.1.raw
tcagtactctcgtgcacgaccggtgctcgatttagtgtcgtcgcaagagagaggggggaggtacaacaggcaggcaggggcagcaagatggtgttgcagacccaggtcttcatttctctgtgctctggatctcgtggtcgcccgacggggacatcgtgatcgacccagtcctccagtacctcccgtggctgtcgtctcgtgggcgaggccgggaccacgactacaacgtgacgtacgtccacgaccaactaacttcttttacaacctacgttaccaaactaaataacgtaaaaaccttacgttagtaccgttaggtaaccagacaaggacaaccacggactacggcctccgtacggctagctactatttacgcggactacgtccggtaacccgggtacgtcccggggtacctacgaacccgtagttaccgacggtcggaccgtaaggggtccgggttaacgtggggaaaccctgttaacgttcctaacgttcccactaaccgtaactcgtaacggcaacggtccgacgtcgacggtacgtagtaacgtcgtaggtacgtcgtttaaagttttactagttcgtaacaaacgttagttattaacttagttaccggttccggtaacggttacgtaccgggtaacggtaaacccgggtaggtaagggttacggtaacttaacgtacgtaaggttaacccgaagttaggggtctaaacccggttcggtaaaaccc

SEQ ID NO: 278616 - DNA, 710 bp, Homo sapiens
  misc_feature: GYAE6OF01BS4KK.19.71.G05.1.454.CMB.1.raw
  modified_base (117)..(117): a, c, t, g, unknown or other
  misc_feature (117)..(117): n is a, c, g, or t
  modified_base (452)..(452): a, c, t, g, unknown or other
  misc_feature (452)..(452): n is a, c, g, or t
  modified_base (673)..(673): a, c, t, g, unknown or other
  misc_feature (673)..(673): n is a, c, g, or t
tcagtactctcgtgcacgaccggtgctcgatttagtgtcgtcgcaagagagagggggtcagactggaactgaggagcaggcaggggcagcaagatggtgttgcagacccaggtcttnatttctctgttgctctggattctctggtcgcccgacggggacagtcgtgatcgacccagtcctccgagacctcccgtggctgtcgtcctcgtgggcgacgccggacccaccatcaactgacgaacgtcccagaccctaataacttcttttaacaacgtacgtttaccaaactaattaaacgtaaaaccttactacgtacgttacggaaccagacaaggaacgaacccgtaggaaccacgtcctacccgtggtacctgcttactagtttacgcggactacgtacccggtaaccgggtacgtccccgggttcctagacccgtattcgaggcgtacgnggtaccgggtgtagggactagttactttaccgacttcccacgtaacctactccgacgtacgcctccgtacgaccgtacggaccgttaagtaagggccgttagggtccggtttaattaggttttaacttacgttaacgtacgtaaactttaagtaacttttaagttacgtttacggttccgggttaacggtaccgttaccggaaaccgggtcgggtaaacgngttacggtattacgtaacgaggttacgacggttacgg

SEQ ID NO: 278617 - DNA, 772 bp, Homo sapiens
  misc_feature: GYAE6OF01AD3Z9.19.71.G05.1.454.CMB.1.raw
  modified_base (366)..(366): a, c, t, g, unknown or other
  misc_feature (366)..(366): n is a, c, g, or t
tcagtactctcgtgcacgaccggtgctcgatttagtgtcgtcgcaagagagaggggggaggtacaacaggcaggcaggggcagcaagatggtgttgcagacccaggtcttcattttctctgttgctctggatctctggtgcccgacggggacatcgtgatcgacccagtcctccagacctccctggctgtgtctcgtgggcgaggccggccaccatacaactgactaacgtccgacgcccaactaactttcttttaatacctacgttacccaaactaaatacgtaaaaacttaccttagtcgtttacggtaaccagacaacgaacgaccgaggaccacgccctcgtaggctgcctctactttacgnggacctacgtacccggtaccgggtaacgtcccggggtacctcgaccgtattacgaggtcgggcgacggtcgggtcgtacgggactacgtactttaccaccttcctaccacctactccgacgtccaacgtccgtacgacgtacggtcgtaacggtaagtggtacggttacggtacgttttaagtttttacgtttaacgtttaccggtaacctaaaactttaaagtttaacttttaaacgttttacccgttaacggtttaccgggttaccgggttaacccgggttttaacccgggaacccgggtaaaacgggggtaacccggttaaagggttacgggttaaacttaccgggttaacaaccggggtaaccgttaacggttagggtacccggtacgttccggtaaccccg

SEQ ID NO: 278618 - DNA, 752 bp, Homo sapiens
  misc_feature: GYAE6OF01AVBGH.19.71.G05.1.454.CMB.1.raw
  modified_base (241)..(241): a, c, t, g, unknown or other
  misc_feature (241)..(241): n is a, c, g, or t
  modified_base (325)..(325): a, c, t, g, unknown or other
  misc_feature (325)..(325): n is a, c, g, or t
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctcgtgggcgagccgggccaccatcaactgcaagtccagccacaattcttttanactacgttaccaacaatgtaaaaacttacttagcttaggtaccagcagagaccaggacagccctcgtaggctgctcatttacgnggcatcgtacccgggaatccgggggtccctgaccgattcgaagtcggcgaaggtcgggtactcgggacaggtacttttccgaccttcctaccgaccctagtaccgtacgaccgtaaccgtccttaggaccgtacgggtaccttagggaaacggtcgttcggggtacggtacgtttaacgggtttttaacgttaggtttaccggttaaccctaaacgttaaagtttttaaactttaaacttttaaccgttaaccgttttccgggttaaggggtttaaccccggttcccgggttaaaccggttaaaaccgggggtaacccccggttaaaaggggttacccgggtaaacgtttaaaccggttccgtaaaaaggggttaccccgttaaagggtttacccggttaacgggtcccgttacgggtaaacccccg

SEQ ID NO: 278619 - DNA, 552 bp, Homo sapiens
  misc_feature: GYAE6OF01CL0RY.19.71.G05.1.454.CMB.1.raw
  modified_base (331)..(331): a, c, t, g, unknown or other
  misc_feature (331)..(331): n is a, c, g, or t
  modified_base (336)..(336): a, c, t, g, unknown or other
  misc_feature (336)..(336): n is a, c, g, or t
  modified_base (527)..(552): a, c, t, g, unknown or other
  misc_feature (527)..(552): n is a, c, g, or t
tcagtactctcgtgcacgaccggtgctcgatttagtgtcgtcgcaagagagaggtctagagtggctgggaaggacatatttcatgtccaacacgtggaatacaaattatgcaccatctgttgagagtcgactgacaatcaacgtagacacatcgaagaaccagttctccctgcagctgacctctgtgactcccgaggacacgggtgtatattactgtggaagaggcccccatagacatcgccacctcgtctctggtgctatagttcgggccagggaacccatgtcaccgtctcctcgccctccaccgacggcccagtccgtccttcccccnggccncccctgcctccgaggacgccacccgtccgagacgcacgacggcccggacccgtcgggctacggcccgttacgggtaccgaaacgggtacccttaacccgtttacccccgaacgggtaacggtaacgttaccgtaggaccgggccggggtccgtgggaccgtaacgggccgaactacggtacgagccagcgnnnnnnnnnnnnnnnnnnnnnnnnnn

SEQ ID NO: 278620 - DNA, 741 bp, Homo sapiens
  misc_feature: GYAE6OF01BG2X1.19.71.G05.1.454.CMB.1.raw
  modified_base (195)..(195): a, c, t, g, unknown or other
  misc_feature (195)..(195): n is a, c, g, or t
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtcgcccacggggacatcgtgagtcgacccgtagtctccacgacctcccgtggctgttntccgtcgtgggcgacgccgggccacatacaacgtgactaacgtcccacgaccctaataacttttaccttttaactaaccgtacgtttaacccaaaagtaacttaacgtaaaaaccttacgttaacgtccgttacggtaaccagaccaggaacgaccgtaaggacaccgtccgtccgtaggccgtagtaccttataccgtttagcggtactaaccgttacccgggtaacccgggtaacgttcccggggtaccctacggtacccgtaagttccggaaggtcggaccgtaaggggtccgggtttagacgggtaataacggtcttttccgacgttacctaccgtaccgtactaccggatccgtaccgtaccgtcggacgtagtaccgtagaacggtgttacggtacgttcttaagtttacgttattaaccgtaactaacgttaagtttacttagttacgtacgtttacgtacggttaccggttaccgaacggtaacggtaccgtaaggtacgtatacgacgaaagtcggtacgtagtcggtatcgaaccc

SEQ ID NO: 278621 - DNA, 721 bp, Homo sapiens
  misc_feature: GYAE6OF01DGLBG.19.71.G05.1.454.CMB.1.raw
  modified_base (445)..(445): a, c, t, g, unknown or other
  misc_feature (445)..(445): n is a, c, g, or t
tcagtactctcgtgcacgaccggtgctcgatttagtgtcgtcgcaagagagaggggggagtacaacaggcaggcaggggcagcaagatggtgttgcagacccaggtcttcatttctctgttgctctggatctcgtggtcgcccgacggggacatcgtgatcgacccagtcctccagacctcccgtggctgtgtctcgtgggcgaggccggaccaccatacaactgacaagtccagaccaactaacttcttttaagactaacgttaccaaactaaataacgtaaaacttacgttagtcttacggaccagaccgaagacgaaccgaggtacacgtccctacgtaggctacgcttactacgtttacgcggactacgtaccggaacccgggagttcccgggtacctagaccgtattccgaggtcggacgagggtcggtcgagggtaacncggttactttccacctctccgaacctcgtacgacgacccgcgtaccgtgaccgacggtacgtaaggaacgtgttaccgggtacgttaagtttaacggttttatttaagtaaccgttaacctaaatttaaatttaactttaagtttaccttacgggtttccggtaacgggttaacccggttaccgggaaacccggtaaaggggtaccgtaaaggggtacgtaaacgtacggttacgaaacggtaaccggtaacgtgggttacgtacgtcgtaacccg

SEQ ID NO: 278622 - DNA, 667 bp, Homo sapiens
  misc_feature: GYAE6OF01BAQWF.19.71.G05.1.454.CMB.1.raw
  modified_base (359)..(359): a, c, t, g, unknown or other
  misc_feature (359)..(359): n is a, c, g, or t
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtcgcccgacggggacatcgtgatcgacccagtctccagacctccctggctgtcgtctcgtgggcgagccgggccaccatcaactcgacaacgtccacgaccactaattaccttttaatacctacgttacccaaactaaatacgtaaaaaccttacttacgtactttacggtaaccagacacgaacgaccgaggacacgcctccgtaggctgactctattcgnggcacgtccgtacccggacgttccggggtcctagaccgtattcgaggtcggcgtacggtcgggtacgtcgggactaggtactttcaccgtctaccactactcacgtcacgtcctgacgacggtctagaagtgtacggtcggtacttaaggttttacttacgttacgtaactaaagttaatttacttttaattaacgttaccgtttacgggtacggtaccggtttaccggaaccgttaacggggacctaaggggtacgtaataccgtaacgaacggtaaccgtacggttaggtcggtcgtcgtaacccg

SEQ ID NO: 278623 - DNA, 706 bp, Homo sapiens
  misc_feature: GYAE6OF01DRSGF.19.71.G05.1.454.CMB.1.raw
  modified_base (260)..(260): a, c, t, g, unknown or other
  misc_feature (260)..(260): n is a, c, g, or t
tcagtactctcgtgcacgaccggtgctcgatttagtgtcgtcgcaagagagagggggagagtctgctgaattctggctgaccagggcagtcaccagagctccagacaatgtctgtctccttcctcttcttcctgcccgtgctcgggccctcccacgaaggtcgtcctgtcacaagtacagctgcagcagtcaggtccaggtactggtacgacgccctcgcacgaccctctcgcctcacctgcgccagtcgtaccgggganacgacgtcgacgtagcgacgtaggttgttcgtcgttcgggcgtacgttcggggtcaggtcctaccgtccccagtccggaaggtcggttcgtaaggacggttgggacggtagggggaaggtaacttatttacgttacgacgttacgtaacccgaacgtacgggtagtaaaactaacttaaattacgcgtaacctactacttcggttaggtacgtaacggtgtacgtaacgtagaaacctaataaccggtaaacgtaagacctaacgtaacggtaaccggaaacgtaaccgttacgtttccctacccggtagacctacggtccttacggttcccttggttaccggtaccgtaccgtacccgggaacggtacgggttaacgggttatttaaacgttaccgttaggtacgggtacggtaaacggccccggtaaccctaggtagtacccgg

SEQ ID NO: 278624 - DNA, 789 bp, Homo sapiens
  misc_feature: GYAE6OF01BRAO6.19.71.G05.1.454.CMB.1.raw
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtcctccagacctccctggctgtgtctcgtgggcgagcgggccaccatcaactgcaacgtccagcccacaatttcgtttttaataccgtagttcccaaactaataggtaaaaaccttcgttaacgtctttacgggttaaccagacaggaacgacccgaaggtaccacgtccccttaccgtacgggtcttacggccttcgtaacgtttttaccgggggtaccctacgtaccccggtaacccgggtaacgtccccgggggtaccctaggaaccgtcttaccgaggtcggcgtacggtcgggtacgtacgggaactacgttactttcgaccgttactaccccgtaacagttaccgaagcccgtaaacggtcccgttaaggcccggacggggtacgtaaccggaaaggtacggttggttacggtacgtttaagtttttaacgtacgtttagtaaccgttaacttaaagttttaactttaagttacgttaaccgtttcgggtacgggttaacccggtttccgggaacccggtaaaagggttaccggtaacggggttaacgtaacgtttaacccgaaccggttaacggtaaccgttaaccggttgggtcccggtacttcggtaaacccccg

SEQ ID NO: 278625 - DNA, 728 bp, Homo sapiens
  misc_feature: GYAE6OF01C9TP4.19.71.G05.1.454.CMB.1.raw
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtcgcccgacggggacatcgtgatcgacccagtctccagacctccctggctgtgtctcgtgggcgagccggccacgatccaactgacacgtccagccaactaactttcttttaacgactacgttaccaaactaataacgtaaaaccttacgttagaccgtttacggtacccagcaagacgacccgtaggaccacgtccctaccgtaggcctcgtcctacttacgtttaccgtgggacctacgtaccggtaaccccgggtaacgttccccggggtccctacgtaccgtagttacgacggtcggccgtacggtccggggtcgtacgggaactaggttacctttacgaccgttcctaccgaaccttagtaccgaacgttccgaacggtccgtacggaccggtaggaccgttaggaacgtgtcggttacggtactttagttttaacgttcgttacgtaacttaaacgttaatttagtttaactttacttacggttacggttaccgggtaccggtttcccggaaacgggtaaacgggtaccgtaagggtcgtaactacgtacgaacggtacgtaacgtggtacggtcacggtaaccc

SEQ ID NO: 278626 - DNA, 756 bp, Homo sapiens
  misc_feature: GYAE6OF01C764T.19.71.G05.1.454.CMB.1.raw
  modified_base (361)..(361): a, c, t, g, unknown or other
  misc_feature (361)..(361): n is a, c, g, or t
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtcgcccgacgggacatcgtgatcgacccagtctccagacctccctggctgtctctcgtgggcgacggccgggccaccatccgaaactcgacaacgtccacgcctaactaattctttaatacctagttaaccaaactaataacgtaaaacctacttaacgtctttacggtaaccagacgaagacgaccaggacacgtcccgtcgtaggctcgcttctacttacgnggcacgtaccgtaccgggaacgtcccggggtcctacgaccgtacgtcaggtcggacgtacggtcgggtcgtacgggtaacgacgttacgtttccaaccgtccttaccgaacctacgttaccaacggcacggaccgtacggacccgtaggaccgttacggaaaggtcgttacggtcggttaacgtttaagttttaaccgtttaagttacgttaaaccctaaaagtttaaactttaatttaacgttttaacgtttaccggtttacggttaaccggtttaccgggttacccgggtaaaccggtaaacgggtaaaccggaagggtttaaggaacgttaacggttaccgaaacgggttaaccgttaacgttaggggttaccgtaaccgttgggtaacccc

SEQ ID NO: 278627 - DNA, 688 bp, Homo sapiens
  misc_feature: GYAE6OF01AUPYL.19.71.G05.1.454.CMB.1.raw
  modified_base (282)..(282): a, c, t, g, unknown or other
  misc_feature (282)..(282): n is a, c, g, or t
  modified_base (560)..(560): a, c, t, g, unknown or other
  misc_feature (560)..(560): n is a, c, g, or t
tcagtactctcgtgcacgaccggtgctcgatttagtgtcgtcgcaagagagagggggagagtctgctgaattctggctgaccagggcagtcgaccaggacgctccagacaatgtctgtctccttctcttcttcctcgcccgtgctcgggcctcccacaaggtgtcctcgtcacaagtacagctcgcagcacgtcacggtccgaggactacggtacgaacgcccgtcgtacgacgacccgtcgtccggcctccaccgtgtcgaccacgtccgtaccggggacncggacgtcgtctacgacgacgtaggtcgttcgcgtttcgggctacgtcggggtaccaggtacctaccgtccccagtcgaggtcggtactagacggtggacggtagggaacggtactagttacttacacgttacgtaccaacgtacggtagtaaattaactaaatttcgactaacctacgtacttcgtttagtacggtagtacggttacggaactacggtaacgtaactacggaaacgttacgaactacgtaacgtaacgaaaccgtacctacgttccnccgttacggataccggtctacgtacccgttctacgccggtacccgacgggtaccgaacggttcggttaacttagttaccgttagtcggggtaaacggaaccggttaccggaccttaagtaccgtaccg

SEQ ID NO: 278628 - DNA, 866 bp, Homo sapiens
  misc_feature: GYAE6OF01CKERK.19.71.G05.1.454.CMB.1.raw
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctcgtggtcgcccgacggggtacatcgtgactcgacccagtcctccgacgtacctcccgtgggtcctggttcgtccttcgtacggggacgacggcccgggacccaacctagtaccctaagtcgaacctaacgtacccacgtaccctaacttaactttacctttaataacctaaccgttaaccaaaactaaacttaaacgtaaaaaccttacttaacggtactttaaccgggaaccaacgacgaaacggaccgaccggaacggaacccgtacgtcccgttaaccgtaggtcctcggtaccttacgttaaccgtttacgtacgggtaccctacggtaaccccgggtaaccccgggacggtttcccccggggtacctacggtaccgtacgttccgaaggtcggtaccggtacgggtaccggtacgggtacggtaacgtaggttacctttacctccggtaccctactaccacgtcgactccgtacgccgtcgacggtacgtacgaggtaatcggtacggtcgttaccttttaaggttttactacgtttactaacgttaaactttacgtttaagtttaacgttaacctttcggttaacggggttaccgttaaccggggttaaccggtaccgggtaaaaccgggggttacggttaaggtacgggttaattaacccgtaaccggggttacgttaaaaacggttcccggttaggtaacccggtcgtaaaccccggtttacccg

SEQ ID NO: 278629 - DNA, 714 bp, Homo sapiens
  misc_feature: GYAE6OF01E2T7A.19.71.G05.1.454.CMB.1.raw
  modified_base (706)..(706): a, c, t, g, unknown or other
  misc_feature (706)..(706): n is a, c, g, or t
tcagtactctcgtgcacgaccggtgctcgatttagtgtcgtcgcaagagagaggggggaggtacaacaggcaggcaggggcagcaagatggtgttgcagacccaggtcttcattttctctgttgctctggatctctggtgcccacggggacatcgtgatgacccagtctccagactccctggctgtgtctctgggcgagcgggccaccatcaactgcaacgtccagccactaattcttttaatacagttaccaaacaataagaaaaccttacttagtcttaggtaccagacaaggacgaccaggacacgccctacgtacggctgccttactactttacgtgggactacgtccgtaacccgggtaacgtcccggggtcctacggacccgtattcgaggtcggccgtacggcggggttcgtacggggtacaacggttactttacgaccttacctaccaacccgtaactcggacgtacccgaacggccgttcggaccgtacggtacgtacgggtaaacgtaggttcgggtacggtacctttaggttttaactttacgtttacgtaacctaaactttaaagtttaacttttaatttaagttacgtttaccgtagggtaccggtttaccgggaccgtaaacggggtaccggtaaagggttacggtaacttaacgtacggaaacggtaacggtaacgttagggtacggttcncggtaccc

SEQ ID NO: 278630 - DNA, 584 bp, Homo sapiens
  misc_feature: GYAE6OF01D5E8V.19.71.G05.1.454.CMB.1.raw
  modified_base (247)..(247): a, c, t, g, unknown or other
  misc_feature (247)..(247): n is a, c, g, or t
  modified_base (335)..(335): a, c, t, g, unknown or other
  misc_feature (335)..(335): n is a, c, g, or t
  modified_base (414)..(414): a, c, t, g, unknown or other
  misc_feature (414)..(414): n is a, c, g, or t
  modified_base (446)..(446): a, c, t, g, unknown or other
  misc_feature (446)..(446): n is a, c, g, or t
  modified_base (471)..(471): a, c, t, g, unknown or other
  misc_feature (471)..(471): n is a, c, g, or t
  modified_base (575)..(575): a, c, t, g, unknown or other
  misc_feature (575)..(575): n is a, c, g, or t
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccgacggggacatcgtgatgacccagtctccagctcctggctgtgtctcgtgggcgaggccgggccaccatccaactgacaacgtccagcccaactaattcttttanacctagttaccaaacaataagaaaaccttacttagtcttaggaccagcaagacgaccaggacacgcctcgtagctcgctatatttcgnggactacgtaccgtaccgggacgtcccgggtcctgaccgtagttcgaggtggcgaggtcggtcgagggactagtcttcnctcacacatcagcacgcctgcgagcgtagagngtggtgtacgttagtttattgttanaacctaatatttattagttacttcgttggtacggtaccgtcggaacggtaaacgggtaccgtaagggtcgtatacgtacggaaagtacggtaacgtggttccgngtcgaaccg

SEQ ID NO: 278631 - DNA, 798 bp, Homo sapiens
  misc_feature: GYAE6OF01D322C.19.71.G05.1.454.CMB.1.raw
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctcgtggtcgcccgacggggacagtcgtgatcgacccagtcctccagacctcccgtggctgtgtctcgtgggcgacgccggccacatacactcgacaacgtccagcctaactaatttctttaacaccgtacgttaccaaactaataacgtaaaaccttacttacgtaccgttacggtaccagtacgaaggtacgaccgaaggaccaccgtccctaccgtacgtcgtacgtcttactacgtttcggtacggctacgttacccggtaacccgggtaacggttccccgggggtacctacggtaaccgtacgttcgacgggttcggaaccggacggggttccgggtacggtacgggactacggttactttaccgtaccctaccgtaccgtaaccctacgtacgacggaccgtacggaccgttcggaccggtacggtacgtaggtaacgttacggttacgtcgggtttacttaacgtttttaacgtttaacgtttacgttaaactaaacgtttaagttttaacgttttaacgtttaaccgttaccgtttaccgggtaccggtttaaccggttaacccggggtaaccgggtaacgggtaaccgtaaggggtacggttacgtaaccgttacgaaacggttaaccgtacgttacggtacggtacgtcggtaaccc

SEQ ID NO: 278632 - DNA, 744 bp, Homo sapiens
  misc_feature: GYAE6OF01B45IX.19.71.G05.1.454.CMB.1.raw
  modified_base (267)..(267): a, c, t, g, unknown or other
  misc_feature (267)..(267): n is a, c, g, or t
  modified_base (330)..(330): a, c, t, g, unknown or other
  misc_feature (330)..(330): n is a, c, g, or t
  modified_base (356)..(356): a, c, t, g, unknown or other
  misc_feature (356)..(356): n is a, c, g, or t
tcagtactctcgtgcacgaccggtgctcgatttagtgtcgtcgcaagagagagggggtcaggctggaactgaggaggtacaacaggcaggcaggggcagcaagatggtgttgcagacccaggtcttcatttctctgttgctctggatctcgtggtcgcccgacggggacatcgtgatcgacccagtctccagtacctccctggctgtcgtctcgtgggcgagccgggccaccatacaactgacaagtccagccactaattctttaanactagttaccaactaatacgaaaacttacttagcttacggtaaccagacagacgacgaggacngcctcgtaggctgctactatttacgnggactacgtaccgaacccgggtacgtccccggggtaccctcgaaccgtacgttcgaaggtcgggaccgagggtccggggttcggtacggggtaacctaggttaactttcctaaccgttcccgtaaccaccgtaacgtaccgaaccggccaacgtcccgtggaacggtcggaaccgttaggaacgtaggttcggtagggttaactttaagtttttaagttacgttacggtaaacctaaacgtttaaactttaaatttaaaccgttttaacgttaacccggtttttacgggtaacggggtttacccggttaacccggtaaaccggggtaaaaccgggtaaccgtttaaaaggggtacgggttaaacttaaaccggtacgtaaaaccgggg

SEQ ID NO: 278633 - DNA, 676 bp, Homo sapiens
  misc_feature: GYAE6OF01CEXVO.19.71.G05.1.454.CMB.1.raw
  modified_base (148)..(148): a, c, t, g, unknown or other
  misc_feature (148)..(148): n is a, c, g, or t
  modified_base (436)..(436): a, c, t, g, unknown or other
  misc_feature (436)..(436): n is a, c, g, or t
  modified_base (452)..(452): a, c, t, g, unknown or other
  misc_feature (452)..(452): n is a, c, g, or t
tcagtactctcgtgcacgaccggtgctcgatttagtgtcgtcgcaagagagagggggtcaggctggaactgaggaggtacaacaggcaggcaggggcagcaagatggtgttgcagacccaggtcttctatttctctgttcgctctggntctctggtcgcccgacggggacatcgtgatcgaccagtcctacgacgacctcccgtggctggttcgtcgtcggtgggcgacggccgggaccaccgataccaactcggacaacggtccacgacctaactaactttcttttaacactacgttaaccaaactaataacgtaaaactcgttagacttacgaacacacgagacaccgagacacgtcctacgtacggctcgtactactagttacgcggtacctacgtacccggtaccggtacgtccccgggtctacgtaccgtntcggaggtcgtacggngtcgggtcgtacggactacgttacctcgtactccgtaacacctagtccgacgtaccgaccgtctacggtacgtacggacgtaggaactaggttacggtagttaacgtttatttacgttactacggtaactaagttattaactttagtttacgttacggttaggttacggttaccggtaccggaacggttaacggtacggtagttacggaactgtagtaaaccgg

SEQ ID NO: 278634 - DNA, 563 bp, Homo sapiens
  misc_feature: GYAE6OF01AK2AU.19.71.G05.1.454.CMB.1.raw
  modified_base (240)..(240): a, c, t, g, unknown or other
  misc_feature (240)..(240): n is a, c, g, or t
  modified_base (315)..(315): a, c, t, g, unknown or other
  misc_feature (315)..(315): n is a, c, g, or t
  modified_base (460)..(460): a, c, t, g, unknown or other
  misc_feature (460)..(460): n is a, c, g, or t
tcagtactctcgtgcacgaccggtgctcgatttagtgtcgtcgcaagagagaggggggaggtacaacaggcaggcaggggcagcaagatggtgttgcagaccccaggtcttcatttctctgttgctctggatctctggtgcccacggggacatcgtgatgacccagtctccagactccctggctgtgtctctgggcgagccgggccaccatcaactgcaagtccagccacattcttttanacagttccaacaatagaaaactcttagcttggaccagcagagaccaggacagcctcgtaggctgctctatttacngggctatccgtacccggaatcccggggtccctgaccgtattcgacgtggcaggccgggtactgggacctaggtctttaccacgttctaccgaccatacagtccagtccgtagacgaggctagaagagtggtagcttagtttattnttgtacgaattaagttatttattattacgttgtcggtacgtttaccgacgtaacgggtactaggtagtatacgtcgagtactaacgtggtacgtcgtgtaccg

SEQ ID NO: 278635 - DNA, 821 bp, Homo sapiens
  misc_feature: GYAE6OF01BTNY9.19.71.G05.1.454.CMB.1.raw
  modified_base (623)..(623): a, c, t, g, unknown or other
  misc_feature (623)..(623): n is a, c, g, or t
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagacctccctggctgtgtctcgtgggcgagccgggccaccatcaacgtgcaagtccacgccaactaattcttttatacgtagttacccaaactaataacgtaaaaaccttacttaacgtctttacgggtaacccaggaccaaaggaacgaaccccgaagggaacccacggtaccccttaccgttaacgggtcccttagggtcccttacgtaacgtttttacccggtacggggtaccttaccgttaccccgggttaaccccggggtaaaccggttcccccggggggttacccctaagggaacccgttatttccgagggtcgggacgtaacgggtccggggtacgtacgggggtaacctaggttaccttttaccgaaccgtttccctaaccgaaccccgtagttacccgacgacgtaaccggtcccgtaggcccgaacggtacgtaggtaaacgngtttgggacgtacttaagttttaatttaacggttacgtaacctaaaacttaagtttaaacttttaacgtttacgtacccggtttagggtaccgggtttaaccgttccgggaaacccgtaaacggggtaccgtaaagggttacggaacttaacgtacgtaaacggtaaccgtaacgttgggtacggccgtcgtaacccg

SEQ ID NO: 278636 - DNA, 722 bp, Homo sapiens
  misc_feature: GYAE6OF01BZY0H.19.71.G05.1.454.CMB.1.raw
  modified_base (712)..(712): a, c, t, g, unknown or other
  misc_feature (712)..(712): n is a, c, g, or t
tcagtactctcgtgcacgaccggtgctcgatttagtgtcgtcgcaagagagaggggggaggtacaacaggcaggcaggggcagcaagatggtgttgcagacccaggtcttcattttctctgttgctctggatctctggtgcccgacggggacatcgtgatcgacccagtctccagcctccctggctgtgtctcgtgggcgacggccgggccaccataccaacgtgacaacgtccacgccaactaattcttttaacactacgttaccaaataataacgaaaacttcttacgctttacggaccaagcaagacgaccgaggacacggcccttccgtaggctgcctctatttacgcggctacgtccgtaaccgggacgtcccggggtcctggaccgtagttcgaggtcggacgtacgggtccgggttacgtaggggtaactacggttacttttcccgaacccgtttcctacccgaaccctaacgtacgacgtacccgaccggtcgtacggacccggtaggtaccgtaagggaacgtaggttacggttacggtttacctttaagtttttacgttaacgttaacgtaactaaacgttaatttaacgttttaactttacgtttaccgtttacgggtaacgggttaccttaccgggaaccgtaaacgggtaccgtaagggttacggtaatacgtacgaaacggacgttacgtgggtacgngtacgtaccg

SEQ ID NO: 278637 - DNA, 824 bp, Homo sapiens
  misc_feature: GYAE6OF01BJJ9E.19.71.G05.1.454.CMB.1.raw
  modified_base (263)..(263): a, c, t, g, unknown or other
  misc_feature (263)..(263): n is a, c, g, or t
tcagtactctcgtgcacgaccggtgctcgatttagtgtcgtcgcaagagagaggggggagtacaacaggcaggcaggggcagcaagatggtgttgcagacccaggtcttcatttctctgttgctctggatctctggtcgcccgacggggacatcgtgatcgacccagtctccagacctcccgtggctcgtgtctcgtcgggcgacggccggaccacatacaacgtcgaccaacgtccaacgtaccaactaactttcttttaanaccgtaacgttaaccaaactaagtaacgtaaaaaccttaccgttaggtaccgttacgggtaaccaggtacgaacggtaacgaaccgaagggaccacggtccctacggtacggcctcgccgttactaacgtttacggcggtactacggttacccggtaacccgggtaaccgttccccgggggttaccctacgggtaaccgtacgttacggacggtacgggacggtacgggtcggggttacgtacgggtaacttacggttacgtttactaccgttacctaccaacgtactaacgacgtacccgacggtcccgtaggtacgacggtacgtaacgggtaacgtcggttacgggtacggttaacttttaaggtttacgtttaacgttacgtaaacgttaaacttaaacgttttagtttaaacgttaccgtttaccggttacggtaccgggttaacccggttccgggaaaccggtaaacggggtaaccgttaaggggttacgttaaataccggtaacggtaacgttaaacgggttaccgttacgggtccgttaacgtccgtaacccg

SEQ ID NO: 278638 - DNA, 603 bp, Homo sapiens
  misc_feature: GYAE6OF01CF055.19.71.G05.1.454.CMB.1.raw
  modified_base (239)..(239): a, c, t, g, unknown or other
  misc_feature (239)..(239): n is a, c, g, or t
  modified_base (326)..(326): a, c, t, g, unknown or other
  misc_feature (326)..(326): n is a, c, g, or t
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccgacggggacatcgtgatgacccagtctccagactccctggctgtgtctcgtgggcgagcggccacatcaactgcaagtccagccactaatcttttanacacgttaccaacaatagaaaactacttagcgttacggtaccagcaaggagaccaggacacgcctccgtaggctgctctatttacgngggcacgtccgtacccgggaagtcccgggggtacctacggaccgtattcgaggtcggcgaggccgggtcgtgggactacgtacttcactctcaacctagtcagctacgcctgcaggctagaagtgtgtggtcttaagttttattagttacgtacaaactaattatttaactttacgttacttacggtcgggtaaccgttaccggaccggtaaagggtaacccgtaagggtaggtaacttacgtacaaggtaaccgacgttaggtcggccgtgtaccg

SEQ ID NO: 278639 - DNA, 980 bp, Homo sapiens
  misc_feature: GYAE6OF01B3KGN.19.71.G05.1.454.CMB.1.raw
  modified_base (260)..(260): a, c, t, g, unknown or other
  misc_feature (260)..(260): n is a, c, g, or t
tcagtactctcgtgcacgaccggtgctcgatttagtgtcgtcgcaagagagaggggggaggtacaacaggcaggcaggggcagcaagatggtgttgcagacccaggtcttcatttctctgttgctctggattctctggtgacccgacggggacatcgtgactcgacccagtcctccagacctccgtggcttgtgtctcgtgggcgaggccggcctacagtacaacgtcgactaacgtccaagccagtaacttcttttaanaccgtacgttaccaaactaagtaacgtaaaacctttcgttaacggtacgtttacggtaaccgacgacgaagaacgaaccgaacggaactaccggtacccttaccgttaacggtcctcggtaccttaacgttaacgttttaaccgcgggtacctaacggtacccggttaacccggggtaaccggtttcccggggggttacccacgggttaacccgtagttacccggtaaggtttccgggacgtacggggtacccgggggttagtaccgggggtaaacctaaggtttaccggtttaccaacccgtttacggttacccaacccgttaagttaccccaagggaccccgtacggttaccccgttaggaccggtaacgggtaccgttaaggaaaccgggttgggttaccggtttacgggtaacttttaaaccgggtttttatttaaccggtttacgtaaacccggtttaaacgttaaatttttaaaccgtttttaactttaaccggttaacccgggttttaacgggttaaacccggggtttaaccgggttttaaacccccgggaaacccggggttttaaaaaccggggtaaaccccgggtttaaagggggtacgggttttaaaacccgttaaacccgggttaaccgtaaaacccggggttaaaccccgggttaaaggttttacggggttacccgggttaaaccccgttacggggttaaaacccccg

SEQ ID NO: 278640 - DNA, 569 bp, Homo sapiens
  misc_feature: GYAE6OF01BWC38.19.71.G05.1.454.CMB.1.raw
  modified_base (250)..(250): a, c, t, g, unknown or other
  misc_feature (250)..(250): n is a, c, g, or t
  modified_base (330)..(330): a, c, t, g, unknown or other
  misc_feature (330)..(330): n is a, c, g, or t
  modified_base (387)..(387): a, c, t, g, unknown or other
  misc_feature (387)..(387): n is a, c, g, or t
  modified_base (417)..(417): a, c, t, g, unknown or other
  misc_feature (417)..(417): n is a, c, g, or t
tcagtactctcgtgcacgaccggtgctcgatttagtgtcgtcgcaagagagagggggtcaggctggaactgaggagcaggcaggggcagcaagatggtgttgcagacccaggtcttcatttctctgttgctctggatctctggtcgcccacggggacatcgtgatgacccagtctccagacctccctggctgtgtctcgtgggcaggcgggccaccatcaactgacaagtccagccactaattcttttanacagttaccaaacaatagaaaactcttagcttggtaccagcaagacgaccaggacacgcctcgaggctgctctattacgnggctacgtcgtaacccgggatcccgggtacctgaccgtattcgagtgcaggcggtcngggactagtactttcactctcaccatcganccagcctagcgtaggcctaggaagtactggtgtactagttttattagtactaacgaactaattactttaattacttacgttcggtaggtaccggttacggaccgtaaagggtacccgaagggttacgtaatactagagtaacgtacggttgg

SEQ ID NO: 278641 - DNA, 681 bp, Homo sapiens
  misc_feature: GYAE6OF01DQNVJ.19.71.G05.1.454.CMB.1.raw
tcagtactctcgtgcacgaccggtgctcgatttagtgtcgtcgcaagagagagggggagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaacgccctcgcacgaccctctcgctcacctgtcgccatcgtccggggacagacgtcgctagcgacagtgttgcttggctacgtgggtcgaggcacgtcccatcggagaggtctagagtggcgtaggggaacggtactagtttacttcgagttcgtacccgaaacgtacggtaggtaaacttaacgtaaatttacgtacgacctaaccgtacttacgttagtttaggaacggtaggttaccgtaacgtagaacctaaacgtaccgtaaaccgggttaacgaactaaccgtaaagttaccgaaaacgtaacccttaacggtttccctaccccgtgtaccacgtacttaccggtaccttacggttacgtaccgacccgttacccgggaacgggtaaccggtacgggttacttaaacgttacgtttaacggtcgggtaacgggaaaccggtcccggaaccccctaagtaaccggtaaacccg

SEQ ID NO: 278642 - DNA, 620 bp, Homo sapiens
  misc_feature: GYAE6OF01BJENA.19.71.G05.1.454.CMB.1.raw
  modified_base (239)..(239): a, c, t, g, unknown or other
  misc_feature (239)..(239): n is a, c, g, or t
  modified_base (282)..(282): a, c, t, g, unknown or other
  misc_feature (282)..(282): n is a, c, g, or t
  modified_base (313)..(313): a, c, t, g, unknown or other
  misc_feature (313)..(313): n is a, c, g, or t
  modified_base (395)..(395): a, c, t, g, unknown or other
  misc_feature (395)..(395): n is a, c, g, or t
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtcgcccacggggacatcgtgatgacccagtctccagactccctggctgtgtctctgggcgagcgggccaccatcaactgcaagtccagccacaatcttttanacagttccaacaatgaaaactacttagcttggtaccagcaganaccaggacagcctctaggctgctcatttacngggcagtcgtacccgggagtcccggggtaccctgacccgattcgagtggcaggcgggtctagggacagtacgtttcactccnccaccagttcagcacgtcctgcgagggtctaggaagtagtggtcggacgtaagttttagttacgtttagtacctaaactaaacgttaatttaattacttacgtttaccggttagggtaccgtttccgggaaccgtaaacggggacccctaaaagggttccgggtaaacctttaggacgtaaccggtaaaccggtaacgtttaggcggtaccgttcggtaaacccg

SEQ ID NO: 278643 - DNA, 607 bp, Homo sapiens
  misc_feature: GYAE6OF01A3AWO.19.71.G05.1.454.CMB.1.raw
  modified_base (240)..(240): a, c, t, g, unknown or other
  misc_feature (240)..(240): n is a, c, g, or t
  modified_base (251)..(251): a, c, t, g, unknown or other
  misc_feature (251)..(251): n is a, c, g, or t
  modified_base (309)..(309): a, c, t, g, unknown or other
  misc_feature (309)..(309): n is a, c, g, or t
  modified_base (390)..(390): a, c, t, g, unknown or other
  misc_feature (390)..(390): n is a, c, g, or t
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccaggggacatcgtgatgacccagtctccagactccctggctgtgtctcgtgggcgagcggccaccatcaactgacaacgtccagaccactattctttanacactaccaanaatataaactactagcttagtaccagacagacgaccagacacgcctcgaggctgcctntattacgtggactactaccgtaccgggtactcccggggtacctagaccgtattcgaggtcgcaggtcgggtctacgggaanagttacttaccgactctaccactacacgagccacgtctggcacgggctaggaagtctgggtacgtcttaagtttacttacgttagtactaaagtaatttatttattacttacgttcggtaggttaaccggtccggaaaccgtaaggggtaaccgtaagggtaggtaaactacggtacaaacccggtaagtaccgtgggtacgcgttaaccgaaccgg

SEQ ID NO: 278644 - DNA, 734 bp, Homo sapiens
  misc_feature: GYAE6OF01CBKEY.19.71.G05.1.454.CMB.1.raw
  modified_base (124)..(124): a, c, t, g, unknown or other
  misc_feature (124)..(124): n is a, c, g, or t
  modified_base (221)..(221): a, c, t, g, unknown or other
  misc_feature (221)..(221): n is a, c, g, or t
  modified_base (441)..(441): a, c, t, g, unknown or other
  misc_feature (441)..(441): n is a, c, g, or t
tcagtactctcgtgcacgaccggtgctcgatttagtgtcgtcgcaagagagagggggtcaggctggaactgaggagcaggcaggggcagcaagatggtgttgcagacccaggtcttcatttctntgttgctcgtggatctcgtggttcctggcgggactatcgtgatcgacccagtacccagactcacgtggctgtcgtctcgtgggcgacgacgaccaanatacaacgtgacgacggtccacgacctaagtaacttcttttacccaccctaacctaaccaaaacgtaaaacctaaaaactttcgtaacgtaccttaacggaaccaaacgacgacgaaccgaaggaccacgtccttaccgtaaggtcacttactagtttacgcggtacttcgaccgcgtaccgtaacgttccgggtcctacggaccgtaggttcccggganacgggtccgggtacgaggtactattcttacgacctccgtactaccagtaccgacgtacgaacgtcgtacgcgacggtcgtaagaagtgtcgggtacttacgttacgtttactacggtgtaacgtaacgttactttaacgttttacttttaccgtacctttacccgggttccggttaaccggttacccggttaaccgggtaacccgggtaaacggggttaccggggtaaagggttacggtaaactacggaacgggttaaacgtacccggttagggtaccgtcgtacggtaaccc

SEQ ID NO: 278645 - DNA, 730 bp, Homo sapiens
  misc_feature: GYAE6OF01AZU57.19.71.G05.1.454.CMB.1.raw
  modified_base (258)..(258): a, c, t, g, unknown or other
  misc_feature (258)..(258): n is a, c, g, or t
  modified_base (723)..(723): a, c, t, g, unknown or other
  misc_feature (723)..(723): n is a, c, g, or t
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtcgcccgacgggacatcgtgatcgacctagtctcagtacctcccgtggctgtcgtcgtcgtgggcgagccgggaccacgatacgaactcgactaacgtccacgaccaatacttcttttaanactacgttaccaaataataacgtaaaaccttacttagtaccgttacgaaccagacaacgaacgaaccacggacacggtccctacggtacgtcctcgtacttacgtacgtttacggcggactacggttaccggtaacccgggtacgttcccggggtacctacggaaccgtagttacgacggtcggacgtacgggtccgggtacgacgggtaacgtagtttaccgttacctaaccgttccgttaaccaaccgtacgtaccgtacggaccggtaccgttaaccgcggttaacgaaccggtagtaaaccggaagtcgtacggtacgttaacgtttaagtttactacgttacgtaacgtaaacttaactttagtttacctagttaccgttaggtacggtactaaccgggtacgaaacggtacgaggttactaatacggtaacgaaggtacccgttagtaccggtcggtcncgtaacg

SEQ ID NO: 278646 - DNA, 674 bp, Homo sapiens
  misc_feature: GYAE6OF01A848X.19.71.G05.1.454.CMB.1.raw
  modified_base (367)..(367): a, c, t, g, unknown or other
  misc_feature (367)..(367): n is a, c, g, or t
  modified_base (446)..(446): a, c, t, g, unknown or other
  misc_feature (446)..(446): n is a, c, g, or t
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtcgcccgacgggacagtcgtgatcgaccctagtcctcagacctccgtggctgtcgtctcgtcgggacgaggccgggccaccacgtacaacgtgactaacgtccaacgcctaactaatttaccgtttaatacaacggttaccaaaactaataacgaaaaccttcgtagtcgttacggaccagcagtacgacgacggacacgcctacgtaggtctcgactactactttacgnggactacgtaccgtaacccgggtacgccgggtaccctacgaccgtattcgaggtcgcgcggtacggtccgtaggtactntacttcactccgtacacacgtacgacgtacacgtccgtacgcgtacggaccgttagaacgtacggtagtacggtagtttaaccgtttagttacgtttaagtaacctaaattaagtttactttaacgttacgttacgttacgtaggtaccgttaccgtaacgggtaacgtacggtaggttacggaacttacgtacgtaacggtacaacggttacgacgggtctcgtacg

SEQ ID NO: 278647 - DNA, 690 bp, Homo sapiens
  misc_feature: GYAE6OF01EKH7E.19.71.G05.1.454.CMB.1.raw
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagctccctggctgtgtctcgtgggcgagcgggccaccatcaactgcaagtccagccacaattcttttatactagtaccaacaatagaaaactacttagcgttggtaccagcagagaccaggacacgcctccgtaggctgctctatttacgtggcacgtccgtaacccgggtacgtcccggggtccctacggaccgtagttcgaggtggccgtacggcgggtcggtggggaactaggtactttaccaaccttcctacccaaccgtatccgacgcctacggcctacggaccgacgggtcctagggtaaagtagttggtacggtactttacgtttttaattacgtttacgtaacgtaaacttaaattttaattttaacgtttaattaaccgttttcggttaacgggttaccgtttaccgggaaaccgtaaacgggggtaacccgtaaggggtttacgaagttaacgtacgttaaacggtaaccggtaaccgttagggttaccgggtccgttacggtaaccccg

SEQ ID NO: 278648 - DNA, 757 bp, Homo sapiens
  misc_feature: GYAE6OF01CGELQ.19.71.G05.1.454.CMB.1.raw
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtcgcccgacggggacatcgtgatgacccagtctccagacctccctggctgtgtctcgtgggcgacggccggccaccatacaactgacaagtccagccaactaattcttttaacactacgttaccaaactaataacgtaaaactacttacgtacgttacggtaccagacagacgaccacggacacgcctccgtaggctgactactactttacgtcggacacgtaccgtaacccgggtacgtcccggggtcctacggtaccgtacttcgagtcggcgacggtcggggtacgtacgggactaggtactttaccgacttcctacctaacctactaccgacgtacgaaccgtccgtacgaccgacgggtacgtagggtaagtacggttacggttacgtaactttaaagtttttaacgtttacgtttaacgtaaccttaaaacgttaattttaaagttttaaactttaacgtttaaccggttttaacgggttaccgggtttaacccgggttaccgggtaaaccgggtaaacggggtaacccggttaaggggttacggttaacgttaaccggtaccgtaaacgggtaaccggttaaccggttagggtaccggtcgtacggtaacccg

SEQ ID NO: 278649 - DNA, 732 bp, Homo sapiens
  misc_feature: GYAE6OF01DGLCA.19.71.G05.1.454.CMB.1.raw
  modified_base (159)..(159): a, c, t, g, unknown or other
  misc_feature (159)..(159): n is a, c, g, or t
  modified_base (210)..(210): a, c, t, g, unknown or other
  misc_feature (210)..(210): n is a, c, g, or t
  modified_base (529)..(529): a, c, t, g, unknown or other
  misc_feature (529)..(529): n is a, c, g, or t
  modified_base (610)..(610): a, c, t, g, unknown or other
  misc_feature (610)..(610): n is a, c, g, or t
tcagtactctcgtgcacgaccggtgctcgatttagtgtcgtcgcaagagagagggggtcaggctggaactgaggagcaggcgagggcagcaagatggtgttgcagacccgaggtcttcatttctctgttgctctggatctcgtggtcgcccgacggganatcgtagactcgacccagtctccgagtcctcccgtggtctgtcgtctcggnggcgacggccggaccacgatacgatcgacgacgtaccacgacactaattcttttaacaaccgtattaacccaaaataagtaaaactaaaaccttacgttcgaccgtttacggaaacccaggaccaaacggtaaccgaacccgagggtaacctcccgtaccgtttacgggactcgttcgtacccttacgtaaacgttttccggcgggtaacctaccggttaacccggtaaccggggtaccgttcccccgggggtacaccggtaacgtaccttggaggtcgaccgtacgggtccggacgttagggactagttccgttaccnctacccacaactacgtccgagccgaacgccgtagcggtaagacgtaggaagtcgtagtcggttaacttagttgttaacgtnaaaacgttagttaattacgtttagtaaccgttcggttacggaccggtaaccgggttccgaaagggtaaccggaaggttaagacgtaaccgttaagacccgtaagggaacccgttaggtaggg

SEQ ID NO: 278650 - DNA, 805 bp, Homo sapiens
  misc_feature: GYAE6OF01DKRCS.19.71.G05.1.454.CMB.1.raw
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtcgcccgacggggacatcgtgatcgacccagtctccagacctccctggctgtgtctcgtgggcgagccggccacatcaactgacaacgtccacgccaactaatttcttttaacacctacgttaccaaacaattaacgtaaaacttacgttacgtcctttaacggtaaccaagccgaaaggacgaccgaaggaaccaccggtcccgttaccgtagggccttcggtccttacgttaagttttaccggacggggtacctaacgttaccccgggtaaccccggggtaaaccgttccccgggggttaccctacggaacccgttaacttcggaacgggttcggcgtacggggtccggggtcgtacggggaactaaggtttccttaccgtacctaccgtacctaccgtaactacgacgacccgacggtcctacggcgtacgggtactaacggaaagtcgtggttacgtacttttaaggttttatttacgttacgttaacctaaagttaatttaattttaacgtttaaccgtttacggtttacggggtacccgttaaccggggtttacccggtaacccgggtaaacgggtaaccggttaagggttaacggttaacgttaaaccgtccgtaaacgggtaacccggttaacgttgggtaccgggtctcgggtaacccc

SEQ ID NO: 278651 - DNA, 742 bp, Homo sapiens
  misc_feature: GYAE6OF01B8IBE.19.71.G05.1.454.CMB.1.raw
  modified_base (242)..(242): a, c, t, g, unknown or other
  misc_feature (242)..(242): n is a, c, g, or t
  modified_base (340)..(340): a, c, t, g, unknown or other
  misc_feature (340)..(340): n is a, c, g, or t
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatcgacccagtctccagactccctggctgtgtctcgtgggcgagccggccacatcaactgacaacgtccagccactaattctttanactacgttaccaagaacttagaaaactacttagcgttacggtaaccagcagacgaccgaggacctacgtccctcgtaggcctgtactctagtttacgngggcctaacgtaccgtaacccggggaactccccggggtacctacggaaccgtattccgaggtcggaccgtacgggccggggttacgtacggggtaactacgttacgtttaccgaccttccgtacccaacccgttaactaccgggtaacgcgtaaccgtccgtacggacgtacgggtacgttaacgggaaagttcgtacggttacggttaacctttaaggttttttacgttaatttccggtaaacctaaacgtttaaagtttaactttaaacgtttaccgttttacgtacggttacgggtaccggtttaacccggaaccggtaaacgggtacccggttaaagggtcgttaaacgtacgtaacgaacggtaacgtaacgttgggttacgaccgtcggtaacccg

SEQ ID NO: 278652 - DNA, 694 bp, Homo sapiens
  misc_feature: GYAE6OF01BYAJH.19.71.G05.1.454.CMB.1.raw
  modified_base (240)..(240): a, c, t, g, unknown or other
  misc_feature (240)..(240): n is a, c, g, or t
tcagtactctcgtgcacgaccggtgctcgatttagtgtcgtcgcaagagagagggggagagtctgctgaattctggctgaccagggcagtcaccagagctccagacaatgtctgtctccttcctcttcttcctgcccgtgctggccctcccacaaggtgtcctgtcacaagtacagctgcagcagtcaggtccaggactggtcgaacgccctcgcacgaccctctcgcctcaccgtgtcncctacgtccgtaccgggacacgacgtcgactagcgacgtaggttgttcgtcgttcggcgtacggtgggtacaggtccgaccgtaccccagtcggaggtagtcgtaggtagtcggcgtaggggacgtactattacgttctagtacgtacctaacgtacggttaaggtaaaacttaaactaaaagttatacgacctaccgtaagttcgttaggttagaaggtacgtacgtaacgtacgtaaactaactaacgtaaaccgtaacgaacctaacctaacgtaaccggaaaccgtaacccgttaccgttcccttacccgtacgtaccgtacgttaccgttccgtacccttcgtaccggttaccgtacccggtacccggtaagggaccggttacgggttaattacgtttaacgtacgtacgggtaccggtaaacggtacccgaccctaagtacgtacccg

SEQ ID NO: 278653 - DNA, 820 bp, Homo sapiens
  misc_feature: GYAE6OF01DV9GT.19.71.G05.1.454.CMB.1.raw
tcagtactctcgtgcacgaccggtgctcgatttagtgtcgtcgcaagagagaggggggaggtacaacaggcaggcaggggcagcaagatggtgttgcagacccaggtcttctatttctctgttgctctggatctctggtcgcccgacggggacagtcgtgatcgacccagtcctccagacctcccgtggcttgttgtctcgtgggcgacggccggccaccatacaactcgacaacgtccacgaccaacttaactttcgttttaacacctacgttaacccaaaactaacttaacgtaaaaccttacgtttacggtaccgtttacggtaaccagtaccaaggaaccgtaccgaaggaccaccgtcccttaccggtaggtcctcggtaccttacgttaacgttttacggcgggtacctaccggtaaccccgggtaaccccggggtaaccggttcccccggggtacctaccggtaacccgtacgttcggacggtcggaccgtacgggtccggggttacgtacgggaactacgttacctttccgacctccctaccacctacgtacgacgtcccacgtcccgtgaccgagtacgtagggaacgttgttcggtacggttactttagttttaacgttacgttaacgtaaccttaaagtttaacgttttacttttaacgttaccttcgggtttaccgggtttaaccgggttaccggttacccgggaaaccggttaaacgggggtaacccgttaagggggttactaaaccttaacgggtaacccgaacgggtaacgttaaccggttggggtacccgtcgtacccgtaccg

SEQ ID NO: 278654 - DNA, 807 bp, Homo sapiens
  misc_feature: GYAE6OF01CLMKY.19.71.G05.1.454.CMB.1.raw
  modified_base (773)..(773): a, c, t, g, unknown or other
  misc_feature (773)..(773): n is a, c, g, or t
tcagtactctcgtgcacgaccggtgctcgatttagtgtcgtcgcaagagagaggggggaggtacaacaggcaggcaggggcagcaagatggtgttgcagacccaggtcttcattttctcttgttcgctctggattctctggtcgcccgacgggactagtcgtgatcgaccctagtcctccagtcctcccgtggctgttgtccgtcgtacgggcgacggccggaccacgatacgaacttcgacctaacgccaacgcctaattaactttcgtttaacacgtacttaaccaagaaacgttaaactaaaccgttacttaagtaccgtttaacggaaccctaggacaacggcgaaccgtacgggaccaacgtccccttcgtaaccggtcttaaccgtacctttacgttaacgtttacgtcgggtaccttaccgtaccccgggtaacccgggtaacggttccccggggtaccccttaaggtaaccggttacttacggacggttcggaccggtacgggttccgggtacggtaggaaccttagttaccttaccgaccttccgtaccaacctagtccgtaaccgtctaacggtcgacgacgtacggtactacggtaaagtcggtacggttgttaaccgttttagttaactttcgtaagtaacgtttaaaccttaggtttaactttaaacgttttcgtaccggtttacgggtaccgttaccggtaaccggtaacgggtaaaccggtacgttagggtaacgttacgtaaacggcggtttaaacnccgggtttaaagttacgggccttacgaagttccc

SEQ ID NO: 278655 - DNA, 761 bp, Homo sapiens
  misc_feature: GYAE6OF01CW95I.19.71.G05.1.454.CMB.1.raw
  modified_base (297)..(297): a, c, t, g, unknown or other
  misc_feature (297)..(297): n is a, c, g, or t
  modified_base (582)..(582): a, c, t, g, unknown or other
  misc_feature (582)..(582): n is a, c, g, or t
  modified_base (663)..(663): a, c, t, g, unknown or other
  misc_feature (663)..(663): n is a, c, g, or t
tcagtactctcgtgcacgaccggtgctcgatttagtgtcgtcgcaagagagagggggagagtctgctgaattctggctgaccagggcagtcaccagagcctccagacaatgtctgtcctccttctcttctcctgcccgtgctcggcctcccacgaggtgtacctgacaacgaagtcagcgtcgacacgcaggtccgaacggtccagggtacgtgggtacgaaccgcccgtcgccgtaccgtcccctccgtccgcctcctaccgtcgtccgaccgtacgtcccgggtaccggggaacncggtacggtccgacgtaacggcgtacgtggttcgtcggttacggtcggaccgtccggttggaccgacggccctaacccgggttccctagggtaccggtaaggtacgggttacggtaaggccgggtcgggtacgggttaaacgggggaaacgttacctttagtttaacgttaccgaacgtttacccgaacccgtaacggaacggttaaagtaaacttaaacgtaaatttccggacgaccgtaaccttgtacgtgggttaagacggttaacgtcgaactacggtaanaaccgttacgaaacggtaccaagtaaccgaagtaaccggtaactaaccgttccgttaccctcgacgggtactacccgggtntaccctacgttccggaccggttacgaaccccgtaggacggtaacgtcgggtactacgtttagcgttagggacgaacccgacccgtacggaatcgtacg

SEQ ID NO: 278656 - DNA, 706 bp, Homo sapiens
  misc_feature: GYAE6OF01BGK18.19.71.G05.1.454.CMB.1.raw
  modified_base (243)..(243): a, c, t, g, unknown or other
  misc_feature (243)..(243): n is a, c, g, or t
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccaggggacatcgtgatgacccagtctccagactccctggctgtgtctcgtgggcgaggcgggccacgatcaactgactaacgtccagccactaattctttanactagttaccaataatacgtaaactactacgtcttacggtaccagacagacgaccaggacacgtcctccgtaggctgctctattacgtcgggctacgtaccgtaacccgggtaacgtcccgggggtaccctacggtaaccgtgttacgacggtcgggtaccgacgggtccggggttaccgtcggggtaacaacggttacgtttacctacgttacctaccacccgtaactaccgaaccggtacgtaaccggtccgtacggaccggtagggtccgttaagggaacgttagtcgggtacggtacgttaagttttaacgtttaagttacgtaactaaacttaattaacttttaagttaccttacgttacgggttaccggtaaccggtttaccggaccggtaaacgggtaccgtagggttacgtagtactacgaacgtacgttaacgtcggttacggtcgagtacccg

SEQ ID NO: 278657 - DNA, 645 bp, Homo sapiens
  misc_feature: GYAE6OF01CBWTB.19.71.G05.1.454.CMB.1.raw
  modified_base (140)..(140): a, c, t, g, unknown or other
  misc_feature (140)..(140): n is a, c, g, or t
  modified_base (255)..(255): a, c, t, g, unknown or other
  misc_feature (255)..(255): n is a, c, g, or t
  modified_base (369)..(369): a, c, t, g, unknown or other
  misc_feature (369)..(369): n is a, c, g, or t
  modified_base (465)..(465): a, c, t, g, unknown or other
  misc_feature (465)..(465): n is a, c, g, or t
  modified_base (484)..(484): a, c, t, g, unknown or other
  misc_feature (484)..(484): n is a, c, g, or t
  modified_base (493)..(493): a, c, t, g, unknown or other
  misc_feature (493)..(493): n is a, c, g, or t
  modified_base (498)..(498): a, c, t, g, unknown or other
  misc_feature (498)..(498): n is a, c, g, or t
  modified_base (607)..(607): a, c, t, g, unknown or other
  misc_feature (607)..(607): n is a, c, g, or t
  modified_base (634)..(634): a, c, t, g, unknown or other
  misc_feature (634)..(634): n is a, c, g, or t
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtcncccgacggggacatcgtgatcgacccagtctccagacctcccgtggctgtgtctcgtgggcgaggccgggtccacgatacgaactgactaacgtccagccaactattcttttaanactacgttaccaaataattacgtaaaaaccttcgttagctttggaacccagtaccaggaccgaaccgtaggaccacggtcccttacgtaggtctcgtcctactattttaccggngggactacgtaccggtaaccccgggattccccgggggactacggacccttagttccgaggtccggcgacggtcggggtctaggactagtaccttcncgtcctacgaccatcgacncgagtccgngacgngtactagaagtcgtcggtagtacgttagtttagttatacgtaactaattaatttaatttacgttatccggttcgtacgttcggtacgaaccggtaacggcgttaaaggnggttacacgtagacgtacgagttggcncgtctaacccg

SEQ ID NO: 278658 - DNA, 713 bp, Homo sapiens
  misc_feature: GYAE6OF01CC4LP.19.71.G05.1.454.CMB.1.raw
  modified_base (241)..(241): a, c, t, g, unknown or other
  misc_feature (241)..(241): n is a, c, g, or t
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagacttcctggctgtgtctctgggcgagcgggccacatcaactgcaagtccagccaactaattcttttaanactacgttaccaaacaatagaaaactacttagtcgttagtacctagcagacgaccagacacgcctccgaggctgctactatttacgcggactactaccgtaacccgggtactcccggggtcctacggacccgtagttccgaaggtcgggaccgacggtccggggtcgtacgggaacgtagttactttccgacttacgtaccctacctacgttaccaagggacccgtacgtacccgtacggaccggtaaggtacccgttaagggaaagtaccggttgggtaccggttaagtttaaggttttttacttaacgtttacggttaaactaaacgttaaatttaagtttaactttaacgttcctttaacgggttaggtacccggtttacgggaaacccggttaacggggaaacccgttaagggtacggttaacacgttacaacgggtaacgtaacggttagtcgggtctcgggtaacc

SEQ ID NO: 278659 - DNA, 821 bp, Homo sapiens
  misc_feature: GYAE6OF01B7CNB.19.71.G05.1.454.CMB.1.raw
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactcccgtggctgtgtctcgtgggcgagcgggccaccatcaactgcaagtcccagccactattctttatacacgttaccaataatagtaaaacttacttagcttacggtacctagaccgaagaagaaccgaggacacgtccctaccgtaggtacctgtacctctaacttttaccgtggggacctactaccgtaacccgggaacgttcccgggggtccctacggacccgtatttccgacggttcggacgtacggtcgggtacgtggggaactagtactttccgacgttaccgtaccaccgtacgtccaacggacccgtaacgtccgtacggaccgtacgggtaccgttaacggaaaggtacgttaggggtacggttacccgttaaggttttttaagttaacggtttacgtttaacccgtaaaacgtttaaagttaattttttaacgtttaacgtttacccggttttaccgggtttacggggttaacccgggtttacccggggtaaaccccgggttaaaacggggtaaacccccgggttaaaggggttacccggttaaaggtttaaacccttaacggggttaaaccgggtaaaacccggttaaacggtttacccggggtacggttaacccggttaaccggtaacccccggg

SEQ ID NO: 278660 - DNA, 808 bp, Homo sapiens
  misc_feature: GYAE6OF01EBSBV.19.71.G05.1.454.CMB.1.raw
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccgacggggacatcgtgatcgacccagtctcagacctccctggctgtgtctcgtgggcgaggccgggccaccatcaactgacaacgtccacgccaactaacttcgttttaataccgtacgttaccaaaacgtaaataacgtaaaaacctttacgttaacgtccgtttacgggtaacccaaggtaccgaaggaaccggaacccgaaggaaccaccggtccccttaccggtacgggcctcggtaccttacctaacgttttaccggacgggacctaaccgttaccccggtaaccccggggtaaccgttccccgggggttacccctacggtaacccgttacgttaccgagggttcgggaccggtacgggtccggggttacggtacggggtactaacggttaccttttaccaccgtttcccgtaaccaacctaacgtacgaaccgtccaacggtcccgttagggacccgacgggttacgtaacggaaacggttgttcgggtacggttaactttaagggtttttaactacgtttacgtaactaaacgtttaaatttactttagtttaacgttaccggttggtaaccggtaccgttaccggacgtaaacggggtacctaaaggggtcttaacgtaactaggaaacggtacgtacggtggtctaccggctaacccg

SEQ ID NO: 278661 - DNA, 693 bp, Homo sapiens
  misc_feature: GYAE6OF01BQRDN.19.71.G05.1.454.CMB.1.raw
  modified_base (244)..(244): a, c, t, g, unknown or other
  misc_feature (244)..(244): n is a, c, g, or t
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctcgtgggcgagccgggccaccatcgaactgacaacgtccagccacaattcttttanactacgttaccaactaatacgaaaacttacttagcttcggtaccagcagacgaccaggacacgcctcgtaggctgctactatttacgtgggacacgtccgtaacccgggtaacgtcccggggtaccctcgaccgtacttcgaggtcggcgaggtcggggtacgtgggactaggttactttaccacttccgtacctaaccctacgttaccgacggtaccaaccggtccctacggaccgtacggtacgtaaggaaacgtacggttggtacgggtactttaagtttttaacgttacgtttacgtaactaaacttaagtttaattttaacttaacgttacgtttacgggttcggtaacccggtttcgggaacccgtaaggggtaaccgtaagggttacggtaacttaacgacgtaacggtaaccgttaacgtcggtacggtaccgttgacccg

SEQ ID NO: 278662 - DNA, 759 bp, Homo sapiens
  misc_feature: GYAE6OF01E05PT.19.71.G05.1.454.CMB.1.raw
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccgacggggacatcgtgatcgacccagtctccagactccctggctgtgtctcgtgggcgagcggccacatcaactgacaatccagccaactaattcttttatactagttaccaaactaataacgtaaaaccttacttagtacttacggtaccagacaacggacgaaccgaggaccacgtcccttaccgtacggctcgtacctccttaagtttaccgtcgggactaccgttacccggtaacccgggtaaccggtccccggggttaccctacggtaacccgtatttaccggaaggttcgggaccgtacgggtcggggttcgacgggtactaggttactttaccgaccttcgacctaccgtacgtaccgtacgaccgtaacgtccgtacggaaccgacgggtacgtaaggtaacggtacgttacggtaggtaccttaagtttttaacttggttaccgtaacctaaacgttaactttaacgtttattaaccgtttacggttaccggttacgggtacccggtttaccgggaaacccgtaaacgggggttaaaccgtaaggggttacgtaacgttaccgtacggtaacgggtaaccgtacggttagcgggttaccacgtacccgg

SEQ ID NO: 278663 - DNA, 788 bp, Homo sapiens
  misc_feature: GYAE6OF01EAQVW.19.71.G05.1.454.CMB.1.raw
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtcgcccgacggggacatcgtgatcgacccagtctccagacctcccgtggctgtgtctcgtgggcgagccggccacatacaactgacaacgtccacgccataacttctttaactacctagttaccaaataacgtaacgtaaaaccttacttagtactttacggaacctagacgtaacgacgtaaccgaaggtaccacgttcccttaccggtaacggtccttacggtacctttacgtaacgttttacgcgggacctaacgttacccggtaacccggggtaacgttccccgggggtacctaggtaaccgtacgttacgacggtcggacgtacgggacggggttctacggggaactacggtttaactttccgaaccttccgtacctaacccgtaagtaccgacgaccgtacgtaccgttacggacgtaccgggtacgtaacggtaacgtacgttcgggtacggtaactttaaggtttacttaacggttaacgtaactaaacgttaactttaagtttactttaacgttaaccggttcggtaaccggttaccgggtaacccgtaaacgggtaaccgggttaaacgtaagggttacgtaacgtaaccgtacggaaacggttaacccggtaattccgggttacggactccggtaaaccc

SEQ ID NO: 278664 - DNA, 847 bp, Homo sapiens
  misc_feature: GYAE6OF01CZHZB.19.71.G05.1.454.CMB.1.raw
tcagtactctcgtgcacgaccggtgctcgatttagtgtcgtcgcaagagagagggggtcaggctggaactgaggaggtacaacaggcaggcaggggcagcaagatggtgttgcagacccaggtcttcatttctctgttgctctggatctctggtcgcccgacggggacatcgtgatcgacccagtctccacgacctcccgtggctgtcgttctcgtggggcacggccgggaccaccataccaacgtcgacaacgtccacgccaacttaatttacttttaacaccgtacgttaccaaactaaattacgtaaaaaccttacttaggacgtttaccggtaaccgagacgacggaacgaaccgacgggacacgtcccgtacctacggtctacgtaccttacgttacgtttaacgcgggactacggtaccggtaacccgggtagtccccgggtacctaggacccttagttcgacggtcggacctacgggtaccgggtcgtacggggtaacttaaggttcttttacccaccgttaccgtaacctacccgtagtacccgacggtaacccgtccgtacccgttacgggaccgtaaccgggtacgttaaggtaaacgttcggttaccgggttacggttaacttttacggtttttaaagttttcggtttaacgtaaaacccgttaaaatttaaacgttttaaacgtttaacgtttaaaccgttttcccggtttacgggttaaccggggtttaaacccgggttaaccccgggttaaacccgggggtaaaacgggttaaccccgggttaaaaggggtttccgggtaaaccttaaacggtaacccggttaaaaaccgggg

SEQ ID NO: 278665 - DNA, 651 bp, Homo sapiens
  misc_feature: GYAE6OF01BQQXJ.19.71.G05.1.454.CMB.1.raw
  modified_base (241)..(241): a, c, t, g, unknown or other
  misc_feature (241)..(241): n is a, c, g, or t
  modified_base (253)..(253): a, c, t, g, unknown or other
  misc_feature (253)..(253): n is a, c, g, or t
  modified_base (463)..(463): a, c, t, g, unknown or other
  misc_feature (463)..(463): n is a, c, g, or t
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccgacggggacatcgtgatgacccagtctccagactccctggctgtgtctcgtggcgagcgggccaccatcaactgcaagtccagccactaattcttttanacagttaccaanaatagaaaacttactagcttaggtaccagcagacgaccaggacacgtcctccgtaggctgctacgtactttacgtggctacgtaccgtaacccgggtaacgttcccggggtccctagaccgtacttcgagtcggcgtacggtccgggtacgtagggacctaaggttacttttaccgaccttaccgttacaacccgtataccgacggtacnccgtccgacggccgtacggactaggaacgtacgtggtacgttacgttagttttacgttacttacgtaactaaataatttaatttacgttaacttaccgttacggtacggttaaccggttccggaaccggtaacggtaacgtaggtaggtactacgtagacgtaacgtacgttggacgtgtcgtacccg

SEQ ID NO: 278666 - DNA, 756 bp, Homo sapiens
  misc_feature: GYAE6OF01B6TD1.19.71.G05.1.454.CMB.1.raw
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtcgcccgacggggacatcgtgactcgacccagtctccagacctcccgtggctgtgtcctgtggggcgaggccggccaccgatacactcgacagtccacgaccactaattctttacacgtacgttaccaaataatacgtaaaaacttacgttaggtacgttacggtaaccagactaacggaacgaaccgaagggtaaccacccggtacccttaccggtaacgggtcctacggacctttacgttaacggtttaccggtacggggaccttacggtaaccccgggttaacccgggtaaccggttccccgggggtacctacgggaccttagttccgagggtcggcgtacggggtaccgggttgtacggggtaactacgttactttacgaccttccgacctacctagtaccgacgcgtaccgtcgacgacggacggtacgtagtaacgtcgtacgggtacgttaccgtttaagttttacgtcgttacgtaactaaagtttaagtttaacgttaattaccttacggtttcggtacggttaaccggtccggtaacggtacggaaccgttagggacggttaacctaggtaccgagttaacggtacggtagtcgtaagtccgtaaaccg

SEQ ID NO: 278667 - DNA, 702 bp, Homo sapiens
  misc_feature: GYAE6OF01AL7WL.19.71.G05.1.454.CMB.1.raw
tcagtactctcgtgcacgaccggtgctcgatttagtgtcgtcgcaagagagagggggcagagtctgctgaattctggctgaccagggcagtcaccagagctccagacaatgtctgtcctccttcctcttcttcctgcccgtgctgggcctcccacaaggtcgtcctgtcacaagtacagctgcagcagtcaggtccaggactggtgaacgccctcgcacgaccctctccgctcacctgtcgccatccgtccggggacaggacgtcgctagcgactagtcgttgcgttggcacgtgggtcaggcacgtcccagtcgagtaggtactaggagtcggacgtagggaacgactaattacgtttacacgttacggtacccaaacgtacggtacggtaaaacttaacgtaaaatttacgacggtaccctaaccgtaagtttccgttagggtttacgaacggtaacggttccgaacgttacggaaacctaagtacccggtaaaacggttacgaacctaacgtaacgtaaaccggaaaacggtaacccctaacggtttccctaccccgtgtaccgtacgtaccgttacgtacccgttagtaccggttaccggacccggtttacccgggaacggtacccggtacgggttagttaacttacggttaacgtacgggtacggaaaccgtacccggtaccccgtaagtaaaccgg

SEQ ID NO: 278668 - DNA, 670 bp, Homo sapiens
  misc_feature: GYAE6OF01C5W9W.19.71.G05.1.454.CMB.1.raw
  modified_base (572)..(572): a, c, t, g, unknown or other
  misc_feature (572)..(572): n is a, c, g, or t
tcagtactctcgtgcacgaccggtgctcgatttagtgtcgtcgcaagagagagggggtcaggctggaactgaggagcaggcaggggcagcaagatggtgttgcagacccaggtcttcatttctctgttgctctggatctctggtcgcccgacggggacatcgtgatcgacccagtctccagacctccctggctgtgtctcgtgggcgagccgggaccaccatacaactgacaacgtccagccaactaattctttttaacacctaagtttaccaaactaataacgtaaaacctacttaggctttacggtacccagcaaggacgaaccaggacacgtcctaccgtagctgcctactagtttacgcgggcaacgttacccgtaaccccggggtacgtccccgggggtcccttcggaaccgtgttaccgacgggtcggacgtacggggtcgggtacgtacggggactaggttacctttaccgaccttccgtaccaaccctagtaccaacggtccgacgtcccgtagccgtacggctaaggaacgtgtggtacgttacgttagtttttactaagttntaactaactattaactttattcttaccgttggtacggtaccgttaccggacgtaaacgggtcgtaagggtgtaactacgacgaacggacgtacgtcgg

SEQ ID NO: 278669 - DNA, 829 bp, Homo sapiens
  misc_feature: GYAE6OF01AEDJR.19.71.G05.1.454.CMB.1.raw
  modified_base (253)..(253): a, c, t, g, unknown or other
  misc_feature (253)..(253): n is a, c, g, or t
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtcgcccgacgggggacatcgtgatcgacccagtctccagacctcccgtggctgtgtctcgtggggcgaggccgggccaccatacaactgacaagtccagccactaacttcttttanactacgttaccaaacgtaatacgtaaaacctacgttagtaccgttacggtaaccaggacgaacggacgaacccgaagggtaaccaccggtaccccttaccgtacgggtccttcggtaccttacttaacgttttaccggcggggtacctaccgttaccccgggtaacccgggtaccggttccccgggggtaccctacggtaacccgtagttacccgagggtccgggaccgtacggggtccgggttacggtacgggtaacctacggtttacgtttaccgacccgttaccgtacccaacccgtacgtaccgacgggtacccacggtcccgtggtaaccgacgggtacgtaacggaaggttacggttaggttacgggttactttaagtttttaacgttacgtttaacggtaaacccttaaagtttaatttttaacttttaaacgtttaaccttaccgggtttacgggttaaccgggttaccgggtttaaacccggaccgggttaaacggggtacccgttaaaggggtcggtaaatacggtaacgaacggtaaccggttagtcgggtactcgtccggtacc

SEQ ID NO: 278670 - DNA, 705 bp, Homo sapiens
  misc_feature: GYAE6OF01EEX1T.19.71.G05.1.454.CMB.1.raw
  modified_base (196)..(196): a, c, t, g, unknown or other
  misc_feature (196)..(196): n is a, c, g, or t
  modified_base (433)..(433): a, c, t, g, unknown or other
  misc_feature (433)..(433): n is a, c, g, or t
tcagtactctcgtgcacgaccggtgctcgatttagtgtcgtcgcaagagagaggggggaggtacaacaggcaggcaggggcagcaagatggtgttgcagacccaggtcttcattttctctgttgctctggatctctggtcgcccgacggggacatcgtgatcgacccagtcctcagacctccgtgctgtgtctcgnggcgagccggaccacgatacaacgtgacgaacgtccacgacctaactaactttcttttaactactaacgttaccaaaactaacgtaaacgtaaaacctttacgttacgtaccgttacggtaccagacacgacgaccgaacggcaacgtccctacgacggctctctaacttacgtttacgcggtactaccgttaccggtaaccggggtaaccgtcccggggtaccctacggtaccgtnttacggaggtcgacggtacgggtcggtacggtacggtaacgtacttaacctttcgacccttactaccgactacgtacgacgcacggtcctggaccgtacggactaaggtaagtgttacggtaggtaactttgtttaacgttattaaccgtaataaacgttaatttaacgtttattacgttacgttcggtaacggttcgtaccgacggtaacgggaaccttagggtactaaagcgtaagtaaaccggtacgttacggtacggctcgactaccg

SEQ ID NO: 278671 - DNA, 668 bp, Homo sapiens
  misc_feature: GYAE6OF01AGSBT.19.71.G05.1.454.CMB.1.raw
  modified_base (188)..(188): a, c, t, g, unknown or other
  misc_feature (188)..(188): n is a, c, g, or t
  modified_base (238)..(238): a, c, t, g, unknown or other
  misc_feature (238)..(238): n is a, c, g, or t
  modified_base (250)..(250): a, c, t, g, unknown or other
  misc_feature (250)..(250): n is a, c, g, or t
  modified_base (253)..(253): a, c, t, g, unknown or other
  misc_feature (253)..(253): n is a, c, g, or t
  modified_base (535)..(535): a, c, t, g, unknown or other
  misc_feature (535)..(535): n is a, c, g, or t
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtcgcccacggggacatcgtgatcgacccagtctccagactccctggctgtntctctcgggcgagcggccacatcactcgcaagtccagccacattctttanacagttaccaanaanacgtaaaactcttagcgttaggtaccagtacacgacgaccaggacacgcctcgacggactgctctatttacgcggctacgtccgtaacccgggaactccccggggttaccctacggtaccgtactttcggaggttacggccgtacggtcggggttccggtagggtaccaaggttacttttccgaaccgttcccgttaccaaccgtactacgacgaccgtaccgtctaacggccgaacggcgtacgtaagtacgttcggtcgtacgttaagttttaacgtttnttactaacgaacgttaacttagttttaacttacgtactttacggtacggtcgtttaaccggacggtaacggtaaccgtaaggtacggtaatacgtaacgagtaaaccgttacggtgtaaccgtgtacgtaccg

SEQ ID NO: 278672 - DNA, 800 bp, Homo sapiens
  misc_feature: GYAE6OF01C61M1.19.71.G05.1.454.CMB.1.raw
  modified_base (576)..(576): a, c, t, g, unknown or other
  misc_feature (576)..(576): n is a, c, g, or t
  modified_base (648)..(648): a, c, t, g, unknown or other
  misc_feature (648)..(648): n is a, c, g, or t
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctcgtggtcgcccgacggggacatcgtgactcgaccctagtctaccagacctccgtggctgtgtcgtcgtgggcggacggccggaccacctatacaactcgaacaacgtccacgacctaactattcctttaataacgtacttaaccaaataacgttaacgtaaaaccttacgtttaacgtcggtttaccggtaaaccagtacaaacggtaacccgaacgaaccgggaaccaccgttaccccgttccggaaggtcctacgtaccctttacgttaacgttttaccgcgggtaacctaccgggttaaccccggtaaccccggggtaacggttcccggggtacccttacgaacccggttatcggtaacgggtcggaaccggtacggggttcggtacggttacgggaactacggtttacgtttaccacgttaccaccgaaccgtataccncggtaccaccgtcgacgggtacgacgtaacgtacgggaatcgttaggtaccggttatttaacgtttaggttnttaaccgtaaattaaacttaagtttactttaacttacggtttacgttacgggttaccggtacgggttaccccggaaacggaacggtaacgtaagggtactaacgttacgaacggtaacgtaaaccgtacgttggtacccggaatcggtaacc

SEQ ID NO: 278673 - DNA, 828 bp, Homo sapiens
  misc_feature: GYAE6OF01E43G3.19.71.G05.1.454.CMB.1.raw
  modified_base (262)..(262): a, c, t, g, unknown or other
  misc_feature (262)..(262): n is a, c, g, or t
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtcgcccgacggggacatcgtgatcgacccagtctccagacctcccgtggctgtgtctcgtgggcgacggccgggccaccatacaacgtgactaacgtccacgacctaactaatttccgttttaanaccgtacgttaccaaactaaagtaaccgtaaaaacctttacgttacgtacgttacgggtaaccacggtacgacggaacgtaaccgacgggaactaccggtacccttccgtacggtccgttcgtaccgttacttaacgttttacggcgggaccttaaccggttacccgggtaaacccggggtaacggtttcccccgggggtaccctacgggtaacccttaggttccgtaacgggtcggaccggtaacggggttccgggtaccgggtacgggaaccgtacggtttacctttaccgtaccgtacccgtaccctaaccgtacttaccggacgtaccgtaaccgttccgacggtacgtacgggtacgtaacggtaagttccggttagggtaccgttagttttaacgtttaacgttagtttaccgtaaactaaacgtttaagttttaaactttacgtttaaccggtttacgttaccgggttaggttacccgggttaccggaaccggttaacgggtacccgtaaggtacgtatacgtacgaacgtacggtacgtaggacgtcgtacgtacccg

SEQ ID NO: 278674 - DNA, 928 bp, Homo sapiens
  misc_feature: GYAE6OF01EM1YO.19.71.G05.1.454.CMB.1.raw
  modified_base (269)..(269): a, c, t, g, unknown or other
  misc_feature (269)..(269): n is a, c, g, or t
tcagtactctcgtgcacgaccggtgctcgatttagtgtcgtcgcaagagagagggggtcaggctggaactgaggagcaggcaggggcagcaagatggtgttgcagacccaggtcttcatttctctgttgctctggatctcgtggtcgcccgacggggacattcgtgagtcgaccctagtcctccagacctcccgtggctgtgtctcgtgggcgaggccggaccaccataccaacgtcgacgaacgtccacgcccaactacttcttttanactacgttaccaaactaaataacgaaaacttacgtacgtacgttacggtaaccaggtacgaacgaccgaaccgaacgggaacctaccggtccccttaccggtacgggtacccttacgtcttaaccttaacggttttaaccggtcgggtaacctaaccggttaccccgggttaaacccccgggggtaaccgggttcccccgggggtaccccgtacggtaacccgtacgtttaccgacgggttacgggcgtaccgggtcgggttcggtaacgggtaacgtacggttaccgtttacccacccgtttaccgtaacccgaacccttaacgtacctacgggaccgtaaccggtcccgtacggaaccggtacgggtaccgttaaaggaaggttaccggttgggtaaccgggtttaacttttaacggttttttaagtttaaacggtttaacgtttaaaccgtaaaacttttaaacgttttaacttttaaacgttttaaacccgttttaccggttttacgggtttaacccgggggtttaaccccggttttaacccgggggaaaacccgggtaaaacccgggttaaaccggggtttaaagggttaacggttaaacgtttaaacccgtaacgggtaaaacgggttaacccggttaagggttacccggggg

SEQ ID NO: 278675 - DNA, 718 bp, Homo sapiens
  misc_feature: GYAE6OF01CRL9E.19.71.G05.1.454.CMB.1.raw
  modified_base (240)..(240): a, c, t, g, unknown or other
  misc_feature (240)..(240): n is a, c, g, or t
  modified_base (328)..(328): a, c, t, g, unknown or other
  misc_feature (328)..(328): n is a, c, g, or t
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagccgggccaccatcaactgcaacgtccagccacaattctttanactacgttacaaacaatagtaaaactacttagcttaggtaaccagacagagaccaggacagcctcctaggctagcttacagttttacngggtacctacgtaccgtaacccgggaacgttccccgggggtccctacggtaacccgtacttacgaggtcggtcgacgggtcgggtcgtaggggaactacggtactttaccgaccttacgtacctacctaacgtcgaacggctacgaccgtacgccgaacgggtcgtaacggaagtacgttacggtacgggtactttaagtttttaattaacgtttacgtaaaccgtaaaaccttaattttaagttttaactttaacgtttaccggttttacgggtaacgggttaacccgggttacgggaacccggtaaacggggtaaacccgtaaggggttacggtaaattacgtacgaacggtaaccggttaacgttagggacggtcgttcgaaacccg

SEQ ID NO: 278676 - DNA, 807 bp, Homo sapiens
  misc_feature: GYAE6OF01D47V3.19.71.G05.1.454.CMB.1.raw
  modified_base (244)..(244): a, c, t, g, unknown or other
  misc_feature (244)..(244): n is a, c, g, or t
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatcgacccagtctccagactccctggctgtgtctcgtgggcgaggcgggccacatcaactgcaacgtccagccactaattcttttaanacacgttaccaacaatacgaaaacttacttagctttacggtaccagacagaacgaccaggacacgccctacgaggctgtctctatttacgtgggactacgttaccgtaacccgggtaacggtcccgggggtaccctacggaacccgtagttaccgacggtcggaccgtacgggtaccggggttcgtacggggaacctaggttacctttaccgaccgttacctacccgtaaccctaagtaccgtaacggacccgtacggtcccttggaacccgtaggggtcccttaagggaaaccgtaggttacgggttacgggtaccgtttaaggtttttaacgtttaagtttaccggtaacctaaaaaccgtttaagttttaaacgttttaacgttttaaaccgtttaccgtttaccggggttaacgggttaacccggggtttaccccgggtaaacccgggtaaaaccgggggtaacccgttaaagggggttacgggtaaactttaaccggttaacgaaaccggtaaacggtacccggttaagggttacgggttccctaaccggtaaccccg

SEQ ID NO: 278677 - DNA, 651 bp, Homo sapiens
  misc_feature: GYAE6OF01EK308.19.71.G05.1.454.CMB.1.raw
  modified_base (320)..(320): a, c, t, g, unknown or other
  misc_feature (320)..(320): n is a, c, g, or t
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcggccacatcaactgcaagtccagccactattcttttatacagttccaaacaatagaaaacttacttagtcttaggtaccagcagacgaccaggacacgcctcctaggctcgctctatttcnggctactccgtaacccgggactcccggggtacctcggaccgtattccgagtggcacggcgggtacgtggggaactaggtactttccacgttctacctaccactcaagtccgacgccgtcggccgaggtcctaggaaagtacgtggtacggtacttagttttaacgtttagttacgtaactaaacttaaatttaacgtttaatttaacgttaccgttttcgaacgggttaccggtttacccggaacccggttaaacgggtaacccgtaaagggttaggtaacttaagtaccaaacggtaccgtaaacgttaggtacggtccgtcggtacccg

SEQ ID NO: 278678 - DNA, 662 bp, Homo sapiens
  misc_feature: GYAE6OF01A97GB.19.71.G05.1.454.CMB.1.raw
  modified_base (502)..(502): a, c, t, g, unknown or other
  misc_feature (502)..(502): n is a, c, g, or t
  modified_base (545)..(545): a, c, t, g, unknown or other
  misc_feature (545)..(545): n is a, c, g, or t
tcagtactctcgtgcacgaccggtgctcgatttagtgtcgtcgcaagagagagggggagagtctgctgaattctggctgaccaggggcagtcaccagagctccagacaatgtctgtctccttcctcttcttcctgcccgtgctgggcctccacaaggtgtcctgtacacaagtacagctgcagcagtcgaggtccaggctggtgaacgccctcgacacgaccctcgtcgcctcactgtcgacctagtccggtccgggacgagtacgtccgacgtacgcgacgtgttcggttgtcgttcggactcggtcgggtacgacggcctacgtaccccgagtcggagtcggtacgtaggaggtcgggaggtaggggaagtacgtagttacttacgtagtcgaaccgtaacgtacggtaagtaacgtaacgttaaactgtacgaccgtactgttacggtttagtacggtagtacctacgtaagtacgtaactaaccgttacaacggttanacccgtataacgttaaccgaaacgtaccttcgttaccaccggntaacgcgtaccgtacgtcctacgtcgttacgacccggtacgaaccgggtacgtagggttacttaattacccggtagttaagggaccgtaacgggaccccgtaccgtaagaccgtacg

SEQ ID NO: 278679 - DNA, 750 bp, Homo sapiens
  misc_feature: GYAE6OF01DRS2A.19.71.G05.1.454.CMB.1.raw
  modified_base (256)..(256): a, c, t, g, unknown or other
  misc_feature (256)..(256): n is a, c, g, or t
  modified_base (366)..(366): a, c, t, g, unknown or other
  misc_feature (366)..(366): n is a, c, g, or t
  modified_base (426)..(426): a, c, t, g, unknown or other
  misc_feature (426)..(426): n is a, c, g, or t
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctcgtggtagccccgacgggggacagttcggtgatcgaccctagtctccgagacctccctggctggtcgtctcgtgggcgagcggccacgatacaactgacaagtccagccactaattctttaanactacgtaccaaactatacgaaaacttacttagtcttaggaccagtaccgaagacgacccgaggaaccgacgtccttaccgaggtcgtacgccttactaacttttacggngggacctacgttacccggaacccgggtacgtcccggggtaccctacgacgtacgttacgnggtcggacgacgggttcgggtacgtagggacctagtttaccttacgacccttacctaccacccgtaacgtccgaacgacccgtaacgtcccggtcggaccgagggtaccctaagggtaacgtacggttcggtacggttaactttaaggttttaatttacggttacgttaaccttaaagttaatttaaacgtttagtttaaccttagtttaccgggtacggttaccggtaccgggtaaccgttaaacgggggtaaccttaaggggtctaaagttacccggtaacggacggttaaccggtaggtttacgggacgttgtacgtaacg

SEQ ID NO: 278680 - DNA, 933 bp, Homo sapiens
  misc_feature: GYAE6OF01AQMY9.19.71.G05.1.454.CMB.1.raw
tcagtactctcgtgcacgaccggtgctcgatttagtgtcgtcgcaagagagagggggcagagtctgctgaattctggctgaccgagggcagtcaccagagctccagacaatgtctgtctccttcctcttcttcctcgcccgtgcgtcggccctccacgtaggtcgtcctgtcaacaagtcagctgcagctagtcgacggtccgaggacgttggtacgaaccgcccctacgaccaccgtaccccgtccgtcccgtccgttacccgtaccgttcggtccgtacccgtaacgttcccccgggtacccggggtaacgtaaccgggtccggttacccggtacccgtaaccgggaccgttaaaccggttaggtttccggtttaccggttccgtttaccgggggacccgttaccggggttccgggttaccggaaccggtccccgtaaccccggtaaccccgtaacggtaccgggtaacggttacgggttaccggtaaagggtacgggtacgggtacggtaacgggggaacgtacttagtttaaccgtttccgtaacgttaccggtaacccggtaaacggttaacgggttaaacggttaaaactttaccgttaaaactttacggtacccgtaaccgttaaccgtttacggtttgttaacgggtttacgtaaacggtaccgttaccggtaacgtttaaccgaaacgttaacgtaacccggtaaacgtacgtaaacctacgttaaccgtaaacgttaacccgttaaccgtaaccgtttacccgacccgttacggaacccgttacgttacccggtaccgttacccgttacggtacccgttccgtaaaacccccgggtccgggtaaaccgggttacggttaggttaccttaaacggttcttacgggtaacggtaccggtaacccgacccgtaaccgtacgtaacg

SEQ ID NO: 278681 - DNA, 714 bp, Homo sapiens
  misc_feature: GYAE6OF01CB3QZ.19.71.G05.1.454.CMB.1.raw
  modified_base (549)..(549): a, c, t, g, unknown or other
  misc_feature (549)..(549): n is a, c, g, or t
tcagtactctcgtgcacgaccggtgctcgatttagtgtcgtcgcaagagagagggggtcaggctggaactgaggagcaggcaggggcagcaagatggtgttgcagacccaggtcttcatttctctgttgctctggatctcgtggtcgcccgacggggacatcgtgatcgaccctagtcctaccagaccttcccgtggtcttgtcgttcctcggtcgggacggacggccgggacccaacctactaccaaactcgaccgtaaacgtcccgacgaccctaacttaaacttttctttttaactaacctacgttaaccaaactaactaacgtaaaaaccttacttacgtcgttacggtaccacgacaagacgaccgagacacgccctaccgtacggctcgtaccttacttaatttacgcgggtacctacgtacccggtaacccgggtacggttccccggggtaccctacggtaccgtagttacgacggtcggacgacggtcgggtacgtacggggactacgtacttacctactctaccaactacacgacgaccncgccgtgcgacgtacgtagagttacgtaggtgtacgttagtttacttaagttacgttaacctaattaatttaatttactttacgttacgtttacggtacggttaccggtacggaccgggtaacggtaacgtaggtacgtaatacgtagaacggtacgtacgtagg

SEQ ID NO: 278682 - DNA, 629 bp, Homo sapiens
  misc_feature: GYAE6OF01B9FYE.19.71.G05.1.454.CMB.1.raw
  modified_base (244)..(244): a, c, t, g, unknown or other
  misc_feature (244)..(244): n is a, c, g, or t
  modified_base (333)..(333): a, c, t, g, unknown or other
  misc_feature (333)..(333): n is a, c, g, or t
  modified_base (390)..(390): a, c, t, g, unknown or other
  misc_feature (390)..(390): n is a, c, g, or t
  modified_base (397)..(397): a, c, t, g, unknown or other
  misc_feature (397)..(397): n is a, c, g, or t
  modified_base (402)..(402): a, c, t, g, unknown or other
  misc_feature (402)..(402): n is a, c, g, or t
tcagtactctcgtgcacgaccggtgctcgatttagtgtcgtcgcaagagagaggggggaggtacaacaggcaggcaggggcagcaagatggtgttgcagacccaggtcttcatttctctgttgctctggattctctggtgcccgaggggacatcgtgatcgacccagtctccagactccctggctgtgtctcgtaggcgaggccggccacagtcaactgacaagtccagaccataatcttttanacgattaccaaacaagtagaaaactcttagcctttaggaaccagcaacgtagaaccaggaccacgccctgacggctgcctatattacgnggactactccgaaccggatccccggggtactagccgtatgacgtcgcgacgtcgggntccgganacgtntttaccgatcctactaccatacacgtcacgtcgtacgaccgaggcctaaggaacgtagtggtaccgtatttaagtttaattacgtacgtaacctaaagttaattaacgtttaactagttaccgttcggtacgtacggttaccgtaaccggtaaagggtaccgtaaagggtagttaacgtacgtaaccgtaacggtaaccgtaacggtagtacgtcgtacgtaacccg

SEQ ID NO: 278683 - DNA, 603 bp, Homo sapiens
  misc_feature: GYAE6OF01EV231.19.71.G05.1.454.CMB.1.raw
  modified_base (239)..(239): a, c, t, g, unknown or other
  misc_feature (239)..(239): n is a, c, g, or t
  modified_base (320)..(320): a, c, t, g, unknown or other
  misc_feature (320)..(320): n is a, c, g, or t
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaattcttttanacagttaccaacaatagaaaactacttagcttggtaccagcagagaccaggacagcctaccgtaggctgctctaatttacngggctatccgtaacccgggtaatcccggggtaccctaggaccgtattcgagtcggcacggtcgggtacgtgggacagtactttcactctacaccatacagcacgtcctgaccgaggctagaagtagtcgtggtacttagtttaacttagtttacgtactaacttaaattactttaattaacgttacgtttacgtaggtaccgtttccggaaccgtaacggggtaaccgtaagggtgtaacttacgtacgaacggtaacgtacggttagtcggtctcgtaaccg

SEQ ID NO: 278684 - DNA, 801 bp, Homo sapiens
  misc_feature: GYAE6OF01EPHAZ.19.71.G05.1.454.CMB.1.raw
  modified_base (130)..(130): a, c, t, g, unknown or other
  misc_feature (130)..(130): n is a, c, g, or t
  modified_base (195)..(195): a, c, t, g, unknown or other
  misc_feature (195)..(195): n is a, c, g, or t
  modified_base (206)..(206): a, c, t, g, unknown or other
  misc_feature (206)..(206): n is a, c, g, or t
  modified_base (237)..(237): a, c, t, g, unknown or other
  misc_feature (237)..(237): n is a, c, g, or t
  modified_base (269)..(269): a, c, t, g, unknown or other
  misc_feature (269)..(269): n is a, c, g, or t
tcagtactctcgtgcacgaccggtgctcgatttagtgtcgtcgcaagagagagggggtcaggctggaactgaggagcaggcagggggcagcaagatggtgttgcagacccaggtcttcatttctctgttnctctggatctcgtggtcgcccgaggggacagttcgtagatcgacccagtcctccgagacctccgnggtctgtgtcncggtgggcgacgcggaccacagtacaacgtnaccaagtccacgaccaattaacttacttttanaccgtaacttaccaaaactaagtaacgtaaaacttcttaacgtccggtttaacggaccaggtacaacggtaacggaccgtaagggacctaacgtcccttaaccggtggaccttaggtacccttaattacggttttaccgacgggtacctaaccggtacccgggtaacccggtaacgggttccccggtacgtaaccggtaccttacgttaccggagttcggaccgtgggtaaccggggttcgaaccggggttataacggttcctttaacccaccgtttccgtaaccgtacaccgttaacgaccgtacgtacccggtcggttacgaaccggtacgtccggtaaagtaagtcgggttcgtaacggtttactttaacggttttaatttaacgttaaccgtttaacaaacgtttaaggttacttttaaacgttacggtttaccggttaggttacccggttacgggtaccggaaacggttaaccgggaacttaagggtaacgttaccgaagtttacgaaacgggtgttaaacggtcgg

SEQ ID NO: 278685 - DNA, 981 bp, Homo sapiens
  misc_feature: GYAE6OF01CG69H.19.71.G05.1.454.CMB.1.raw
tcagtactctcgtgcacgaccggtgctcgatttagtgtcgtcgcaagagagagggggtcaggctggaactgaggagcaggcaggggcagcaagatggtgttgcagacccaggtcttcatttctctgttgctctggatctcgtggtcgcccgacggggacagtcgtgatcgacccagtcctccacgtacctcccgtggcttggtcgtcctcggtcggggcgtacggccgggacccaaccgtactaccgaacgtcgaccgtaaacggtcccaacgaccctaagtaacttttactttttaactaaccgtaacgtttaacccaaaaacgtaaaacttaaccggttaaaaaaacctttaccgtttaacggtaccgttttacggggtaaacccaacgggtaaccgaaacgggtaaccggtaaacccggaacgggaacccgtaaccggttacccccgtttaaccggtacgggtaccgttacggttaccctttaacgttaaacggttttaccgggtacggggtaccttaaaccggtttacccggttaaaccccgggggtaaaccgggtttccccggggggtaccccgttaacgggtaaccccggttaaagtttccggtaacggggttaccgggtaaccggtaaaccggggttcccggggttaacgttaacgggggtaaacctttaacgggtttaccttttaaccgaaccgtttacccgtaccgtaaccgtacgttaccgaacgtccgtacgtccgttacggaccgtaacggacgttaacggaacgtaagggttcgggttacgttaacgtttaagttttaacgttaacgttaccgtaaaccttaaagtttaacttttaacgttaacgtttaacggttaccggttaccgggtaacgggttacccggttaaccggaaaccggtaaaccgggttaacgttaaggggttacgtaaacgttaccgtaccggaaacggtacccgttaaggtccggg

SEQ ID NO: 278686 - DNA, 725 bp, Homo sapiens
  misc_feature: GYAE6OF01BP407.19.71.G05.1.454.CMB.1.raw
  modified_base (188)..(188): a, c, t, g, unknown or other
  misc_feature (188)..(188): n is a, c, g, or t
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccgacggggacatcgtgatgacccagtctccagacctccctggctgtntctctgggcgagccgggccaccatacaactgacaagtccagccactaattcttttatacctagttaccaaactaataagtaaaacttacgttacgtactttaggtaccagcaagacgaccaggacacgccctcgtaggctcgctctattacgtggctacgtccgtaacccgggtacgtcccggggtccctagaccgtatttaccgaggtcggcgacgggtcggtacgtagggactagtactttcacgttccacgacctatcgacgcacggtcctagaccgacggtacgtagaaagtacgtcggtacgtacttaagttttagttacgttacgtaaccttaaacgtaaacttttaatttaaccgtttaacgttacgtttaccgggttaaccgggtaaccggttttacccggggaaacccggtaaaaccggggttaaccgtaaaggggggtttacgtaaccggttttaaaccgtacggaaacgggtttaacccggttaaacgttgggggtttaaccgtagttaccccggttaaacccccg

SEQ ID NO: 278687 - DNA, 891 bp, Homo sapiens
  misc_feature: GYAE6OF01EFA4G.19.71.G05.1.454.CMB.1.raw
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctcgtggtcgcccgacggggacatcgtgatcgacccagtctccagacctcccgtgcttgtcgtcctcggtcgggcgacggccggcccaaccactaccgaacctgacgtaacgtcccaacgacctaactaatttccttttaacactacgttaaccaaactaataacgtaaaaccttacttacgtcgtttaacggtaaccagaccgtaagaaccgtacccgaaaggacctacccggtacccgttaccgtaaccgggtctcggtaccttactacgttttacggcgggtacctaaccgttaccgggtaacccggtaccggttccccggtacctaggaacccgtacgtcgtaacggtcggacgtaccgggtcggtacggtacggggtaactacgtttaacgttccgacctttacccgtaccgtaacccgtacgtacgaacgtccggtacccggtcctaggaacccgtaggtaccgttaagtaacgttacgacgggttaccggttaagttttaacggttttaaccgttaacgttacgttaaacccgtaaatttaaacgttttaaacttttaaccggtttaacggtttacccgggttacgggttttcccggggtaaaacccgggtttcccgggaaaaccgggtttaaacccgggtaaccgggttaaacgggggttacgttaaaccgttaaacgggttacccggtaaaaccgggtaaccgtttaacccgggttaacgggtacggttaaccggttaccccgaaaccccg

SEQ ID NO: 278688 - DNA, 679 bp, Homo sapiens
  misc_feature: GYAE6OF01A7HWA.19.71.G05.1.454.CMB.1.raw
  modified_base (246)..(246): a, c, t, g, unknown or other
  misc_feature (246)..(246): n is a, c, g, or t
  modified_base (264)..(264): a, c, t, g, unknown or other
  misc_feature (264)..(264): n is a, c, g, or t
  modified_base (331)..(331): a, c, t, g, unknown or other
  misc_feature (331)..(331): n is a, c, g, or t
tcagtactctcgtgcacgaccggtgctcgatttagtgtcgtcgcaagagagagggggaggtacaacaggcaggcaggggcagcaagatggtgttgcagacccaggtcttcatttctctgttgctctggatctcgtggtgcccagggacatcgtgatcgacccagtctccagacctccctggctgtgtctcgtgggcgagccgggccaccatccaactgacaacgtccagcccactaattctttaanacagttaccaaataatanaaaactacttagtacttagaaccagacagacgaccgagacacgtcctcgtagctgctctacttacgnggactacgtaccgaccgggtaaccgtcccggggtacctacggaccgtagtcgtaggtcggacgtacggtcggtcgtacgggactagtactttccacgttcctaccgtacactcgacgtacacgccaggacctacggtactagtaacgtatcggttacgtacttagttttacgttattaacgtaaccgtaaagttaactttaagttttaacgttaacgttaccgtttacgggtaccgggtttaccgtacccggggtaaaccggtaaacggggaacccgttaagggttacggaattaaaccgttaaccgaacggtaacgtaccggttaggtccgtcgttaaccggaaccc

SEQ ID NO: 278689 - DNA, 745 bp, Homo sapiens
  misc_feature: GYAE6OF01BK9Q8.19.71.G05.1.454.CMB.1.raw
  modified_base (251)..(251): a, c, t, g, unknown or other
  misc_feature (251)..(251): n is a, c, g, or t
  modified_base (263)..(263): a, c, t, g, unknown or other
  misc_feature (263)..(263): n is a, c, g, or t
  modified_base (299)..(299): a, c, t, g, unknown or other
  misc_feature (299)..(299): n is a, c, g, or t
  modified_base (317)..(317): a, c, t, g, unknown or other
  misc_feature (317)..(317): n is a, c, g, or t
  modified_base (423)..(423): a, c, t, g, unknown or other
  misc_feature (423)..(423): n is a, c, g, or t
tcagtactctcgtgcacgaccggtgctcgatttagtgtcgtcgcaagagagaggggggaggtacaacaggcaggcaggggcagcaagatggtgttgcagaaccaggtcttcatttctctgttgctctggatctctggtgcccaggggacatcgtgatcgacccagtcctccagtacctcccgtggctgtcgtctcgtgggcgaggccgggccacgactacgactgacgaagtccagccactaattctttanacacttaccaanatacgaaaactcgtatcgttgaccagcagacacagntacgctcgagtctgcctntaacgtttgcggactaacgtcccgtaacgggaacgttcccggggtactaccggtactaacgttcgaaggtccgaacgtcggccggttgacgggactgtaacttccncgtacaccgtactactcgacgtacgtacgtcgtaccggacggtagtacgtaacggtaacgtacggttcggttaacgtttaaggtttacgttttaacgtttaacgttaaccgttaaaacgtaaccgtttaaacgttttaacttttaaacggtttactttaacccggggtttacgttaaccggggtttaaacccggttaccgggaaacccgggtttaaaaccggggtaaccggtttaaagggttaacggttaaacggttaccggtaaaccggtaaacggttaccgggttaaccggtaggttacccgtacgttaaccggaaaccc

SEQ ID NO: 278690 - DNA, 785 bp, Homo sapiens
  misc_feature: GYAE6OF01ENZHI.19.71.G05.1.454.CMB.1.raw
  modified_base (175)..(175): a, c, t, g, unknown or other
  misc_feature (175)..(175): n is a, c, g, or t
  modified_base (406)..(406): a, c, t, g, unknown or other
  misc_feature (406)..(406): n is a, c, g, or t
  modified_base (568)..(568): a, c, t, g, unknown or other
  misc_feature (568)..(568): n is a, c, g, or t
tcagtactctcgtgcacgaccggtgctcgatttagtgtcgtcgcaagagagagggggaggtacaacaggcaggcgaggggcagcaagatggtgttgcagacccaggtcttcatttcctctgttgctctggatctcgtggtcgcccgacggggacagtcgtgatcgacccagtccnccagacctccgtggtctggtctctcgtggcgacggccgggcccaccgataccgaacgtcgacaacgtccacgtacccaactaactttacttttaataacctaacgttacccaaaataaacgttaactaaaaaccgttacgttagtaccgtttacggaaccaagacgaacgacgaaccccggaggaacctaccggacccttacgtacggctacgtactacgtagttttacgnggacctaacgttacccggaacccgggtaacgtcccggggtaccctggtaaactcgtaacgaggttccggacgtaacggccgggtacgtacgggaacctaagtctttacccgactcctaaccacgtacaccgaaggtacaccgtccgtagacgtacgggttanaacggttacgtattggaaccgggttacctttaggttttaaattaacggtactaaaccctaaagtttaaagttttaacctttaaatttcggtttaacccgttggtaccggttaacccggttacgggaaaaacccgtcccggggtaaaacgtagggttacgtaccgtaaataccgggaaacgttaacgacggttaacggtcgtacccaaaggtaacccg

SEQ ID NO: 278691 - DNA, 850 bp, Homo sapiens
  misc_feature: GYAE6OF01DFDQD.19.71.G05.1.454.CMB.1.raw
tcagtactctcgtgcacgaccggtgctcgatttagtgtcgtcgcaagagagagggggaggtacaacaggcaggcaggggcagcaagatggtgttgcagacccaggtcttcatttctctgttgctctggactctcgtggtcgcccgacgggactatcgtgatcgacccagtcctaccagtacctcccgtggccttgtcgtccgtcgtgggacgacggccggaccaacatacgaactcgactaaacgtccaacgaccaactaacgtttacttttaacaacgttaacgttaccaaaacgtaacgtaacgtaaaaaccttacgtaacggtaccgtttacgggaaccagacgaacggaaccaaccgaacgggtaccacgtccccttacgacggcctcgtaccttacgttaacgttaccggacgggtacctaccggtaacccggtaccgggtaccgttccccggggtacccgttagaacccgtacgttacggcggttacgggacggtaacgggttcggttacgaccgggtaacgtacgtttaccgttacgtacctaccgtaaccctacctaacggtctaacggacccgttaacgggcccttaacggacggtacgggtaccgtaaagggtaacgttacgggtttcgggtaaccgtttaagttttaacgttttaaacgttcgtttaacgaaaaccctttaaaagttaacttttaatttaacggttaacccttttagggtaaccgggttacggtacccggtaacccgggtaaacggaaaaccggggtaaccgttaaggggtaacttactaaccgtaaggaaaccccggtaagtcgtacgggtcgtacctacgtaacccg

SEQ ID NO: 278692 - DNA, 1129 bp, Homo sapiens
  misc_feature: GYAE6OF01DIZ7T.19.71.G05.1.454.CMB.1.raw
tcagtactctcgtgcacgaccggtgctcgatttagtgtcgtcgcaagagagaggggggaggtacaacaggcaggcaggggcagcaagatggtgtgcagacccaggtcttcatttctcttgttgctctggatctcgtggtcgacccgacggggacagtcggtagactcgaccctagttcctaccaggtaccttccgtgggtccttggttcgtccgtcggtcggggacgacgggccgggaccctaaccgtactaccgtaaacctcggtaacccgaaacggttccccaacggacccctaaacgttaactttttacctttttaaacgaaccgttaccgtttaaccaaaacgttaaacttaaaaccggttaaaaacctttaaccgtttaaccggtaccggttttaaccgggaacccaacggtaaccgtaacggaaacccggtaaaccccgtaagggaacccgtaacccggtacccgttaacccgggttacgggtacccttacggaccctttaaccgttaacggtttttaaccggcggggtaccttaaaccggttaaccccccggggtaaacccgggtaaccgggtttcccccgggggttaacccgttacggaaacccgggtttaacgttaccggtaacggggtccggttaacccgggacggggtttcccgggggtaaccggtttacggggaactttaaaccggtttcctttacccgggtaacctttacccgtaaccccgtaaacccggtaactttaccccgggaaacgggtaccccgtttaacgggtcccccggttacgggaacccggttaacgggggttaccgttaaaacggggtaaccggttaacgggttttccggggttaacggtttaaaccgtttttaaacgggttttttaacgtttaaaccggtttacggttaaaccctttaaaaacgtttaagttttaaaccgtttttaacggtttaaccggttttcccgggtttaagggttacccgggttaaacccgggttccggggtaaaacccggtaaaacggggtttaaaccggttaacggggttaactttaacgtaacggttaacccggtaacggtaacggtttaaacgttccgggttacggtacccgtaacggttaaccccg

SEQ ID NO: 278693 - DNA, 767 bp, Homo sapiens
  misc_feature: GYAE6OF01BPZ67.19.71.G05.1.454.CMB.1.raw
  modified_base (188)..(188): a, c, t, g, unknown or other
  misc_feature (188)..(188): n is a, c, g, or t
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtcgcccgacgggacagtcgtgatcgaccagtcctccagcctcctggctgtntctcgtgggcgacggccggccacactacaacgtgacaacgtaccacgacctaactaatttcttttaacacgtacgttaccaaaactaaagtaacgtaaaaccttacttacgtactttacggaaccaggaccgaacggacgaccgaaggacaccgacccttaccgacggtcctcgtccttagttaacgtttacgcggacctaccggtaccccggtaacccggggtaccggttcccggggtaaccctacggtacccgtagttacgacgggtcggaccggtacgggtcgggttacgtagggaacctaggttaccttaccgactccgttaccaagtaccgtacacggtaccacggtcgacgtcggagtactacggtaaagtcggtaggttacggtaagttttaacggttttactttaagtaaccgttaaactaaacctttaatttaacctttaaaggtttaaccttcggttacgggttacggttacccgggttaaaccgtaaccggggtaacgggttaccgtaagggttagtaccttaaacgtaccggaacgttaccggtagtaggtcttacgggactaaccg

SEQ ID NO: 278694 - DNA, 799 bp, Homo sapiens
  misc_feature: GYAE6OF01EUX8Z.19.71.G05.1.454.CMB.1.raw
tcagtactctcgtgcacgaccggtgctcgatttagtgtcgtcgcaagagagagggggtcaggctggaactgaggagcaggcaggggcagcaagatggtgttgcagacccaggtcttcatttctctgttgctctggatctctggtcgcccgacggggacatcgtgatgacccagtctccacgacctccctggctgtgtcctgtgggcgagccggaccaccatcgaactgacaacgtccacgaccaactaattcttttaagtactacgttaccaaactaataagtaaaaccttacttacgtacgttacggtaccagtacaaggtaacgaaccgaggaccacgtcccgtaccgtaggtctcgtccgttacttacgtttaacggtcgggtacctaccgttaacccggtaacccggggtaaccggttccccggggttcccctacggtaccgtacgttacggtacggtcgggtaccgtacggggtccgggttccgtacggggtaacgttacggttaacctttaccgtacccgttaccgtaccgtaacccgtacgtacgtaacgtaccgtaccgtcccgtcggaacgacggtcgtaagtaacggtacggttggtacggttacgttaagttttacgttaacgtttacgttaacctaaacgttaatttaacgtttaatttaaccgtttacggttccggtttaaaccgggttacccggttaacgggtaaacccggtaacggggtaacccggttaaagggtccggttaaattaccggttaaacgaaccggtaacggtaaccggttacggg

SEQ ID NO: 278695 - DNA, 818 bp, Homo sapiens
  misc_feature: GYAE6OF01CMWTL.19.71.G05.1.454.CMB.1.raw
  modified_base (252)..(252): a, c, t, g, unknown or other
  misc_feature (252)..(252): n is a, c, g, or t
tcagtactctcgtgcacgaccggtgctcgatttagtgtcgtcgcaagagagaggggggaggtacaacaggcaggcacggggcagcaagatggtgttgcagacccaggtcttcatttctctgttgctctggatctcgtggtcgcccgacggggacatcgtgatcgacccagtctccagcctccctggctgtgtctcgtgggcgaggccggccaccgatacaactcgacaacgtccacgccaactattctttanactacgttaccaactaataacgtaaaactacttagtcttacggtaccaggactaaggacgaccgacggaacacgtcccttaccgtaggcctcgtaccttacgtagtttaccgtgggacctacgtacccggtaaccccggggtaacgttcccccggggggttaccctccgggaacccggttacttaccggtaacgggtcgggtaccggtaacggggttccgggggttccggttaacgggggaaaccttacggtttaaccgtttttacccaacccgttaccttaaccccgaacccgttaacgttaccggaccgtacccgtaaccggtccgttacgggaccgtacgggtacgttaacgggaaacgttcggttacggttacggttaacgttttaagggttttaactttaaccgttacgttaaacctaacgtttaattttacttttaaacgtttaacgttaccgtttacgggttaaccggttacggtacccggaacggtaaaccgggtaacgttagggtacgttacttacgaccgtaacgaaccgttacggtaggtacggtcgcggtaacc

SEQ ID NO: 278696 - DNA, 702 bp, Homo sapiens
  misc_feature: GYAE6OF01A86V9.19.71.G05.1.454.CMB.1.raw
  modified_base (240)..(240): a, c, t, g, unknown or other
  misc_feature (240)..(240): n is a, c, g, or t
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctcgtgggcgaggcggccacatcaactgcaagtccagccactaattcttttanactattaccaactaatagaaaactacttagcttggtaaccagcagacgaccaggacacgccctacgtaggctcgctctagtttacgcggacacgtaccgtaccgggtaccgtaccccggggtccacggtaccgtactcgaggtcgcgacgggtcgggtcgtacgggaactagtactttaccacgtcctaccgacctatacgacgtaccgacgtcgtacgacgtacgggtcgtaaacgggagtacggtacgggttcgggtaaccttttaaggtttttaagttaccgttaacgttaactaaaaccgtttaattttaacttttaacttaactttacccggttacgggttacggttaccgggttaaccggaaaccgggtaaaccggggtaccgtaaggggttaacgtacgttaagtaaccggtaacggtaaccgttaacgttgggtaccgttcggtacgtaacccg

SEQ ID NO: 278697 - DNA, 702 bp, Homo sapiens
  misc_feature: GYAE6OF01D8SZ2.19.71.G05.1.454.CMB.1.raw
  modified_base (668)..(668): a, c, t, g, unknown or other
  misc_feature (668)..(668): n is a, c, g, or t
  modified_base (678)..(680): a, c, t, g, unknown or other
  misc_feature (678)..(680): n is a, c, g, or t
  modified_base (682)..(702): a, c, t, g, unknown or other
  misc_feature (682)..(702): n is a, c, g, or t
tcagtactctcgtgcacgaccggtgctcgatttagtgtcgtcgcaagagagaggtctagagtggctgggaaggacatatttcatgtccaaacatgtggaatacaaattatgcaccatctgttgagagtcgactgacaatcaacgtagacacatacgaaagaacctagtttcctccctgcacgtcctacgtaccttcgttcgtacgtacccgtcccggacggaccgtacggggttattaacttacgtttaacgtggtaaggaacggacccggtaccccctaagtacgactacgtccgaccctaccgttcgtctcgtacggtcgtacttagttacggtcgggaccgtaacggacctgtaccgtccgtacccgttccgtcccgtccgcccctaccgaaccggtaccggcctaccgttcccggtcccttccccggtcggcccctcccgtacgccgtaccggacggaccctacctacccgtacggacgaccgaccgtaaccggccgggtccccggtccggtcggtccggttaccgaccgggttacggtaacccgtaaacccgggttacccttaccccggtaaccggtaacggtaaggttacccggtttacgggacggggtaccgggaccggggttacgtaccgggaacgaccgggaccctaagaagtccgagntccgattcgnnntnnnnnnnnnnnnnnnnnnnnn

SEQ ID NO: 278698 - DNA, 725 bp, Homo sapiens
  misc_feature: GYAE6OF01D8BPH.19.71.G05.1.454.CMB.1.raw
  modified_base (186)..(186): a, c, t, g, unknown or other
  misc_feature (186)..(186): n is a, c, g, or t
  modified_base (197)..(197): a, c, t, g, unknown or other
  misc_feature (197)..(197): n is a, c, g, or t
  modified_base (253)..(253): a, c, t, g, unknown or other
  misc_feature (253)..(253): n is a, c, g, or t
  modified_base (266)..(266): a, c, t, g, unknown or other
  misc_feature (266)..(266): n is a, c, g, or t
  modified_base (327)..(327): a, c, t, g, unknown or other
  misc_feature (327)..(327): n is a, c, g, or t
tcagtactctcgtgcacgaccggtgctcgatttagtgtcgtcgcaagagagaggggggagtacaacaggcaggcaggggcagcaagatggtgttgcagacccaggtcttctatttctctgttgctctggatctcgtggtcgcccgacggggacagtcgtgactcgacccagtctccacgcctccgnggtctgtgtcngtgggcgaggccggaccacactaccaagtcgacaacgtcacgccactattctttanactacttaccaanaatacgtaaacgtcttagtcgttacgacagacagagaccgaggacactcctacgtcgctcncgtactagttacgcggtctacgtaccggtaccggtacgttcccgggtacctacggtacgtacgttcggacgggttacggacggtacgggtaccgggttacgtacggggtactaacggtttacttaccgtaccttaccgtaaccgtaacctaacgtacgaccgtaccgtaccgtaccgtggtacggtaccgtaacggtacgtaacggtcgttacggtcggttaccgtttaacgttttagtttacgtaacgttaacctaacttaaacgtttacgttaacttacgttacggttaacgttacgggtacggtttaacccggaaaccggtaacggtaaccggtaagggttacgtaacgttacgtacgtaacgggtaaccgtaagttacggacgtcgacgtaacc

SEQ ID NO: 278699 - DNA, 758 bp, Homo sapiens
  misc_feature: GYAE6OF01C7VU1.19.71.G05.1.454.CMB.1.raw
  modified_base (146)..(146): a, c, t, g, unknown or other
  misc_feature (146)..(146): n is a, c, g, or t
  modified_base (173)..(173): a, c, t, g, unknown or other
  misc_feature (173)..(173): n is a, c, g, or t
  modified_base (189)..(189): a, c, t, g, unknown or other
  misc_feature (189)..(189): n is a, c, g, or t
tcagtactctcgtgcacgaccggtgctcgatttagtgtcgtcgcaagagagagggggtcaggctggaactgaggagcaggcaggggcagcaagatggtgttgcagacccaggtcttcatttctctgttgctctggatctctggtcncccgacgggacagtcgtgatcgacccngtctccagtacctccnggctgtcgtcctcgtgggcgacggccggaccaccataccaacgtgacgaacgtccacgaccaacttattcttttaactacctaattacccaaaataaataacgtaaaaactcttaagacttacggaccacgacagaacgacacggactacgcctaccgtggctacgtactactacgttacgtcgggaccttacgtccggttaaacccggaccggttcccgggccctacggaaccgttcgttacgacgggtcggacgtacggtcgggttaccggtgggtactaacggttcttacacccttactccctaactcgtaccgacgtacccgcgtacccgtggtacctacgtaccgtagtaaacgttgttacgggtacgttaaccgtttaagttttaccgtttagttacccgtaaacttaaacttacttttaaacttactttaaacgtttacccggtttacgggttaccgggttaaccgggttacgggtaaacccggtaaacggggttaaacccgttaaagggccggtttaaacgtacgtaaacccggtacgggttaaaccggtacggttacggg

SEQ ID NO: 278700 - DNA, 629 bp, Homo sapiens
  misc_feature: GYAE6OF01COE7G.19.71.G05.1.454.CMB.1.raw
  modified_base (151)..(151): a, c, t, g, unknown or other
  misc_feature (151)..(151): n is a, c, g, or t
  modified_base (220)..(220): a, c, t, g, unknown or other
  misc_feature (220)..(220): n is a, c, g, or t
  modified_base (237)..(237): a, c, t, g, unknown or other
  misc_feature (237)..(237): n is a, c, g, or t
  modified_base (306)..(306): a, c, t, g, unknown or other
  misc_feature (306)..(306): n is a, c, g, or t
tcagtactctcgtgcacgaccggtgctcgatttagtgtcgtcgcaagagagagggggagagtctgctgaattctggctgaccgagggcagtcaccagagctccagacaatgtctgtctccttctcttcttcctgccgtgctcggcctccanaggtctcctgtcacaagtcagctgcagtcagtcaggtcaggactggagaacgccctcgacacgaccctntccgcctcaccgtgtcnccagttccgcgggacagagtcgcgtagacgactaggtgtcgcgttcggactacggttcggcacgtaccncgtacccagtacgaggtacgtagtagagggtcggcgtaggggaagtactagtttaacgttacagttaccgaaccgaacgtaacggttaagtaaattaaacgttaagtacgtacgaccgtactaagtttcgtagttaacggagtacgtaacgtacgtaacgaactaacgtacaaacggtacgactaacgtaacgacgtaaacgtacttccgtacgtccagaccgtacgtctacgtccgtcgtcgtaccgtaccgtacggaccggtacgtaggtaacttcgttaacgtcgggttagacccggtaacgaccggaccaggtactacg

SEQ ID NO: 278701 - DNA, 816 bp, Homo sapiens
  misc_feature: GYAE6OF01E058H.19.71.G05.1.454.CMB.1.raw
tcagtactctcgtgcacgaccggtgctcgatttagtgtcgtcgcaagagagagggggtcaggctggaactgaggagcaggcaggggcagcaagatggtgttgcagacccaggtcttcatttctctgttgctctggatctctggtcgcccgacggggacatcgtgatgacccagtcctccagacctcccgtggctgtcgtctcgtgggcgaggccgggccaccatcaactcgacaacgtccacgccaactaacttcttttaacacgtaacgttacccaaaactaaagttaacgtaaaaaccttacgtttaacgtaccgtttacgggtaacccaggacccgaggtaacggaacccgtaacgggaacccgtacgtaccccgtaccgtacggggccttagtacccctagttaacgttttacggcgggtactaccgtacccggtaacccggggtaacggttccccgggggtacccgtcggtaacccggttacttccggaagggtccgggtaccggttacgggtccggggtttacgtacggggtaaccgttaaggttaaccgttttaccctaccgttaccgtacccgtaacccttaaccgtacgaccgggtacccgacgtacccgttacggaccgtacgggtaacgttacggaaacgttgttacgggtacggttacgttaacgttttagttcgtttaacgtacaaacgtttaatttaacgttatttaacgtttacgttaggttacggttaccggttacggacccggtaaacgggtaccgtaaagggtacgtaacttacgacgtaacggacgtaacggtcggg

SEQ ID NO: 278702 - DNA, 753 bp, Homo sapiens
  misc_feature: GYAE6OF01E44VL.19.71.G05.1.454.CMB.1.raw
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtcgcccgacggggacatcgtgatcgacccagtctccacgacctccctggctgtgtctcgtgggcgaggcgggccaccatcaactgcaacgtccacgccaactaattcttttatacacgttaccaaacaatagaaaaccttacttagtcttcggtaccagacagagaccaggacacgcctcctagctgctctacttacgtgggctactccggtaacccgggaacggttcccgggggtccctacggaccgtagttcgaggtcgggcgtacgggtccggggttcgtacggggtaactacgtacgtttaccacttcctacctaaccctactcgaccgtacacggtcccgtggaccgtagggtccgtaaggaaggtagttcgggtaggttaccgttaaggttttaactttacgtttaacgtaacctaaaacgttaaatttaaacgttttaactttaacgtttacccgggtttacggttacgggttaacccgggtttacccgggaaacccgggttaaacgggggtaacccggttaaagggggttaacgggtaactttaaaccggtaccgaaacggggtaaacccgtaacggttagggttaccgggtaccgttacggtacccc

SEQ ID NO: 278703 - DNA, 745 bp, Homo sapiens
  misc_feature: GYAE6OF01AHLN0.19.71.G05.1.454.CMB.1.raw
  modified_base (201)..(201): a, c, t, g, unknown or other
  misc_feature (201)..(201): n is a, c, g, or t
  modified_base (256)..(256): a, c, t, g, unknown or other
  misc_feature (256)..(256): n is a, c, g, or t
tcagtactctcgtgcacgaccggtgctcgatttagtgtcgtcgcaagagagagggggtcaggctggaactgaggagcaggcaggggcagcaagatggtgttgcagacccaggtcttcatttctctgttgctctggatctctggtcgcccgacggggacatcgtgatgacccagtctccagacctccgtggctgtgtctcgngggcgaggccggccaccatcaactcgacaacgtccagcccaactaattcttttanactacgttaccaaactaatacgtaaaaactacttagtccgttacggtaccagaccaaggacgaaccccaggaccacggtccctaccggtacggcctcgtcctacttaacgttttacgccggggtactaacgtttacccggtaaccccgggggaacgtttccccgggggtacccctaggtacccgtagttaccgtagggtccggtacgacgggtcccgggttcgtacggggaacctacgttacgttttaacccaccgtttacccgtacctaaaccccgtaacgtcctaaacggccctaacggcccgttaaggacgaccggtacgttacggaagtcgttcgggtagtaccgttaagtttaacttagttacgaacgttaactagtttaatttagttccgttaacgttcgggtacggtaccggttaccgaaccggacgggtaaccggtaagttagggaacctttaacgagaaccgggtaagtacgttacgggg

SEQ ID NO: 278704 - DNA, 759 bp, Homo sapiens
  misc_feature: GYAE6OF01BXSZA.19.71.G05.1.454.CMB.1.raw
  modified_base (266)..(266): a, c, t, g, unknown or other
  misc_feature (266)..(266): n is a, c, g, or t
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccgacggggacatcgtgatcgaccagtctccagcctccctggctgtgtcctcgtggggcgacggccgggcccaccgtataccaacgtcgactaacgtccacgacccaactaactttactttttaanacctacgttaacccaaactaattaacgaaaaacctttatacgtccttacggtaaccaggacagaacggacccagggacacgtccctcgtaaggcctagccttacgtaacttttcgcggacctacgtacccggtaccccggggtaacgttccccggggtacccgtgtaacccgtagttaccggtggtacggaccggtacggggtccgggtaccggtacgggtaacgtacggtttactttaccctaccgtccgttaacccacccgtacttaccgacgaaccgtccgtacccgtacgccgacggttaccaggtaacgtaggtcggttagtcgttttaacgttagtttaacgtacttaacgtaaaccttaagtttaaccttttacttaagttaccgttccggttaacgggtaccggttacggtaaccggtaaccgggtacgaagggttggtaaactcgaacgttacggacgttacggtaggtcggcttaccggaacc

SEQ ID NO: 278705 - DNA, 745 bp, Homo sapiens
  misc_feature: GYAE6OF01BDFDU.19.71.G05.1.454.CMB.1.raw
  modified_base (240)..(240): a, c, t, g, unknown or other
  misc_feature (240)..(240): n is a, c, g, or t
  modified_base (252)..(252): a, c, t, g, unknown or other
  misc_feature (252)..(252): n is a, c, g, or t
  modified_base (384)..(384): a, c, t, g, unknown or other
  misc_feature (384)..(384): n is a, c, g, or t
tcagtactctcgtgcacgaccggtgctcgatttagtgtcgtcgcaagagagaggggggaggtacaacaggcaggcaggggcagcaagatggtgttgcagaccccaggtcttcatttctctgttgctctggatctctggtgcccacggggacatcgtgatgacccagtctccagactcccgtggctgtgtctctgggcgagccgggccaccatcaactgcaagtccagccatatcttttanacagttaccaanaatagaaaacttacttaagcttggtacagcagagtaccaggaccaagtccctaccgtaggctagccttctaatttacgtgggactacgtacccgtaccgggtaacgtcccggggtacccctagtaacccgtnttccgaggttcggaccgacggtccggggtacgtacggggtaccaaggttaccttttcccgaaacccgtttccgtaaccctaacccgtaaacgttccgtaacgggttaccccaaccggtcccgttaccgggtaccggaaacggggtacccggttaaggtaaaaaccgtggtttacgggttacgggttaccgtttaagtttttaaagtacgtttaaggttaccctaaaacgttaagttttaactttaatttaacgttccttacggtgggtaaccgtttcccgggaagtaaccgggtaccgtaaggggttcgtaaagtaccgtacggaacgtaaccgtaccggttaggtcgccgtcggtaaccc

SEQ ID NO: 278706 - DNA, 615 bp, Homo sapiens
  misc_feature: GYAE6OF01AIH96.19.71.G05.1.454.CMB.1.raw
  modified_base (247)..(247): a, c, t, g, unknown or other
  misc_feature (247)..(247): n is a, c, g, or t
  modified_base (607)..(607): a, c, t, g, unknown or other
  misc_feature (607)..(607): n is a, c, g, or t
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtcgcccacggggacatcgtgatgacccagtctccagactccctggctgtgtctcgtgggcgagcgggccaccatcaactgacaacgtccacgcccaactaattcttttanacacgttacccaaactaatacgaaaacttacttagcttaggtaccagcagacgaccaaggacacgtcctacctaggctgctctatttacgcgggacataccggtaacccgggacgttcccgggggtaccctggtaaccgtattcgaggtcggcgagggtccgggtcgtagggactagtactttcacctctaccacctatccagcacgtcctacgacacggtacaggtaacgtgtggtacgtacttagtttaacttagtcgtaactaaactagttaattattacttacgttacggtaggtccgttacggaccgaagggtaccgtaaggtcgtaatacgtagaacgtacgtaacgtgtacgngtcgaccg

SEQ ID NO: 278707 - DNA, 797 bp, Homo sapiens
  misc_feature: GYAE6OF01B7ZA7.19.71.G05.1.454.CMB.1.raw
  modified_base (354)..(354): a, c, t, g, unknown or other
  misc_feature (354)..(354): n is a, c, g, or t
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccgacggggacatcgtgactcgacccagtctccagtacctcccgtggctgtcgtctcgtgggcgaggccggaccaccgtatacactcgacaacgtccagaccactacttctttaacaccgtacgttaccaaactaataacgtaaaaccttacgttacgtcgttacgaccagacacgacgacgagacacgcctacgagctgactagtacttacgnggactacgtacccgtaccggggtaaccgtcccggggtcctacggtacgtacgttacggacggtcggacggtacgggtccggggtaccggtacgggtacgtaacgttaaccgtttccgtaacgtttcccgtacctaaaccggttacaccggtacgaccgtaaccggtccgtaacggtacgggaccggtaagttacgggtaaactgggttaccgttacggttacttttaagttttaacgtttgttaaccgtaaacttaaaccgttaaacttttaagttaacgttacgttttaccggttacggttccggggttaaccggtttacccgggaacggttaaaacccggggtaaccgtaaagggggtttaccaaggtttaaaccgttaaccggaaacggggtaacccgttaacggttaacgggttaccggtacggtttcggaaaaccccg

SEQ ID NO: 278708 - DNA, 794 bp, Homo sapiens
  misc_feature: GYAE6OF01B1TF1.19.71.G05.1.454.CMB.1.raw
tcagtactctcgtgcacgaccggtgctcgatttagtgtcgtcgcaagagagaggggggaggtacaacaggcaggcaggggcagcaagatggtgttgcagaaccaggtcttcatttctctgttgctctggatctctggtcgcccgacggggacatcgtgatcgacccagtctccagacctccctggctgtcgtctcgtgggcgagccgggccaccatacaactgacaacgtcccacgaccaactaattcttttaacactagttaccaaactaagtacgtaaaacttacttacgtacgttacggtaccaagacaagtacgaaccgaggacacgtccctacgtacgcctgcctacgtactttacgcggactacgtccgtaaccgggtacgtcccgggtacctgaccgtactcgaggtcgcgtacggcggtcgagggactacggtactttcaaccgttctaccgtaacctactaccgacggcccaacggtccgtacggaccggacggtaccgttaaggaaccgttaggttcgggttaacggttactttaaggtttttaacgtttacgttaacggtttaaacccgtaaaacgtttaacgtttaaagtttttaacgtttaaccgttttaacccggtttaccgggtttaaccggggttacccgttttacccgggggaaacccgtaaacggggggttaacccggtaaaggggtttaccggttaaacgttaacccggttaacggaaacgggttaaacccggttaccgggttagggtacccggttaccgttccggtaaaccccg

SEQ ID NO: 278709 - DNA, 731 bp, Homo sapiens
  misc_feature: GYAE6OF01EAJ9M.19.71.G05.1.454.CMB.1.raw
tcagtactctcgtgcacgaccggtgctcgatttagtgtcgtcgcaagagagaggggggaggtacaacaggcaggcgaggggcagcaagatggtgttgcagacccaggtcttcatttctctgttgctctggactctcgtgggtcgcccgacgggacagtcgtagactcgaccctagtctccagtcctcccgtggctgtgtcctcgtgggcgaggccggccaccgatacactcgacgacgtccgacaccaactaattcttttaacactacgttacaaactaagtaactaaacttatacgtcgttacggtaccagacagacaccgacggacacgtcctcgtaggctcgtctacgtactttacgcggactacgtccggtaccggaccggttcccgggtactacgtacggtactcgacggtcggcggtacggtcggtcggtaggacgttagttaccgttaccaccttacgacccgtaatcgacacgacgtcgtcgcggtactacgggacgtagtaacgtggtcggtagtttacgtttaagtttacgttacgtttaactaagtaacgtttaacttttagttaacgtttaaccggttaccgtttacggggtaccgggttaaccggtaccgggtaaaacccgggttaagggtaaaccgttacgggttaaccgttaaattacccggaaggttaaaccccgtaggttaacggtggtaacccgttcgggtacctaaacccgg

SEQ ID NO: 278710 - DNA, 752 bp, Homo sapiens
  misc_feature: GYAE6OF01BWGKN.19.71.G05.1.454.CMB.1.raw
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtcgcccgacggggacagttcgtgatcgacccagtcctccagtacctcccgtggctgtcgtctccgtggggcgacggccgggccacgatccaacgtgacaacgtccagccctaactaacttcttttaacacgacgttaccaaactaaacgtacgtaaaaacttaaccgttagtaccgtttacgggaacctaacggctaaggacggtaacccgaaggaccgtaacggtccccttacccggttaacgggccttacggaccgtttacctaacgtttttaacccggtgggggtacctaacgttacccgggtaaaccccgggtaacgttccccggggggtacccctaggtaaccgtacgttacgacggtaggacggtcggtgtcggaatacgtacttcgacttccgtcaccatcgagccgtacgacgtggtcaccgggtgaacgaagtacgtggtacgtcgttaacgtttagtattacgtaacaaacgttacttaacttaactttatacgttcggtacggttaccggttaccgaccggtaaacgggtaaccgtaaggttacgaagttacgtacctaacgggtaacgttaacgcgggttacgacggttacgtaccgtaaccg

SEQ ID NO: 278711 - DNA, 666 bp, Homo sapiens
  misc_feature: GYAE6OF01D5IFA.19.71.G05.1.454.CMB.1.raw
  modified_base (198)..(198): a, c, t, g, unknown or other
  misc_feature (198)..(198): n is a, c, g, or t
  modified_base (204)..(204): a, c, t, g, unknown or other
  misc_feature (204)..(204): n is a, c, g, or t
  modified_base (252)..(252): a, c, t, g, unknown or other
  misc_feature (252)..(252): n is a, c, g, or t
  modified_base (355)..(355): a, c, t, g, unknown or other
  misc_feature (355)..(355): n is a, c, g, or t
  modified_base (451)..(451): a, c, t, g, unknown or other
  misc_feature (451)..(451): n is a, c, g, or t
  modified_base (472)..(472): a, c, t, g, unknown or other
  misc_feature (472)..(472): n is a, c, g, or t
  modified_base (491)..(491): a, c, t, g, unknown or other
  misc_feature (491)..(491): n is a, c, g, or t
  modified_base (523)..(523): a, c, t, g, unknown or other
  misc_feature (523)..(523): n is a, c, g, or t
  modified_base (615)..(615): a, c, t, g, unknown or other
  misc_feature (615)..(615): n is a, c, g, or t
  modified_base (657)..(657): a, c, t, g, unknown or other
  misc_feature (657)..(657): n is a, c, g, or t
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctcgtggtcgcccgacggggacatcgtgatcgacccagtcctacagacctccgtggctgtctctcgngggcgnggcggccacatcaacgtcgactacgtccacgaccataacttctttaanactacgtaaccaaactaataagtaaaaccttacttacgtacgttacgacacacgaagaccgaaccgaggaccacgtccttcgtagctcgtctactactttcgnggactacgttacccggtaccggaccggtcccggtcctacggtaccgtattcgaggtcggacgtacgggccgggtgacgggactacgttactttacncgttccgactacagtcgaacncgaccgtcacggcgtacgngttaaggactgttcggtagtactttaagtttntaacgttagtaactaaagttattttaacgttacgtttactaccggtttggaaccggttcgttaccgggaactaacgggggtactaaagggtntaaaccgttacgacgaaacgttacggtagttaggacccggtnttcccgacg

SEQ ID NO: 278712 - DNA, 711 bp, Homo sapiens
  misc_feature: GYAE6OF01DGQD9.19.71.G05.1.454.CMB.1.raw
tcagtactctcgtgcacgaccggtgctcgatttagtgtcgtcgcaagagagaggggggaggtacaacaggcaggcaggggcagcaagatggtgttgcagacccaggtcttcatttctctgtgctctggatctcgtggtcgcccgacggggacatcgtgatcgaccctagtcctaccagacctccgtggcttgtgtcgtcgtcggggcgacggccggaccacataccaactcgacgtaacgtccacgacctaactaactttctttaactaccgtacgtaaccaaactaaattaaccgtaaaaacttaccgttaggtaccgtttacggtaccaacggtacaagaacgaccgaggaaccaccgtcctccgtaggcctgctctattcggagcacgtaccggtaccggaggttccccggtccacgacctatcgacggtcggacgtacggtcgggttcggacggactagtcttaccgctaccgtaccactactacgcgtacgacgtccgtacgccgtacggtcaaggtaagtcggtcggtacgggtactttaaggtttaacttattacggtaacttaacgtaatttacttactttaagttccgttacgggttaccggttaaggtcccggtaacggtaaccgggtaaccggttaagggtacgttaacgacgtaacggacggtaaccggtaacgttggtacggttcgacgttaacccgg

SEQ ID NO: 278713 - DNA, 814 bp, Homo sapiens
  misc_feature: GYAE6OF01CIQFO.19.71.G05.1.454.CMB.1.raw
  modified_base (129)..(129): a, c, t, g, unknown or other
  misc_feature (129)..(129): n is a, c, g, or t
tcagtactctcgtgcacgaccggtgctcgatttagtgtcgtcgcaagagagaggggggagtacaacaggcaggcaggggcagcaagatggtgttgcagacccaggtcttctatttctcttgttgcttcnggtatctcgtggtcgacccgacgggacattcgtgatccgaccctagtcctcgacgtccgtcccgtggtcgtgttcgtcgtcggtcggcggaccggccgggacccacgtaataccgaacgtcgacctaacgtccgaccgtacctaacttacttttctttaacgactaaccgttaaccaaaactaagtaactaaaccgtttcgttacgtacgtttacggaaccagacgaagaccggacgtaaggacctccgtacctccggtagcctcgttacttactaacgtttcggcgacttacgtaccccgggtaaccggtccggtcccgggtcctacggtaccgttagttcggacggcggtaggtaccgggtcgggtcgacggtaaccgttactttaccttccgtaccgtacctacccgacgtaccgttacgaccgtacgtacggtacccgaggtaccgtagggtactacgggtaattcgggtagtccggtttaatttaacggtttattaccggtaacttaaccgttaattaagttttactttaacgtttaaccgttcgggtttaaccggtacgggtttaacgttaacccgggtaaacggggtaaacccgttacgggtaaggtttaacccggtaacgtacgtaaaaccgggttaacgtaccgtttaacggtccggtaacgtccgtaaccgtacc

SEQ ID NO: 278714 - DNA, 726 bp, Homo sapiens
  misc_feature: GYAE6OF01ATSVS.19.71.G05.1.454.CMB.1.raw
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctcgtggtcgcccgacggggacatcgtgatcgacccagtcctccagacctcccgtggctgtgtctcgtgggcgacggccggaccaccatacaacgtgactaacgtccacgacccaactatttctttacactacgttaccaaataactacgtaaaaccttcttacgtcgtttacggacctagacaaggacgaccgaggactacgtccctacgtacgctcgtacctacgtaagttcgtacggactacgttaccgggaacccgggtacggttcccggggtacctaggacctgttacgaggtcggcgacgggtcggtacgacgggtactaggttacttccgactccgactacctaagtccgacgtaccgtaccggacccgttaggacccggtaggaccgtaaggtaccgtaggttcgggttacgtaactttaacgttttagtacgttaaccgtaactaacgtttaaatttatttaactttacgttaccgttacgggtacggttaccgggttaaccggaaccggtaacggggtacttaagggtaggttaactacggtaacggtaacggtaacgttagggttaggtcgtaccggctaaccg

SEQ ID NO: 278715 - DNA, 712 bp, Homo sapiens
  misc_feature: GYAE6OF01BYDWS.19.71.G05.1.454.CMB.1.raw
  modified_base (252)..(252): a, c, t, g, unknown or other
  misc_feature (252)..(252): n is a, c, g, or t
  modified_base (355)..(355): a, c, t, g, unknown or other
  misc_feature (355)..(355): n is a, c, g, or t
tcagtactctcgtgcacgaccggtgctcgatttagtgtcgtcgcaagagagagggggggaggtacaacaggcaggcaggggcagcaagatggtgttgcagacccaggtcttcatttctctgttgctctggatctctgggtgcccgacggggacatcgtggatgacccagtctccagactccctggctgtcgtctcgtgggcgaggccgggccaccatacgaactgacaagtccagccaacaattcttttaanaccacgtttaccaaacaataacgaaaactaacttagtacctttacggtaaccagcaagaacgaccgaggacacgcctaccgtacggctcgcttctagtttacncgggtcacgtcgtacccgggtaacgtccggggtacctggaccgtctcgagtcggacgtacggcgggtcgtacgggactaggtactttcgacctacctccacctatcgacgacgtacgtccgtacgcgacggtcgtacggtaaggtaggtacgttagggtacgttagtttttaattaacgtttacggttaactaaaagttaactttaattttaactttaacgttaccggtttaccggtacggggttaccgttacccgggtaaccggtaaaacggggtaccggtaaagggtaggtttaaacgtacggttaacgaacgggtaaccggtaacggttaggtcggtaccgtaaccggtacccg

SEQ ID NO: 278716 - DNA, 833 bp, Homo sapiens
  misc_feature: GYAE6OF01D3PBB.19.71.G05.1.454.CMB.1.raw
tcagtactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctcgggcctcccagtaaggtgtcctgtacaacgaagtacagctgcagcagtcaggtcaggtactggtgacgccctagcacgtacccctcgtccgctacaccgtgtacgcctacgtccggtaccggggacaggtacgtcgacgtacggcgacgtggtgttcgtcgttcggacgtacggtcgggtacaggaccgtacgtccccaggttaccggaaggtacggttaccgtaaggtacggtcgggaccggttaaggggaacgtagttaacttacgtttacgtaacgttaccgtaaccgaaacgttacgggtaacggtaaaacttaacttaaaagttacgtaccgaacctaacccgtacgttacgttacggttaagtaacgggtaacggtaccgtaacgttaaccgtaacgtaaccgtaaccgtaaacggtactaaccgtaacgtaacgtaaacgtaaaccgtaacccggttacttaccccgtaccgtacgtaacggtaccgtaaccgttaccgttacccggttaccggttacggtaaccccgtaacccgggttaaccggggtaaacccggttaccgggttaaaccggggttttaaacgttaacccggttttaaaccgttaaccgggttaaccggggtaacgggtaaaaccccgggttacccccggttaaaccccgtaaggtttaaaacccccggg

SEQ ID NO: 278717 - DNA, 862 bp, Homo sapiens
  misc_feature: GYAE6OF01DNWXT.19.71.G05.1.454.CMB.1.raw
tcagtactctcgtgcacgaccggtgctcgatttagtgtcgtcgcaagagagagggggtcaggctggaactgaggagcaggcaggggcagcaagatggtgttgcagacccaggtcttctatttctctgttgctcgtgatctcgtggtcgacccgacgggacagtcgtagactacgacctagtcctacacgtccctcccgtggtcttggttcgtcgtcggtgggaccggacggccgggacccaaccgtactaccgaaccgtcgaccgtaaaccgtccgacgaacctaacttaactttacgttttaactaaccgttaacgttaacccaaaataaaacgtaaactaaaaccgttacgtttaacggtaccgtttaacggaaccaacgacgaaacggaaaccgaaccgaacggaaccgtaccgtcccgttacgacggtcttacgtactacgttaacgttacggcggtacctaaccggtacccggttaaaccgggtaacccggttccccgggtaccgtaacggtaccgttacgtacggacgggtcggaccggtagggttccggtacgtagggaccttagttaccttccacgtacctaacaccctataccgcgtaccgcgtctacggccgtaagtacgtaaggtaagtcggtacggtttacggtaacttttaacgtttttacgttaaacgtaacttaaacctaaagttttaactttaaagtttttacccgttaaacggttccggtttaaccggggttaaccgggttaaaccggttaccggggaaacccgggttaagggtaaaaccggtaggtttaaccgggtaatttaaacccggaacgggttaaacgggtaaacgtttacggtccgggg

SEQ ID NO: 278718 - DNA, 812 bp, Homo sapiens
  misc_feature: GYAE6OF01AMKIR.19.71.G05.1.454.CMB.1.raw
tcagtactctcgtgcacgaccggtgctcgatttagtgtcgtcgcaagagagagggggagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaacgccctcgcacgaccctctcgctcaccgtgtcgcctagtccgtaccggggacacggacggtccgtacgtacggccgacgtaggtcgtttcgtcgttggccgtacggttcgggtcgacggtccacggtaccccagtcggagtaggtaccgtaagggtacggttcggggaccggttagggggaaacggtacgtaacgtttacgtttacgaacgttacggttacccaaacggttacgggtaacggtaaaacgttaaaaccttaaagtttaacgtccggtaaccctaacccgtaagtttcggtttacgggttaggtaacggttaaccggtaccgtaacgtacggtaaacctaactttaaccggaaaccgttacgaacctaacggtaacgtaacccggaaacgtaacccttaccggttaccccttacccgtacgtacccgtaacggtacccgttaccgtaaccgtttccggtaccggtacgtaccccgggtaaaccccgggaacgggtaaccgggtttacggggttaacgttaacggtttaaaccgttacggttacggggttaaaccgggaaccggtaccccggtaaccccgaagggttaacctaacccggg

SEQ ID NO: 278719 - DNA, 737 bp, Homo sapiens
  misc_feature: GYAE6OF01DLEHS.19.71.G05.1.454.CMB.1.raw
  modified_base (199)..(199): a, c, t, g, unknown or other
  misc_feature (199)..(199): n is a, c, g, or t
  modified_base (503)..(503): a, c, t, g, unknown or other
  misc_feature (503)..(503): n is a, c, g, or t
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctcgtggtcgcccgacgggacactcgtagatcgacccagtcctcagacctccgtgcttgtgtcgtcgnggcgcgccggccacatcaactcgacaacgtccacgacctactaaacttttcgttttaactaccgtacttaaccaaaactaacgttaaacgtaaaaacctttacgtttaacgtccgtttaaccggtaccgacgaccgaaggaaccgacccaagggaccaccggtcccgttaaccgtagggtcctcggtaccttacgttacgtttacggtgggacctacgtacccggtaaccgggacgttcccgggtctacggaccgtaacttcgaggtcggaacgcggtcgggtcgacggacttaagtcttaccnctactaccacctactacgacgtcgtcgtaccgtagtccgtacgtacgtacgagtacggtcggtacgtagttacgtttaacgttacgttacgttaactaacgttaactttaatttacgtttaacgttacggttacggtacggttaccggttaccggtaacccggtaagggtaaccggtaaggttacggtaactacgtacggaacgtaaccgtaagtcgtacggtcgtcgtaaccg

SEQ ID NO: 278720 - DNA, 710 bp, Homo sapiens
  misc_feature: GYAE6OF01CWM61.19.71.G05.1.454.CMB.1.raw
  modified_base (477)..(477): a, c, t, g, unknown or other
  misc_feature (477)..(477): n is a, c, g, or t
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctcgtggtcgccccgacgggacagtcgtgacgtcgacccctagtcctaccgacgacctcccgtggcttgtcgtctcgtcgggcgacggccggcccaccatacaactgacaacgtccacgcctaatattctttaagactacgtaccaaataataagtaaactcgttagtcgttacggaaccagcgaacggtacgacccgaaggtaccaccgccttccgtaggctcgtcttactacgttacgcggactcgtaccgtaacccgggacgtcccgggtccctaggtaccgttacttcgaggtcggcgacggtcgggtcgtagggactagttacttacgactctaccgactntacgagccgtcgtcccgtagaccggtagtaccgtaagtaacgtgtcggttacggtaattttaacgtttaagtttagttaacaaacccgttaaattaatttaacttttaagttaccgtttacgttcggttaaccggtccgttaaccgggtaaccggtaaacgggtacgtaagggttacaaagttccgaacggtaagtaaacccggttacgttgggtactaccggtgtaaacccg

SEQ ID NO: 278721 - DNA, 1015 bp, Homo sapiens
  misc_feature: GYAE6OF01EGPG4.19.71.G05.1.454.CMB.1.raw
  modified_base (386)..(386): a, c, t, g, unknown or other
  misc_feature (386)..(386): n is a, c, g, or t
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtcgccacggggacatcgtgatcgaccagtctccagactcctggctgtgtctcgtggcgagcggccacagtaccaactcgactaacgtccacgacctaaactaactttcgttttaataaccgtacgttaacccaaaactaacgtaaacgtaaaaacttacgttacgtacgtttacggaaccagacgaaggacgaaccgaacggacaacgtccctaccgtaaggtcgtcgtacctacgttactttaacggngggtacctacgtaccggtaacccgggtaaacgttccccggggtaccgtacggaaaccgtacgttaccgaagggtcggacggtaaccggttccggggtacgttacgggaaacgttaacggttaactttaccgtaaccgttacctaacccgtaaacccgtaacgttaccggaacgtacccgtaaacggtcccccgtagggaacccgtaagggtaccttaaaaggggtaaacgttaaccggttgggttaacggttaactttaaacggtttttttaaaccgtaaagtttttcccgggtaaaaaccttaaaaccgggttttaaaaaatttttaacccgttttttttaaaaagtttaaacccgggtttttaacgttttttacggggggaaaacccgggtttttaaacccccgggggttaaacccgggggaaaacccggtttaaaaaaaaccccggggggggtaaaccccgttttaaaaggggggggggtttaaacgtttaaaaaacccggggttaaaacccttttaaccccgggggtaaaaaaaccccgggtttacggggttttaaaaaaccccccggggtttaggggttttaaacggggtacccccggttttaaaccgggtaaaaccccccggg

SEQ ID NO: 278722 - DNA, 784 bp, Homo sapiens
  misc_feature: GYAE6OF01ARPNP.19.71.G05.1.454.CMB.1.raw
  modified_base (772)..(772): a, c, t, g, unknown or other
  misc_feature (772)..(772): n is a, c, g, or t
tcagtactctcgtgcacgaccggtgctcgatttagtgtcgtcgcaagagagaggggggaggtacaacaggcaggcaggggcagcaagatggtgttgcagacccaggtcttcatttctctgttgctcgtggatctcgtggtcgcccgagggacagtcgtgatcgaccctagtctccagacctcccgtggctgtgtctcgtgggcgaggccggccacatcaacgtgacaacgtccacgaccaactaattcttttaacacgtacgttaaccaaataagtaacgtaaaaaccttacgttacggttaccgttacggtaaccaaggaccaaggaaccgaaccgaacggggtaaccaaccggtccccgttaccggtaacgggtcctacggtcctaacgtttaacgtttacggacgggtacctaaccgttacccggtaaccccggggtaaacggttccccgggggtaccctaacgggtaaccgtacgttcgtaacgggtcggaccgtaagggtcccggggttacggtacgggaacttacggtactttccgaccgttcctacccgaacgtaactcgaaccgtacgtacgccgtagaccgagtacgtagaagtcgtagtcggtaatttagtttacttacgttagtaaacctaagttaattagtttaaactttagttacgttaccgggttaggtaacccggtaccggtaaaccggtaaacgggtacgtaaaggggttacgaaattacgtaacggaaccgtaacgtaccggtaagttccggggntaaccccggacg

SEQ ID NO: 278723 - DNA, 882 bp, Homo sapiens
  misc_feature: GYAE6OF01BCOD5.19.71.G05.1.454.CMB.1.raw
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtcgcccgacggggacatcgtgatcgaccctagtctccagacctcccgtggctgtgtctcgtgggcgacggccggccaaccataccaactgacctaacgccacgacccaactaactttcgttttaactaaccgtaacgttaaccaaaactaaagtaaacgtaaaaaccttacttacgtaccgttacggtaaccagacaaggaacgtacccgaaggtaaccacgtacccgtaccgtacggctagcccttacgtaacgtttacggtcgggacctaccggttaccccggtaacccgggtaaccggttccccgggggtacctaccggaaccgttacgttaccggtaggccgggtacgtacggggtccgggttaccgggtgggaaacgttacggttacttttacccgaccgttacccacccgtaaacctagtccgaacgtacccgaccggttaccctacgaaccgggtacggttaacggttaacggaaggttaccggtttaccggttaacgggttaacggtttttaaacgtttttaacgttcggtttaaaacgtaaccttaaaactttaaagttttaacgtttaaacctttaggtttacccgtttaacggggttacggttaaccccgggttaccggaaaacccggggttaaaacgggtaccgtaaaggggtttaacccgtaaagttaccgtaaaccggaaaacggggttaccggttaaacggtcggttaacgcccgggttacgaaaccccc

SEQ ID NO: 278724 - DNA, 743 bp, Homo sapiens
  misc_feature: GYAE6OF01A0O7P.19.71.G05.1.454.CMB.1.raw
tcagtactctcgtgcacgaccggtgctcgatttagtgtcgtcgcaagagagaggggggcagagtctgctgaattctggctgaccagggcagtcaccagagctccagacaatgtctgtcctccttcctcttcttcctgcccgtgctcgggccctccacaaggtgtcctgtcaacaagtacagctgcagcagtcaggtccaggtactggtgaacgcccctagccacgaccctctccgctccaccgtgtccgccacgtccggtccgggacgacgacggtcgtacgtaggaccgaactcggttgtttcggcgtttcgggaccgtacggttcgggtaccgaacggtcccgtaccggtaccccgtagtaccgggtaacggtaacgggttaccgtaaggggtaacggtcggggtaccggtaggggaaacggtaacgtaaacttacgtttacgacgttacgtacccgaaacgtacggtaaggtaaacttaaccgtaaaattacgtacgactaacctcttacgttacggttagtacgtacggtaacgtacgttaacgaacgtaacgtaccgtaaaccgtaacgaacgtaacgtaacgaacgtaaacggtaacccttaccgttacctaccgtacgaccgtacgtacctacggtccttacgtaccggtaccgtaacccgtccggaacgtacgggtaggttacgttagtaacgttcgtaaggtaacggtacggaacccgtcccgtaagttaaccg

SEQ ID NO: 278725 - DNA, 767 bp, Homo sapiens
  misc_feature: GYAE6OF01BZQG0.19.71.G05.1.454.CMB.1.raw
  modified_base (246)..(246): a, c, t, g, unknown or other
  misc_feature (246)..(246): n is a, c, g, or t
  modified_base (334)..(334): a, c, t, g, unknown or other
  misc_feature (334)..(334): n is a, c, g, or t
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatcgacccagtctccagactccctggctgtgtctcgtgggcgagccgggccaccatacaactgacaagtccacgccaactattcttttanactagttccaaactaatagtaaaactacttagcttacggtaccagacagacgaccaggacacgcctccgtaggctgctctatttacgngggctacgtccgtaccgggaacgtcccgggggtaccctagtaccgtatttaccgaggtacggccgtaacggtccggggttacgtacggggtaacgtacggttaactttccaccgtttacctacctaacccgtacgttcgaaccgtaccgtaacgtcccggttaccgaccggtaacgggtccgttaaagggtaaacgtacggttacggtacgggttaacgtttacggttttttaaacgttagtttaaccggtaacttaaaactttaaaccgttttaattttaaacgttaactttaccgggtttaggtaaccgggtttaccgtttacccgggaaacccgttaaaggggacccggttaaaggggttcgggttaaactacggttaacgaaaccggttaccgaaacggttttgggaccggtacgttccgggtaaaccc

SEQ ID NO: 278726 - DNA, 876 bp, Homo sapiens
  misc_feature: GYAE6OF01C7A0L.19.71.G05.1.454.CMB.1.raw
  modified_base (770)..(770): a, c, t, g, unknown or other
  misc_feature (770)..(770): n is a, c, g, or t
tcagtactctcgtgcacgaccggtgctcgatttagtgtcgtcgcaagagagagggggagagtctgctgaattctggctgaccagggcagtcacagagctccagacatgtctgtctccttctcttctcctcgccgtgcgtcggcctcccacgtaaggtcgtcctagtcacagtacagctgcacgcgacgtacgacggtaccgaggtacgtaggtacgaaccgtccccgtcggacctaaccggtcccctaccgtccgaccttccgaccgttcggtaccgtcccgtaacgttcccgggtacccgggggtaacgtaccgggtaccggttaccgtaccggttacggaaccggtacggttaacggttttcggttcggttcccggtttcgggaaccgttaccgggttacgggtaccggacggtacccgtacccggttaccccgtaggtaccggtaacgggtacggttacggtaacgggtagggttacgggtcggaaggggtaaacggtaactttacggtttacgtttaacgaaccggtttaaccgtaaaccgaaaccggttaaggtaacggtaaaacttaaacgtaagtttacgtcggaaccctaccgttagttacgtaggtacgacggtacgtacggtaactaaccggtaattaaccgaaggtaaaccgtacgtaaaccgaacttaacgaaccgtaaaccgttacccgttacgttaccctacccgtaccgtacgttaacccgccgtttaacgtaccttaccggtacggttaacccnccggggtaaacccggtcggttaaaccggtacgggtaaatttaacggtaacctttacgggaacggtaaaccggaccggtaacccccgtacgtaaaggttccgaaacg

SEQ ID NO: 278727 - DNA, 669 bp, Homo sapiens
  misc_feature: GYAE6OF01AX17U.19.71.G05.1.454.CMB.1.raw
  modified_base (486)..(486): a, c, t, g, unknown or other
  misc_feature (486)..(486): n is a, c, g, or t
tcagtactctcgtgcacgaccggtgctcgatttagtgtcgtcgcaagagagagggggaggtacaacaggcaggcaggggcagcaagatggtgttgcagacccaggtcttcatttctctgttgctctggatctctggtgcccacggggtacatcgtgatgacccagtctccagactccctggctgtcgtctcgtggcgagcgggccaccgatcaactgcagtccagccacattctttatacagttaccaactaatacgtaaactacttagccttaggtaccagcaggacgaccgaggacacgtcctcgtaggtcctcggcttcgtaacgtttaccgtcgggacctaacgttcccgtaaccccggggtaactccccgggggttaaccctcgggaacccgtagttcgaacgttcgggaccgtagggtcgggtcgtcgggtactaacggtctttccacgttcctcaccgattccaggtccgacgtcccgnggtaccgtaggccgtaaggacgtcgtagtacggtactaggtttaactttattacgtactaaagttacttaagtttacttattaaccgtttcggtacggtaccggttaccggaccggtaacggaaccgttagggaactgtaccgtacgtaacggtacgaacgtttggaccgttgtacccggtac

SEQ ID NO: 278728 - DNA, 884 bp, Homo sapiens
  misc_feature: GYAE6OF01BSUY7.19.71.G05.1.454.CMB.1.raw
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtcgcccgacggggacatcgtgatcgacccagtcctaccagtacctcccgtggctgtcgtctcgtgggcgacggccggccaaccataccaacgtcgaccgtaacgtcccacgaccaactaactttcttttaactacgacgttaccaaactaataacgtaaaaccttacgttacggtctttacggtaaccgagtaccgaagaacggaaccgaacgggaacctacggacccttaccggtaacggtccgttcgtaccttaccttaacgttttaccgtcgggtacctaaccggttacccgtaacccggggtaaccggtccccggggtaccctgaaccgtcgtacggtagtacgggacgtaacgggtccgggtacgtacggggaactaccgggtttacttaccgtacccgttaccacccgtaaccgtaaccgtcaaaccggtccgtaacggtcccgtaggacccgttaacggggaccgttaaggaaggttacggttacgggtaccgtttaaccggttttaagtttttaagttaccgttttaacggtaaacccttaaaaccgtttaaagttttaactttttaaacggtttaacccgttaaccgggttttaccggttaccggggttaacccgggttaacccgggaaaacccgggttaacggggttaaacccggtaaggggttaagttaaacgttaaccgtaacgaaaccgggtaaaccgttcgggttacgggtaccgtaccgttaccggaacccc

SEQ ID NO: 278729 - DNA, 743 bp, Homo sapiens
  misc_feature: GYAE6OF01C5AXX.19.71.G05.1.454.CMB.1.raw
  modified_base (300)..(300): a, c, t, g, unknown or other
  misc_feature (300)..(300): n is a, c, g, or t
tcagtactctcgtgcacgaccggtgctcgatttagtgtcgtcgcaagagagaggggagagtctgctgaattctggctgaccagggcagtcaccagagctccagacaatgtctgtctccttcctcttctcctgcccgtgctggccctcccacaaggtcgtcctgtcacaagtacagctgcagcagtcacggtccaggacgtggtcaacgccctgacctacgacccctcgtcgacctcctacgtgtcgccgtagtaccggtccggggacagcgtccgtacgtagacgtacgtacggttgttnccgttggacctacggtcgggtacgacggtcgaccgtaccccgagtccggaaggtcggtacgtaggacggttcgggcggaaggggagtaccgtaattagtttactacgtaccgttaccgaaacggtaccggttaagtaaaagtaccttaaagtttacacggtaacctaccgtagttaccggtttggttacggaaggtacccgttacgtaacggtactaacccgttaagtaacccctaaaggtaccgaaactaaccggtacgttaaacggacccgttaaacccgttaccgtttacccctaccccggtttagtacccggtacttacccgttaaccgtaccgttcccgttacggtaccgtacccgtaccgggagtaaacccggtagggtttacgtaatttacccggttaggtacgtaacgggtaccgccgaccctaagtacgacccg

SEQ ID NO: 278730 - DNA, 685 bp, Homo sapiens
  misc_feature: GYAE6OF01BRFWN.19.71.G05.1.454.CMB.1.raw
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtcgcccgacggggacatcgtgatcgacccagtcctccagacctccctggctgtgtctcgtggcgagccggccaccatacaactgacaacgtccacgaccactaacttactttagtactacgttaccaaactaagtaacgtaaaacttacttagtacttacggtaccagacagacgacgaggacacgcctacgaggctcgctacttacttacgtggacctaacgttacccggtaacccgggtaaccggttcccggggttaccctacggtaacccgtacgttaccgtagggtccggacggtacgggtccggtacggtacgggactacggttacttcgtaccgtcctacaccgtactacgacgtcacgctaacgcgaggtcgtaaggtacgtagtaggtcgttacgttagttttactagttactaactaacttagttaactttattacgtttacgtacggttacggtaccggttcggaaaccggtacgggtaacggtaaggttaggtacttacgacggacgtaacggtacgtcggtacgtcgtcgtaaccg

SEQ ID NO: 278731 - DNA, 726 bp, Homo sapiens
  misc_feature: GYAE6OF01AKCCW.19.71.G05.1.454.CMB.1.raw
  modified_base (234)..(234): a, c, t, g, unknown or other
  misc_feature (234)..(234): n is a, c, g, or t
  modified_base (262)..(262): a, c, t, g, unknown or other
  misc_feature (262)..(262): n is a, c, g, or t
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacagtcgtgatcgacccagtcctccgacgacctcccgtggctgttcgtcctcggtggggccgaggccgggccaccgactacgaacngacgtaacgtcacgccactattctttanacacgtacaacgaatagaaaactattacgtcttacggaacagacagacgaaccaggaccacgtccctaccgtaggcctgctactagttacctggactacgtccggtaaccgggtacggtcccggtaccgtacgtaaccggtacttaccggaggtcggaccgaggggtcggtacgtacggggaactagtacctttaccacgtcctacacctacggtacacggtacaccgtcgtagtccgaagggtactaggaacgtagttaggtcggtactttaagtttaactttacgtaactactaaaataatttaacttttaagttaacgtttaccggtttacggtacggttaacccggttacgggtaaaccggtaaacggggtaacccggtaaaggggttccgtaaaggttctaaacccggggaacgtaaaccggtttaacggtaggtttaccggaaccgtccgtaacccgg

SEQ ID NO: 278732 - DNA, 644 bp, Homo sapiens
  misc_feature: GYAE6OF01A38L5.19.71.G05.1.454.CMB.1.raw
  modified_base (354)..(354): a, c, t, g, unknown or other
  misc_feature (354)..(354): n is a, c, g, or t
  modified_base (472)..(472): a, c, t, g, unknown or other
  misc_feature (472)..(472): n is a, c, g, or t
  modified_base (638)..(638): a, c, t, g, unknown or other
  misc_feature (638)..(638): n is a, c, g, or t
tcagtactctcgtgcacgaccggtgctcgatttagtgtcgtcgcaagagagaggggggaggtacaacaggcaggcaggggcagcaagatggtgttgcaggacccaggtcttcatttctctgttgctctggatctctggtgcccacggggacatcgttatcgacccagtctccagactccctggctgtgtctcgtgggacgagcggccaccatcaactgacaagtccagccactaattactttacactacgttaccaaacaaatacgtaaaaactacttacgacttaggtaacccagacaagaacgaccaagggtacaccggcctaccgtacggcttcgactcttaagttaccgngggaccacgttcccggtaacccgggtaacgtcccggggtcctaggaccgtattccgaaggtcggacgtacggtcggtacgaggacctagtacgtttcaaccgttcacacctataccgngtacctagacctgaccgaggtactaagacgtgtacggtacgtactttagtttatttacgtacgtaacgtaataacgtttagttaaacttagtacgttacgtcggttaacgtacggaccgaagggtacgtaaggtgtaactagacgagacggtacttaggtcgagtnacgtac

SEQ ID NO: 278733 - DNA, 813 bp, Homo sapiens
  misc_feature: GYAE6OF01CYDU8.19.71.G05.1.454.CMB.1.raw
  modified_base (240)..(240): a, c, t, g, unknown or other
  misc_feature (240)..(240): n is a, c, g, or t
tcagtactctcgtgcacgaccggtgctcgatttagtgtcgtcgcaagagagagggggaggtacaacaggcaggcaggggcagcaagatggtgttgcagacccaggtcttcatttctctgtgctctggatctctggtgcccgagggacatcgtgatcgacccagtctccagacctcctggctgtgtctcgtggcgagccggccacgatcaactgctaacgtccagccactaattctttaanctacgttaccaactaagtaagtaaaaccttcgttagtacgtttacgtaacctagactaagaacgaccgaggtaacaccgtcctaccgtaacgtccgtcgtacttctaacgtttacgtaggacctacgtaccggtaccggtaaccggttccccggggtacctccggtaaccgtaggtttaccgagggtttacggaccggtaacggttaccggggtccggtttacgggaaccgttaagtttacctttacgacccgtttaccgtaccaacccggtactaccggtaacgtaccgtaccggtaccttaccgggaccgtaagggtaccgtaacggttaaaggtggtttaccgggttaggttaaccggtttaagtttttaacgttttaacggtacgttaaacccgttaaaagtattttaaacggtttaaaccttttaccggttacggttttacccggtaaggtttacccgggtaccggtaaccgggtaacggtaaacccgggtttagggttaagggtacccttaaacggtacgttaaccgttaacggtaacggttagttacggccttaaccgtaacccgg

SEQ ID NO: 278734 - DNA, 689 bp, Homo sapiens
  misc_feature: GYAE6OF01EZ741.19.71.G05.1.454.CMB.1.raw
  modified_base (241)..(241): a, c, t, g, unknown or other
  misc_feature (241)..(241): n is a, c, g, or t
  modified_base (681)..(681): a, c, t, g, unknown or other
  misc_feature (681)..(681): n is a, c, g, or t
tcagtactctcgtgcacgaccggtgctcgatttagtgtcgtcgcaagagagaggggggaggtacaacaggcaggcaggggcagcaagatggtgttgcagacccaggtcttcattttctctgttgctctggatctctggtcgcccacggggacatcgtgatgacccagtctccagactccctggctgtgtctctgggcgagcggccacatcaactgcaagtccagcccactaattcttttanacctagttaccaactaatacgtaaaacttacttagtcttaggtaccagacagacgaaccgaggacaggtcctaccgtaggctgctctagtttacgtgggactacgtaccgtaacccgggacgtcccggggtccctacgtaccgtattacgagtcggaccgaggcgggttcgacggggtacacgggttactttccgacgttactacccgtaacctacgtacgacgtacctaacggtccctcggtacccgaacgggtacctacgggtaacgtacggttcggtacgggtacgtttacgttttaagtttacgttaacgttaaccgtaaacttaagtttatttaatttaacgttacgtttacggagggtttaccggttaccggaccgtaaacgggtacctaagggtagtaactagtactaacggtacgtacggtagtcggtacgngtaacccg

SEQ ID NO: 278735 - DNA, 901 bp, Homo sapiens
  misc_feature: GYAE6OF01C9U7K.19.71.G05.1.454.CMB.1.raw
  modified_base (258)..(258): a, c, t, g, unknown or other
  misc_feature (258)..(258): n is a, c, g, or t
tcagtactctcgtgcacgaccggtgctcgatttagtgtcgtcgcaagagagagggggaggtacaacaggcaggcaggggcagcaagatggtgttgcagacccaggtcttcatttctctgttgctctggatctctggtcgcccgacggggacagtcgtgatcgacccagtcctccagacctcccgtggctgtcgtctcgtgggcgacggccggcctaccgatcaacgtgaccaacgtccgacaccactaattctttaanactacgttaaccaaacaataacgtaaaactcgttaagtccgtttacggaaccagacaaggacgaccgaggaacctaccgtcccgttaccgtagggtcctacgtacctttactaacggttttaccggtacgggtaccctaaccggttacccccggggttaacccgggtaacccgggttccccgggggtaccccgttaccggtaaacccgttacggttacccgtacgggggttacggtacccgggtacggggtaccggggggttacccgttacggggtaacccgtttaacgggttttaaccctttacccgttaccccgtttaccccaaccgtaacccggttaacacccggtaacggtaacccgtaaccggttccccgggtacgaaccgggtaccgtaccgggttaaagtaacggtacggtttagggtaaccgtttaaccgttttagttttaacggtttaacgttaccgttaaacctaatttaacttttaagtttacctttaacgttaccggtttacggttaaccggttaccggttaacccgggaaccgggttaaagggtaacccggtaaagggtttaccgagttaccggtaaaccgtcgggttaaacgttacgggttagggtacccgtacccggtaggtaacccc

SEQ ID NO: 278736 - DNA, 778 bp, Homo sapiens
  misc_feature: GYAE6OF01AD3RM.19.71.G05.1.454.CMB.1.raw
  modified_base (261)..(261): a, c, t, g, unknown or other
  misc_feature (261)..(261): n is a, c, g, or t
  modified_base (277)..(277): a, c, t, g, unknown or other
  misc_feature (277)..(277): n is a, c, g, or t
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccgacggggacatcgtgatcgacccagtctccagacctccctggctgtgtctcgtcggggcgacggccgggcccacgactacaacgtgacctaacgtccacgccaactaacttcttttaanacgtacgttaccaaanaactagtaaaacctcgttagtacgttacggtaccaagcgaacgtacgaaccgtaagggaccacgtccctaccgtaaggcctggtacctacttagtttaccggtcgggtacctaacggttcccggtaaccccgggtaacggttcccccggggtacctaccggtaaccgttgttaccgaggtcgggacgtacggggtccgggtacggtacgggaacttacggttctttacccgaacgtacccgttaccaacccgtatacccggtacgggacctaaccgggcctagggaccgtaacgggctaaggaacggttcgtacgggttcgttattaacgttttaagtactttaacggaaccttaaatttaagtttcgtttaacgtttaacgttaccggtttacgggtaccgggtaccgtttaaacccgggaaccggttaacggggaccgtttaagggtactattaccggacttaacgggaaccgttagtacgggtcgtacggtacgtacc

SEQ ID NO: 278737 - DNA, 651 bp, Homo sapiens
  misc_feature: GYAE6OF01BAYKE.19.71.G05.1.454.CMB.1.raw
  modified_base (243)..(243): a, c, t, g, unknown or other
  misc_feature (243)..(243): n is a, c, g, or t
  modified_base (296)..(296): a, c, t, g, unknown or other
  misc_feature (296)..(296): n is a, c, g, or t
  modified_base (319)..(319): a, c, t, g, unknown or other
  misc_feature (319)..(319): n is a, c, g, or t
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctcgtgggcgaggccgggccaccgatcaactgcaagtccagccacaattcttttanacagttccaacaatagaaaactcttagcttaggtaccagcagagaccaggacngcctcaggctgctctatttacgngggctactaccgtacccgggaacgtcccgggggtccctacggaccgtattccaggtcggacgtacggccgggtcgtacggggaacctaggtactttccgacttcctaccaccctattaccgacgccgaacggtcctacggacgacggtccgtaaggaagtcgttggaggtacttaggtttacttagttacggtactaaactaatttaagtttattaacttacgttcggtcggttaccgtttaccggaaccggtaaacgggtaccgtaagggttacggtaattacgtaccggtaaacgtaccggttaacgtgggtacggtccgtacgtacccg

SEQ ID NO: 278738 - DNA, 714 bp, Homo sapiens
  misc_feature: GYAE6OF01D33XW.19.71.G05.1.454.CMB.1.raw
  modified_base (141)..(141): a, c, t, g, unknown or other
  misc_feature (141)..(141): n is a, c, g, or t
  modified_base (256)..(256): a, c, t, g, unknown or other
  misc_feature (256)..(256): n is a, c, g, or t
  modified_base (385)..(385): a, c, t, g, unknown or other
  misc_feature (385)..(385): n is a, c, g, or t
tcagtactctcgtgcacgaccggtgctcgatttagtgtcgtcgcaagagagagggggggaggtacaacaggcaggcaggggcagcaagatggtgttgcagacccaggtcttcatttctctgttgctctggatctctggtcncccgacggggacatcgtgatcgacccagtcctccagacctccctggctgtgtctcgtgggcgacggccgggccactatccaactcgacaacgtccagaccactaacttcttttanaacctacgttaccaaactaataacgtaaaaacttacgttagtccgtttaggtaccagtaccgaagaacgaacccgtaagggaaccacgtacccttacggtaggtcgtacgtccttactagttttacggngggactacgtacccgggtaaccgggtaccgttcccggggtacctacggaccgtattccgagtcggacgtaggccggggtcgtacggactacgttactttaccacgtacctacctacctaatcgacggtactacgtcctaggacctagggtacctaggaagtacgttggtgtacgtttaagttttactagttacgtaactaaattatttattacgtttacgttacggttacggtaccggtaaccggttaccgggaaccgtaagggaaccgtagggttaggaacttacgacgaaacgggttactaaacggttgggacgtcccgtgtacccg

SEQ ID NO: 278739 - DNA, 807 bp, Homo sapiens
  misc_feature: GYAE6OF01CP42K.19.71.G05.1.454.CMB.1.raw
  modified_base (209)..(209): a, c, t, g, unknown or other
  misc_feature (209)..(209): n is a, c, g, or t
  modified_base (245)..(245): a, c, t, g, unknown or other
  misc_feature (245)..(245): n is a, c, g, or t
  modified_base (363)..(363): a, c, t, g, unknown or other
  misc_feature (363)..(363): n is a, c, g, or t
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtcgtctcgtgggcgagcgggccacntcaactgcaagtcccagccaactaattcgttttaanactacgttaccaaacaactagtaaaaaccttacgttaacgtctttacgggtaaccagacaggaacggaaccgaggacctaacgtccctaccgtagggcctgaccgttcagttttaccncgggactagtcccgtacccgggtaacgttccccgggggtcctacggaaccgtacgttcgaggtcggacgaggtccggggttcgtcggggtaactacggttaactttccgaaccgttccgttaccaacccggttacaccgtacggacctacggtccgttacggaaccgtcgggaccgttaaggaaaccgggtagttacggttacgggtaccgtttaacgggttttttaaactttggttttaaccggtaaccttaaaaacgtttaccttttaaaggttttaaactttaacgtttaccgtttacgggtttaccggttaaccgggtttacccggaacgggtaaaccgggtttaaaccgaagggggttacccggttaattaaccggtaacggttaaaccggtaaaccggttaacggttacgggtccggggtaacctttcggaaaccccg

SEQ ID NO: 278740 - DNA, 864 bp, Homo sapiens
  misc_feature: GYAE6OF01DHPC4.19.71.G05.1.454.CMB.1.raw
  modified_base (197)..(197): a, c, t, g, unknown or other
  misc_feature (197)..(197): n is a, c, g, or t
tcagtactctcgtgcacgaccggtgctcgatttagtgtcgtcgcaagagagagggggagtacaacaggcaggcagggcagccaagatggtgtgcagacccaggtcttcatttctcttgttcgctactggtactctcgtggtcgccccgagggactagtcgtgatcgacccagtcctaccacgacctccctggctgtntccgtggtcgggcgacgcccggtccaaccgtactaccgaacgtcgaaccgtaacgtccaaccgaccctaaataacgttttaccgttttaacaccgtacggttaaccaaaacgtaagttaacgtaaaaccgtctttaacgtaccgttaccgaacgtagaactaaacggtacgaacccgtaggtaaccgaccgtccgtaccgtaaggccttaacgcttaactttacggttaacccgtggaacccttaccgtacccggtaacccgggtacggtcccccgggttccaaggtacccgtacgttacggacggtttacggcgacggttacggtccggttaacgggacttaacgttaccgtttcgaacctttaccccgaaccgaacctagggttaccgacggaaaccccttggggtccctaaagggacccgtaggtaaccggttagaaacgttcgggttcgtttaaccggtacctttttaagttttaacccgtaacggtttaacccttaaccgtaaaagttttaccttaaggttttaacgttaccttaccggttccgggttaaaccgttaaacccggtcgggaaaaccctaacgggtaaccggttaagtgtaaaaacctcgttaaaaccgaccggtttaaacggacccgttaggccggttaagcccccttaacgg

SEQ ID NO: 278741 - DNA, 724 bp, Homo sapiens
  misc_feature: GYAE6OF01EKUQ6.19.71.G05.1.454.CMB.1.raw
  modified_base (241)..(241): a, c, t, g, unknown or other
  misc_feature (241)..(241): n is a, c, g, or t
  modified_base (354)..(354): a, c, t, g, unknown or other
  misc_feature (354)..(354): n is a, c, g, or t
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagccgggccaccatcaactgacaagtccagccacaattcttttanactacgttaccaaactaaatacgtaaaaaccttacttaagcctttacggtaaccagtccaagtacgaacccagggaccacggcccttacctagggcctggctctattttacgngggctacgtaccgtaacccgggaacgtcccggggtcccctaggacccgtagttccgaggttcggcacggtcggggtcgtacgggaactaggtatttccactcctccgaaccactccgaacgtccgtacgcctgggcctaacgggtccttaggaaagtagttcgggtacgtacgttaagtttttaattagtttacgtaacctaaacgtttaatttaacgttttaatttacttaaccgtttttcgggtaacggttaacccgggtttccgggaaaccgtaaacgggggaacccgttaaaggggttacggtaaatttaaccgtaacgtaacgggtaaaccgtaaccgttgggttcgggtcctacgggtaacccc

SEQ ID NO: 278742 - DNA, 672 bp, Homo sapiens
  misc_feature: GYAE6OF01CHR21.19.71.G05.1.454.CMB.1.raw
  modified_base (235)..(235): a, c, t, g, unknown or other
  misc_feature (235)..(235): n is a, c, g, or t
tcagtactctcgtgcacgaccggtgctcgatttagtgtcgtcgcaagagagagggggagagtctgctgaattctggctgaccagggcagtcaccagagctccagacaatgtctgtctccttctcttcttcctgcccgtgctgggcctccacgaaggtcgtcctgtcaacaagtacagctgcagcagtcaggtccaggctggtgacgccctgacacgaccctctcgctcactgtcncctatccgtaccggggacacggacgtccgacgtacgcgtacgtaggttcgttcggacgtttggacgtacgttcggggtcacgggtccacggtacccgtagtcggagtacggtctaggaggtcggacgtaggggaactacgaagttatttacgaacgtcgtaaccgaacgtaacggtaggtaaaacttaacttaaagttacgtacgaccgtaactacgtttcgttaggttaggtaacgtacgtacgtactacgaactaacgtacgtaaacgacgtaacaacgtaacgttaacgaaacgttaaccgtacgtttacccgtacctacgtctaacgtccgtacgtaccgtcgtaccggtacgtacccgtacggacggtacggtacggttagtacgttacgttacggaggtaaccggacgacccgtacccgagtaccgtaacg

SEQ ID NO: 278743 - DNA, 722 bp, Homo sapiens
  misc_feature: GYAE6OF01AU2G4.19.71.G05.1.454.CMB.1.raw
  modified_base (360)..(360): a, c, t, g, unknown or other
  misc_feature (360)..(360): n is a, c, g, or t
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacgggggacatcgtgatgacccagtctccagactccctggctgtgtctcgtgggcgaggccgggccaccatacaactcggacaacgtccagcccaactaattccttttatactacgttaccaaactaatacgtaaaactacttacgctttggtaaccagtacaggaacgtaccgaacggacacgcccttaccgtacggtctcgcttactagtttacgngggactacgtaccgtaccgggtaacgtcccgggggtccctaggtaacccgtcttacgacggtcgcgtacggtccgggtcggagggtactagtacttccgactcctactacctagtaccagcctaacggccctaggtaccgagggtctaaggaacgttgtacgggtcgttacttaagttttagttaccgttagtaaccgtaaacttaatttaacgtttaactttaacttacggttcggtttaccgggtaccgggtttaccggaacccggttaaaaggggaccccggttaagggtaccggtaaagttacgtaaccgaagggttaaaccgtaacggttagggacgggttcctacggtaaaccccg

SEQ ID NO: 278744 - DNA, 739 bp, Homo sapiens
  misc_feature: GYAE6OF01EW4YO.19.71.G05.1.454.CMB.1.raw
  modified_base (272)..(272): a, c, t, g, unknown or other
  misc_feature (272)..(272): n is a, c, g, or t
tcagtactctcgtgcacgaccggtgctcgatttagtgtcgtcgcaagagagaggggggaggtacaacaggcaggcagggggcagcaagatggtgttgcagacccaggtcttctatttctctgttgctctggatctcgtggtcgcccgacggggacagtcgtgatcgaccctagtcctccgagacctcccgtggctgtcgtctgtcggggcgacggccggacccacctacgtaccaacgtgactaacgcccgacacctaactaattcctttanaacctacgttaccaataataacgtaaaacttctacgtcgttacgaccagacaagacgaaccgagacaccgcccgtacgacggtcgtcgtacttattaacgttacgcgggtacctacggtaccccgggtaacccgggtaacccggttccccggggtacccgtaggacccttaggtaccggtaggtaccggcggtacgggccggggttacgtacgggtaactcggtttaacttccgtacctctaccaacctactacgacgtactcgctacggcgaggtaccgtaagacgtagtcgttagttacctttagtttacttaggttactaacgtaatttaactttaagttacgttaaccgtttacggttacgggttaccgggttaccggtaaccggaaccgggtaaaccggaacggttacggtaaggttcaagttaacgaacggtacgtacggttagtcggtacgaccggtacg

SEQ ID NO: 278745 - DNA, 564 bp, Homo sapiens
  misc_feature: GYAE6OF01CU060.19.71.G05.1.454.CMB.1.raw
  modified_base (211)..(211): a, c, t, g, unknown or other
  misc_feature (211)..(211): n is a, c, g, or t
  modified_base (401)..(401): a, c, t, g, unknown or other
  misc_feature (401)..(401): n is a, c, g, or t
  modified_base (491)..(491): a, c, t, g, unknown or other
  misc_feature (491)..(491): n is a, c, g, or t
  modified_base (536)..(537): a, c, t, g, unknown or other
  misc_feature (536)..(537): n is a, c, g, or t
  modified_base (539)..(544): a, c, t, g, unknown or other
  misc_feature (539)..(544): n is a, c, g, or t
  modified_base (546)..(564): a, c, t, g, unknown or other
  misc_feature (546)..(564): n is a, c, g, or t
tcagtactctcgtgcacgaccggtgctcgatttagtgtcgtcgcaagagagaggtctagagtggctgggaaggacatatttcatgtccaacacgtggaatacaaattatgcaccatctgttgagagtcgactgacaatcaacgtagacacatacgaaagaaccagttcctccctgcagctgacctctgtcgacctcccgaggacgacggtntatattactgtaggaagaccggaccccatagacagtcgcccacctcgtcttcgtggtcgcttaagtacggttcgggggaccgaacggggaacccctagtcgtccgtacccgtcctcccgtccggccctaccgaacccgacgggccctagtccgtcccttcccccgtgccgccctcgcgtccgaggcaccncccgtcgagacgcacgacgcccggtccgtcgggctcggccgtaggacgaaccggtaccttaccgtacccgaacggtacggtacgtaacgngggacggccgggtacgtacgggacgaacgggccgtacgaagtagnngnnnnnngnnnnnnnnnnnnnnnnnnn

SEQ ID NO: 278746 - DNA, 863 bp, Homo sapiens
  misc_feature: GYAE6OF01E32UN.19.71.G05.1.454.CMB.1.raw
tcagtactctcgtgcacgaccggtgctcgatttagtgtcgtcgcaagagagagggggaggtacaacaggcaggcaggggcagcaagatggtgttgcagacccaggtcttcatttctctgttgctctggatctctggtcgcccgacggggacatcatgatcgaccagtctccagactccctggctgtcgtctcgtgggcgaggccgggccaccatcaacgtgacaacgtccacgcctaacaattcttttaactacacgttacccaaacaactacgtaaaaacttacttacggtccttacggtaacccaagaccgtaacggaaccgtaaccgaacgggaccaacgtacccttaccgtacggcctacgtccttacgttaacgttttacgacgggtaccctaagttacccggtaaaccccggggtaccggttacccccggggttccccctaacgggtaccccgtaacgtttccgagggtccggtaccggtacggtaccggggtccgttaaggggaaccgttacggtacttttacccgacgttcctacccgaaccttaacgttccaagtacccgtacggtcccgtaggaccgaacggggtctaaagggaagtacggttcgggtcggttaacgtttaagttttaacgtttaggtttaccgtaaaccttaaaacttaaagtttttaacctttaagttttaaccgttaacccggtttgggtaaaccgggggtttaaaccccgtttaccgggggaaaccgggttaaaacccggggttaaacggaaccggggtttaaaggttaccttaaaaggttaccggaacgggtaaaacccgggttaacgtttcggggtaccgggttaccgtaaaccggg

SEQ ID NO: 278747 - DNA, 655 bp, Homo sapiens
  misc_feature: GYAE6OF01BQ8CJ.19.71.G05.1.454.CMB.1.raw
  modified_base (158)..(158): a, c, t, g, unknown or other
  misc_feature (158)..(158): n is a, c, g, or t
  modified_base (465)..(465): a, c, t, g, unknown or other
  misc_feature (465)..(465): n is a, c, g, or t
tcagtactctcgtgcacgaccggtgctcgatttagtgtcgtcgcaagagagagggggtcaggctggaactgaggagcaggcaggggcagcaagatggtgttgcagacccaggtcttcatttctctgttgctctggatctgtggtcgacccgagggacngttcgtagatcgacccagtcctccgagacctccgtggctgtcgtctcggagggcgacggccggaccaccgagtacgaactcgacgtaacgccgagacccaattaacttcttttaacaccgtagttaaccaataaataccgtaaaacttcgttagtacttacgaccagcgaagacgaccgaaggacctcgccgtacggagtcgtcacgttactacgttacgcggactacgtaccggtaccggacggtcccggacagtaccgagttcgaacgtgacggtacggtcggcgtacggcgtaacgtcgttacnccttacgcgaactagtccgagacgtcgcgtagaccgagtacagtaagtcgtagtcgtaagttatttcgtaacttacgaacttaatagttacttaatttacgtacgttacgtacggtggttaacccgacggttacggtaaacgtggttaacgttacgaacggttaacccgagggttacgtaaggttccggg

SEQ ID NO: 278748 - DNA, 622 bp, Homo sapiens
  misc_feature: GYAE6OF01AGBO0.19.71.G05.1.454.CMB.1.raw
  modified_base (248)..(248): a, c, t, g, unknown or other
  misc_feature (248)..(248): n is a, c, g, or t
  modified_base (311)..(311): a, c, t, g, unknown or other
  misc_feature (311)..(311): n is a, c, g, or t
  modified_base (326)..(326): a, c, t, g, unknown or other
  misc_feature (326)..(326): n is a, c, g, or t
  modified_base (338)..(338): a, c, t, g, unknown or other
  misc_feature (338)..(338): n is a, c, g, or t
  modified_base (376)..(376): a, c, t, g, unknown or other
  misc_feature (376)..(376): n is a, c, g, or t
  modified_base (381)..(381): a, c, t, g, unknown or other
  misc_feature (381)..(381): n is a, c, g, or t
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtcgcccgaggggacatcgtgatcgacccagtctccagactccctggctgtgtctcgtgggcgaggccgggccaccgatacgaactgacaagtccagccataacttctttanacacgttaccaagtaatacgaaaactcgttacgtcgttggtaccagacacgtagaccaggacncgtccctcgtagctnctctatttacgnggactagtaccgtaccggtagtcccggtactcgacgtntacgngtcgctaggcggtctacgggactagtacttccactccacacgagtcagtacctcggtccgtacgaccgagtacctaaggaacgtgttacggtagtaccgtttaggttttaactcgttacgtaaccgaaactttaagttattttacgttacgtacggtttcgaaccggttcggtacccgaacgggaaccggttacgaaggtgtaccttacgtagaccgtacgaccgttgcggtcttcgaccg

SEQ ID NO: 278749 - DNA, 699 bp, Homo sapiens
  misc_feature: GYAE6OF01CVGY2.19.71.G05.1.454.CMB.1.raw
  modified_base (289)..(289): a, c, t, g, unknown or other
  misc_feature (289)..(289): n is a, c, g, or t
tcagtactctcgtgcacgaccggtgctcgatttagtgtcgtcgcaagagagaggggggaggtacaacaggcaggcaggggcagcaagatggtgttgcagacccaggtcttcatttctctgtgctctggactctcgtcggtcgcccgacggggacatcgtgactcgaccctagtcctccacgtacctccgtggctgtcgtctcggtgggacggacggcccggacccacgtactacctaacctcgactaacgtccaccgccaacttacttactttatactacgtaccaaanaataactaactgtacgtcgtacgtaacagacgacgacgacgacggacctacgtccgtacgtcgtctacgtcttacgttacgttacggaccggtactaccggtacccggtaccgggtccggtacccggtcgtaacggtactcgtacggtggtacggcgtcgggtcggtacggacgtagttacgtctcctactactacctactacgacacgtacgacgtacgtcgacgtaggacgtaaggtacgtacgtgtacgttagttacttacgttagtaacgtaactaacttaacttaacgttacgtttacgttacggttacggttaaccggtaccggtacggtaacggtaacggtacgtaaggtacgtacgttacgtaacgtacgtaaccggttaggtacgtacgtacgtacctacg

SEQ ID NO: 278750 - DNA, 713 bp, Homo sapiens
  misc_feature: GYAE6OF01A5TW0.19.71.G05.1.454.CMB.1.raw
  modified_base (248)..(248): a, c, t, g, unknown or other
  misc_feature (248)..(248): n is a, c, g, or t
  modified_base (554)..(554): a, c, t, g, unknown or other
  misc_feature (554)..(554): n is a, c, g, or t
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtcgcccgacggggacatcgtgatgacccagtctcagactcccgtggctgtgtctcgtgggcgagccgggccaccatacaacgtgacaacgtccagccctataattctttanactagttaccaaactaatacgaaaacttactaagtcgttaggaccagaccaagacgaaccgaggacacgtcccgtcgtaacggctcgactaccgtaattttacgagggactacgtaccgtaacccgggtaaccgttcccgggggtaccctacggtaaccgtacgttcggaacggtacgggacaaggggtcccggggtagttacgggggaacctaaggtactttccgactacctaccgaactatacgacgtacaacgcctagaccgaggtacgtagaacgtagttggtacgggactttaaggttttnttaagttacgtaaccaaacttaagtttaatttaagtttaacgtacgtttaccggtaggttaaccgttaccggtaaccgtaaaacggggtaccctaaagggttagtaaacgttacgaacgtaaacgtaaccggtaaagttggacgggtctacgtaacccg

SEQ ID NO: 278751 - DNA, 883 bp, Homo sapiens
  misc_feature: GYAE6OF01DVDZS.19.71.G05.1.454.CMB.1.raw
tcagtactctcgtgcacgaccggtgctcgatttagtgtcgtcgcaagagagagggggtcaggctggaactgaggagcaggcaggggcagcaagatggtgttgcagacccaggtcttcatttctctgttgctctggatctcgtggtcgcccgacggggactagtcgtgatcgaccccagtcctccagtacctcccgtggctgtcgtctcgtgggacgacggccggaccacataccaacgtcgaccgaacgtccgacgaccctaactaacttttactttttaactaccttaaccggtttaacccaaaacgtaaagttaaaccggtaaaaaacctttacgtttaacgtccgttttaacggtaaccccgaggtaccgtaacggaaccggtaacccgaacgggaaccctaccggtccccgttacggtttacgggccttacgttaccttacgttttacggtttaaccggcgggtacccttaaccggttacccggtaaccccggggtaaccgggtttcccccggggtacccgttacggaacccggttactttacgggacgggttacggaccggtaccggggtccgggttaccgtaacgggtacttaacggtttacctttacccgtacccttccgtacccgtaacctcgtacggacgaccgtccgtaccgtacgccgtacggtaccgtagaaggtttacgtcggttaacggttagttttacgttttaacgttattaacggttaacctaaagtttagtttaactttacgtttaacgtttaccgggtttggttaacccggggttacccgttaacccggggtaaccggtaaacgggttaccggtaaagggttacgttaaacgttacgtagtaaccgggtaacgttacgtacggg

SEQ ID NO: 278752 - DNA, 754 bp, Homo sapiens
  misc_feature: GYAE6OF01EHCTK.19.71.G05.1.454.CMB.1.raw
  modified_base (124)..(124): a, c, t, g, unknown or other
  misc_feature (124)..(124): n is a, c, g, or t
tcagtactctcgtgcacgaccggtgctcgatttagtgtcgtcgcaagagagaggggggaggtacaacaggcaggcaggggcagcaagatggtgttgcagaccctaggtcttcatttctctgttnctctggatctcgtggtcgcccgacgggacatcgtgatcgacccagtcctccagtacctcccgtggctgtgtctcgtgggcgacggccggcccacatacactcgactaacgtccacgaccactaattcttttaacacctacgttaaccaaataaactaacgtaaaaaccttacgtaacgtaccgttaggtaacccaggtaccaaggaaccgaaccgaagggaccacggtcccgttaccggtaaggtccctaggtacctttacgttaacgttttcgacgggactacggttacccggtaacccgggtacgtcccggggtccctagacccgtatcggtacggcggaccgtaggcgggtactcggggtaaactacggttactttaccgaccttccgtaccgtacctaacgtcaacgcgaaccgtctacggcgtacggtacgtagaaagtacggttggtacgttacggtttaagttttacgttttaacttaacgtaacccgtaaattaagttttactttaacgttacttacgtttacggttggtacccggtttaccggaaccggtaacggtaacggaaggttacggtataaaccgtaggtacgtaacgtaacgttcgggtaacggctcggtaaccc

SEQ ID NO: 278753 - DNA, 691 bp, Homo sapiens
  misc_feature: GYAE6OF01DI07U.19.71.G05.1.454.CMB.1.raw
  modified_base (258)..(258): a, c, t, g, unknown or other
  misc_feature (258)..(258): n is a, c, g, or t
  modified_base (425)..(425): a, c, t, g, unknown or other
  misc_feature (425)..(425): n is a, c, g, or t
  modified_base (570)..(570): a, c, t, g, unknown or other
  misc_feature (570)..(570): n is a, c, g, or t
tcagtactctcgtgcacgaccggtgctcgatttagtgtcgtcgcaagagagagggggtcaggctggaactgaggagcaggcaggggcagcaagatggtgttgcagacccaggtcttcatttctctgttgctctggatctctggtcgcccacggggacatcgtgatcgacccagtctccagacctccctggctgtgtctcgtcgggcgagccgggccaccatacaactgactaagtccagccaataacttctttttaanactacgttacccaaataataacgtaaaactacgttaagaccttacggtaaccagtaccaaggtaaccgaaccgaggaaccgacgtccccttcgtagggtcctgtccgttacgttacgcgggtactagtacccgtaacccggaacgttcccggggtacctcgaccgtnttcgagtcggcgacggcggtctagggactagtacttccacttacgtaccacctaagtcgaacgtcaccgtccctagccggaagtcgtaagaagtagttcggaggttactttaagttttattacgttagtactaaacgttaatttntttaaacgttacttacccggttcgggttaacgttaccggtttaaccggaaccgggttaaacggtaacggaacgggtttgaaacgtttaccgaacgtaagtaaccggtaggttaggtaccgg

SEQ ID NO: 278754 - DNA, 668 bp, Homo sapiens
  misc_feature: GYAE6OF01DQ13O.19.71.G05.1.454.CMB.1.raw
  modified_base (194)..(194): a, c, t, g, unknown or other
  misc_feature (194)..(194): n is a, c, g, or t
  modified_base (252)..(252): a, c, t, g, unknown or other
  misc_feature (252)..(252): n is a, c, g, or t
  modified_base (290)..(290): a, c, t, g, unknown or other
  misc_feature (290)..(290): n is a, c, g, or t
tcagtactctcgtgcacgaccggtgctcgatttagtgtcgtcgcaagagagagggggagtacaacaggcaggcaggggcagcaagatggtgttgcagacccaggtcttcatttctctgttgctcgtggatctctggtcgcccaggggacatcgtgatcgacccagtctaccagacctccgtggctgtgtctcgngggcgaggccggaccaccgatacaacgtgacaagtccacgccaaactattcttttaanactacgttaccaaaataactacgaaaacttacttacgngtttacggaaccagacgagtaacgacctaggaactcgacctcgtaaggctcgactactaagttcgtggactaacgttccggaacccggtagttccccggggtacctacgtaaccgtaattcgaacgggttgaaaccgtcgggcggttaaccggggaacctgtaactttcgactccacgactcgtacacgtccagtccaggacacggtactaggaacgtgcggtagtacttagtttatagtacgaactaagttaattaagttactacgttcgtacggttcggttacgtacggaaccgttaaaaggggaccgttaagggtaattaactacgggtaaacgtaacggtaacccggtaattgggtaacgggcttaccgaaccg

SEQ ID NO: 278755 - DNA, 740 bp, Homo sapiens
  misc_feature: GYAE6OF01EN9WD.19.71.G05.1.454.CMB.1.raw
  modified_base (406)..(406): a, c, t, g, unknown or other
  misc_feature (406)..(406): n is a, c, g, or t
  modified_base (549)..(549): a, c, t, g, unknown or other
  misc_feature (549)..(549): n is a, c, g, or t
  modified_base (566)..(566): a, c, t, g, unknown or other
  misc_feature (566)..(566): n is a, c, g, or t
  modified_base (587)..(587): a, c, t, g, unknown or other
  misc_feature (587)..(587): n is a, c, g, or t
tcagtactctcgtgcacgaccggtgctcgattttagtgtcgtcgcaagagagaggggggaggtacaacaggcaggcaggggcagcaagatggtgttgcagacccaggtcttcattttctctgttgcttctggactctgtggccaccgggacggatcgtgtagtagtaccgacgtcttcctacgaactcccttccggtcgtcgttggttccgttcttcgggcgggacgggaccgggcccgaccactactaaccgtactcgaacgtcgaccgacacctaacttacgttttactttaacaccgtactaaaccaagtaataaaacgtaactttaacgtcgttaacggtaccgtaacacgtaacgacgaaccgtaccggaagaaccgtccgtacccgtttacggcgttccncgtcctttaacttcgtttacgggacctacgtaccgttacccggaacggtccgggttccgtaccgtaacgattacgtcgaggcggcggtacggtcgtacggaggtaactacttacgttacacttcaacctgactgcaggtaccngtacacggatcaaaggngttgtcgtacgttaacgtttntttaacgttgtaacaacgttaaactttattttatttaactaacggtttcggtaccggtaacggtttacccggaaggttaaaccgggaacgttacggtaacggttatacggttactaacgaaacgttggtaccgttaggccttgaaccggtacc

SEQ ID NO: 278756 - DNA, 655 bp, Homo sapiens
  misc_feature: GYAE6OF01DIBHX.19.71.G05.1.454.CMB.1.raw
  modified_base (244)..(244): a, c, t, g, unknown or other
  misc_feature (244)..(244): n is a, c, g, or t
tcagtactctcgtgcacgaccggtgctcgatttagtgtcgtcgcaagagagaggggagagtctgctgaattctggctgaccagggcagtcgaccagagctccagacaatgtctgtctccttctcttcttcctgcccgtgctgggccctccacgaaggttcgtcctgtcaacaagtcagctgcagcagtcgaggtccaggactggtacgaacgccctagcaacgccctctcgcctcgacgtggcnccagtccgtccggggacagacgtccgcgtagcgtaacgtggttgtcgcgtttacggctacggttgggcaggcctacgtcccgagtcggaaggtacgtcgtagcggtggcgtagggaagtacgtatttcttcgagtacgtacaacgtacgtgaaactacgtaaatttgcgtactacctagtcgtacgttaggacgtacgacgtaacgtagaaccgtaacgtacgtaaacgtaacgaactacgaacgtaacggaacgtaaccgtcgttacccgtaccgtacgtccacggtaccttaccggtacctacggttacgtaccgtacccgtaccggaacggtaacggttacgggtacttaacgttaacgttacggtaaggtaccggtaaacggcccggaacccgtggtaaccgtaccg

SEQ ID NO: 278757 - DNA, 911 bp, Homo sapiens
  misc_feature: GYAE6OF01B6V7Y.19.71.G05.1.454.CMB.1.raw
  modified_base (227)..(227): a, c, t, g, unknown or other
  misc_feature (227)..(227): n is a, c, g, or t
  modified_base (236)..(236): a, c, t, g, unknown or other
  misc_feature (236)..(236): n is a, c, g, or t
tcagtactctcgtgcacgaccggtgctcgatttagtgtcgtcgcaagagagagggggagagtctgctgaattctggctgaccagggcagtcaccagagctccagacaatgtctgtctccttcctcttcttcctgcccgtgctgggccctcccacaaggtgtcctgtcacaagtacagctgcagcagtcaggtcaggtactggtcgaacgccctcgacacgacccctntccgctccnccgtgtcgacctacgtccggtaccggggacaggacgtccgacgtacgacggtactaggttggttcgtacgttcgggacctacggttggggtaccacgggcccgtaacggttacccccaaggttacccggaacgggtacgggttacgtaacgggtacgggttacggggtaccggttaaaggggggaacggtaaccttaagtttaaccgttttaccgaaacgtttccggtaaacccgtaaaacggttaaccggtttaaacgggaaaaaccttttaaacgaaaacgttttaacggaccgttaaccgtaacccggttaactttcggttaacgggtttaagtaaaccggggttaaccgttaaccggttaaccggttaaccggtaaaaccgttaaaccggtaaaccgttaaaacccgggtaacggtaaacccaaacgttaaacgtaaccgggtaaaacccgttaaccgttacccgtttaacccgtacccgttacgggtacccgtaccgttacgttaccggtacccgtttacggtaccgggttaaccgtacccggtaaccccgggttaaacgggtaaaccgggttaccggttaggtttaaaacctttacggtttaaccgggtaaacgggttaacgggaaaccggtaacccccggtaccccgtaaaggtaccgtaaacccggg

SEQ ID NO: 278758 - DNA, 815 bp, Homo sapiens
  misc_feature: GYAE6OF01BS10E.19.71.G05.1.454.CMB.1.raw
  modified_base (684)..(684): a, c, t, g, unknown or other
  misc_feature (684)..(684): n is a, c, g, or t
  modified_base (793)..(793): a, c, t, g, unknown or other
  misc_feature (793)..(793): n is a, c, g, or t
  modified_base (804)..(804): a, c, t, g, unknown or other
  misc_feature (804)..(804): n is a, c, g, or t
tcagtactctcgtgcacgaccggtgctcgatttagtgtcgtcgcaagagagaggggggaggtacaacaggcaggcaggggcagcaagatggtgttgcagacccaggtcttctatttctctgttgctctggatctcgtggtcgcccgacgggtacatcgtgatcgaccctagtcctaccgacgtacctccgtgctgtcgtctcgtgggcgacggccggccacctactaccactgaccgaacgtcacgacccaacttaactttctttaactaccgtaacttacccaaaactaacttaacgtaaaaacctttacgttacgtacgttacggtaaccgaacgacgaacgacggaacccgaacggaccgtaacgtccccgttaccggtaacggtcccgttacgtaccttactttaacggtttaccggttacgggacccgttaaccgtaaccccgggttaacccgggtaacccggtccccgggggttacccgtaccgtaaccgttacgttaccgtacgggtcggaccgggtacgggtccggggttacgggtacggaacggttaacgttaccgtttacctacccgtaccgtaacccacccgtatacccgaacgtaccgcgtaccgcgtacggtagaccggtaaggaagtggttacgacggtttaacttttagtttaactagttaccgtaaanaactttacttatttaacttacgttccggttaacggttaccgggtaacgttaccggaaccgggacggtaacggtaggttaacgtcttaaacgaccgtaggttaaacccgnggttacgcgtntaccgtacccg

SEQ ID NO: 278759 - DNA, 886 bp, Homo sapiens
  misc_feature: GYAE6OF01AS4O0.19.71.G05.1.454.CMB.1.raw
tcagtactctcgtgcacgaccggtgctcgatttagtgtcgtcgcaagagagagggggtcaggctggaactgaggagcaggcaggggcagcaagatggtgttgcagacccaggtcttcatttctctgttgctctggatctctggtcgcccgacggggacagtcgtgatcgacccagtcctccacgacctcccgtggctgtgtctcgtgggcgaggccgggaccaccgataccaacgtcgaccgaacgtcccacgaccctaactaactttcctttttaataaccgtaacgtttacccaaaacgtaaacgttaacgtaaaaaaccttacgtttaacgtaccgttttacgggtaaccctaacgtaccgaagggtaaccggtaacccgaaacgggaacctaaccggtccccttacccgtaacggggtaccttcggtacctttaccttaacggttttaccggtcgggtaaccttaaccggttaccccggttaaacccccgggggtaaccgtttcccccggggggttaaccccgtaccgggtaaccccgtacgtttaccgtaacggggttccgggtaccggtacggggtcccgggtttaccggtacgggtaaccgtaacggtttaccctttccggaaccccttacccgttaccaaccccgtaacgtcgaacggtaccaccgggttcccgtcggacggtacggtaccgtaaggtaaacggtcgttgggtaacggttacgttaaggtttttacttaaggttaccgaaacttaaaaccgttatttaaacgttaagtttacgtacgtttaccggtacgggttaccgtaccgggtaacccggaacggtaacccgtaagggtacgttaaactactaaggtaacgtaccgtaagttcggg

SEQ ID NO: 278760 - DNA, 733 bp, Homo sapiens
  misc_feature: GYAE6OF01DEXNP.19.71.G05.1.454.CMB.1.raw
  modified_base (569)..(569): a, c, t, g, unknown or other
  misc_feature (569)..(569): n is a, c, g, or t
  modified_base (587)..(587): a, c, t, g, unknown or other
  misc_feature (587)..(587): n is a, c, g, or t
  modified_base (596)..(596): a, c, t, g, unknown or other
  misc_feature (596)..(596): n is a, c, g, or t
tcagtactctcgtgcacgaccggtgctcgatttagtgtcgtcgcaagagagagggggtcaggctggaactgaggagcaggcgaggggcagcaagatggtgttgcagacccaggtcttctattctctgttgctctggactctcgtggtcgacccgacggggcagtcgtagacgtacgacccagtcctcaacgcctccgtgctgtcgcgtacgcgggcgacggccggaccactactactacgcgactacgccgacacctaatacttctttaacactacgttaacaactaactaacgtaaaccttcgtaacgtacggtacgaccgagtaccgaggtaaccgtcgtaacgaccttaccgacccgttacgaacggtcctccggtacttacgttattaaccgggccgtaccgttaccggtaacccggtaccgggttaccgggtaaccccggttccgaacggtaaccggttactacggttacgggacgtccgggtacgggtaccggtacggtacgtaccgtagttacctccgaaccttcaccgtactacgaccgtagacctaccgcggtacgacgngttaaccgagggttaacnggttacggngttaacgttacgttttacgtaagttacccgtaaacgttaattaacgttaagtttacgttacgtacggttaccggtacggttaccggaacgtaacggtaagggtccgtaagacgtatacacggtaacgtaggtcgtcg

SEQ ID NO: 278761 - DNA, 768 bp, Homo sapiens
  misc_feature: GYAE6OF01E21BK.19.71.G05.1.454.CMB.1.raw
  modified_base (762)..(762): a, c, t, g, unknown or other
  misc_feature (762)..(762): n is a, c, g, or t
tcagtactctcgtgcacgaccggtgctcgatttagtgtcgtcgcaagagagagggggtcaggctggaactgaggagcaggcaggggcagcaagatggtgttgcagacccaggtcttcatttctctgtgctctggatctctggtcgcccgacggggacacgtcgtagactcgacccagtcctccgacgtacctcccgtggcttgtcgtctcggtcgggcgacggccgggccaccacgtaccgtaactcggacacgtccacgaccactaactttcttttaacgactaacgttaccaactaaactacgtaaaaccttacttacgtcgttacggtaccacgtacgacggacgacctaggacacgtccctacgtacggtctacgtccttacgttaacgttaccggtcggtaaccgttaccgttacccggtaaccccggggtaacccggttccccgggggtaccccgttacggtacccggttacttaccggtacgggtaccggaccggtcggtcccggggtacgtacgggaaccgttacgttacccgtttcccgtaaccccttacccgtacgtaaccccgtacgtttacgacccgtaccgtaaccgtcgtacgaaccccggtagggtactaacgggtacgttacgggtggttacggttacgttaattttaacgttagttacgtaactaacgttaatttaccttaagtacgtttacgtcggtacggtacgtacgaacggagtaccgtagggactacgtacacgagtacngttggg

SEQ ID NO: 278762 - DNA, 756 bp, Homo sapiens
  misc_feature: GYAE6OF01A0GUB.19.71.G05.1.454.CMB.1.raw
  modified_base (285)..(285): a, c, t, g, unknown or other
  misc_feature (285)..(285): n is a, c, g, or t
  modified_base (302)..(302): a, c, t, g, unknown or other
  misc_feature (302)..(302): n is a, c, g, or t
  modified_base (723)..(723): a, c, t, g, unknown or other
  misc_feature (723)..(723): n is a, c, g, or t
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctcgtggtcgcccgacggggactagtcgtagactcgaacccgtagtcctccgaagtacctcccgtggcttcgtcgtccgtcgtacggggcgacggcccggacctaacactacaacgtcgacgaacgtccacgtacctactaacttacgttttanaacctacgttaccaaanaagttaacgtaaaaccttcgtacgtcgtttacggaccaggccaaaggcgaaaccgagggtaacaccggtacccttacgacggtcctagtaccctagttaacgtttcggaggtcctaaccgttacccggtaaaccgggtcccgttaccccggggttacctacggtaccggttaacttcggacgggtacgtaccggtacgggtcgggttacggtaacgggaccttagttacccgttccgtaaccgtacgtacccgtaccgacgttacgaacgtaccacggtaccgtacgacgacgggtactaaaggaaccggtgtacggtacggttacgttaacgtttaagtacgttactaacgttaattattaagtttacttacgttacgtacgtacgtaccgttacggaacgtacggtacgtaggacgtanacgtacaggtaccgtagtcggtactgtcgtacg

SEQ ID NO: 278763 - DNA, 765 bp, Homo sapiens
  misc_feature: GYAE6OF01AWUFT.19.71.G05.1.454.CMB.1.raw
  modified_base (394)..(394): a, c, t, g, unknown or other
  misc_feature (394)..(394): n is a, c, g, or t
  modified_base (568)..(568): a, c, t, g, unknown or other
  misc_feature (568)..(568): n is a, c, g, or t
  modified_base (577)..(577): a, c, t, g, unknown or other
  misc_feature (577)..(577): n is a, c, g, or t
tcagtactctcgtgcacgaccggtgctcgatttagtgtcgtcgcaagagagagggggtcaggctggaactgaggagcaggcaggggcagcaagatggtgttgcagacccaggtcttctatttctctgttgctctgattctcgtggtcgcccgaggggactatcgtgactcgaccctagtcctccgacgcctcccgtggtctgtcgtcgtcgtggggccgacggccggacccaccgtactaccgtacgtcgactaacggtccacgaccaactaactttccttttaacacctaccgttaacccgtaataaacgtaacgtaaaacctttcgtaggttaccgttacggtaacccagacgaacgacgtaccgaggctaccgcccgtttacgagtcgtanaccgttacgttagttaccgcgggtccttaacctacccgggttaaccccgggtaccggttccccggggtacctaacggtaccgtacgtggtaacgggtccgaccggtacggtcgggtcgacggactacgtttacccttcccgtaacctaccaccctacctaaggtcccaggtccncgttaccgngtaccggagtacgaagtacctggtgttacgttactttaagttctttaagtaacctaacgttaatttaacgttttattaaccttaccggttaccggttagggtaacccgttaccgggtaacccggtaacgggtaacgtaaccggttaggtacgttaaatcggtaacgaaacgggtcctaagggtccggg

SEQ ID NO: 278764 - DNA, 708 bp, Homo sapiens
  misc_feature: GYAE6OF01E4YLX.19.71.G05.1.454.CMB.1.raw
  modified_base (248)..(248): a, c, t, g, unknown or other
  misc_feature (248)..(248): n is a, c, g, or t
  modified_base (260)..(260): a, c, t, g, unknown or other
  misc_feature (260)..(260): n is a, c, g, or t
  modified_base (671)..(671): a, c, t, g, unknown or other
  misc_feature (671)..(671): n is a, c, g, or t
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatcgacccagtctccagactccctggctgtgtctcgtgggcgaggccgggccaccgatacaactcgcaacgtccacgccactattactttanactactaccaanaatagaaactctagcgttcgaccagcagacgacctaggacacgcctcgtaggctacgtctactaactttaccgtcgggactacgtacccggtaacccggggtaacgttccccggggttacccctacggacccggtatttcccgaaggttccgggccgtaaggtcccggggttacgtacggggtaactacgggttaacttttcccgacttccgtacccaaccgtcgttacgacaccgtccggtaccgtcgtaccggaaggtccgaagtaaacgtcgtaaggtcggttacttaaggtttaacttcgttagaacccttaaataacttttaattaagtttaccgtacgttaccgggttacggacccggtttacgggacccgttaaacggggaccgttaagggtcgtaacgttacnggtaaccgacgttagacggttcgtacgtcggtaaacc

SEQ ID NO: 278765 - DNA, 709 bp, Homo sapiens
  misc_feature: GYAE6OF01A7PNW.19.71.G05.1.454.CMB.1.raw
  modified_base (237)..(237): a, c, t, g, unknown or other
  misc_feature (237)..(237): n is a, c, g, or t
tcagtactctcgtgcacgaccggtgctcgatttagtgtcgtcgcaagagagaggggggcagagtctgctgaattctggctgaccgagggcagtcaccagagctccagacaatgtctgtctccttcctcttcttcctgcccgtgcgtcgggccctcccaacgtaggtcgtcctgtcaacaagtacagctgcaggcaagtcaggtccaggtactggtgaacgcccctagcacgaccctntccgctcaccgtgtcgccagtccggtaccggggacaggtacgtcgacgtacgacgtaacgtcggttgttcgtcgttacggctacggtcggtcgacggtccacgtcccctagtaccggtaggtacgtacgtagtacggtggacggtagggaaacgtactattacgttctaactcgtaaccaacgtacggtagtaaacttaaacgtaattacgacgtaccaacgtattacgttggtacgtagtacgtacgtacgtacgaactaagtaacgtactaaacgaaccacgtaacgaaccgaacgtaacccgttaccgttacccaccgtaccggtacgtacgttaccgtaccgtcccgttacgttacggtacccggaaccggtacccggaacggttaaccgggtaggtttaccgttaaaggttacgttaacgtacgggtaaaccgggaaccgtccccggtaaccccgtaaagtacccgg

SEQ ID NO: 278766 - DNA, 849 bp, Homo sapiens
  misc_feature: GYAE6OF01EESZ6.19.71.G05.1.454.CMB.1.raw
  modified_base (260)..(260): a, c, t, g, unknown or other
  misc_feature (260)..(260): n is a, c, g, or t
tcagtactctcgtgcacgaccggtgctcgatttagtgtcgtcgcaagagagaggggggaggtacaacaggcaggcgaggggcagcaagatggtgttgcagacccaggtcttcatttctctgttgctctggatctcgtggtcgcccgacgggacatcgtgatcgaccagtctccagtactccgtggctgtgtctcgtgggcgaggccggccaccattacaactcgacaacgtaccacgacctaacaatttaccgttttaanaacctacgttaccaaacgtaaattaacgtaaaaccttacttacgacttaggtaaccaggacaggaacgaccaaggtaccagtccctacgtaaggctacggtcttactaacgttttacgacgggtacaacgttacccggtaaacccgggtaacgtccccggggtacccgtacggtaacccgtattacgtaggcgacgtaacggtcgggtacggtagggaactacgtactttaccgacttaccgttaccaaccctatacgagaccctaacggtccttaaggacggtacgttaaggtaacggtagttacggtggtaacttttaaggtttaaacgttttacgtttaacggttaacttaaaaacggttaactttttaaacgttttaaacgttttaaacgtttaacccgggtttacggggttaaccgggttaaaccgggtttacccgggaaaacggtaaaacccggggttaaaaccccgggttaaaagggttaaccggggtttaacgttaaaacgttacgggaaacccgggttaaacccgtaaaaccgggttaggttaacccgggtacggttaaccggtaacggttaaaaccccg

SEQ ID NO: 278767 - DNA, 785 bp, Homo sapiens
  misc_feature: GYAE6OF01EQQVT.19.71.G05.1.454.CMB.1.raw
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtcgcccgacggggacatcggtgatcgacccagtctccagacctcccgtggctgtgtctcgtgggcgaggccgggccacatcaactgacaacgccacgaccaactaattacttttaataacctacgttaaccaaaacaaataacgtaaaaaccttacgttaacgtacgtttacggtaaccaagacaacggaacgaaccgtaaggaccacgtacccttaccgtacggacgtacgtactactaacgttttacgacgggtactacgttaccgtaacccgggtaacgtcccggggtacccgtacgtaccgtacgtacgaaggtcggaccgtacgggtcgggtaccggtagggtaacctaacggttactttaccgtaaccgttcctaaccgtaaccgtacgtacgtaacgcccgaacggtccctaggacctacgggtactaaggtaacgtagttacgggttacggtaactttaacggttttaattacgtttaacaaaccgttaaaacttaaagttttaacctttaaagtttacgttaaccggtttcgggtaacgggttaacccgtttaccgggaaaccggtaacgggtaacggtaaacgggtacgtaaactaagtaaccgaggttaaaccgagttcggacgtacgtccgtaacg

SEQ ID NO: 278768 - DNA, 641 bp, Homo sapiens
  misc_feature: GYAE6OF01DNXU4.19.71.G05.1.454.CMB.1.raw
  modified_base (275)..(275): a, c, t, g, unknown or other
  misc_feature (275)..(275): n is a, c, g, or t
  modified_base (298)..(298): a, c, t, g, unknown or other
  misc_feature (298)..(298): n is a, c, g, or t
tcagtactctcgtgcacgaccggtgctcgatttagtgtcgtcgcaagagagaggggagagtctgctgaattctggctgaccagggcagtcaccagagctccagacaatgtctgtctccttcctcttcttcctgcccgtgctgggcctcccacaaggtgtccctgtcacaagtcagctgcagcagtcaggtccaggactggtgaagccctgcagaccctctcgctcacctgtgccagtctccggggacagagtcgctagcgacagtgttgcttgcnctggtcaggcagtcccatcgagngtctagagtggcttggggaacgacagtattcgatcggtaccaacgacggttggaaacttaacaaagtttacgtcgacgtaacctactccgttagtttacggacgtaagttcggaacttacggaaacctaacgttaccgtaaaccggttaaacggtaccgaaaccgtagtaacccgtaaacggtaaccctaaggtttaccctaccccggttaggccgtaacgccgttacgacccgttccttacggtccgaaccgttccccggaaggtacccgtagggttaccgttaagttacgttaacttagggttacgaaacggtacggtaacccccctagtacccggtaacg

SEQ ID NO: 278769 - DNA, 910 bp, Homo sapiens
  misc_feature: GYAE6OF01DEAQ8.19.71.G05.1.454.CMB.1.raw
  modified_base (637)..(637): a, c, t, g, unknown or other
  misc_feature (637)..(637): n is a, c, g, or t
tcagtactctcgtgcacgaccggtgctcgatttagtgtcgtcgcaagagagaggggggagtacaacaggcaggcaggggcagcaagatggtgttgcagacccaggtcttcatttcctctgttgctctggattctcgtggtcgccccgacggggactacgttcgtgactcgaaccctagttcctaccagtaccctcccgtggcttgttcgtcctcggtcgggcgacggcccggacccaaccgtactaccacgtcgacaacgtcccacgacccaacttaactttcgttttaactaacctaccgttaaccaaaacgtaagtaaaccgtaaaaccttacgtttacggtccgtttaacggaccagtacaaggaaccgtaccgaaggacccgtacgtcccttaccggtacggtcctcgttaccttacttaacggtttaccggacgggtacctaacccggttaaccccgggtaaccccggggtaccgggttaccccccgggtaccctacgggaaccgtttacttaccggtagggtcggaccggtacgggtcccgggttaggtacgggaactagtttacccttttaccgaccgttaccctaccaacccgttacggtacgaacccgtgtacccggtacgtaccggnggtaccggtacggttaaagacgtcggtttacgggtaacgtttacgttttaacgggtttttaattaaccgtttacgaaactttaaaacgttaatttttacgttttaaacgtttaccgtttaccggggtttacggttacccgggttaaacccgggttacccgggaaccggtaaaccggggtaaccgtaaggggttaccttaagtttaacccggtaacggtaaaccgggttaaacgggttccggttaagggtacccggtagttacccgtaaaccgg

SEQ ID NO: 278770 - DNA, 830 bp, Homo sapiens
  misc_feature: GYAE6OF01BU5B5.19.71.G05.1.454.CMB.1.raw
tcagtactctcgtgcacgaccggtgctcgatttagtgtcgtcgcaagagagagggggagagtctgctgaattctggctgaccagggcagtcaccagagctccagacaatgtctgtctccttcctcttcttcctgcccgtgctgggccctcccacaaggtcgtcctgtcacaagtacagctgcagcagtcaggtccgaggtacgtggtcgaacgccctcgaccacgaccccttcgtccgtcctacctaccgtggtcgacctacgtccggtccggggacaggtacgttccgacgtacggcgacgtaggttcgttcgtcgttcggccgtacggttcggggtcgaacggtccgtaccggttaccccgtagtaccgggtaggtacgggttaccgtaagggacggttacggggtacggtaggggggaaacgtaacctaagttttacgtttaccgagtttacccggtaaacccgtaacggtaacgggtttaacggtaaaactttaaacgtaaacgtttacgtacgacctaaccgttacgttcggtttgggtaacggagtaccggttaccggtaactacggtaaacttaacgtaccggtaaacgttaccgaaccgaacgttaacgtaccgtaaaaccgtaaccttcccgtttaccctcccggtaacgtaccgtaaccggttccgtaaccgtaccgtttacgtacgggtacccggtacccggttaacccgggaacgggttacccggttaaggggttactttaacgttaaccgtttacgggttacggggtaaacgggtaacccggtaaccccggttccccgaaagtacccggtaacccgg

SEQ ID NO: 278771 - DNA, 817 bp, Homo sapiens
  misc_feature: GYAE6OF01BVRB0.19.71.G05.1.454.CMB.1.raw
  modified_base (303)..(303): a, c, t, g, unknown or other
  misc_feature (303)..(303): n is a, c, g, or t
tcagtactctcgtgcacgaccggtgctcgatttagtgtcgtcgcaagagagaggggggaggtacaacaggcaggcaggggcagcaagatggtgttgcagacccaggtcttctatttctctgttcgctctggtatctctggtcgcccgacggggactagtcgtgtatcgacccagtcctaccagtacctcccgtggtcgttcgttgtccgttcgtacggggtcgacggccggggtacccaacctactaccgtaaacgtcggacctaacggtcccaacggacctaactaaacttacgtttttaanaccgtacgttaacccaaaactaaacgtaacgtaaaaaccgttaacttaacgtaccgtttacgggtaaacctaacggtacgaaacggtaacgaaccgtaacggaaccgtaacggtaccccgttacgtaacggtccgtacggtactacgtaacgttttacgtcggaactaccgtacccggtaacccgggtacggtaccccggggttaccgtaccggtaacgtacgttacccggtagggtaccggtacggtacgggtccggggtacggttaccgggaactacggttaacttcgaacttccgtactaccgaagtcgtaacgcgacgcctggaccgtagcgaagagtaggtgtacgtattaagttttaacgttattaagtaacctaaacttagttaactttaacttaagttaccgtttaacggtagggtttaccggtacggaacggtaaacggtaacgtacggaaggttacgtacgtaacgtaacgggtaactaacggttgacgttacgacgttaaccc

SEQ ID NO: 278772 - DNA, 655 bp, Homo sapiens
  misc_feature: GYAE6OF01EQ64B.19.71.G05.1.454.CMB.1.raw
  modified_base (311)..(311): a, c, t, g, unknown or other
  misc_feature (311)..(311): n is a, c, g, or t
  modified_base (357)..(357): a, c, t, g, unknown or other
  misc_feature (357)..(357): n is a, c, g, or t
  modified_base (613)..(613): a, c, t, g, unknown or other
  misc_feature (613)..(613): n is a, c, g, or t
tcagtactctcgtgcacgaccggtgctcgatttagtgtcgtcgcaagagagagggggagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaacgccctgcagacccctctccgctcacctggtacgccatcgtaccggggacacggagtcgactaggcgaacgtaggttgttcggcgtttggcctacggtcgggtacnggacctacggtacccccagtaccggagggtaacggttcgtaacggnggtacggggacgttagggggaaacggactaagttaatttcgaagtcgttacccaaacgtacggtacggaaacttaaactaaagtttacgtacgcctaaccgtacttcgtgttacggaaggtacgtaaccgtagcgtaaacgtaactaacctaacggtagacctagaacttaacggaacgtaaaccgtcttaccgtacctcggacctacgtactaccgtacgtctacgtacgaccgtacccggagtaccgtagggtntacgttattacgttggaacggagacccgaccctagcggtaac

SEQ ID NO: 278773 - DNA, 703 bp, Homo sapiens
  misc_feature: GYAE6OF01BH2IY.19.71.G05.1.454.CMB.1.raw
  modified_base (373)..(373): a, c, t, g, unknown or other
  misc_feature (373)..(373): n is a, c, g, or t
  modified_base (687)..(687): a, c, t, g, unknown or other
  misc_feature (687)..(687): n is a, c, g, or t
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtcgcccgacggggacatcgtgatcgacccagtcctccagacctccctggctgtgtctcgtggggcgacggccgggccaccatacaacgtgacaacgtccacgacccaactaacttacttttatacctacgttaaccaaactaataacgtaaaaaccttacttacgtacgttacggtaaccagacaaggacgaccgacggacacgccctaccgtacggctcgctactacgtttacgngggtactacgtaccggtaacccggggtaccgttcccggggtaccctacggaccgtacgttcgacggtcggacgacggtcgggtcgtacgggactagttacttcgacctctaccacctagtaccgagtccgacgtcctcgaccgtacggtactaagggaagtacggtcggtacggtacttttaacggtttatttacttacggtaactaaattaatttaatttacttacgttacgttacggttacggtaccggttaccgaaccggtaacgggacgtaagggtaggacgtaacgtaacgtaaaccggtagttacggnggtcctacgacctacg

SEQ ID NO: 278774 - DNA, 876 bp, Homo sapiens
  misc_feature: GYAE6OF01BB3YX.19.71.G05.1.454.CMB.1.raw
  modified_base (408)..(408): a, c, t, g, unknown or other
  misc_feature (408)..(408): n is a, c, g, or t
tcagtactctcgtgcacgaccggtgctcgatttagtgtcgtcgcaagagagagggggaggtacaacaggcaggcagggcagcaagatggtgttgcagacccaggtcttcatttctctgtgctctggatctctggtgcccgtaggggacatcgtgatcgaccagtctacgagactcccgtgctgtcgtctcgtgggcgaggccgggaccaccgtataccgaacgtgaccgtaacgtcccaagtccctaacgtaacttttcttttaagtacgtacgttaccaaactaagtaacgtaaaaccttacttacggttaccgtttacggtaaccgagacctaggtaacgaacccgtaaggaactaaccggtcccttaccgtacggtccttcggtaccttacttaacgtttaccgngggtaactaccgttaaccccgggttaaccgggaacccggtttccccgggggtacccttacgggtaacccggttacgttacggtacgggtcgggtaccgtacgggggttacccgggtacggttaggggaaccgtttaaccgtacggttttaccctaccggttaccgtaccctaaccgttaccgtaccgaccgtaacccgaccggttacccgtaggtacgggtaccgtacgttaaacgggtattacggttccggaaggttttacgtttaacgtttttaactttcgttaacgttaaccgtaaattaacggtttttaactttaacgtttaacgtttacgggttaccggttaacggttacccgggtttacccggaacggttaaacggggtaccgttaaggggttctaaacccggttttacgaacccgtaaacggttacctacgggtttagacggttacggtcccctaaccggg

SEQ ID NO: 278775 - DNA, 812 bp, Homo sapiens
  misc_feature: GYAE6OF01CNUEW.19.71.G05.1.454.CMB.1.raw
  modified_base (530)..(530): a, c, t, g, unknown or other
  misc_feature (530)..(530): n is a, c, g, or t
tcagtactctcgtgcacgaccggtgctcgatttagtgtcgtcgcaagagagaggggggagagtctgctgaattctggctgaccagggcagtcacagagctcagacaatgtctgtctccttctcttctcctcgccgtgcgtcggccctaccagaaggtcgtcctgtacaacgtaagtacaggtctggacaaggcaggtacacgggttaccagggtacctgggtacgaaccgcccccgtgaccgtaaccgtaccccgttctaccgtacccttcccaaccggttggtcctacccggtaacgttccccggggttacccgggggaacgtaacgggttacggtaccgtacggttaaccggaccggtaacggttagggtttcggttttcggccggtttgggacccgttaaccggggttcggggttaccgacggggtacctaacccggttaccccgtaggttaccgggtaaggtacgggtacgttagggtacgggaggtacggtaagggggtaaccggtacttagtttaccgtacgtnttaaccggacctaaacgtacggtagtaaaactaacgtaattacgacgtcctaagtctcggttagtagacgtagacgtaatacgactaagtacctaaacggtacgactaagtacgtaacggaaactaaccttcgttccgtcctacgggtacaccgtcttaccgttactcggtacgtacccgtaccggtaccgggtaaagtccgggttaagttggttaaacgttaccggtttaaggccggttaaaaccggacgggtacccctaaaccgtggtaacgtaacccgg

SEQ ID NO: 278776 - DNA, 723 bp, Homo sapiens
  misc_feature: GYAE6OF01BY910.19.71.G05.1.454.CMB.1.raw
  modified_base (313)..(313): a, c, t, g, unknown or other
  misc_feature (313)..(313): n is a, c, g, or t
  modified_base (349)..(349): a, c, t, g, unknown or other
  misc_feature (349)..(349): n is a, c, g, or t
  modified_base (386)..(386): a, c, t, g, unknown or other
  misc_feature (386)..(386): n is a, c, g, or t
tcagtactctcgtgcacgaccggtgctcgatttagtgtcgtcgcaagagagagggggaggtacaacaggcaggcaggggcagcaagatggtgttgcagacccaggtcttcatttctctgttgctctggatctctggtgcccgaggggacatcgtgatcgacccagtctccagactccctggctgtcgtcgtcgtgggcgagccgggccacatcaactgacaacgtccagaccaactaattcttttatactacgttaccaacaatacgtaaaacctacttacgtcttacggtaccagacgagagaccgaggacncgtcctaccgtagcctcgcttactatttacgcgganacgtccgtaaccggtacgtccgggtacctcgaccgtntaccgagtgacgtcggtcgggtcgtaggactacgtactttacgaccttcgtaccaacgactccgacgacctacgtccgtcggaccgtacgggacttaggaaacgtcgttacgggtacgtacgtttaacggttttactttaacgttaccgttaaccgttaaaccgttaaattttaaaccttttaaacgtttacgttaacccgttttacgggttaccggggtttaaccggttacccgggttaaccggtaaacggggttaaccgtaacgggttagggttaacttaacgggtacgtaacgggtaacgttaacgggtaggtaacggtccgtaaccggtaccc

SEQ ID NO: 278777 - DNA, 870 bp, Homo sapiens
  misc_feature: GYAE6OF01EAH4D.19.71.G05.1.454.CMB.1.raw
tcagtactctcgtgcacgaccggtgctcgatttagtgtcgtcgcaagagagaggggggaggtacaacaggcaggcgaggggcagcaagatggtgttgcagacccaggtcttcatttctctgttgctctggatctcgtggtcgcccgacggggacagtcgtgatcgacccagtcctccagcctccctggctgtgtctcgtgggcgaggccggccaccgatacaacgtcgactaacgtccacgacctactaactttcttttaactactacgttaccaaaactaactaacgtaaaactacttacgtcgttacggtaaccaggacgaacggaacgaccgaacggtaacgaccgtcccgtaccgtacggtcgtacgtcttaccttaacgtttacggtacgggtactaccgttaacccgggtaaccccggggtaaccggttcccccgggggttacccgttaccggtaacccgtacgttcggtacgggtacgggaccggtacggggttcccggggttacggtacggggtaactaacggttacctttaccgtacccgttaccctaaccctaacccgtattccggaaccgtaccggtccgtaccgtaggaacccggtacggtacgttaaacggtacgtaacgttcgggtacggttacgtttaacgtttttaagttaaccgtttaccggttaaacttaaaaccgtttaatttttaagtttaaaccggttttaacgttcccgggttttaacgggtacgggtttaaacccgggttaccgggtaaacccggtaaacgggggttaaacgtaaggggttaggtaaccttacggtaacccggtaaggtaaccgggttaagttccgggtaacgtcctaggtaacccc

SEQ ID NO: 278778 - DNA, 965 bp, Homo sapiens
  misc_feature: GYAE6OF01CQP97.19.71.G05.1.454.CMB.1.raw
  modified_base (887)..(887): a, c, t, g, unknown or other
  misc_feature (887)..(887): n is a, c, g, or t
tcagtactctcgtgcacgaccggtgctcgatttagtgtcgtcgcaagagagagggggaggtacaacaggcaggcagggcagcaagatggtgttgcagacccaggtcttcatttctcttgtgctcgtggatctcgtggtcgacccgacgggacacgtcgtgatcgaccagtcctcagcctcctggctgtcgtctcggtagggcgacggccggacctacgacgacaacgtgaccgaacgtccaacgaccctaacgttaactttccgttttaactaccttaaccgttaacctaaaactaacgtaaacgtaaaaaccgtttctttaacggtacgtttacggaacccgtagtacgaacggtaacgaaccgaacggttaaccgaaccgtacccgttaaccggtacggttccgttacgtaccgtttaaccgtttaaccggttttagggacccggtacgttacccggttaaccccggggttaaaccccgggttaaaccgggttcccccggggtttacgtaaccgttaaaccggttacgtttaacgggcggtttaccgggaaaccggcgggtttacccggggtacgtacggggttaacgtaaccggttttaccttacccgttaccgtcctaaaccggtacctaaccggtataccccgggagttaacccccggttggaacccggtcgtaaccgggtacgtttaaaaccggagggtttaaccggtttcggggttaaacctttaggtttttaaacctttacggttttaaccgttaagttaaaaaccccgtttaagttttaaaggttttactttttaaaccgggttaacctttacggggtttacccaacgggggtttaaaccccgtcccgggtaaacggaaccggggttttaaaaacggngggttacctttaaacgaaacccgttcgggtaaaacgttcggttaaacccgggttgaaccggtcccgaagtttaccccg

SEQ ID NO: 278779 - DNA, 669 bp, Homo sapiens
  misc_feature: GYAE6OF01EFW39.19.71.G05.1.454.CMB.1.raw
  modified_base (271)..(271): a, c, t, g, unknown or other
  misc_feature (271)..(271): n is a, c, g, or t
  modified_base (323)..(323): a, c, t, g, unknown or other
  misc_feature (323)..(323): n is a, c, g, or t
  modified_base (338)..(338): a, c, t, g, unknown or other
  misc_feature (338)..(338): n is a, c, g, or t
  modified_base (353)..(353): a, c, t, g, unknown or other
  misc_feature (353)..(353): n is a, c, g, or t
  modified_base (406)..(406): a, c, t, g, unknown or other
  misc_feature (406)..(406): n is a, c, g, or t
  modified_base (433)..(433): a, c, t, g, unknown or other
  misc_feature (433)..(433): n is a, c, g, or t
  modified_base (437)..(437): a, c, t, g, unknown or other
  misc_feature (437)..(437): n is a, c, g, or t
  modified_base (441)..(441): a, c, t, g, unknown or other
  misc_feature (441)..(441): n is a, c, g, or t
  modified_base (464)..(464): a, c, t, g, unknown or other
  misc_feature (464)..(464): n is a, c, g, or t
  modified_base (474)..(474): a, c, t, g, unknown or other
  misc_feature (474)..(474): n is a, c, g, or t
  modified_base (477)..(477): a, c, t, g, unknown or other
  misc_feature (477)..(477): n is a, c, g, or t
tcagtactctcgtgcacgaccggtgctcgatttagtgtcgtcgcaagagagaggggggagtacaacaggcaggcaggggcagcaagatggtgttgacagacccaggtcttcattttcctctgttcgctcgtggacttctcgtgggtcgacccgacggggactacgtcgtagtatccgaccctagtacctaccgaacgtcctcccgtggcttggtcgtcgtcgtacgggacgacggccggacccaacgtactacaagtcgaacgtacgaccncactaactacttacttttacgactactaacaatagtaaacgtaacttacgtntacgttacgacgtanacgaacgacaaccgngaacctcgtacccgtacgttacggacttcgtacctattacgttacgcgttacncgtaccggacgacgtccggactcgatntcgngacncgaggtcgcgtaagcgatactcntactacgatnacngaccgtagccgtagacgtacgcgtaaggacgttcgcggttagtttaactttagtttaacgttctaacgttaacgtaaaacctttagttttaattacgttaacgttacgttaacggttacggtacccgttaggaacccgtaggtaaggtacgtaaggtactacgaaagtacgtagtacgagttcagtcgtaac

SEQ ID NO: 278780 - DNA, 766 bp, Homo sapiens
  misc_feature: GYAE6OF01A5SGJ.19.71.G05.1.454.CMB.1.raw
tcagtactctcgtgcacgaccggtgctcgatttagtgtcgtcgcaagagagagggggaggtacaacaggcaggcaggggcagcaagatggtgttgcagacccaggtcttcatttctctgttgctctggatctctggtcgcccgacggggacatcgtgatcgacccagtcctccagacctccctggctgtcgtctcgtggggcgacggccgggcccaccactaccaacgtcgacaacgtccacgccaactaacttcttttaacacgtacgttaccaaactaataacgtaaaacttacttacgtcgttacggtaccagacaaggacgaccgaggaccacgcccttaccgacggtccgtcgtcctactacgtttacggtcgggtacctaaccgtaccccggtaacccggggtaaccggttccccgggggtaccccgtacggtaacccgttagttaccggacgggtccggaccgtacggggtccggggttaccggtaggggtaacctaggttacctttaccgacctttccgacccaccgtactaccgacgtaccacgtcccgtagaccggacggtcgtaaggaacgtgtggtacgtactttaagttttatagttacgtaacctaaagttaacttacttttaacttacggttacgttacggggtacgttaacccgggttaccggaaccgggttaaacgggaacggtaagggttacgtacgttaaacgtaccgacggttaaaccgtaggttaccgaggtccttacggaaccc

SEQ ID NO: 278781 - DNA, 731 bp, Homo sapiens
  misc_feature: GYAE6OF01ANCSA.19.71.G05.1.454.CMB.1.raw
  modified_base (158)..(158): a, c, t, g, unknown or other
  misc_feature (158)..(158): n is a, c, g, or t
  modified_base (188)..(188): a, c, t, g, unknown or other
  misc_feature (188)..(188): n is a, c, g, or t
tcagtactctcgtgcacgaccggtgctcgatttagtgtcgtcgcaagagagaggggggaggtacaaacaggcaggcaggggcagcaagatggtgttgcagacccaggtcttcattttctctgttgctctggatctctggtgcccgacggggacatcgngatcgacccacgtcctacgagacctcccgnggctgtcgtctcgtagggcgacggccggccaaccactacaacgtcgacaacgtcaacgccaactaattacttttaactacgtacgttaaccaacgtaaatagtaaaaccttactacgtacgttacggtaaccgagaacacgtaacgaaccgtaacgggaccaccgtacccttaccgtacggtctcgcctacgttacgttacgcggacctacgtaccggtaacccgggtaccgtccggggtaccctacggtaccgtacgttcgtacggcggacggacggcgggttcggaggacgtagtacttactacctcaccgaactcgtacgacgacgacgccgttcggaccacgggacgttacggaacgtacgttacgggtacgtacgtttaacgttttaacgttacgtttaccgtaaataacttaaatttaacgttactttaccgttacgtaccggttacgggtaccggttacggtaaacgggtaacggtaccgtaagggacgttacgtacgtaccgaacggtaacgtacgtaaggtgttccgacgtacg

SEQ ID NO: 278782 - DNA, 948 bp, Homo sapiens
  misc_feature: GYAE6OF01D2BL5.19.71.G05.1.454.CMB.1.raw
tcagtactctcgtgcacgaccggtgctcgatttagtgtcgtcgcaagagagagggggagagtctgctgaattctggctgaccagggcagtcaccagagctccagacaatgtctgtctccttctcttcttcctgcccgtgctgggcctcccacaaggtctcctgtcacaagtacagctgcagcagtcacggtccaaggactggtagaacgtcccgtcgactacgaccctcgtccgtcctaccaccttggcacccagttccggtaccggggacacggtacgtaccgctaacgcgaacgtaggttgtttcggtccgtttacggacgtaccgggttacggggttaccgaccgggtaccgtacccggtaccccgaaggttaccgggaacggttacgggtacgttaagggacggggttcggtacgggtaagggggtaaaacggtacttaaagttttactttaacggtaactttaccgtaaaccgtaaaccggttaacggtaaacgggtaaaaacctttaaaacgttaaaaacgttttccggtaaccgaacccgtaaaccgttaacgtttacggtttaaggttaacggtaaacgggttaacgggtttaaaccgaacgttaacgggtaaaacccgttaaacgttaaaccggtaaaacggttaaccggaaacccttaaaccggtaaacgttaaaacccgggaaaaccttaaacccggttaacttttaccccgtaccggttaaccggtaaccgttacggtacccgttaccgtaacccgttcgttaccggggttaacctaaccccggggtaaacccggtaacgggggtaaccccggtttaaggggtttaaacgtttaaccgtttaaaacgggttacggtttaaacgggggttaaccccggggtaaaaacccgggtacccccggttaaacccccgtaaggttaaccccggttaaaccggg

SEQ ID NO: 278783 - DNA, 504 bp, Homo sapiens
  misc_feature: GYAE6OF02HQAAI.19.71.G05.1.454.CMB.1.raw
  modified_base (236)..(236): a, c, t, g, unknown or other
  misc_feature (236)..(236): n is a, c, g, or t
tcagtactctcgtgcacgaccggtgctcgatttagtgtcgtcgcaagagagaggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttanacagttccaacaatgaaaactacttagcttggtaccagcagagaccaggacagcctcctaggctgctcatttactgggcatctacccgggaatccggggtccctgaccgattcagtggcagcgggtctgggacagatttcactctcaccatcagcagcctgcaggctgaagatgtggcagtttattattgtcaacaattattattatacttcgtggacgtttcggccaagggccaaggttggattatcagacgaatgtggactggacc

SEQ ID NO: 278784 - DNA, 493 bp, Homo sapiens
  misc_feature: GYAE6OF02I8PU0.19.71.G05.1.454.CMB.1.raw
  modified_base (236)..(236): a, c, t, g, unknown or other
  misc_feature (236)..(236): n is a, c, g, or t
tcagtactctcgtgcacgaccggtgctcgatttagtgtcgtcgcaagagagagggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatctttanacagttccaacaatgaaaactacttagcttggtaccagcagagaccaggacagcctcctaggctgctcatttactgggcatctacccgggaatccggggtccctgaccgattcagtggcagcgggtctgggacagatttcactctcaccatcagcagcctgcaggctgaagatgtgcagtttatattgtcaacatattattatacttcgtgacgttcgcaagggcaaggtggatatcgagacgtaactgtgctgacc

SEQ ID NO: 278785 - DNA, 501 bp, Homo sapiens
  misc_feature: GYAE6OF02GQVH0.19.71.G05.1.454.CMB.1.raw
tcagtactctcgtgcacgaccggtgctcgatttagtgtcgtcgcaagagagaggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttatacagttccaacaatgaaaactacttagcttggtaccagcagagaccaggacagcctcctaggctgctcatttactgggcatctacccgggaatccggggtccctgaccgattcagtggcagcgggtctgggacagatttcactctcaccatcagcagcctgcaggctgaagatgtggcagtttattattgtcaacaatattaattatacttcgtgacgttcggcctaagggaccaaggtggatagtcagacgaactgtggctgac

SEQ ID NO: 278786 - DNA, 588 bp, Homo sapiens
  misc_feature: GYAE6OF02HHTQA.19.71.G05.1.454.CMB.1.raw
  modified_base (213)..(213): a, c, t, g, unknown or other
  misc_feature (213)..(213): n is a, c, g, or t
  modified_base (221)..(221): a, c, t, g, unknown or other
  misc_feature (221)..(221): n is a, c, g, or t
  modified_base (224)..(224): a, c, t, g, unknown or other
  misc_feature (224)..(224): n is a, c, g, or t
  modified_base (230)..(230): a, c, t, g, unknown or other
  misc_feature (230)..(230): n is a, c, g, or t
  modified_base (236)..(236): a, c, t, g, unknown or other
  misc_feature (236)..(236): n is a, c, g, or t
  modified_base (246)..(246): a, c, t, g, unknown or other
  misc_feature (246)..(246): n is a, c, g, or t
  modified_base (276)..(277): a, c, t, g, unknown or other
  misc_feature (276)..(277): n is a, c, g, or t
tcagtactctcgtgcacgaccggtgctcgatttagtgtcgtcgcaagagagagggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggctacgcagacgnactagcancanatctancatcanatgaacatanctgtcagcagagacagacagctcctaggcnnctctatactgctactacgtaccggtacgtccggtccgtcgacgtactacgtagtagcgacgtcggtcgtcggacgtacgtacgttactactctactacctactacgacgacgacgtacgtcgacgacgtacgtagtagtagtaggtcgtacgtagtttagttagttacgtacgtaactaacttaatttaattaacgttacgttacgttacggtacggttacggtaccggtaacgggtaaccggtaacggtaacggtaacgttaacgtaacgtaacggtaacggtaacgtacggtacggtacgtacgtaccg

SEQ ID NO: 278787 - DNA, 504 bp, Homo sapiens
  misc_feature: GYAE6OF02G8GXF.19.71.G05.1.454.CMB.1.raw
  modified_base (237)..(237): a, c, t, g, unknown or other
  misc_feature (237)..(237): n is a, c, g, or t
tcagtactctcgtgcacgaccggtgctcgatttagtgtcgtcgcaagagagaggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccgatcgaactgcaagtccagccacaatctttanacagttccaacaatgaaaactacttagcttggtaccagcagagaccaggacagcctcctaggctgctcatttactgggcatctacccgggaatccggggtccctgaccgattcagtggcagcgggtctgggacagatttcactctcaccatcagcagcctgcaggctgaagatgtgcagtttatattgtcaactaatattattatacttgtaggacgttggaccaagggaccaaggtggaatagtgagtacgaacttgtggactgac

SEQ ID NO: 278788 - DNA, 510 bp, Homo sapiens
  misc_feature: GYAE6OF02I4T0H.19.71.G05.1.454.CMB.1.raw
  modified_base (236)..(236): a, c, t, g, unknown or other
  misc_feature (236)..(236): n is a, c, g, or t
tcagtactctcgtgcacgaccggtgctcgatttagtgtcgtcgcaagagagagggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatctttanacagttccaacaatgaaaactacttagcttggtaccagcagagaccaggacagcctcctaggctgctcatttactgggcatctacccgggaatccggggtccctgaccgattcagtggcagcgggtctgggacagatttcactctcaccatcagcagcctgcaggctgaagatgtggcagtttattattgtcaactaatatttattatactttcgtggtacgttcggccgtaagggtaccaaggtggattagtcagacgaactggtggctgacc

SEQ ID NO: 278789 - DNA, 510 bp, Homo sapiens
  misc_feature: GYAE6OF02H233T.19.71.G05.1.454.CMB.1.raw
  modified_base (237)..(237): a, c, t, g, unknown or other
  misc_feature (237)..(237): n is a, c, g, or t
  modified_base (409)..(409): a, c, t, g, unknown or other
  misc_feature (409)..(409): n is a, c, g, or t
  modified_base (454)..(454): a, c, t, g, unknown or other
  misc_feature (454)..(454): n is a, c, g, or t
tcagtactctcgtgcacgaccggtgctcgatttagtgtcgtcgcaagagagagggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttanacagttccaacaatgaaaaactacttagcttggtaccagcagagaccaggacagcctcctaggctgctcatttactgggcatctacccgggaatccggggtccctgaccgattcagtggcagcgggtctgggacagatttcactctcaccatcagcagcctgcaggctgaanatgtggctagtttattattgtacaacaattattattatactttgnggtacgtttcggccaaggggccaaggtggaattatcagacgaacttgtaggctgac

SEQ ID NO: 278790 - DNA, 503 bp, Homo sapiens
  misc_feature: GYAE6OF02GO7D4.19.71.G05.1.454.CMB.1.raw
tcagtactctcgtgcacgaccggtgctcgatttagtgtcgtcgcaagagagagggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatctttatacagttccaacaatgaaaactacttagcttggtaccagcagagaccaggacagcctcctaggctgctcatttactgggcatctacccgggaatccggggtccctgaccgattcagtggcagcgggtctgggacagatttcactctcaccatcagcagcctgcaggctgaagatgtggctagtttattattgtcaacaatattattatacttcgtgacgttcggacctaagggaccaaggtggatagtcagacgaactgtggctgacc

SEQ ID NO: 278791 - DNA, 543 bp, Homo sapiens
  misc_feature: GYAE6OF02IT3MM.19.71.G05.1.454.CMB.1.raw
  modified_base (236)..(236): a, c, t, g, unknown or other
  misc_feature (236)..(236): n is a, c, g, or t
  modified_base (366)..(366): a, c, t, g, unknown or other
  misc_feature (366)..(366): n is a, c, g, or t
  modified_base (404)..(404): a, c, t, g, unknown or other
  misc_feature (404)..(404): n is a, c, g, or t
  modified_base (407)..(407): a, c, t, g, unknown or other
  misc_feature (407)..(407): n is a, c, g, or t
tcagtactctcgtgcacgaccggtgctcgatttagtgtcgtcgcaagagagagggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatctttanacagttccaacaatgaaaactacttagcttggtaccagcagagaccaggacagcctctaggctgctcatttacgtggcatctacccgggaatccggggtcctgaccgattcagtgcagcggtctgggacngtatttcactctcacatcagcagcctgcaggctgaagntgngtctagtttattagtgtactaactaattattatttattacgtttcgtgtaccgttcggaccgtaaggggtaaccctaagggttggtaattacgtacgtaaggtaaccgtaacgttggtcgggtacctaggtacccg

SEQ ID NO: 278792 - DNA, 505 bp, Homo sapiens
  misc_feature: GYAE6OF02HO1MP.19.71.G05.1.454.CMB.1.raw
  modified_base (236)..(236): a, c, t, g, unknown or other
  misc_feature (236)..(236): n is a, c, g, or t
  modified_base (310)..(310): a, c, t, g, unknown or other
  misc_feature (310)..(310): n is a, c, g, or t
  modified_base (406)..(406): a, c, t, g, unknown or other
  misc_feature (406)..(406): n is a, c, g, or t
tcagtactctcgtgcacgaccggtgctcgatttagtgtcgtcgcaagagagagggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatctttanacagttccaacaatgaaaactacttagcttggtaccagcagagaccaggacagcctctaggctgctcatttacnggcatctacccgggaatccggggtcctgaccgattcagtggcagcgggtctgggacagatttcactctcacatcagcagcctgcaggctgagatgngctagtttatattgtacaactattaatttattattacttcgtaggtacgttcgactaagggacctaagggtgaatatcgagtacgaactggtgctgacc

SEQ ID NO: 278793 - DNA, 505 bp, Homo sapiens
  misc_feature: GYAE6OF02IRZ7U.19.71.G05.1.454.CMB.1.raw
  modified_base (236)..(236): a, c, t, g, unknown or other
  misc_feature (236)..(236): n is a, c, g, or t
tcagtactctcgtgcacgaccggtgctcgatttagtgtcgtcgcaagagagagggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatctttanacagttccaacaatgaaaactacttagcttggtaccagcagagaccaggacagcctcctaggctgctcatttactgggcatctaccgggaatccggggtccctgaccgattcagtggcagcgggtctgggacagatttcactctcaccatcagcagcctgcaggctgaagatgtggcagtttattattgtcaactaatattattatacttcgtgacgttcggaccaagggaccaaggtggaactatcagacgaactgtaggtctgtacc

SEQ ID NO: 278794 - DNA, 498 bp, Homo sapiens
  misc_feature: GYAE6OF02HCBJX.19.71.G05.1.454.CMB.1.raw
  modified_base (409)..(409): a, c, t, g, unknown or other
  misc_feature (409)..(409): n is a, c, g, or t
tcagtactctcgtgcacgaccggtgctcgatttagtgtcgtcgcaagagagagggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttatacagttccaacaatgaaaactacttagcttggtaccagcagagaccaggacagcctcctaggctgctcatttactgggcatctacccgggaatccggggtccctgaccgattcagtggcagcgggtctgggacagatttcactctcaccatcagcagcctgcaggctgaagntgtggcagtttatattgtcaacaatattattatacttcgtgacgttcggccaagggccaaggtggaatagtcagacgaactgtggctgc

SEQ ID NO: 278795 - DNA, 500 bp, Homo sapiens
  misc_feature: GYAE6OF02FWKYK.19.71.G05.1.454.CMB.1.raw
  modified_base (237)..(237): a, c, t, g, unknown or other
  misc_feature (237)..(237): n is a, c, g, or t
  modified_base (312)..(312): a, c, t, g, unknown or other
  misc_feature (312)..(312): n is a, c, g, or t
tcagtactctcgtgcacgaccggtgctcgatttagtgtcgtcgcaagagagagggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttanacagttccaacaatgaaaactacttagcttggtaccagcagagaccaggacagcctcctaggctgctcatttacngggcatctacccgggaatccggggtccctgaccgattcagtggcagcgggtctgggacagatttcactctcaccatcagcagcctgcaggctgaagatgtgcagtttattattgtcaacaatattattatacttcgtgtacgttcggccaagggccaaggtggatatcgagacgaactgtggctgacc

SEQ ID NO: 278796 - DNA, 506 bp, Homo sapiens
  misc_feature: GYAE6OF02F43NJ.19.71.G05.1.454.CMB.1.raw
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttatacagttccaacaatgaaaactacttagcttggtaccagcagagaccaggacagcctcctaggctgctcatttactggcatctacccgggaatccggggtccctgaccgattcagtggcagcggtctgggacagatttcactctcaccatcagcagcctgcaggctgagatgtggctagtttattattgtacaacaattattattatacttcgtgtacgttcggctaagggaccaaggtggaatagtcagacgaacgtgtcggctgacc

SEQ ID NO: 278797 - DNA, 519 bp, Homo sapiens
  misc_feature: GYAE6OF02IO95R.19.71.G05.1.454.CMB.1.raw
  modified_base (238)..(238): a, c, t, g, unknown or other
  misc_feature (238)..(238): n is a, c, g, or t
  modified_base (370)..(370): a, c, t, g, unknown or other
  misc_feature (370)..(370): n is a, c, g, or t
  modified_base (409)..(409): a, c, t, g, unknown or other
  misc_feature (409)..(409): n is a, c, g, or t
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttanacagttccaacaatagaaaactacttagcttggtaccagcagagaccaggacagcctcctaggctgctcatttactgggcatctaccgggaatccggggtcctgaccgatcagtggcagcgggtctgggacngtatttcactctcaccatcagcagcctgcaggctgaagntgtgctagttttatattgtacaactaattattatttatacttcgtagtacgttcggacgtaagggtacctaaggttgatagtacgacgaacgtattggtacgtctgtacc

SEQ ID NO: 278798 - DNA, 501 bp, Homo sapiens
  misc_feature: GYAE6OF02IPNOR.19.71.G05.1.454.CMB.1.raw
  modified_base (237)..(237): a, c, t, g, unknown or other
  misc_feature (237)..(237): n is a, c, g, or t
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatctttanacagttccaacaatgaaaactacttagcttggtaccagcagagaccaggacagcctcctaggctgctcatttactgggcatctacccgggaatccggggtcctgaccgattcagtgcagcgggtctgggacagatttcactctcaccatcagcagcctgcaggctgaagatgtggcagtttattattgtcaactaatattatttatacttcgtggacgttcgcctaagggccaaggtggatatcagacgaactggtggctgacc

SEQ ID NO: 278799 - DNA, 515 bp, Homo sapiens
  misc_feature: GYAE6OF02G7WE2.19.71.G05.1.454.CMB.1.raw
  modified_base (238)..(238): a, c, t, g, unknown or other
  misc_feature (238)..(238): n is a, c, g, or t
  modified_base (313)..(313): a, c, t, g, unknown or other
  misc_feature (313)..(313): n is a, c, g, or t
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttanacagttccaacaatgaaaactacttagcttggtaccagcagagaccaggacagcctcctaggctgctcatttacngggcatctacccgggaatccggggtcctgaccgattcagtggcagcgggtctgggacagtatttcactctcaccatcagcagcctgcaggctagaagatggtgctagtttattattgtacaataatattattatacttcgtagtacgttcggacctaagggacctaaggtggatactgaacgacgtaactggtcggctgacc

SEQ ID NO: 278800 - DNA, 503 bp, Homo sapiens
  misc_feature: GYAE6OF02FIM4X.19.71.G05.1.454.CMB.1.raw
tcagtactctcgtgcacgaccggtgctcgatttagtgtcgtcgcaagagagagggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttatacagttccaacaatgaaaactacttagcttggtaccagcagagaccaggacagcctcctaggctgctcatttactgggcatctacccgggaatccggggtccctgaccgattcagtggcagcgggtctgggacagatttcactctcaccatcagcagcctgcaggctgaagatgtggcagtttattatgtcaactaatattattatacttcgtggacgtttcggccaagggaccaaggtggaatatcagacgaactgtggctgacc

SEQ ID NO: 278801 - DNA, 550 bp, Homo sapiens
  misc_feature: GYAE6OF02HD24M.19.71.G05.1.454.CMB.1.raw
  modified_base (237)..(237): a, c, t, g, unknown or other
  misc_feature (237)..(237): n is a, c, g, or t
tcagtactctcgtgcacgaccggtgctcgatttagtgtcgtcgcaagagagagggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttanacagttccaacaatgaaaactacttagcttggtaccagcagagaccaggacagcctcctaggctgctcatttactgggcatctacccgggaatccggggtccctgaccgattcagtggcagcgggtctgggacagatttcgactctcaccatcagcagcctgcaggctgaagatgtgcagtttattattgtacaacaattattaatttataactttcgtagggtacgttcggaccgtaagggtaccctaaagggttcgggaattaacgtacgacggtaaccgtaaacgttggtacgggtcgttacggtacccg

SEQ ID NO: 278802 - DNA, 532 bp, Homo sapiens
  misc_feature: GYAE6OF02IR74X.19.71.G05.1.454.CMB.1.raw
  modified_base (237)..(237): a, c, t, g, unknown or other
  misc_feature (237)..(237): n is a, c, g, or t
  modified_base (314)..(314): a, c, t, g, unknown or other
  misc_feature (314)..(314): n is a, c, g, or t
tcagtactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccacatcaactgcaagtccagccacaatcttttanacagttccaacaatagaaaactacttaagcttggtaccagcagagaccaggacagcctcctaggctgctcatttacnggcatcgtacccgggaatccggggtccctgaccgattcagtgcagcgggtctgggacagatttcactctcaccatcagcagcctgccaggctagaagtatgtgctagtttatattgtacaaactaattattaattatacgttgtcggtacgttcggaccgtaacgggtcctaaagggtggaatagtacgaaggtaaccgtacgtggtcgacgttgacc
